United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 21

SEQ ID NO: 84774 - DNA, 477 bp, Glycine max
  Peptide Sequence Number=SeqID_201552
atgacaagggagctgaaagaggaatgccgagcttcaattctgagttacccaattccaattcatggaaaccatatagaaactgcactcacagatgcaggagttgctcaagttaatgtaaaagcctccaacttcagttggcgggcctgtactgtggtcaagagcgggatgatcccgctttgcgcttccgtctctgtctattgtcggccatcgtccccaacgccactggctgttgccggcaatcattgtcggcaccgccgtcctcccccacacctatttccgatgatacctagatttgggtcgtctatttcagcatgtcccaaacccgaaggttttgaagttagaaacctcaacacgtgcactcacgtgccacttctccacgcatgcatcccatgcgctcgtctccaatcaccggaacttcgacacaacacttgggttttggtcgccggcccctcttgctatttttcagccctcagatag

SEQ ID NO: 84775 - DNA, 1504 bp, Glycine max
  misc_feature (1489)..(1489): n is a, c, g, or t
  Peptide Sequence Number=SeqID_201553
atggacacaaaagagaaattaaaggaggtggagaggtgtttggatcctcagctatggcatgcgtgtgcaggtggtatggtacaaatgccaacagtgaacactaaggtctattacttccctcaaggtcatgctgagcatgcatgtggaccagttaacttcaagacttgtcctaaggttccaccttttgttccatgtagagtggttgctgtcaaatacatggctgatcctgagacagatgaggtctatgccaaactcaagctcgttcctctgaatgccaatgatgttgattatgaccatgatgttattggggctgaaactcgagacaagccagcttcatttgcaaaaaccttgacccaatctgatgctaacaatggtgggggattttctgttcctaggtattgtgctgagacaattttccctcgtttggactactcagctgaccctcccgttcaaaacatccttgccaaggatgttcatggggaaacatggaaattcagacacatctataggggcacgccaaggcgacatttgttgaccactgggtggagtacttttgtgaatcacaagaagcttgttgctggggactcaattgtgtttttgagggcagaaaatggggatttgtgtgttggtattcggcgagcaaagaaggggattggcggtggacttgagacttcctcagggtggaatcctgcaggaggaaattttcctatgccttatagtggattttctccctttttgagggaggatgataatagaatcttgagaaatggcaatagcaatggattgaaccctagtgtaagtatgatgggaaagggaaaagtgaggccagaagcaattattgaagctgcaaatcttgcagccaataagaaaccctttgaggttgtttactaccctcgggcaagtactcccgagttttgtgtgaaggcctcactagttgaagcagcaatgcagactaggtggtattctggaataaggttcaagatggcctttgaaacggaagactcctcgcgaataagttggtttatgggaactatatcttcggttcaggttgctgatcccctaaactggcctaactcaccttggaggcttctccaggttacatgggatgaaccagatttacttcaaaatgtgagaagggtgagcccgtggctggttgaattggtgtcaaacatgcctgccattcatttttcccctttctcaccaccacggaagaaattgagattgcctcagcacccagatttcccccttgatggccagattcctttgccgacacttcccaacaaccttctaggtcccaacaacaccaaccaatttggttgtctactcgaaagtactcctgctggcatgcagggagccaggcatgctcattatggtctatccttatcggatctccacctcagtaaattgcaatcaggtctatcttcggctggtttcccgcctcttgatcacgctgctacgccaatgaaggtctcaaataacaagacattgncaaagcctagcatca

SEQ ID NO: 84776 - DNA, 423 bp, Glycine max
  Peptide Sequence Number=SeqID_201554
atgaatgaagaacaaaagatgtataagcttgccaaatatatggaaaggaaatcaagagatttgaatgaaggaacatacccagtttacaattcactaaaggtaaatagccaaacaatttctccgggttctgttcacattagtagccttggtcagttgccaatttcactcgaaaaaagcccattgacaaatcaaacagagccaccgcataggttgcgattacagaaggttcaatcatcaaatcctggcacaatattagttggtaatacagataactgggaggagtctaccatggctgatgccagtcccaggactgatatttctacagatggtgacactgatgacaagaatcatccggtgatgtttctttaccttttatgctgttttctcccttcttgttcaattgatgctatctcaagtccctaa

SEQ ID NO: 84777 - DNA, 648 bp, Glycine max
  Peptide Sequence Number=SeqID_201555
atggcgaacgcggcgcttcggaacgtgaaggtgctcccgaactcggcgaatatggaggaagcgcgtcaccgagtcttcgaattcttcagaacggcctgcagatcgctaccttccgttatggaaatctacaacctctacgacgtcgtttccgtctccgaactccgctcctccgtcgcctcccagatccgcaacaacatccacgtcaccgatcccaaactgaccttacctggtgggataaggttatttattgttgttgtatgtgaatggatatctggttatttactatcaatgctatcaatggtggattctggaatatggcagaaagcccaagttctgccatataaacatgctattgcggcctatgacactgcgatagtgggccacttcctccatattggaatacaccaatatggcggtggaagttatagttttgaatttatccatgtcatgatggaaacatgtgaaaaggtgatcgatatgctgcttttcaaggggatggaagagctgaagaatgttgtggaccattcaaagcagaggcatcatattattggtcagtacgtagttggtcggcaagtgcaggattcagccacaaaagacccggacacctctacttttctgaagaatttctacaacaccaattacttctga

SEQ ID NO: 84778 - DNA, 339 bp, Glycine max
  Peptide Sequence Number=SeqID_201556
atggcccaccaagagaaccaagttacagggaaaatatctgaagatcttgatgatgaaaaaaggttatacgaatgtgtaaggaagtatgaaatcatagtcaaacagtttgacgagctgatggcaataatgagcaatggcaatgcagtagcaaagacaaagtggagaaaggtagggtccccgaatgctgctattaaggaaggaatgcaaggtcgaagagggaatgcttctggtggaagagcagctgcttcctcaatccagacaaacaacaatgaaatagtagtgcagacagtgaccaggtttttgcatgaactgagaaacaaccctacagattctgagtga

SEQ ID NO: 84779 - DNA, 546 bp, Glycine max
  Peptide Sequence Number=SeqID_201557
atgttggttgttgggttgggatcccaacaacgttatactgaagagaagagtgaggaacagacatcacatgacagaggaattatgggagcaaggagaagaaggtcgatcttggccactctcgcttttctaatgttaatgggcatcgccctctatttcagactctgggctattcactacaacctttcttccgacgacacccaactcttaaggctacagtttgatattgccaacagagaggcaatggatgagtctgcagagtggaggctgaggtatgatgaggaggtagataggacaaataagtgtttacagcagcttcaactgtttcgggagtcctctcagaagggggaagatgcttctggtattaaccatgaattgacaattctgcaaaaggtatgcataatttgtttgtttttcacgacgttattcaagtgttataatgaccttctaacataccaggagaatgcagtcttacttgaaaggttggaaacactgaaaagagagcttgaagaggaaaggttgaagtgcagttcacgatacatgaactaa

SEQ ID NO: 84780 - DNA, 216 bp, Glycine max
  Peptide Sequence Number=SeqID_201558
atggctatcaggaagtgccttgaagcaactggccatgtttgctgtggatgcgcactgcagcaatcatgcaagtttgggaatcaaagtgtatggaaatgtaaagatgccaataatttggattctgtgactgtgatgaaggttattactccatatgctttagagtcagtgaacccccaactggtagtgcctgatgaagtaaagaagtcagtaaattaa

SEQ ID NO: 84781 - DNA, 156 bp, Glycine max
  Peptide Sequence Number=SeqID_201559
atggccttcgtcattttcatacaggcactttatccaaagaaaacgttgtcactcatgagaaattctgcattaaggagaggcttgtgtagagagaaagagaatctccaacaatggtctgcaaggcctgattatgttcacaaattttccctcttgtga

SEQ ID NO: 84782 - DNA, 837 bp, Glycine max
  Peptide Sequence Number=SeqID_201560
atgagcaagattttgattatcgacggcggcaagacctttgcccattccaaaggcgaactgaaccataccctgaccgaagtggcggccagccagctgcgcgatctgggccatgaggttcaggtgaccgttgccgatagcgactacaacgtggcggacgaagtacagaaatacctcgacagcgacgtggtgatttatcagatgccgggctggtggatgggcgagccgtggacggtgaaaaagtacatcgatgaggtgtttactctgggccacggcgcgctgtacgccagcgatggccgttcgcgcagcgatgccagcaaaaagtacggttccggcggcctgattcagggcaaaaaatacatgctgtcgctgacctggaacgccccgctggaagcctttaccgatcccgaccagttctttgaaggcgtcggcgtggacggcctgtacctgcacttccataaagccaatcagttcctcggtatggaaagtctgccgacctttatctgtaacgacgtgattaaacagccggacgtgccgcgtgatatcgcacaaatttgcgttaagccgggccgccgtcaggaggtgctggaggcgattaataaactgatccctgtcgtgctggaagaagagggttgccatcagtacgatgcgctggtcgatcaccaggcgcaggtgccgtggaagcagaactcgccagactcgatctttatgcttgagcagtgggaatcgctgcgccatctggagcagcatcagcagatgccgcacatggatgcacaccgcgccaccatcaaagatgacgtggtggacgtgaaaattctggtgctggaaccgaccgcctga

SEQ ID NO: 84783 - DNA, 1391 bp, Glycine max
  Peptide Sequence Number=SeqID_201561
agctggcggaaggttcacacgatattgaactgatcgctaaagatccatccaccggcaaagagtcaccgacctcagatccaattaacgtgattatcgatattacgcctccggatcagccgcaaccaccaacgattgtcgataacgaaggtgacaacaccggtccggttgaaccaggtaagccaattgatgacaaccgtccaggtttcggcggcgaaggcggtacccctggcgacaaagtggaagtcatcattgatgacggtaaaggtaatccggtggtgattggtaccggtatcgtgggcgaagacggcaagtgggaagtgaaacctgagaacccaatcgatgacggtaactatcaggttatcatcgagatcaccgatccggccggtaacgaatcgcagccatccgatcctatcgatctgatcatcgacaccaaaaaaccaggctcaatggaaggttcgtacatactggaggataacgtcggtcctatccagggtgagatcgaaaatggcacggtcaccgatgacaaacagccaacgctgaagggcacgtcaccggatctgtcgcaggtcatcatctacatcgacgatcgggaacctgtcgtggttgatgttaaggatggcaagtggagctatgagctgccagaactgggcgagggcaaccataaagttgaagtacagccagtgagccagtccggtgtgaaaggcgataaagaggcggcgattaactttgacgttgataccactaagccggagccagtagaaggcggcgacaaggctaacttcgaaggcgtcttcgcggataaaaccggcactgaaatcccagtgcggccggacaccaacgatgacacgctgatcttcagaggtaagggctcagaagacggtactatcgtgatgatttggggcgacgaagcgcgtacccagctgatcggttctaccgtggtagaaaacggcgtgtggcgctatgagtcagacaaactggcagaaggagattatgcctttaacgtcacggttcgcgatgcagccggaaacgaactggtcatcgaccataccgttaagaccaacgtcgacgtcaccccgccgccgccgccagaaatcaactcgatcttcgctgcgggtgctacggatgttgaagggctgatgagcatgtcgctgaacgacatcatgacgcagggtcaggattcactgtttatcgacaacggcaagtcacagctggtagtgaacgctaaacagggcgaggcgctgacgctggaagacatcctgccagccggtgaagatgccagctcctggcagcaggcgacaggtaccgtcaccgtcggcggcaccgagtacaacgtctacagcaacggtgatgcggaactgctggtgcagaacctgcacaacgaacagcactga

SEQ ID NO: 84784 - DNA, 959 bp, Glycine max
  Peptide Sequence Number=SeqID_201562
atgttgatttcaatgaaagagatgctggccccgacccgtgaacatcgcttcgccatcggcgcatttaacgtcgctgacagctgctttatccgtgccgtggtggaagaagccgaagccaccaacacgcccgccattatttctatccatccgagcgaactggaatttgtcaccgatgaattttttggctacgtgcgcgaacgcaccctgaaaagccgcgtgccgtttactattcacctcgatcacggcgcttcaattgcgcaggtgctgcgcgctattcagtgcggctttacctcggtgatgattgacggctcgctgctgccgtacgaagagaacgtggcgctgaccaaagaggtggtgaagctggcgcacgcggtgggcgtgtcggtggaaggcgagctcggcaccatcggcgataccggcaccacggtggaaggcggcgtgagcaaggtgatctacaccgaaccggcgcaggcggaagattttgtgcagcgcaccggcgtcgatacgctggcggtggcgattggcaccgcgcacggtatctatcccaaagatatgaaacccgagctgcagatgcacattctgaaggatatctcccagcgcgtagacattccgctggtgctgcacggcggttcggccaatccggacgcggagatcgccgaggcggtgacgctaggcgtaggcaagatcaatatctccagcgacatgaagtttgcctatttcgcccgactgcgcgagatcctcgcgcgggagagctggtgggatccgaatgtgatttatccggacgccatcgccgccgcgaaagcggtgattcgctacaagatgaatctgtttggcgggctgggtaaagccgggatgtcagttgcacatgccgtagcggcgcgatttatcgctaacgattacttcaccacccccagccactgtctggcgatctgcgcatattcgccggtggcagtgctgag

SEQ ID NO: 84785 - DNA, 840 bp, Glycine max
  Peptide Sequence Number=SeqID_201563
atgaatgacctgattcaggccgccttccagcacaagtacgcggtgctggcgatcaactgcttcaacctcgaaaccgcccgtgcggcgattcaggcggctgaacagcagcgcgcaccgctgatcctcaatgtgtatcagggacacagcgcgcattttccgccgacggtggcggcaccgctggtacaggcgctggcggctcaggctgcggtgccggtggcactggcgctcgaccacggcaaagcttttccgctgattggtcaggcgtttcgcgccggctttaccggtctgatgattgacgcatcggccgagccgctggcggacaatattcgtcagaccgcagcggtagtgaagatggcgcataccgctggcgtgtgcgttgaaggcgagctggggcatatcgccgatgcgcccacgtatgaactggccgatgccgccgtgaagatgacgcgggtagaagacgtgctgccgtttattgagcagaccggcatcgatctgctggcgatttcggtcggtaccgcgcacgggctttatccgccgggcgtaaagccgaagatcgactttgaacggctgcagcagctgcacgcggtgacgacgcggccgctggcgctgcacggcggctcgggcaccccggcggaggatatacgccgcgtcagcgcctgtggcgtcgccaagatcaacgtcggcgctgcggtgttcgacgccggtaagcacgcggtgcagcaggcgctgcgccagcatccgcaggccgagctggccgatgtgctggcgctgatggagtccgcctgtcgcgaagtggttattgaatatctgagctggtcagggtcggcaaaccgctactga

SEQ ID NO: 84786 - DNA, 3057 bp, Glycine max
  Peptide Sequence Number=SeqID_201564
gcgatcctcgcctccgatcgcaaaatgagtaacctgctgaagaaagaactgctggccgatagccagacctacggcgacgatcgccgctcgccgctgcatgaacgtgaagaagcgaaagcgctgagcgagaacgagctggtgagcgctgagccggtcaccattgtgctgtcgcagatgggctgggtgcgcagcgccaaaggtcacgatatcgatccggcaggattaagctacaaagccggcgacagctaccgtgccgccgcgcgcggcaagagcaaccagccggtggcgtttattgactccaccggccgcagctatacgctggatccgacctcgctgccgtcggcgcgcgggcagggcgagccgctcaccggcaagctgacgccaccgccgggcgcggtgattgagcaggtgctgatggaagcggatgatcagaagctgctgatggcctccgatgccggctacggcttcatctgtacctttgccgatctggtgtcgcgcaaccgcgccggtaaagcgctgctgacactgccggaaaacgccaaagtgatgtcgccgctggcggtgcactctggcgacgacatgctgctggccatcacccaggcggggcggatgctgatgttcccggtggccgatctgccgcagatgtcgaaaggcaagggcaacaagattatctcgattccgtccgcggacgccgccgcgggcgtggacaagctgcagtggctgctgattctgccgccgggcagttccatcactatctatgtcggcaagcgtaagctgatcatgcgtgatgaagatctgcagaaagtgcgtgctgagcgcggccgtcgcggtagcgtatcgcgcggactgcagcggatcgatagcgtggaagtgaatgcgccagcgcggccaaaaagtgacgcgaatagcgaagacatctggtgtctgttttcaccgcgtaatccgcgccacgtggcgacctttggtcacatgtttggtcgtctgtcgacggtgtttggcgtcaaagtcgaactgcgtaaaccggcggatgccgaaagctacggtaacgcgatttacatcgctaaccatcagaacaactacgacatgattaccgccgccaatatcgtgcagccgaccacggtcacggtgggcaagaaaagcctgctgtggatcccgttcttcggccagctttactggctgaccggtaacctgctgattgaccgcgataaccgcgccaaagcgcacggcaccatcggcgagctggtggcgcagtttaaaaagaagaaaatttccttctggatgttcccggaagggacgcgcagccgcggacgcggtctgctgccgttcaagaccggcgcgttccatgcggcggtggcggcgggcgtgccgatcatcccggtggtggtctctaacacccacggcaaaatcaaactgaatcgctgggacaatggcttagtgatcgtagaaatgctgccgccagtggataccacgcagtttgaaaccacgtcggtacgcaaactggcgacccactgccgtgaattaatgtctgctaagctggaagagttgaacgctgaagtcgccgaacgcgaaaaaaacggcgcaccgggccccgccatttgtaggatgcgcattcatgcgcaccgggccccgccgcttgcagggtgcgcattcatgcgcaccgggtcccggatgcgcatcgacctgacccggacacacagccgcgcctttcgggcgcttcacaacacgattaaaaataacaacatggacacggcgtcttcacgccacgctcaaaagctttctgccggtatggcgctggcttccagcgttatgccttacgccgcccgcgccgccgcgccattgggcgatgtgcctttgccggtgccgccgctgatcgaatcacgccgcggtcagccgctgttccttacgctgcagcgcagccactggtccttcaacggcaacagcaacaaagtgccggtatggggcattaacggcctgtaccttggcccgacggtgcgcgtttacagcggcgacgatgtcaaactgatttacagcaaccgcctcaatgaaccggtggcgatgaccgtcagcggtttgcaggtgccgggcgcgttgatgggcggtgcgccgcgcatgatgtccgccggcgtagactgggcgccggtgctgccgattcgtcagggcgcagccacgctgtggtatcacgccaacacgccaaatcgcatggcgccgcacgtctataacggcctggcggggatgtggctgatcgaagatgacatcagcaaagcgctgccgctgccgaagcattacggcgtcgatgatttcccgctgattattcaggacaagcgcctcgataactttgccacgccggtttataacccaccgtcggacggcgggttcctcggcgatacgctgctggttaacggcgtgcaaaacccgtatgtcgaagtgtcgcgcggctgggtacgtttgcgcctgctgaatgcggccaatgcgcgccgtttcgatctcagctttagcgacaaccggccgtttacggtgatcgccagcgatcagggcttcctgcccgcgccggtagcggtgcagacgctgtcgctcgcaccgggcgaacgccgcgaagtgctggtggacatgtcgcagggcgatgaagtgtcgatcaccgcaggcacggcggcaggcattatggatcgtctgcgcgggctgtttgagccgtcatcgatcctgaccaatacgctggtgctgacgctgcgtccaaccggcctgctgccgctggtgaccgacaacctgccgatgcgcctgctggcggatcagattcttgatggcgtggcggtgcgcacgcgtgaattccgcctcggcgacggtacgccggggattaacggtgtgctgtgggacatgaatcgcatcgatacgacggtgcagcagggcacctttgagcgctggatcattcacgccgaccgtccgcagtcgctgcatattcagggcgtgatgttcctgattaagagcgtcaacggcgcgcagtcgatgggagaagatcgcggctggaaagatacggtctgggtggatggtgatgtcgaactgctg

SEQ ID NO: 84787 - DNA, 2334 bp, Glycine max
  Peptide Sequence Number=SeqID_201565
atggaactgttcaattatgaagaggtgaaatacctcgagcgcgataccaacacccccacgttttttggctatgcaaattcagaaatcggtaagggcggcaccatgctgattaccgtcggcaaagagaccttttcggtagatatcgaccctgccaatggctactggagctggacacctgcaacgccgctggaggatggttactacaacatgtcttttcagtcggttgataaggctggcaacgtcagtacacccagtctgcgtacgctgattgttgataccacaccgccagcagcgccgacgctgctgaacatgtacgacgatcagggtgacatcaccggcagttttgattctggcaaaatgaccgacgaccgccgccccaccctgaccggtatcgcggaaaaaggcgtgattgtttatctgaaagaaggcaatacggttatcggcagcgcgaaggcggatgaaaataccgggatatggaagatcgagccggagattgacctcaccgacggtcagcatgatttgacgctggtagcgagtgaaaccttcgccggtaaggtgcgtgagggtgaggtttcggatgagttcatcattattattggtaaagacggcgaagtgccggttgatccaggcggcgtggcgaaaattattgatgccgtcgacaacgtcggcagtgtgaccggctcattgaagagcgatggcatcaccgacgataccacgccagagctgcgtggcagcgcgccagcaggcagtgtggtacgtattcagtaccgtaatgctcagggtgaatgggttgatggcggcaatgcggtgatgaagggcaccagctggagctggacgccgaatccagcgctaggcgaaggaaactggcaattcagggcaaatgctggcgacgaatggagcaacgaattcaaactcaatattgatttgacgcctgcaagcgagaccacgattgcttacgcctgggataattatggtcatgccactggcatgttaggtaattccgcccggacagatgaccgtacccccacgttacacggacgcgccgaagcaaacagtattgtttatattgaatacggtaaagctggagcaccatggattccaggttattcagttcaggttggtgctgatggtaactgggagttcacaatacctatcgaattagataatggtaactgggagttccgggcaaaaagtggtaatagtggcgcattcacacccaagttcaaactcaatgtgattgataataaccttgctccaaccattgattttgctttagataacgtgggtaaaacacagggaaaattaacatctggtagtgtaactgacgatacaactcccgagctacaaggccatgccgaagccaacagcactgtctatatagaatattacgctggaaataacagtaaagtcatcgcctcagttactgctaatatatatggagagtggacattttccccaccaaaacttaactacgggaactggactttcaatgcttatacaaacgacaaagcgcagagctcttttgaaataaaagtcagagagactgatcttatcagccatcgtgaagattttagtaacggaacctatataattcagcaaggcacttcagttaccctggcctctggcatcaaagtatacaatcagtatggaaatgcttcccaaaggaatgaatttttagtcggaccagacttaggcactgggaacccttcaaattctaaacaaacagcagtacatttttatattgataaatctaactactttaagtttgacgcccaggctcaacaagccactcataatatgatacggttttataatgagaaggatgagcttatcggctccatcgaaatctcaaaatggggcggaatgaaaccctacgagttcattgccccacaaggtcagttaataagcaaagtatcggcgttcaatagtttttatgatgacggtacaggcaattcacgctacgacactatttttttagacaatttcgaatggggtataaaagataatgttgtcaaatccactgatatatcagtgaatgaaatttccacattagacgccgatgcgtttagtgctctagaaaatataactgccgaagaagtgttctctaaaggaactaaggatttcttcattgatgacggcaaaacccagctgatgatcaacggtaaccagggcgataccatgcgtctggaagatatcctgcctgaaggcagcgagcaggaaggctggacgcagcaaaccggcaccgtgaccatcgctggcaaccagtaccatgtgttcagccacggcgacgccgaactgctggtgcaggacggcgtaacggtgaatctggtttaa

SEQ ID NO: 84788 - DNA, 1230 bp, Glycine max
  Peptide Sequence Number=SeqID_201566
gatggcattggcgactgcggccgcaccgcacggatagagcacgcagccggcgccgccttccagttcggtcatcgcatcctggaaggaaaaatgggtgagggtgccgcgccggccataaaacagttcaccgctggcgcgtccggcggtggcgcgttgtttgtccgcgacggagtcaaaaaccaagtgacgccagcacaatcgcggaaagaggctggatgtggcttttgttacgcggcggaaaagcaaagcgcaataaattgcgccgctacgacccgtgcggggtgttcgtccgcgcctgttgctcaattccgcaaagcgcaccaaaccgtagcggcgcgattcatcgcgcaatcgtgcctgctgctccatcccagagaccgtagcggcgcgatttatcgcgcaactgtgcctgctgctcaattccacaaaccgcacccaaccgtagcggcgcgatttatcgcgcaaccaagtcggagacgcagcgtggtagccagtgacttgatgcaaacggacctctccgtttggggcatgtatcagcatgccgatatcgtggtaaaaattgtgatgatcggcctgttgctggcctcggtcgttacctgggcgattttctttggcaaatacgcggagctgagcggggcgaaacgtcgcctgaagcgtgaacagctggcgctgggcgaagcgcgctcactgaatgacgcgtatcgcgctgccgaaaacttcaaagccaacagccacagcgccgtgctgctcgccgacacgcgtaacgaagtggaactctccgccggcagcgaagacctcgacggcatcaaagagcgcaccagcttccgccttgagcgtcgcgtcgcgggcttcagccgccacgccggtcgcggtaacggcttcctcgccaccatcggttccgtcgccccgtttatcggtctgttcggcaccgtctggggcatcatgaacagctttattggtatcgcgaaaacccagaccaccaacctcgcggtggtggcaccgggcatcgcggaagcgctgctggcgacggcgattggcctggtggcagcaattccggcggtggtgatctataacgttttcgcccgcatgattgccagctacaaagcttcgctcggcgacgtggcggcgcaggtgctgctgctgcagagccgcgatctggaccttggcaacgtcgataccgcaaaagaagttaaccgtccggcggcggcccagaaactgcgcgtaggataa

SEQ ID NO: 84789 - DNA, 1422 bp, Glycine max
  Peptide Sequence Number=SeqID_201567
gaaaccttcgccggtaaggtgcgtgagggcaaagtatccgatgagtttaacattactatcggaaaagacggcgacgtgccgagcgatccgggcggcgtggccaaaatcattgaggcgatcgacaatgccggcagcctgaccggctcactgaaaagcggcggcatcaccgacgacactacgccagagctgcgcggcagtgcgccggaaggcagcgtggtgcgtattcagtaccgtaacgataaaggtgaatggatcgacggcggcaatgcggtgatgaacggcaccagctggagctggacgccaaacccggcgctgggtgccggtaactgggagttccgcgccaacgccggcagcggctggaccgacgaattcaagctggatatcgatctcgcaccggcagcaaaaacggaaatcacccacgcttacgatgactttggcccgttcaccggcacgctgggcaacggcgcgattaccgatgaccgcacgccaaacctgcacggccgcgccgaatctaacagcctggtgtatatccactatcgcaacgtgctgggcacatgggaactgctggacagcgtgactgccggtgccgatggccgctgggagtatgagactgaccgtctttctccggggacgtatgagtttcaggccgggagaacggcaacccgtgatgcgaacggtaaaccgtttgggctgcagattgtggcgccgggcagcgtcgcaccagagatcgctatggcctgggatgacgtgggcaaaatcaccggtgaggtgaaatcgggcgggctgaccaatgatactcagccggagctgcgcggcagtgccgaggcgaatgcggttgtacaggtcgagtactcacgcgacggcaaaacctggcatagcgggtcaacggtcgcggatgcgaatggccgctggtcgtttacgccaaaagacgagctggaatatggtaactgggatttcagagcaaaaaccactaatggcaatagctacagtgcagattatgcgctgcgagttgttgaacatgaagaaatggttaaatcttatgattttgaatcaataatcccaggagacatgactaaagattttatttatggcgatctcaactttaaattcaacaatcaggaaaagagattggcccgcgtatacgctaccgaatacacgggagatggagcccgtgaagtgctacgcttcttctccagtgagattgaaataagttatgttgagcttcatttacaaagcgcaagaaatgtttttgggattgacaacatcataacaaaacgttacgcgaatgatgatatcacacatggtaaccatggctttgaagctttcaatagctatgaagcagcatataaattccctctgggaaaagcagataatctcggcagtggtttgattttcaaacccgtgaaaggcactgaagcagag

SEQ ID NO: 84790 - DNA, 1215 bp, Glycine max
  Peptide Sequence Number=SeqID_201568
atgaaaacacgcctctctctgtgcgctgccgcgctgctgctcaccagctttgtgtctcacgcccagccggaatacgatcagtacgcgcgcggcagctatatcgccacgctggcggactgcaccgcctgccacaccgccgatccgcagcagccgtttgccgggggcgtcaggttgcagacgccgtttggtacgctggtcggcgctaatatcacgccggatcgcgaaaccggcatcggcaactggcgctatgaagatttccgccgcgccatgaccgagggcatcggccacggcggcaagcggctgtacggcgcgatgccgttcaccgcgtacaccaaaatgtcggataaggatctgcaggatttgtgggcatggatgcagacgctgcagccgatacaccacccggtcgagaccaatcagctgccctttcctttcaatatccgcaccagcctgatggtttggaactggatcaactttgaccgtggcgcgttccagccggacgccagtcaatccgctgagtggaatcgcggtgcgtatctggtgcagggcgcgggccactgcggcacctgccacacgccaaaaaatctgctcggcggcgataaaaacggcgcgttcctgcgtggtgaagtggtcgaaggctggatggcgccggacatcaccgcgaacccgcacagcgggctgggcaagtggagccagcaggatatcgtcagctacctgcgtaccggcgtgaaccgtttcgatatcgcttccggtccaatggccgacgcggtgcgtcactccacgcagcactggcgcgatgaagatctgcaggcggtggcggtgtacctgaaaagcggtgaatcacgtgatgagcaagtgcccgctgcacttgccgcgacggacgatcgcatgaagctgggcgcgcaaatctatgcggcgaagtgttcagcctgccacagcccgggcggccgcggtgagaagaatatcttcccgcagctggcggacaatccgttgctcaatcaggaggatgccacctcgctgattcgggtggtcgccgccggcagtcgcggtgtcgataccgatgcccgccccacggcaccggcaatgccggcctttgccggcacgctgggtgatgaggagatcgccgcagtggtgagctacatccgcaacagctggggaaatgccgccgcaccggtcagcgctgacgacgtgaagaaagtgaaacagaagctggaatag

SEQ ID NO: 84791 - DNA, 246 bp, Glycine max
  Peptide Sequence Number=SeqID_201569
atggcaacaacaagttattcactcaacgaagcctcctttgatttgggtatcgacaacgactcacaagatttatcacttcacatggttgaagaattagtcgatttatcacttcacattgttgaagaatcattccataaggatgaagagaccgacacaggtgtggtggtgtcaagccatgatgatgaggtcaaagcaaagataattgagttatcaaatggaaatgaagatgaaaaaaaactcaattaa

SEQ ID NO: 84792 - DNA, 399 bp, Glycine max
  Peptide Sequence Number=SeqID_201570
atgattggcaccaatgccctcacgggtggcgaaaacagagacaaaccacatagtaaagttgcggttcagctgcttgatcgtgacgtcgctttggtcgaggaagctgcggtagacggagccgaagcctccctcgccgacgaggagggcacggctgaaggtgcacgtggcagatttcaggtcggagaaggagaaaagacggagattgttggcgcggcgctgcgccaggaaatggtgcaagtccaccgtgtcagagaactccgtcgactcggagtcgaagtgggagcgactgttgttactgtgcgtgtccatcaggctcaacgaacgagcccacgacacgtgcaaggtggagccaccgctcctccccccacggaatcctcgttttctccgtttgagaaatag

SEQ ID NO: 84793 - DNA, 240 bp, Glycine max
  Peptide Sequence Number=SeqID_201571
atggctattgcttctgatagcttcatgcacatgccaatgctgcgaacgtccaattacaattctttcccacagaaacctatgacaatgaccattaataaaacagaacaagcagggacaagagggattgctgtcttacaagctaaaagtagtgacaaccaagggaaagggaagggtactcaaacaaatcgcgtaggcaatgaagaagtgaagaaaagcatggaaattaaggaatattggtga

SEQ ID NO: 84794 - DNA, 462 bp, Glycine max
  Peptide Sequence Number=SeqID_201572
atgacagaccttgggtttgatgagcctttggagaagggagactcaccaagagcgaaccttgggtttgataagcctttggagaaggttgttatgaccctgaatgagccttcccagttgggtccaagctttcctgctcgaggatcttttctggcttcacttcgaactcgccacgctaggtcactaggtttaaaggctcgaaacaagaacctccttgtcaacggttccccgacatcaacggggatcatggcgtatgtgtcatattcgataacgactagtaagaactttactattcctggggcttttggtagtggtcccagtatgtccattccctacatggagaaaagccaaggggaactcaagctatggagattgttgggaggagtgcgcggaatgtatacaaacacctggcatcgtctgcacctcctagtgaagtcaaggttgtcggccttgagtgttggctaa

SEQ ID NO: 84795 - DNA, 1668 bp, Glycine max
  Peptide Sequence Number=SeqID_201573
atgacaagtaggagggttgcgagtttgttaagccccccaagcttggacaggtgttgcccgatattgagggtggtaacctcgacaggtgcaagagctgcagtggaccgggaggtcattccaatcggcagttcctccttggaggagacacgccatatagcttctgatagcgagtcctctttttcagagaggttagtggtctcgggccgtgctaccaggggtacttcttgccttcataggggagggggggcgcaaccttttgttgcctctctagatggggaacccaatccagtcaccataatcctcccccgcgtgcgacatagccatagtgttaggtcaccttcgtcccctcttgtcgtcattggctacgagtgggtaagggatgatgttttcaaatatcacttttccattacatttgtcacgagtgtcgcagctctagaacgtcaactagggtttggttctccccctgaactctttcaatgtgctccgcttgagcatctgaatgtagccctttctcagcttgatgccaatagttgggctatgatgagggcctttgaggtcttctaccctttttcaacattcggcctatcgtgttggtatttttttttccaaatgaaattgataggaaaaataggctgggtatccctaaatagcgtgtccaagaagctattcgagtttgactcgaacgtgtttcgtcacttcaaggaccatttcttcaaggttcaagctactgacaccgtggttgataggttggcaccaatgttcaatcgtgacggggaaccctgtttctcgttctactggcagtcacacgctactaggttcaagtcttttgacgaggatttgttgaccttagtagaaagggttgacaaggctatcttggagcaacttccagcctcactagatgatcgggccatcttgtcgcttccctcagcaaatgatcctctcattgccttggatggtaaactcagacctgctagtggagttgtgccactatctactgtcgatcctcctgttggaggaaggggtcaacctactgctagggttggccccaatgatgacaaagtttttgaggtctcccccaacgcgtcttcctctgtttttgctaaaagggtctaccctcggcctcattggccgtccaagctattgttcttcttctactcctccttttgcgcttgtttaggaggtttttgtttcccctcccgttgtagttacgacgccagttctttggccccccttatcatggctcctccatccaccattgttacgcccttgttgagcattggtgtgacgatcatgagtgctcaaaaaatgtggcctccttcttttgtagctccaccagttccccctctctccccagttgttttgacaccagcgtcaccttcttcatcctcttctcgtccaatgtctcccttgatcacgtctacacttctcgtgatagaagctctgagcaaggtggcgtccttagaggttgaggtcgcccagtggatggccattgttcgaactgtttggagagtggagtgtcctaagaaagaaagaaatgacttagcagttaaggttgagagcactattgctaagaaggacaagctcgccaaggtggttttcgacctcgaggctcaattgaaggaggcgaagtctaggctggaggattttgagctaagggcatcaaagtag

SEQ ID NO: 84796 - DNA, 1452 bp, Glycine max
  Peptide Sequence Number=SeqID_201574
atggcgcagacccaaaccctatccttcattcacgagatcgaatctctcgtctccgataaacttcaagtggtttcgtacaaatggctgagtcgcaattatatggtatcgtccgatgaagcaaagaggttgcttcaggagtttgtgcaaaaacatgagggtgggttggaggtggtgtatgctttgtctggctggttaaagagcaaccatcctagttaccacgtaaggcttgttaccgggccaaagcttgcagaagcacaacaagaatttgatggtgattgctccgttcagatatatagtgtgcaagctagcattcccaaggatccagctgttctttggaatgctgagttcattcaagcagaggagctcttcaagcaaccttcctcggttgacaattgtttgagggataataggttctgtgggatctctaattcttttgtgcagcggaatgtggatggcccaacagtagtttttgcagctcctcaatcaaaatctgtaggtgagggaccaacaaagagtgacatagttcagcaacctcctaaaaatatatcacgtgattcgattgacaaagtcgataccaaaccacagagtgtggtaaaagaagtcaagagtgaaagcaatggtatagggaatactggagttcatgataacatgaacaaacctactgcagataaagaaaaggcccctcccttacccacaggcaaaaagaaagtacaagctgataaaagtggttctgttaatggaggttcattagcaagcctttggggccgtgcatctgcaaaacccaagccttgctcctcatcagcagaaaataataacaaaatttcaaatcctcttgtatctactgaagctggacaaactgctgcttgtgaagcagaagagtgtgacagtggtaatgatgataatcaagatgtctccttgaggaggtcgtccaataggaaaagaagggttgtctttgatttctcagatgaagatgaagatgatgttgaagaaaataaatcaggggttaaggaagaaagagcaactgagcaaaaagctcaccttccactgagagaaaatgtatcagctatcagcaggtgcacaaatactgggaaatcatcttctgagaagttgcagagtggtgctcctgaagtacatttaaataaggatagtgtaaacaatgcccctccatgttcacctaagaggagaaaagtgatgaagaccaggattgatgaacgagggagagaagtaactgaagtagtctgggatggggaggagacagaagagaagaaacctgataaggttacaacaaagaagtctgacagtaacgcatctaccaaagctatcaatagtgctccagcaactaagaagccaccagccaattcaaatgccattagtggaaaaggaggaaagaaagcaggaaactcaaaggatcccaaacagggcaatattctttcatttttcaagagagtttga

SEQ ID NO: 84797 - DNA, 588 bp, Glycine max
  Peptide Sequence Number=SeqID_201575
atgctgcagcagcagcaaccatcagaaaaccagttcaaagggctagcaagcaatgagaaacacatgccaatcctggagagcagtaaagaggagcctggatggccgtcttttggacagctcatcattgatctttctaagctttcccttgaagcattagctagtgcattcattccctcacatttcagacctggcaactccaagaggggcctaaaacctctgaatgatcgtcttgtgatgcctgaagatgatgtgcggcctccattggtcaataggcaaaatgctcaaggacatactcctcttaccgaaaatcggatggcgtcacagcaagcaccgatcatcaaaacgacccgagtatgccgaattctatggtcttctgagattcctccatacaccaaatctaagagccagaaagaaaggccaagacacaggcaacgagaaaagagtggagaagttgttatgggggcagttggagctgaggccaaacctgttgagacaagggttgttgatcataataataaaaaatttgaccattaccgtatgagaactaagtatgcatctgaggagaccttccgattcaattctcagtaa

SEQ ID NO: 84798 - DNA, 207 bp, Glycine max
  Peptide Sequence Number=SeqID_201576
atgttttcctgcttgccactagagatttgggatgctcttcgagctgctgctgaggctgatctaactttagcacaagtaattgtggatagtgctggggtcattgtccagagttctgatttgacagtatgctatgatgaaagaggagcaaagtatgagctacccaagtacgttttgagcgagccaactaacctgattcgggacagttaa

SEQ ID NO: 84799 - DNA, 423 bp, Glycine max
  Peptide Sequence Number=SeqID_201577
atggaaggttcaattcctttttctgctttagatggaaggtgttttgggaaaccggaggaagaaattcctgctcccaagttaatggaaaaaggcaaagctcatttcaaagaagtgcctatatcggttgatgagtattcagaatggtgtaagtctcggagaggttttttaatggtgacagtcttggggaaggtggggttccgagtttccaaattgaagagtgggcgaagaaagggtccaacaaaatcattgatgtaccacctaatttctaccaagttctttttatgtcagatgaggattgcaataatgctatgtttgaaggggcatagatggtggcgaatcattacatcacggtacaatgttggaggccattctttatggcctatgctgaaatgttccttagttttcagttttgttggcccttag

SEQ ID NO: 84800 - DNA, 246 bp, Glycine max
  Peptide Sequence Number=SeqID_201578
atgggcatttcctcaaacatacttgcaatagcaggcaccacagttgacgtagtgccactcgaagaagtaggcgaagtagttgtcacaggacttgtcattaaggaaacaaacattctcaatgaactctctccttatttcgaatcgttcttcctcttgctgcttcagctattacacgcatttcggctaagtagcaacacaatgcactttccaagtttcaattctttaggagctgctcctagttcatga

SEQ ID NO: 84801 - DNA, 180 bp, Glycine max
  Peptide Sequence Number=SeqID_201579
atggggccgttgattaagcatctctcttcactcatcaaatggacgaggtctacctccaagacaccacactcagatgggaatgctcttcaatttgaaaatggttacgtggtggagactgttgtggaaggaaacaagattggggttgtcccttacaggatccgtgtctcaggaggacggtga

SEQ ID NO: 84802 - DNA, 321 bp, Glycine max
  Peptide Sequence Number=SeqID_201580
atgaaagtgaaacaaatcgcaggaagcaatggtgcctccttcctacaacgtgcaaccaccaatggcgcgtccttgatcactgcgtccctgacctgctaccactgcgtccctgccattgcactctgcagctacgctgcaaccctagggccttcaacgcgccagtttgactggcgccaatgcccaagtcgccgtgcatgctggcaactccaacgccacgtaggaaaaagcaaaggcgctggttggaatggtggcaccaacaccacatggcacgtcctcgccgaaagcgccaatggtggtggcgccatgcatggagatacgtga

SEQ ID NO: 84803 - DNA, 783 bp, Glycine max
  Peptide Sequence Number=SeqID_201581
atgacatcaaaaatttgtgggaaggaaactctaacttcaaagtatccaaggttgttcttattatccgaaaagaagaatggtgtgctagttgacatggggggtgggctcaagggtagtgggatgcatattcagtgcttcttcgcaatggaaatcaaaaataccatccaacgtgacagcattttcgtggagaatgcttcaggacagaatccaaacaaaagggaacttgctaaagagaagactgacactgccagacaacaattattctggccccttctgctctcaacatttggaaattgtacaacatctcttcctcagctgcactttttcgcaggaagtatgttctctgtctttcagggaaactcaattatctttaataatggcagtaaaaactacaaaaaggtgatggagttggataaactattccaagcatcatggcaagcttggaagagtattaccgctgatcaatttattgctcgagggtttttgatgcaggggataactatgtttaggaggaatggctctcgaaggaaatgcatactactacgtgtagcgtggctgaaatccgcttatggtgctgtttgtgatcaggatgacatcttcatgcaagcatggaatatcaaggaagaatgtggaaatcagtgcatggttgtgaatttctctgccctttttgtagaagtgttgatgaatccttgttacacactctttttgtttgcaaacatgcaaaggaacaaggtggcagattatctggtgtacttgttgggttctttggagttgcaggaatag

SEQ ID NO: 84804 - DNA, 570 bp, Glycine max
  Peptide Sequence Number=SeqID_201582
atgggggagaggttgcttgtctacgagtatatgcctcacgggacgctctatgatcacctccacggtggtctttctccgctgaattggagcctcaggttgaagacagcgatgcaggccgcgaaggggcttgagtaccttcacaaggaacttgttcctcccattgtgcacaaggatctcaagagttccaacattctcttggattcggagtggggggcaaggatttcagactttggacttcttgcttctagtgacaaggatctcaacggggacctagaaagtgatgtttacaattttgggattgtgttgcttgagattctgagtggaaggaaggcttatgatagggattacactccacccaacgtggttgagtgggcagtgcctttgatcaaacaagggaaaggtgctgctataattgataggtatgtggctcttccaagaaatgttgagcctttgctcaagcttgctgatatagcagagcttgctgtgagagaaaatccaagtgagcgtccacctatgtcagatatagcatcttggttggagcaaattgtgaaggacggattgttcttatag

SEQ ID NO: 84805 - DNA, 1581 bp, Glycine max
  Peptide Sequence Number=SeqID_201583
atgcaaattatctctcactcttccttctttcttcttctgttattccttttcttatgcagtaatgcaaacggtggaaagcaggacgttatttgctgggggagcaacgccacgtcaccgtcgctctcaaccgtcagcaacgccctccctgccatgtcagcactctccggcggggagggatttctctgcggcattttagcgaacacctcgcaagccttttgctggagtgctgtaaccagaccgagcgcagatctaatcctcgtgcctccggcgtaccggaacaccgcctattcccaagtcgccgccggaaagagccacgtctgcgccatccggggatcctactacgccgatcgcgattccggcaccgttgactgctgggaaatcacgaaaaccgccaacaaaacgttgacagcgaaacagagtgataagttcatcgaccaattaatatcgaatctggaggtgaagagggttgtttccggtgaaggcttcacctgcggcgaggtaaacgacggtggactaatctgctggggacccacttcggaaaatttgggaaacatttccaatgtttccgacaccttcgcggttctggcggcgggtcggagcgccgtgtgcggcgttttcaacgtttccggcgagttaaaatgctggggcgacccggtttcgttttcggaccctccgctagattcggttcggttagtctctctatccgccggggccaaccatttctgcggcgtgagaatggataaccatgaagttgaatgctggggtgatttgaattcttcggttattccaaaaggtaatggctttatggctattgcttcttcggatttcaccacgtgcgggatcagggaagatgatcttcttctggattgttggttggtcaacgcttcaaaacccgattttgatcctcctttggaactttcgagccctggactctgtagggctagtgagtgtggggttgatgagtttgctttcaatgtgagtgtgctcaatgagctagctttgacgagcgtgtgtgttagagaggatttgaggatttgttcgccttgtgggtcaaattgttccaaagggttcttcttgtctagtgaatgttctaggaatgctgatagagtttgcactgcttgttctctttgtcagaacagttcttgttttggtgtttgtggactccactcctcatcggggcagcatttgcatttgcattggcatcatttacgtaaatgggtggtgatagttgggtgtccagtgttggggtttttggttattttgctttgtgggtgtctttttatggttagaaagaggactaagaagcaatccaagtcttgcatcgggaaaccggatcaggaggaagatcatgtgaatgttgctcttaactctactctttcagttaattcgtgccccggtgcgcctcaggttttcaggctctctgagcttaaggatgctactaatgggtttaaggagtttaatgaacttgggagggggagttatgggtttgtgtataaggctgcattagctgatgggagagtggttgctgttaaaagagcgaatgctgctaccataattcacacccaacaaccgcgattttga

SEQ ID NO: 84806 - DNA, 249 bp, Glycine max
  Peptide Sequence Number=SeqID_201584
atggcgtatgaggagtcatgcatgctgtgttttgctcaccaagcgaaattaaaagctaaagagaaggaatggggaactgggttttcaatagggcttcggatctcctttcatcttatgcagctggatgctattgctatcagcatcaagtattctaattctctgaattgtgcctctgtcatgagtccttcaaattctgaagctgttgaaggtgtcttgcaggatcattatgggtctgttgtgtttgcttga

SEQ ID NO: 84807 - DNA, 1281 bp, Glycine max
  Peptide Sequence Number=SeqID_201585
atggaatcagtgaagccgtcggccgtgaccccgcgaaagaagttggcacgcaattttgcgaaggttcttcatgtcaaagcactgattggaattgcttcagttgatggattgaagaatgttatatctgatgcaaatctcaaggatgaagggaacattggtaagagtaaggctacactgaattggtctgagtcattcaatgaagatgatgatgaagaccttcaagagagagaggccaatgaagcacttttggcaaagctttttgctagcatttcaactgttaaagctgcatatgctgagttgcagtatgctcagtcaccttttgaccctgatggcattgaagctgctgatcaattgctagtgtctgagttgaagaacttatctgagctaaagcaatgttacttgaagaaacagtttgatccttcacccaagactgcaatactcgaggccgaatccaaggaattgcagggtgtgatcaaaacctacgagatcatggggaagaagttggagtcacaggtgaggctcaaggattccgagataatttttcttagggagaagttggaggaagctaataggcagaacaaggcaatcgagaagagattgaatcaaagtggccaactatccgggcttgataatcttcacataacaggattaagtcctagccatttcatcacggttcttcgccacacggtccggtccattcgcaactttgtgaggctgattgttgatgagatgagatatgcaggttgggacgttgatgccacggtcgacgccatcgagcagaatgtggtttatatggcggaagatcacaagtgtttcgcgatcgaggcctttgtttgcagggaaatgtttgatgcattccacattccaaacttcgccctttcaagcgagtctcttctagacaaaaacaggagacaacagtggttctttgggaagttcaatgagatgaaatcaatgaaggcaaagtactacctagccgagaagccaagatcatcgttcgcaaagttttgccgggtcaagtattcgagacttgtccatcccaagatggagtcatcgttttttggcaaccagagtcataggaaccttgtgaatgcaggagggtttccagacactgaattctttgcctcattcgccgagatggcgaagagggtgtggcttctacactgcttggccttctcctatgagcctcaggcttcaatcttccaagtggggaaagggtgcagattctctgatgtgtacatggaaatgtcaagtgtacctctcacagcaccaaaccaaggttaa

SEQ ID NO: 84808 - DNA, 231 bp, Glycine max
  Peptide Sequence Number=SeqID_201586
atggccaaagacaagtataggtcttttttgcatgatgaacctgataacatccagtggagacatggtggccctcccacttatgaagctgttaacaagctttttgaagaaagaagaaccaaggagtggccagaaggatcattggaggagatagtgcaaaatgctataaagtcatgggagatatggagctttcacacaagacccgcttatgcatgctttgatgatttaatctga

SEQ ID NO: 84809 - DNA, 765 bp, Glycine max
  Peptide Sequence Number=SeqID_201587
atggcgggttacagagccgacgacgactacgactacctcttcaaggtggtcctcatcggcgactccggcgtgggcaagtccaacctcctctcgcgcttcaccaagaacgagttcaacctggagtccaagtccaccattggcgtcgagttcgccacccgcaccttgaacgtcgattccaaagtcatcaaggcccagatctgggataccgcaggccaagaaaggttagtgaatgaagtgagtgttgttgttgttgttgcagatttggttttgtggagtcggtggggatttgtgtttttgagatcgggagtggaagtgggacctgcaacgaggaggtatcgtgcgatcaccagtgcttactatcgtggggcagttggtgcacttcttgtgtatgatgtcactcgccatgcaacatttgaaaatgttgacagatggctgaaagaattgcggaaccacacagacgccaacattgttgtgatgctagttggcaacaaatcagaccttcgtcacctcgtagcggtgtcaactgaagatgggaagtcctatgctgagaaagaatcactttacttcatggaaacctcagctctggaggctactaatgtagagaatgcatttgctgaagttctgactcaaatctaccgcattgttagcaagaaagcagtagagggggctgaaaatggaactgcatctgtgcctgccaaaggagagaaaattgatctgaaaaatgatgtgtctgctttgaagagagttggttgctgctcaagctaa

SEQ ID NO: 84810 - DNA, 237 bp, Glycine max
  Peptide Sequence Number=SeqID_201588
atggctcgcttgaattctgttttactcaccactctacttgttttggtatgctattcctcagtcttggatgcccgaaagattctcaaaattgagacacaagaattgctctctttgaagggtaccccaccttcaattgaggccaatggttatcatcacaagaatggtagtggaaggctcgttgctcatctttccaatgaagaagtagtatctaatcccagccccggtgaaggacactag

SEQ ID NO: 84811 - DNA, 1248 bp, Glycine max
  Peptide Sequence Number=SeqID_201589
atggcgaagggagcaacttcaaaacttaacatcgcaataattcacccagatcttggcataggtggagctgagagattgattgtagatgctgccgttgagcttgcgtcccaaggccataaagttcatgtttttactgcacatcatgataaaaacagatgctttgaggaaactgttgctggtgaacctctctatatgaatgtgtgcacctttccagttactgtgcatggttcctttcttccccggcatatattctaccgtcttcatgcattgtgtgcataccttcggtgcctatttgttgctttctgtgtacttttcatgtggcattcatttgatgttatcctggcagatcaagtctctgtggttattcccatcttgaaactcaaaagatcaacaaaggttgtattctactgccattttccagacttgttgctggctcaacattcaactttcattaggagaatgtatcgaaaaccaatagaccttgcagaagaaataacaactggaatggctgatttgatacttgttaacagcaagttcactgcatctacttttgcaaatacttttaagtatctagatgctaaaggaattcgaccagctgttttatatccagcggttaatgtggatcagttcaatgaacccagttcctttaagctgaattttctttccatcaatcgctttgaaaggaagaagaatatacaattagctatttcagcttttgctatgcttaactcacccgaaggagttcttaagcataaagatattactaatgcttctttgactattgcaggtggctttgataaacggttgaaggagaatgtggaatacttagaagagcttaaagatttagctgaaaaggaaggagtctctaataaaataagattcatcacgtcttgctctacagctgaaaggaatgaacttctttctgaatgcttgtgtgtcctttacacgccaaaggatgagcactttggcattgttcctttggaggcaatggcagcttataaacctgttattgcatgcaatagtggtggccctgtggagtcaattaagaatggtgtaacgggattcctttgtgatcctacaccacaggagttttctttagcaatggctaagctcataaatgatccccaggaggcagaaagaatggggagagaagctaggaggcatgttgctgagtcattctctacaaagtcatttggccagcatctaaatagatatctagttgacattcaccggggaaaggaggattga

SEQ ID NO: 84812 - DNA, 402 bp, Glycine max
  Peptide Sequence Number=SeqID_201590
atggctaaaccatgctttgcaaaaactcacttcccaagctcttctagaggaaaaagatcattgataaaaaaaaagactcctttcggatgtaagtacttcatcctgaatgctagaggtcaacttgcaaaatttgattcgaaggtggataaaggaatcttcctacggtattctaatacatctaaagcatatagagtgtttaactcaagaactttagttgtagaagaatccatccatgttaagtgcaacgatggtctaaccttttataagaagctatcaaatcttgaggatgattttgcagatatgcacactggtctatttgttacacctaagaagatgaagtcaaatagtctaatgaaattcttcctcagactggagaatcatcttatcaataaccttggatga

SEQ ID NO: 84813 - DNA, 300 bp, Glycine max
  Peptide Sequence Number=SeqID_201591
atgactctggaaatactgtcaaaatcgccttgtcacaatgattgtgcttctgtcatagactgggtagtaactaccatgctcttcttcggggcgcaagggagttttattaggtgttcgatatttagccatgccgaatacctgagcacttgcataaaagcgtgtgacaaagtgttcaggcgtatacttgatactggtgagtggaagacgacattggtgttcatgggtgaaacgttcttgggtattcgacatggtcaaatatttgataatgatggagatagcaagacaatggatgacctttag

SEQ ID NO: 84814 - DNA, 492 bp, Glycine max
  Peptide Sequence Number=SeqID_201592
atggacgcttttgattttgcgaatgtgtgtcgaaaagtcattttcaacaccaggaacgcctccattaccccgcctacaaatccacttcatccaccctgcctaacacctaaggatgtcattcctcctgccaataagaacaagaagaaaatgggtcaaaaagagaatgaggaggaggctcaacctccgaaaaggctacaacaacaaactctgcatcatttctcccattctcttcctagctctctaaaggcattgcctatggctaaggtgttcgaggaacacaaggttggctttgacatgactatccggcaggtgcaccataaatttaagatactagaagccacaaagtttgatatccttaaggatgtgcatcagggagtgttgatgtctatcaatggcattccaaagaagactccttgttcaagccaaccacctactccacctattgataccttgttggctaatgtcgattttggcgaagatgaaggtatatag

SEQ ID NO: 84815 - DNA, 249 bp, Glycine max
  Peptide Sequence Number=SeqID_201593
atgcctttgagggacagcataaccagtgtctatgtacctggtgtggttgagtacctaggcccttctaaagtaagttgcatagttcctaaaagtaattatcagcaacaagaatctttggaatcaaattgtcctcaaactccaccttcaaaagattacatgcaaagaggcccttctccaccttgggcaatgggtggtcaggtggcggccttctaccatgaggaggggaagcagagaaaacaaaatcgctag

SEQ ID NO: 84816 - DNA, 1167 bp, Glycine max
  Peptide Sequence Number=SeqID_201594
atgggtaacataggaagcagcggctccaacagccgccggagacacggcggcggcggcggcagcggtaggcggattcacccgcctccgccgcaggtgatgccgccgccggaggtcacggccaaccaattcgtgtatcctccggccgccacgccgtatcacaactaccccgggtactacccggcgccgaccaccatgccggcgccgttgccggcgccgtacgaccaccaccaccgtacggcggtagacccgatgtgggggcggtatccggtggcggcaccgccggcaccggcgccgtacgtggaacaccagaaggcggttactattaagaacgatgtcaacatcaagaaggagacgcttaggattgagcctgatgacgagaatcctggccgtttccttgtgtcatttacgtttgatgccaccgtttcggggagtgtgtggtgtcgtgtgaatgatggtaattatgtgtcagatgcaaggttttggggtggttgttgttgtgatcctgtgctggatttgattgctttgcccaatttgcttattttgattctgataagtaaaggggtgtgcaaagctgcaagggaaggttgcacactaactccaatgaaagaaaatgttcttccacccgtgactgtaaatttccagcaaggacttggccagaagtttaaacagccagctggaactggtattgatttttcaacatttgaggagtctgagttattgaaagtaggggacatggatgtctatcctgttgcaattaaagcagatgcatcctccagcgaccatgatgaatcaaaatcaaatgaaactccatcatccggtagctcaaactctcagataactcaagcagtgtttgagaaggagaaaggagaattccaggtgaaggttgtgaagcagatcttatgggtaaatggaatgaggtatgaactgcaggagatatatggtattggaaattcagtggagagtgatgtggatgggaatgacccaggaaaagagtgtgttatatgcttgtcagagcctcgggacacaactgtccttccatgccgccacatgtgtatgtgtagcggatgtgcgaaggttttgaggttccagacaaatagatgtccaatctgcagacaaccagttgagaggctattggagatcaaagtcgggcctgagcctgaggaatga

SEQ ID NO: 84817 - DNA, 312 bp, Glycine max
  Peptide Sequence Number=SeqID_201595
atgcctattatagccattgttggaactctgacatgtggcccttttgctggcccatattttcgacgagctaaaatatgctctaagtatgcattagatgtcgtctcgagtttcgaagcgtattacagagcaagagtctggttaggacctgctcgaatcgaaaagaggggagagtctttgagaaggaattcccaggttcaaagaagtatttatgaagtacaaagcttagacaagaaagaggacttcgagccattgggcaattcgaactggtgtatggacgagtcgaagtcgaggcagcaagagttctggacttag

SEQ ID NO: 84818 - DNA, 1435 bp, Glycine max
  Peptide Sequence Number=SeqID_201596
atggattctaagagcttcaaattttacgcgctgagcggctccattgctcggcgcgtattcttccgcgcgttattgctctcctccgctgtctccctcgttgccctgatccgcttcctccccaccgtcgatttgggatctttgactcccaagacctactttgactgcgtcgacgacgactcagattcgctctccgaaaacgccaccttaacagccggctcctacttgttccagagccgcatcctcaacaccttctggggctccttcgactccatgaactgcaaaaacgacacgagtttagcttccaccgtcatcaccattctaacgggtaaacgactcttgaacttcggcgcaagaagcctctgcgttggagaagggtctaatgtaattgtctcctcaatgcaacggttgggattctccagtgtcgttggtctccacaagcacccttttttgtccctccacaaaaagaaaaccgtgtgccacttcgagtacgatgattccaccttcgacttcgtgttctccaaggatgttgttgaccaggtttctgtcccagctgcattgctcgtgcttgaggttgagcgcattcttaagcctggtggaatcggtgccttgcttgttggttcttcttcttcatcatcagtgccttcattgctgagatcttccaacctggtgcatgttggttatgtcaatgaactcaaccttgtggttttcaagaaaagatctgaaaacgcaagcacaagctctcctttttataaccatgtactaccagaagattgtgcaagtgttgaattcaccaagcctttggtgaaactaatggagcctcttgtggtggaaagagtaggacatgatgtcaagtatgagaaaaaaaatgtctcctatttgcctaagtttgtggacgtttctaataagaagaggctggtgtatattgatattggggtgagggagttggtgaatgcaaatgtcaatgttactaattggttcccaccgtcttatcccattgatcagaaggctttcagtgtttactttgttcattacaacgcttctgtgttgtcctatgtgaaactgcctcgtgtcacgttcgtttatcatccgggtttagctgggaaaattgcacacaagaatggtgtggatggagaaatggaaccgtttttcggtgaggaagagtttgattttcttgtgtggttcaaggaaactgtgcagcatgctgattttgtggttctgaagatgcatgctggggaagttgaaatgaagttccttgcggatatatttgagagtggagctatatgctctgttgatgagttgtttcttagttgctcagagagtggagatggtaaaagggaaaccatgagcagcagggaacactgcatggatacttacaagggtctcagaagcaatggtgtctacgttcatcaatggtgggatgcaaaattgcatcaag

SEQ ID NO: 84819 - DNA, 384 bp, Glycine max
  Peptide Sequence Number=SeqID_201597
atggatccagacagagaaagcattaacgcaaatgagaggaagaaagagaagccaaacctagtctgcctctggattctgcacgtggagcaaccaacagaaaaaaaagcaagccagagagagggagaggggaattcagtgtctgtcacgccactctcggtgttttgcagagttgctgtgttgtgcgcgttggaggcaaacaggtgtggtgtactaatcgaactcggcatgcttctatacttggtggttggccgagtagatctcttgctaagccaccatgagactcgtttgggaaaaattaggaaagatagaaagtctatcttcaccgattatcaagtaaaaatggagaaagatcaagataagattgtctatagatcagacacataa

SEQ ID NO: 84820 - DNA, 918 bp, Glycine max
  Peptide Sequence Number=SeqID_201598
atgacagatgaaagccaaagggccaaccttaccttagttatggatgttgaggcagagattgatcgcttgccaattgatttgttggctcatatttttgttctgttcacttccttcactgatttggcacaggcgagtggtgtttgcaagaaatggaaacaaggggtgaaggagtctcttgctcggagacacaatctcagctttgccggttggaagatggatgatgactccactgctcgccttgtttatcatgcctacaacctcactaaactagatatcttccctttgatggtctttcttgaacatcaaagagaactttctgtattgattctcagagctttggagatggattgtgaatttgagtttataaattttgattgtatcgaggaattgagttgttataagctgataaattgccatgatgtcaagaatgtagatctaagatgcaccacatttattgtcttttgtatttgcagaccgaggagccgctggggttgccaaataactgatgctggacttctcagaatatctttcgctaagtgtataagcaatctcacatccatatcactgtggggtttgactggcatcacagatgaaggtgttgttcaactgatatccagaactagatctttacaacatctgaatgttggtggtacgtttataacggatgaatctctgtttgtcattgcaagaagttgtccaaagttggagaccattgttctttggagctgtcgtcatgtaacggagagtgggctttttgcgctagttgatcaatgcctgaagctcaaatcaatgaatgtatggggaacaagagttcctgaggagtgccttaacaatttacttatttgtaagtccagctcttcagataaaagtttgaaactggactgcatgtatagaatggcgttcaaggtgttgaaataa

SEQ ID NO: 84821 - DNA, 369 bp, Glycine max
  Peptide Sequence Number=SeqID_201599
atgtcgctgaggaaggtcttccgctcccgcaagttctccaaatcgttcaaagaggtgctgccggcggagggcgccgccgtcgagggcggggtcgccggcaccgtcgaggaggcggcgaatgggaataataatgggtggtctagcatgctgccggagatcctcggcgagatcgtgcggcgcgtggacgccgccgaggagcagtggccgaaccgccaaaacgtcgtcgcctgcgcgtgcgtctgcaagaggtggcgtgacatcacgcgcgaggtcgtgcgtgtgccctcgcataccgggaaaatcactttcccttcgtgccttaaacagggatcagcagtgatttgggaactatgtttgtgtaacatatga

SEQ ID NO: 84822 - DNA, 1422 bp, Glycine max
  Peptide Sequence Number=SeqID_201600
atgcaggcgaataaagtggagggttcaagtccgactgctaaagatgtgctgctggttattgattctttgaagaaacaagttgctgcagaacgagttgtttatgtaaagaaaagaatagaggaaaacagacagaagctggttggtgtcactaaccatctctgcacaatgtcaacggagagaaggaactgcagcattactgatacgaatagaagtctggacctactgacaaagaggcaaaaagatgcaattgatatgcacaatggtgttcatgcgagtaatggtgacgtggagagcaacggctatcatgatgataaccatggttctacagcagttcttctagggtctaatgttgccgtaaagaatgctgttcgtcccatcaagttacctgaagtaaaaaaattgcctccttacactacatggatttttctggacagcatgactgtcaaagagtttggtttaactgacattgttctggagtcgttggctcagtgtttttctagaaacaccagtgaaattaaggcaaagtatgaaaccctcagtattcatgacaatgctggcgggtgttccaaggctggagattctgaagagaattctcaaagtggcaatttttttctggaaaaggatcttgaagcagctcttgactcttttgacaacctcttttgtcgacgatgtcttgttttcgattgtagattacatggatgttcacaggatcttgtcttccctgctgagaagcaacctacatggaaccctcctgataccgaaaatgcaccctgtgggccaaattgtttccgatcgtcagaaagatttgccaaaacatcctctgcccaggctgatgaagagaagtcctctggtggtgctttatctaggaagaagtcttctgctaagaggcggataaaatgtagccaaagtgaaagtgcttcatctaatgcaaagaacatatcagagagtagtgactcagagaatggtcctggacgagatgctgtctcagcctcccgctcagcacctcctaaaactaaacctgtggggaaaggtggaattggtaaaaggaacagtaagcgagtggcagaacgagtcctagtatgcatgcagaaacggcagaagaaaacaatggtttctgattctgattccattagtgaagctcttgaccgttcatcgaatgatatggtcactgacccacatgccatgagcagtgaagacaacatgaggaaagaagagtttgtagatgacaatgtttgtaaaccagaaatcacagataataaatcttggaaagctcttgaaaaggggcttttagagaaaggaatggagatttttggtagaaacagcatgcaagagtatgaccactggtccaagtgtttatatgaagttaagcttgtcttcagtcaatttcatggggaatggatgggtataattttgaagctttga

SEQ ID NO: 84823 - DNA, 1230 bp, Glycine max
  Peptide Sequence Number=SeqID_201601
atgctcatgtgctcgcgtttcttggattaccgcaccaaatgcagagcctcaacccctaccatctttgcctcattcttcttctccctcttcctcacctcttccgccgcatgctttaacggaaattgccaggttctggaagcatgtacagctgccaccgattgtgggccaggcctctattgcggcaattgccctgctttgggccggactcggcccgtttgcaccagaggccaagccaccatcgttacatctctcgtaacctccaaaaacgtgaatggtttgcccttcaacaagtactcgtggatcatgacccataattcattcagcatcgtggatgcgccacctttgcctggaggagttcagagactcaccttttacaatcaagaagacactgttactaaccagttgaggcttgatgatgaagggaatcaacaacctgcaataaatactttgagagaagtggaggcattcttgactcaaaatccaacggagattgtcaccattgtaattgaggattatgtgcgtactccaaaggggttgactaatctattcacaaatgctggacttgataaatattggtttcccgtgtctgatatgcctaaaaagggagaagattggcccactgtaacagagatggttcaagcaaatcaccgacttcttgtttttacttcggatgcttcaaaggaagctgaagaaggaatagcttatcagtggtcttacatggttgagaatgagtctggagatcctggagttcaagggggttcttgcccgcatagaaaagaatcaaagctgttaaattctagaagtgcatcacttttcttgcagaattactttccaacagatccagttgaagctgactcatgcaaagagcattctgctccacttgctgatatggtgaacacatgttacaaagctgcagggaatgtgctgcctaactttatagcagttaatttttacatgcggagtgatggtgggggtgtttttgatatcgtggacaaaataaatggccattcattgtgcggctgtaatacagtctctgcttgccaggagggagcaccttttggatcttgcaagaacattgctgtacctgatacaactccagtgaccaacacaactggaagctttacaggatatgttcagttctctagatcagcttcaccagtccattctccaaattgctggcttttcctagcgttttacttacggcttattactattttattgcaattgtga

SEQ ID NO: 84824 - DNA, 1008 bp, Glycine max
  Peptide Sequence Number=SeqID_201602
atgtctggtcctcctggggatgttgcaaattccctcatggactgctattccaagggtactaatgaagtgagacgaaggtctagattcttacgtagaagaggaagagttcgtcgattgaagtacacctggaaatctgctgcttatcattcaattaggaaaaggattacagagagaaaggatcagccttgccggcagtataatccatgtggttgccaatcggcttgtggaaagcagtgtccttgtcttcaaaatggaacctgctgtgagaagtactgtggatgccccaagagctgcaagaatcgatttcgtggctgtcattgtgctaagagtcaatgcagaagtcgtcaatgtccatgttttgctgcagatagggaatgtgatccagatgtttgtaggaattgttgggtcagttgtggcgatggtacactagggattcctagccaaagaggggataattatgaatgtagaaacatgaagcttcttctcaaacagcagcaaagggttcttcttggaaggtctgatatatcaggttggggagccttcttaaagaatagtgttggtaagcatgaataccttggagagtatactggagagttgatttctcatcgggaagcagataagcgaggaaagatatatgaccgtgaaaattcatcttttctcttcaatttgaacgatcaggcaagcttttatgactttgtatcttttgtgggcgataagttctttgttacatatacgcattttgttcttgatgcttaccgaaagggtgataaattgaagtttgcgaaccattctcctgatccaaattgctatgcaaaggttattatggttgccggagatcatagggtaggcatttttgccaaggaacggatttgtgccggggaggagctgttctatgattatcgttatgagccagatagggctcctgcgtgggctcggaagccagaggcatctggatcaaaaaaagaggacggtgctccttcaagtggtcgtgcaaagaagcttgcttaa

SEQ ID NO: 84825 - DNA, 231 bp, Glycine max
  Peptide Sequence Number=SeqID_201603
atgaagatggaggaaagttcgttcctttccgtgaagaaaaggtggtgcaaggttgagaagagatcatataaggaatgtgttggagagaagagtccatgtataccaagtgagtgtgttggactcagggaaacctatttcaattgcaagagaggccaggcaagtgtttacttttttaacttgatcatgcatgtaaatggacttccaccaaattatctggctgctaatttttaa

SEQ ID NO: 84826 - DNA, 1512 bp, Glycine max
  Peptide Sequence Number=SeqID_201604
atggcaactgaagctgcaggctcttccaaggacaacaataaccaaggccatgtcaccactgaaaatagggctgatatcccaaaacaaaagggtccagcaccatctgaaataactgaggaactcccaagagaacaacatggggcaaggcaaaaccttatcttggatattcctgcaatatctcaggaggaagcaagagaagattacgtgaggataaacatgcctctaactccgcctccaagaagagtgattttttctccctgtccaagtcctgttttccccagaagcaaagaatccccaggtccctcctcatcaaaaagtaaatcaaatattaaaacctttcttcccaaactcagtttgaaatttcgtaacacaagttcggagattgaaaaggctgccttcctagcactagaaggatcaacagtggcaccaaaaaagccttttctttcaaggacattatctcttgtcacacctagagggaagaaaacatcatccttacctgtaaccccaattgctcattcaaatccagggtctgtacatggagggaacttggtttatgcagaaacagttgagaaagaactgaacttaccaatccatcgttcccgttcagtacctgtgcttaacaaagaaggtaactcacctgtacgtggcatgtttcgcatagttccgaccacactacgattggatgagaaaattgccagtgcaacgcctatgacatctccaattcatgatactgttaaaaatgaggatggtggtgaagatattcccgaagaagaagctgtttgtagaatttgttttgttgaactcggagaaggtgctgatactttcaaattggagtgtagctgcaaaggtgagctttcgttggcacacagagaatgtgtagtcaagtggtttaccattaaaggtaatagaacttgtgacgtgtgcaagcaagaagttcagaatctacctgtcactcttttacgagttcaaaatggccaggcacataacatgttaggggctgatgcttctcaatacagggtgtggcaggatgctcccattcttgttgttatcaacatgctggcttacttttgttttcttgagcagcttcttgtgtctaatatgggatctggtgctattgccatgtctctcccattttcatgtatattgggtcttcttgcaagcatgacagctacaacaatggtgaggagaaatcatgtttggatttatgcaactgttcagttttgtctggtggttcttgctggacatctttttttctcattggttcatatgcaagctgttctagctatccttctagctacatttactgggtttggagtggtaatgtgtggagcttctattcttatggagattttgaagtggaggggaagatcacttgctcaatcgaatcaacagcaaggttcccaagaggcaataccaccacctgatcaatcatctacagttgctcatcaacctcagattggttctgaacaaactgaaagtaatttgggagagtctcctgcacagaggagttga

SEQ ID NO: 84827 - DNA, 657 bp, Glycine max
  Peptide Sequence Number=SeqID_201605
atggatctttggattaatctcctatttcctcagttcctttcttactctagctcaagagcttctaaaataacagtgcttgactttgctgttactgtggatgatttagttcaagtttggagtatggaagatcgcaaggttgtggcatggggtgaggggcacaactcatgggtcagcggtgtggcttttgattcatattggtcatcacctaattcaaatgacaatgaagagactgttagatatcgatttggttccgttggtcaggacacacaattgcttctatgggacctggaaatggatgagattgtggtacccttgcgacgtccttctggtggatccccaacttacagtgctggaagccagtcttcccaatgggacagtgttgtcccgttgggtaccttgcagcctgctcctagtatgctggatgttctgaaaatctctccactcgttacccaccgtgttcatactgaaccactctcaggcttgatatttacccaggaatctgtacttactgcctgtcgggaggggcacataaaaatctggattagacctgcagctgctgagagccaatcaagcaacgctgaaactctcttatctaccagccttaaggagaagccttcaattttgagtaaggttggcaattctagccacagacaatga

SEQ ID NO: 84828 - DNA, 798 bp, Glycine max
  Peptide Sequence Number=SeqID_201606
atgactgatgaatcattgattccaattgatccgataaacatatacccaaccatgcaagcactaccatcttgtgcgtattcctttcctatctctctcttccctcctccatcaaactttgtacctagcagtgtcaagctctcttggttctctaaacaagagaatgatgagttatcacacagagattactgttacattttccctgctcccgtttcccctgcagaatcaaaacttatggtttcaggtcccaatccaatggataaaatatatggtgcaataaatcattatggcaagaaggttgaagaagcaaccaaacaagccgagaccatggttggcaatatacggaatcacgtaagagttagttctaggccagctgatgctgcaattgctagacttattcaaggaacaaaggtgcttacatcaggaggacctgataagctatttcaacaaacatttggggtttttccaggagagaagctcttacagccatgtgcttgctacatatcaacaaactctggacctctaattggaacactttatatatccaccaaaagattagcattttgcagtgactctccattgtgccatcatccattctccctgcagcagcatgaatgcgtttattataaggtgatagtgctgctggatcagttgagcaaagtcagttctgtcacaaatggattgaatccatcagaaaaacgcatgcaggttatcacaacagatggctatgagttccatttcatgggttttttctcatatgacaaggctctcaaggctgtaaacgaggctctaaagcattaa

SEQ ID NO: 84829 - DNA, 2838 bp, Glycine max
  Peptide Sequence Number=SeqID_201607
atggatcacaagtcttggctttgggggaacaaagccacacagaagacaaatttagcaactgacaaaacaaatctcacttcaaaagaaaatggagaggtacaggctcctctaactgataaagaaaaattggagaaagacttaaaaagattaaatgataagcttgcttttacactttctgaatgcaatgctaaagatgagcagatcaagaaacaaacgaaaattgtacaagaagcagtagcagattcctttgaaggatgggagaaagcagaagctgaaatattgtctatgaagcaacatctcgatgaatctatacagaagcagttagtttataaagaaagagtggcccaattggatggtgctctcaaggaatgtatgcaacagttacgttttgttagagaagaacaagagctaaggattcatgatgctgtgatgaaggcttctaaagaatttgaagaagcatacatagttttggaggagcagctatcagagaccagtaaagggcttgctaaatctggggttgaaaattctcgtcttaataaatctattattgctaaagaaaatttgattgaagatctgaaaagacaattggctcatgcagaggctgatcataatgcactgatgattagattagagtccattgagaaagataatgcatccctaaagtatgaagctcaagtgcttgaaaaggaacttgctattagaaatgaggaaagagaatttaattgtcgagcagctgatgcttctcataagctgcacttacagagtgtaaaaaaaattgccaacttagaatcagaatgtcagaggctgcgtattctggttcgaaaacggttaccaagtcaagcttgcctggcaaaaatgaaaaatgaagtcgaaatgttggaacaggattcacttgaaatgagaaggaaaaacttgaactcaaccagtgtagtggttgaatcttcacttgacagttctcctgagactaccattagaagaatcactgctttgaccgatcaactatgtggtgtggaagaagaaaacaagaccttgaaagaatcgctaaataggaaagcaaatgaaatccaattctccagagtaatgcttgctcgcacagcttctaaactgatgcgacttgagtcagagattgaatctagaggtcatgtaaccttggagcagcctaaaagtaatcctgcattgcaagacatatctttgtcatcaacgtctgacattggcagtgaggacaaggttagctgtgctgactcctgggcttctgcattgatttcacaattggagcactttagaagtgtaaaacagaaggaatcaatgtcttgtaaaagtgttggaccttcagatataagcctaatggatgacttccttgaaatggaaaaattagcagtggtctctgttgaaaaagcccccaaaatttcttgtgcttctttagaagaaaacaatgaaatagatggcctgccagaggctagaccgaatgggattagctctgaagtaataagtaaggagattattcctgtttctgatcatttgtcagagttctctacatctaatcaggaatcatgttccattgacatattaaatggtgatattcctggttggcttctggatgtagtaaaagtgatcttggaacaaaagtgtgtcactcataagaaccttgatgacatacgtgaggatattagattggctttgagctatctaaataatgcagatcaatgtgggtttgattcaagcaaaggccatccatttgatggatctaagcctctacattttagtcagcacacctcatggaaacctttgaataattctgtggtagatccatgtggtgaagtaaatgatgccgagattttatcaataaagggaactaaacagaaacctcaaagagatttgagccagtcaataggtaagataattgagcttattgaagggattagcatgcctgctgaggattatgataattcagattccttgtacaaaagagatggaaatatccgtacacataagaatcaaggaatgccaacaggctacatggtccgtgttttccagtggaaaacatctgaactcagtaatgtcttgcagcaatttctccatgtgtgttacgatttactcaatgacaaggctgatcatgaaaaatttgccacagaactaacgacagctttggattggattatgaatcactgcttttcacttcaggatgtttctagtatgagggatgccattaaaaaacaatttgattgggatgagacgcaaagtgaaaatgaagctgaaacagggatgtttgcagacacatataagttgcatcttcccatagaacagttatcatgtttgcctgtgctaactaattcagattgtcatgatgttccaactgaagagatgcaatatgttgataaggaagaaattaaaaatattgaagataaagtaatcagttctgaatctgagaaagaagccttggaagggaggctccaatcagctataaatcaacttcaggaatcagagaaaactattggcagcttgagattggagttacaaaccttgaaagaattgaatcgaatacttgaggagcaagtacaaaatcatgcattcataaatgtagatcttgacactcagctaacagaaactgaattaaaagaagctaatcacaaagttttggcattagaagtggaactggagaacaaaaatcaatattgtgaagaattagagaccagatgcgttgaacttcagctccagcttgaaagcatgacaaagaagtggtcggacaatgatgttaatcaaagagatgagccactgcaaactatcccagactggagcatgatgagcaagttacttcatcagctcatagattgcttttaa

SEQ ID NO: 84830 - DNA, 920 bp, Glycine max
  Peptide Sequence Number=SeqID_201608
accacgtttctttcgtgaaggatgtagctgcgactcagcctcctcaacatctttcacaactcctcagtattctgaagaccagaggtgaatctattatctccccgggtgccaggcaaggattaattcctcttgctataccactgtcaaaaaatagctctggtaatgtgactgcactgttgcggtggccgacggctccacctgagatggaaatgccagtggtggaagtcagaaaatatggagtatggcttttagctaagagtgtagaccaatttatacaacgactgttggttgaggaagataccaagaatggtcgagagagaaatgaagaagtattttatgcttcgggtgatgctggggagaaattttacaggaagggtgattttacagagtctggaatttctaacctagatgtctatcttttgaaaaaggttggtctatttccagatatcatagagcggaaagtggcacgacattttgaggaaggagatcttgtttcagcattagtaactggggaattttataccaagaaggagcattttccaggatttgctcgaccttttgtgttcaattctgaggttttgttgagggttgggcgtaaagtagaagctaaagatgctgccaggggagctttgaagtcaccatggtggactcttggctgcaagtatcaggacgtagctaatatagcacaatgggatgatgagcaaattgagtacgttaaagagaaggtaactgaagagggaaggcaagaagatcttaaaaaggggaaggcccctgcacaggttgtattagatgaagctgctttcttgttggatttggcttctatagagggagaatgggatgagtatttggagcggattgccaaatgttacgaggaagcgggacttcatgatgtcgcaaaattcatactttatagagattaa

SEQ ID NO: 84831 - DNA, 243 bp, Glycine max
  Peptide Sequence Number=SeqID_201609
atgaagaatgtaattggtagtctcgatgataataatggtatcggtagcattggcgttggttgtggtgccaacaatgatgacattggtggtgttgatggttttggtggtggcaacaaagatggtggtagtggtggtggcattggcgacgacgaggattgtgatggcgatgacaataacaatggtggaagtggtattagtggtggtggttataacagtgcggttgcaatgatgataataatgata

SEQ ID NO: 84832 - DNA, 243 bp, Glycine max
  Peptide Sequence Number=SeqID_201610
atgaagactttaaagactaccgtggatggtcattctgaagctaaggatttggattgcaatgattttgcagttattaatcgtgttcgtcctctcaatagcatggagcgatgtacacaagggtataacagatgcctgaagcaagaaggctctcagagcattacttggattggggaactggagaaccagtttgatggaagcttgcttgtgggacttctatggaggctggatcttgagcttcaatga

SEQ ID NO: 84833 - DNA, 1362 bp, Glycine max
  Peptide Sequence Number=SeqID_201611
atggaagtagcacaggtactccacatgaacggtggcgttggagacgcaagctatgcaaacaactcccttgttcagcaaaaggtgatttgtttgacaaagcccataagagaggaagccataagaagcctctattgcagcacacaccccagaagcttggcaattgcagatttgggttgctcttctggaccaaacactttatttgttgtgtctgaattcataaaaattgtggagaagctttgccgagagctgaaccacaaatctccagaatacaaagtctttctgaatgatctccctgggaatgacttcaacaacatcttcaagtctcttgacagcttcaaagagaaattgtgtgatgaaatggaaagtgggatcggtccatgctacttctcgggtgttcccggttctttctatggaagggttttcccatatcaaagtcttcattttgtccattcctcatacagccttcaatggctatctaaggttcctgagggtgtagacaacaacaagggcaatgtttacataggcagtacgagccccaaaaatgttgtgagagcttactatgagcaatttcagagagatttctctctttttctcaagtgtcgtgcagaggaattggttgaaggaggacgcatggttctcacatttttgggaagaagaagcgatgatccatctagcaaggatggttgctacatttgggagcttttggctactgctcttagtgatatggtcttgcagggaatcataagagaagagcaattagatacttttaacatccctcaatacactccatccccatctgaagtgaaattggaagttcttaaagaaggatcattcgccatcaatcgtctagaggtttctgaggtgaattggaatgctctcgatgagtggaatgctctagactttgaatctgaaaggtctgaatcacttagtgatggtggatacaatgtggcacagtgcatgagggctgtggcagaacctatgctgattagccactttggtgaagctatcattgaagaggttcctgagggtatagacaacaacaagggcaatatttacataggcagcacaagtccgtcaaatgttccgagagcttactacgagcaatttcaaaaggatttctctttatgggaagaagaagcggggatccatctagcaagggtggttactggttgctacatggctactgctcttaatgatatggtcttgcgggataatttgccattaatcgaggtgtctgaggtgaactggaatgctcatgatgagtggaacgctcttgagtttggatctgaaatacttggtaatggcggatacatgcaatgtgacacagtgcatgagagctgtggcagaatctatgctggttag

SEQ ID NO: 84834 - DNA, 960 bp, Glycine max
  Peptide Sequence Number=SeqID_201612
atgagactggatcatcgacgtctggttctactcgtcggagttccaggacatgatctctggcggcttcctctcgccgacagcgaaggcactctgcgtggagatgacgtcaggatctcgaagatggcgtcacccccgctggtgaagtccgcccaggctcgttggatttcgttcccggacggcacgttcgacttcgattttgccgacgacaacacactggaggaagaagaagctgtgaaattagaagttcttaaagaaggatcatttgccattaattgtctagagggctgtgtggcagaatctatgctggttagccactttggtgaagctatcattgacgagctttttagcccttaccaagaaaccttggctgatccaatgtccaacgagaaaactaagtttgcatccgagcaaaaggcgatttgtttgtcaaagcccataagagaggaagccataacaggtctctattgcaacacagtcccgagaagcttggcaattgcagatttaggttgctcttatggaccaaacactttgtctgttgtgtctgaattcatcaaaactgtggagaaactttgccggaagctaaaccataaatctccagaatacaaggtctttctgaatgatctccctgggaatgacttcaacaacatctttatgtcccttgacaacttcaaagagaaattgtgtgatgaaattgaaactggggttggtccatgctacttctttggggttcccggttccttctatagcagggttttcccaaatcaaagtctgaattttgtccattcctcttatagtcttcaatggctttctaagtgtcgtgcagaggaattagttgaaggaggtcgcatggttctcacaattttgggaagaagaagtgatgctgagaatccagctatcaaggagggcggttatattatctgggagcttatggctacagctcttaatgatatggtcatgcag

SEQ ID NO: 84835 - DNA, 2085 bp, Glycine max
  Peptide Sequence Number=SeqID_201613
atggcgcaccaccacaacaactccacaactcttcgcgttttctgcgtcggaaccctcgacaccaagctccacgagctcctattcctctccgaatcacttcgctccaatctcaatcgcttctcctcctctaaggtagaagtggtggtggttgatgtctctgccggtacaaacgcgccagagagtttgcaggatttggcgtttgtttcaaggaatgatgttgtgtcttcctacaacagtggatcaggcgaggccttgtctctcccggaggacagaggcaaggctgttgccgtgatgactcaagcattggagcagttcctgaagaagtctcacgaggatcagagtcttgttggcgttattggtgttggggggagtggagggacgtccctcttgtcgtctcccttcgcctctctcccaattgggatccccaaggtcatcgtgtcaacggtggccagcggtcaaactgagccttatgttggaacctcggatttggtgttgtttccgtctgtcgtggacgttgctggcatcaatagagttagcaggctcatcctgtccaatgctgcagctgcttttgctgggatggttgttggaagggttcagagcttacaggaatcttctcgcgccgaagataagcctaccgttgggataactatgtttggagttactactccttgtgttaatgctgtcagagataggttgcatgaagaaggttatgaaaccctggttttccatgcaactggggttggtggcagggcgatggagaatttggttagagagggatttatacagggtgtttttgacatcacaacaacagaggtagcagactacatagttggaggtgtaatggcttgtgaaagttctcgttttgatgccatcatagagagtaaagtcccgttagtcttgagtgtgggagcattagacatggtgaactttggagcgaaagataccataccactgaagtttcagcagagaaatatatatgaacacaataaacaggtttcacttatgcgaacaacggtagatgagaacagaaaatttgctgatttcatagcaaataaactgaagaattcatcatctaagatttgtgtttgccttccagaaaaaggtgtatctgctttagatgcacctgggaagccattttatgatccagaggcaacgagtactcttcttcgtgaattacaaaaccttattccgactaatgatgatcgacaggtaaaggtgtatcctcatcatattaatgatcttgaattttcaaatgcattggttgatgcatttttagagattaatgagaaaactagtaaaggttctactcatcaacaagtagccagtcctgaatctgttgaacaatttcatgaggataatgtttcaaatgcatcaagctttgggaccattctctatacacctaatgaattcccagaagcaagaacagaaactttggagaaaacacagcttatattacagcaacttttacatcagatacataaaggaattcctataataggagctggtgctgggacagggcgcttccgaatggctggaagaggttcattagctggattattaccttttgctgatgctaatgctgttgttctcgacatggccaatgaagttttgccagtggtaaagaaggttccagttcttgctgacaaaatcttgaagaaacgggaatgggatataggtggcttggaagttgagatgatccagaaagcccataaaatgggtctcttgacaaccccatatgctttcaatcaatatgaagctattgaaatggctaaagttggcgctgatattatagtggcccatatgggtctaactacaacaggctccataggtgcaaaaacagctgtttcacttgaagaaagtgtagttcgtgtacaagctattgcagatgcagcgcataggatcaatcccggtgtcattgtgttgtgtcatggaggtccaatatccggtccaaaagaggcagaatttatattgaagagaaccaaaggagttcatgggttttatggggcttcaagtatggaaagacttccagtggagcaggctattacaaatacagtcaaagagtacaagtcaatttcttttcattaa

SEQ ID NO: 84836 - DNA, 243 bp, Glycine max
  Peptide Sequence Number=SeqID_201614
atgccaataacaaaatgcttatgctacagtagaacaatcgcaaatcgatgcttcgtcttcgcttgccgtcaaaatctaactacaacgactcttggacgcgcaacaagtgttgttgtttgtcttcgctacaacaacgactctttgaaatcacatatagtatttggcaaagaagggagtaaggaagaaagagaagaggaaaaacgatggtggtacctcgcatgcgacaaaggaggttttccgtga

SEQ ID NO: 84837 - DNA, 174 bp, Glycine max
  Peptide Sequence Number=SeqID_201615
atgaagcaaggagcttcaatttaccatgaagatctcaacagcatgcgttatggtttgaaggtatttaaggaaacattgagaatgtccaatgtcctgttgtggtttcctcgtgttgcacttgaagactgcacgatcgaaggagggctttcatcattagcctttctggcctcatga

SEQ ID NO: 84838 - DNA, 1488 bp, Glycine max
  Peptide Sequence Number=SeqID_201616
atggctatggcttcaccctcttcaatcttctcaccttatgcttccatgacagcctacatcatgctcctgcgttcaattaccaacgacctcattcctcaaccaattcgctgctacctcaccaacaccttccgctacttcttcaaggctcgctgcaacgccctcgccctcatcatcgaagagtactccagtggcatagcgcgcaaccatgtctacgacgctgcagaggtttacttgtccaccaaaatcaccccagaaaatgagaggctcaacatcagcaagagtccaaaggagaaaaaactctccattaggctggaaaagggtgaagagccagttgattggttcaacggggttaaggtcaactggaaactaatctgctcagagtctgagaagagcaatagtcccacaagagcagaaaagaagtactttgagctaagctttgagaagaagcacaaggagatggtgttgggaacttacttgcctttcattcttgagaaggaaaaggagatgaaggacgaggagagggtgttgaagatgcacactctcaacacttcatatggttatggagggttcaagtgggattctattaatttagaccacccttcaacgtttgagacgctggctttggaggcagagcagaagagtgccatcatggaggatttgagcaggtttgtaggaggaggaagtaccggcaaatcgagcttgatcgcagccatggctaactacttgaagtttgatatctatgatcttcagcttgacaacttagtgaccgattccgacctcagaaagttgttgctagcaactgaaaacaggtctattctggtgattgaggacatcgattgcagtactgtcgatctgccagggcctaggcatggagatggacgtaagcaacctgatgtgcagtaccttgattggctttacatggattctctactcataatttggatgctaaagttgagtttgtgtggattactcaacttcatagatgggttatggtcgagttgtggagacgagagaatcatcatactcaccaccaaccacaaggaaaggctagacccggcactgctgcggccaggaagaatggacatgcacattcacatgtcctactgctcctaccacggcttcaaggttttggcctcaaactacctagacatcgccccagatcatcacctcttcgggaagattgaagggctgatagaggacatggagataaccccagcacaagtggcagaggaactgatgaagagcgaagatgctgacacggcgctagaagggttcctaaagctgcttaagaggaagaagatggaaggtgatgtgtgtgagaatgatggttcacataaaacagaacttcgccaatctaaaaggtccaaagttggttgcaagcagaaaagacccgtttgtatcagcaagagaaaaaatggtgtgggtactcaaagaatgacaagagaggacgtacattgtaatcagcttagcacctttggaacgatctaa

SEQ ID NO: 84839 - DNA, 1698 bp, Glycine max
  Peptide Sequence Number=SeqID_201617
atgggtgattggctttgttgcatcggcacggggcatggagacgcagttagcctggaaagcggagccggtaatggtgtaggacttggttgcatgggtgcggagcatggtggcggagtcggtatggaaagcggaggtggcggtgttttagaagaatggtatccagtgtggattccatggaagcttgggtttcgacgaagcgaagttgagctgcagcaagtttggtcatggcggcctcaagacggtccacacaagcggcggaaagttcagcgtctgccattaaaggacgtcagggaaggggcagaatccatggaaggcggagttggcatggtccgcacaatttgtagagttgtggtaccgaacaagcatagcaaacgtttgcagaaatggttgctggtgggtggctgtgtggaaaagatgtcgtgcgaagaggtgatttggactgacatgacagccatggaaggtagccattggagctcaatgacagcaccaatttgttatgaactgaagaataattcagcgattcctaacattcgagctcttgaaaagagtgaccgtgttggttcgttgaagaaaatgctaaggaattctctgacaaggagtaggaggcgaagcagcagcaaggtcatgtcggttgaaatcgaggatatccgcgatgctgaagagtccaaagctgttgatgagttccgtcaagctcttgtcttggacgagctactccctgagaagcacgatgattatcacatgttgctcagattcttgaaggccaggaaatttgaacttgagaaatctaagcaaatgtggtctgacatgcttcaatggaggaaggaatttggtgctgacaccatcagtgaggattttgaattcaaggaactcgaagaagtcctgcaatactatcctcatggacatcatggagttgataaagatggacgaccagtttacattgagagaattggtcaagtagatgccacaaagttgatgcaagtcacaaccatggatcgctacatcaaataccatgtcaaggagttcgagaggacattcgatgtgaaatttgcggcttgctccatttctgcaaagaaacacatcgatcaaagtacaaccatccttgatgtgcaaggagtgggcctcaagagcttcaacaagcatgccagggagcttatcacccgtcttcaaaagattgacggtgacaactaccctgagaccttgaaccgcatgttcatcatcaatgcaggttctggattcagaatgttgtggaataccgttaagtcattccttgacccaaagaccacatcaaaaatccatgttcttggcaacaagtatcaaagcaaattgcttgaaataattgatgagagtgagttgccagagtttttgggaggcacttgcacctgtgctgatcaaggaggttgcatgcactctgataagggcccttggaaggatgcagatataatgaagatggttcaaaatggtgaccacaaatgttcaaggaaatgtgaggttcctgtcatggaagagaagacagcttctgaggaacacgagacttccaagttggaggctaatctcaccgcacaattgtcttctgtctttgctggggtccctgcttctaaggcttacaactacgaggactttgtccccgaggctgataaaactgcttggaataaaaagatggatgaaaatgagaaatttgcattatccaaaggtagaatg

SEQ ID NO: 84840 - DNA, 480 bp, Glycine max
  Peptide Sequence Number=SeqID_201618
atggtattgagtggaggtgggacttgcttgggagaggcaggggtatttgtgtttattcaggtcttattgaaggtagaagaagtaaaaagggttgtgcaggaagccattaccgagatagaggaatcagcatatgaattagatcatcatgcaaagaaggactggtttgttgattctgggcagaagtctggcctttatgcgtgggttgcccgagcagatgactacaaagtgaacaatatctatggagaacaactgcaaaagatgggcgatctcaaaaccatacctgagcgtatggaagaagaagctaggaagcaggatatacttgtctccagtttgactagcattatcgaagtcaagaaccagcacttaaaagagattgaagtgagatgtcatgagactacgaacaaaatgaaccttgctatgaatgaaaaagataaactcattcaaacttataatgaaggtatctattttattgagccttag

SEQ ID NO: 84841 - DNA, 804 bp, Glycine max
  Peptide Sequence Number=SeqID_201619
atggctgctctggagcaaaagaaagctgatgaaaatgttatgaaactggctaagatcaacaggtgtgtgaagcaaaaagaacaactccatgctaaaatcattcagcttcaaaaacaacttgataagaaacaagagctggagttggagattcagcaattaaaaggaacattaaatgtgttgaagcacatggaagatgatgaagatgcagaagttctgaagaaggtagatactttacaaaaggatttaagagacaaggagcagtcacttgaagacttagtagatgcattgaaccaagcacttatcgttaaagagcgtgagagtaatgataagctgcaggaagctcgaaaagcattggttgatggtatgaaagagctatcatctcatggcaatattcgcttgaagagaatgggagaacttgacactataccattccatgacgcaatgaagaaaagatataatgaagaggaagctgaagagagagcttcagaactgtgctcattgtgggaagagtatctaaagaatcctgattgccatccattcaaagttaccatggttgaagggaaagaaaaagcaattgttagagatgatgatgaaatgctgaatgagttaaaaaatgacttgggtgaaggggcatataaagcagtggtacaggctttgtcagaggtaaatgaacataatcctagtgggcgatacttaacctcagtagtatggaactataaagagggaaggagagcatctctgaaagaagtacaatttctgttgaatcattggaaagttctcaaacgaaagaggggaatggtgtga

SEQ ID NO: 84842 - DNA, 1572 bp, Glycine max
  Peptide Sequence Number=SeqID_201620
atgatgcccggtgaccccttttccctatccacttccatcggaggcttcactcaagataagcaaaacacaaaccctaaccctaaacctaatcctcctcccaagaagaagagaaaccttccgggaacaccagatccagatgcagaggtcattgctctctccccgaagaccctcatggcaacgaaccgatttatatgcgaaatatgcaacaaagggttccagagagaccagaaccttcagcttcaccgaaggggtcacaaccttccgtggaagctaaggcaaaggtccaacaaagaggtaaggaagaaggtttatatctgccccgaacaaacctgcgtccaccacgaccctgcaagagcactcggcgacctcactggcatcaaaaagcacttcagcagaaagcacggtgagaagaagtggaagtgtgaaaagtgctccaagaaatacgcagtccaatcagattggaaagcccacaccaaaacctgtggcactagagaatacaaatgcgactgtggcaccctcttctccaggaaagacagcttcattactcatagagcattctgcgatgcattggctgaagagagtgctaggctcacatcagttacaacaacaaatctaaatttcaagagtgaagagggtggtaataatgtgatgaactcgcagcagcatggtttgggaggacatggactaattggagcacaaagtcttcaaaatgtttctggcattccacaatttggttcacatggttttcgtttggatttcaatggaatggaacaacaaattaggccaagtttgtcactatggttgaaccaggggaatcaccagatgaatagtaataataataacattaatagcaacaacaatagtgcttccgatgcgggacccaattacatgtcatcatcaggtttgcctgagattgtgcaaatggctcatgctaatgctttgatgggttgttcttcatcgatggtgtctaattttggaggagttcatgcgggttctaattcgagcagtgcaaatctttcactagggaaaagaggggaagcatgtggaagtactgtagtggacttggcttctatttataataactctgagggtcaaaacaagaattcaaagcctgcttcacccatgtcagcaactgcgcttcttcagaaagcagcgcaaatgggttccaccagaagcaccaacccttctattttcagtggtagttttggagtgattaactcaccttcctcacaaactaccagtctcaacaacaacaacaacggaggtgcagccatgatgctggcaagtaacacttctactgctgctgcaaatgcaaatgactttagctcattgaggcattcatcaaacagttttgaccagcttgtgatgcaaaccaatgcgcagttgcaaagtgagcctgtgaagttgaagcttcattcaaatggtatggagaacaatttgacaagggattttcttggtgtcagcggtggaggaggaggtggtggtggacctcagtttcttccccaagaacttggaaagtttgcttccatgggctcaccaatggggttgagccaattcacaagtaaccaatga

SEQ ID NO: 84843 - DNA, 150 bp, Glycine max
  Peptide Sequence Number=SeqID_201621
atggcttcctctcaattcctaatcatgaccacaatggcggtctttctcgccgtcgtctccgccgctcacgccgccgatgcgccggcacctagccccacctctcccgcctccgtcatctctccgtccttcgccgccgagatcgaggcttga

SEQ ID NO: 84844 - DNA, 378 bp, Glycine max
  Peptide Sequence Number=SeqID_201622
atgaacggcgtgagggcatggatgaggcgaaaccgtgaatggttagagggaggaaagaggaaagccgtgagattgttgatctacgatgaatttcattgtaaattttcaattgaaatctgttgtggaaatttcctttgttcattgagattttttcgaggtgcagaagatttcccagttttgaaggaacgggttcaagagatggagaacgagtcaattattcagagcaataacaatacgaacacaatgtctagtgttagagaaaaaaacggaggggatgggtcgttgctgttgagggcgaattccgatagcgctaggcaagcaacgacgtcggatttggtgttgcagtgggggaatcggaagcggctaaggtgcatgaag

SEQ ID NO: 84845 - DNA, 1368 bp, Glycine max
  Peptide Sequence Number=SeqID_201623
atggacaaagatcaggagtggttcattgccatgttcgaaacaattgacaaatggacttcagatgaaagaacaagggagagtatagtcaagatcaaatgtagagaggtgatggtgcaactaatagaggagtatccaatacagacaaagggtaggtgctactatactgaccacgagattcctgatgatgaactatctgtgttcataatggagaatgaagatatctcattatcaggatcagaatggtcaagagaggaagaaaccaaccatagagaaagctttcaggaggctattagcgacgatgctgacatgacgttgggacaaattgctcaaaactgtagcaaaaggagcaaggggaaagtaagaatggatgaagaagaagggacaatgcctaggccagagaaaaagaaaaagagggtggagcttgaggaaggaaaggtgatggaggtagaagtaggtaaggataaggaagtcctagagggattcgttgggaagaccaacagggagggtgatgctggcagtcgggaaagccacatagatgtaaaggatgatagggaaggccatattttaagccgtcaaaagggaaacataaatctgatagacgtgggcttgacaaaggagatgaaatcccaacatgttaatgttcaacaaaagtgggctgataggactacaaactcaattaatagaggagctaagggaaacaaatgtattaagcagggaattgcaaatgagaagattgatcaaacacgtagatatgaaagtatagggggtggacatggttatggagacaaatctataatgactcaaaagatccaaggggtggaggacacaaatatggtggtaacaggcgggaagaacaatgaagtagaagaaaaggttaaacaaagggttcaatgggcaattatacaagaattcaagagactcaacctaatggataaatggtgtttggtggaagactccaattcagtgagaagattgggagacagtagaagacattatcatattgctataggtggcattgagatgaaggaattcaataattttattgaagacatggaagtggatgatctacctttagtaggtttgaaatacacatggtttagatctaatggtgtagcaaaaggtaggttggataaatgcttaatctcatctagttgggatgatcaatggttggggaggagtattcaagtggaaggatggggtgcatgtatgctcaaagaaaaattaaagcgtcttagaggaaggctaaaagagtggaatacacattcctttgaaaacttgcacgatagaaaggaaataatagaggagaaattgtcgtcttttgacaagaaagatgaagaaggaaccttgtgtgaaggatgtagcgactag

SEQ ID NO: 84846 - DNA, 1548 bp, Glycine max
  Peptide Sequence Number=SeqID_201624
atgacaagcaatggtttgaacttgtttcaattccctcgtcttacaaaatggaattatgataatcggtgtcaccgcatgaaggctttggtaggttcccaagatgtttgggaggttgtggagaaaggttatacaaagcctgaaaatgaggattctttgccacaaactgagaaggagactttgttgaaaatgaagaaggatcaacaagcacttaccttcatctatcaaggtttagatgaaggcatgtttgagatggtgtccaatacctccacctccaaagaagcttgggagattttgaagacatcccttgaaggtgttgacaaggtgaaaaaggtgcatctacaaactcttcgtgaagagtttgaatccttgcaaatgaaggagtccgaatcaattttagattttggcaatagggtgataatggttgtgaaccaaatgaagcattatggagagaatatggaagatgttcaagttgtagagaaagtcattcattctttaactgcaaaatttgattttgtggagaaaaagagtcatggaagtggccaaggaagaggagaccatgacaaatgtgataataatgaaagaagtaatcaacccactagaaattatgaaagaggaagaggtagagacaattttggaagaacaaatgaaagaagagccaatcttggaggtgagaaagaagaagataaagagccaacactattgctagcacataatagagaagagaatggtgataagaacttgtggtatattgacaatggagcaagtaatcacatgtgcggttacaaggagaaatttgtggagcttgaagaaaaggagaaggaaaatgtttcctccgatgattcttccaaggggtatgaagttctcatgaaagataattgtctatggcttaaagatcaaaactctaatttgattgctaaggctcttgtaaagaaggagagtggctatgtaatcaaggctctaagatctaatagaggtggtgaattcacatcaaaagaattcaatgagttttgtgaaaataatgggattcttcaccctctaacggttcctagaaccccacaacaaaatggagtggcggagagaaaaaatagaactattcttaatacgactagatgtatgttgaaagctaagtctatgcccaaggagttttgggccaaagctgtttcattctttgggagcattgcaaatgctcacgtgcccgaccaaggaagatacaagcttgatgataggagtgtgaagcatgcgatcattggttatgttgcaagttcaaaaggctacaagttgtacaattcaagcaatgggaagattgttgtaagtagagacatagaatttgatgaagaagagacatggaatcgggagaaaaaagaaggcacctatgttttcctttcttattttgaagaaaatgatgaagaagttgcagcaccaaatgagttttctactccacctccttcaccaactcattcaattcatgaagcatcatcttccgcagggagttcaaaagctatggaagagaaaaggaggagacgagacattaagaagaatgatatttag

SEQ ID NO: 84847 - DNA, 762 bp, Glycine max
  Peptide Sequence Number=SeqID_201625
atggaggacggggataacattctggatgccatatacgaggaggataccttagatgatgacgttgacatggttgatgttgaagaaggagagttggtggagcctgattcccaaaatgttttgggacaaagcagtgccggagatatcaacgaaccaaatcaagaacctctcagtaagaaccaaaagcgtagagctaacaagaagaagaataagaagaaaaggaagggttcaggatctaatgccatggacataaacagatttgtgttagatacatgtcgacggctcaaagagaaaaagtcatacatggtatacactgctgtgggttgccttggggtctctgcattaagtgatcttgtcaatgaggtggatgcaatacagacttgtggaggccagaaaactgctgatggtagacgattccggacagggggtggcatattgtggagcatcttgaaagttagggaaccaaaggtctacaaagagataataaaaaaagcaaaggagtttgagaaacaattcaggcaacctaatgtgatgcaacgaccggtgccaaagaaagaggattcttctcaaggagtgccagtttcattttctggcagggatctcggcaatgtttcggacagcaatattcttgcatcccagatgcaaaatcaacatcaaccagcaactttggaagaaaaacctgtatctgctcatgacaggttaaggatacctgtatcatatgatgatgatcttcttggagagaatccaatcaatgatgcaacctga

SEQ ID NO: 84848 - DNA, 891 bp, Glycine max
  Peptide Sequence Number=SeqID_201626
atggcttcccaaaacccagcggaggaagaaaattcaaagcgacattggtcccttgaagacttcgagatcggaaaacctctcggtaggggcaaattcggtagagtttacgtcgccagagaagttaagagcaaatttgttgtggcgttgaaggttatatttaaggaacaaattgataagtacagagttcatcaccaactgaggagagagatggagatacagaccagtctccggcacgcaaacatcctgcgtctttacggttggtttcatgatgctgaccgtgttttcttgattcttgagtatgctcataagggagagctttacaaggagctgagaaaaaagggtcatctcactgagaagcaagctgccacgtatattttgagcctcacaaaggcgttggcatattgtcatgagaaacatgttattcatagggatatcaagccagaaaatttgttgcttgaccatgaggggcgtcttaaaattgcagactttggttggtctgttcagtctagaagcaaaagacataccatgtgtggaacattggattatttagcaccagaaatggttgaaaacaaagctcatgactatgcagttgacaactggactttgggtatcctttgttatgagttcctctatggtgctcctccatttgaggctgagagtcaatctgataccttcaaaaggataatgaaggttgatctaagcttcccttccaccccttctgtctctatagaggcgaaaaatctgattagtcggctcctggtgaaagactcctcacgaaggctctctcttcagaagataatggagcatccttggataatcaagaatgcagattttgtggtgttcaagtgtttaatcaacttgaatgacacattacctttgctgcgaggttag

SEQ ID NO: 84849 - DNA, 294 bp, Glycine max
  Peptide Sequence Number=SeqID_201627
atgcctgagcctagatgggtcgtctcaatgggaagttgtgctaatggaggaggatactaccattactcttactccgtagttcggggatgtgacaggattgttcctgttgacatatatgttccaggctgtcctccaactgctgaggctttgctgtatggactcctccagctgcagaaaaagatcaataggcgcaaagacttcctccactggtggacaaagtttcttctctaccttataccttccgcacctcctttcctcaacctcctcactgttcgcccttcaaaaagaaattaa

SEQ ID NO: 84850 - DNA, 453 bp, Glycine max
  Peptide Sequence Number=SeqID_201628
atggaatattattatttatccacgcacaaacaaagcaaatcagtgcatcgagtgaaaaggaataaaaatagggaagtaaaaaaccctagaaaagggaaagagggaatacttgcgaagagcgggagccatcttgttggtgagagtgccggcgacgatcatgcaatcagactggcgagggctgggcctgaaaatgatgccgaagcggtcgagatcgtagcgggcggcgccggtgtgcatcatttcgacggcgcagcaggcgaggccgaaggtcatgggccagatggagccgcggcgggcccagttcatcagatcgtccaccttcgagatcacgaactccgccgccttcgaaacgccggcgggagaggaagcggacggaggcggtggcggggcatatggtgtaggcgtggctgtggatggggatgcgttcagagatgggagcgttgtgtggagtga

SEQ ID NO: 84851 - DNA, 906 bp, Glycine max
  Peptide Sequence Number=SeqID_201629
atggcggaggaagcacagtactcatcgggacccgattccgcgcccctcaagcgcaagtacgaagaccaaccctccggcatcgagcttgccaagcagcgtgctcaggaagtcgccgcacgcctcctcaacgccgctcctcctccgccactcgacgccaagcgtcccaaacccgacaccggcttcgattctctcgatttgaagcctctgtattccgcatctcctcctcccgtctcctacggtcaccaaggttccagcaagaagattgatatccctaatggcagggttggtgtgattattggtaaaggcggagagactattaagtatctccagttgcagtctggtgccaaaattcaaattactcgtgatattgatgcggaccctaattcttccactaggacggttgagcttatgggcactcctgaagcaatttcctctgccgagaaactcatcaatgaagttcttgctgaggctgaatctgggggttctggcattgttactcgaagattcacgggacaagctgggtcggatgaatttgtcatgaaaatcccaaataataaggttggccttataattggcaaaggtggagaaactataaagaatatgcaagcttctactggagcacggattcaggtgatacctctgcatcttcccccgggtgacacatcaactgaaagaacattaaaaattgatggtactcctgagcaaattgagtctgcaaagcagttggtttatcaagtcatcagtggcgagggttatagtgtctattggaccattggtgacaccaacatgaattcctttgttggtgttccctcagcatgccctggtatggttctaaatctcagttttgatatttattatcacgggcagcatatcaacctgaaatttgcccattgtgaagcactttaa

SEQ ID NO: 84852 - DNA, 492 bp, Glycine max
  Peptide Sequence Number=SeqID_201630
atggcagttggagcagtggacgcatacgccatggttgattcgttcaacattcacgagaaaatgaactctcaaatcttcactggcgtgatggcctttgtgatgggcatagtgacaatggtgaggatgactaagaacatgccaaagaagctcacagacgccaacttctactccaactttggtagcgaatacaaaggacaggctacaaattcagaggaaatgactactatgcctaacatctctgctaaagagttcatgactgtgatgaaacgcatggctgagttggaagacaaaatggtcaaaatgaacaaccagaccatctgcatgccgcctgagaaggaggaaatgctcaatgctgctatcaccagagcagatgctttggagcaagaactcttggcaaccaagaaggctttggaggattcactttccaagcaagaggaactttctgcttacattgagaaaaagaagaagaagaagaagttgttcgcttggtaa

SEQ ID NO: 84853 - DNA, 198 bp, Glycine max
  Peptide Sequence Number=SeqID_201631
atggctgatcgatgtggagtgaatttaaagcagaccagtacagcctatgtgttgagtgaagccattggctacatccatttccttcaccaacaaattcagactttgagcatcccttacatgaaatccgcacaaagcaagccctctagaatggtgcagctgaatttgactcctaggcgaagagtaaactttagaaaataa

SEQ ID NO: 84854 - DNA, 355 bp, Glycine max
  Peptide Sequence Number=SeqID_201632
atggagtttgcccgtttccatcttcagcatcagctccaagaagaatctactatgtgtataacttcaacaatcccaccacctgactctacaccttcctttatcactaatcaatcatggatcccaagcaacatgtacaatggctatgaccgtgggtttctaactgatcagtgcttcacaaattcaagagagctacaactgaagcacgccatgactgattcacttagaatttcaacaaggcaagcctttggttttcacaatggaaaaagcctcataactcagcatccagttagtgataataataatctctttcctgcaagaatcttcaaaggtggaatgatcaatacctccatgaagg

SEQ ID NO: 84855 - DNA, 282 bp, Glycine max
  Peptide Sequence Number=SeqID_201633
atgaaaggcgatgtaccttcttgggaagaaggcatggtagatggtttacttgttactaatgaagtgatggatgaggcagaaaagaggaagaactatttggttgttgatgttgattttgagaaatcttgtgggctagtatcttcaccagtctcaattttgattaatggtagtccaacgaaagaatttagacgacaaagaggactaagacatggtgactccattacacctttcttgttcctcttggtgtcgaaagacttatccgatttgataaggcatgcctga

SEQ ID NO: 84856 - DNA, 1779 bp, Glycine max
  Peptide Sequence Number=SeqID_201634
atggccaatgtgcaatggcgcttccaaattttcagcgaagaagcaaaccaaagagcaagcattagaatgtgcagcgacagcgaacaacaaggatggcgttacacatgggaagcacagtcccacatcccaacgctgcgtttaacgctcttccctaacgacaaaaccctaaacccttctctccaatgcaaagacctcgccgtcgatcttcactcctcccactccttcctcactctcacagcctcctttctctcccttagggttccgctccccgccgtcttggtcgatggcgactctccggtcgctttccggcctctctccgaccacatcgaggtcaagctcctcctcctcctccccgtcgaccaccccatcctctccgccctcgacctctcccaaaccccgccgccggaccctctcgattcacaatccgatgtgaaaattttgtcttctgcaggagaagttgacttctactgcagaacttgtgccttcaagttgaccagaattcctctcaggaattttgttgaaatgccatcggtgaattggagagaggtggcggacaattggtttggagcttgctgttgttcgtttggagggataagtgagaagatggccgggggtatgtctaggtgtggagagcaagaatgtagtactgtaacagaagtctccagagatgatggtgttgtcaaaggcatgcgaaactgtgaattgaatgatgaaagaacttcaacttgcagtgactatggtgaagtgacccatgcttttgatagcaattctaggcttgtacatcctgaggatgagaagctttctgtgaatttgaggtgtgaagttgcgaagagtaaacctggttgtggtgacttccctgattcatgtccagatttgaatcatgccgaagatgtgacccaaactcctagttgttgtgctcatttgacaagcaatgttgggcatggagacagtgaacacaatttatgtggaactgctggaaagaaagggatgccaacagagactgtggaaattctgggaaatcagaagtctttcctcaacggttatcttgaagatgttttcatggctagattatcaaatctttctaaggatattgattggcgtgaatttacgtgccctcaatgcacgtctctccttggagcctacccatgtcgtgagggacagacacctgtagatgggggagtacgatttttcaaatgttatatttcaacttgtgtgcaagttggaggatcaggggatatgttcagaaaaagcattaagtctcaaaaattgaagtattggtggacaaaacttctgccgatggcagtgctattgcatgcttcaggaagtccttctgcttgtagcacctacaggctacagataattaaatatacaatgggcaaaatgtttgcaaatcagttgatggagtgtgcaaatgatgaatcatcatttcggtttgtcattagagatctgacaaccaaatcccccgtcctgcaaatcattctcttaaatccagatacttggtcatgttctgggaattgttctagtttagaagacaaagacccaattgctaaattaaagttacagcccataatcaaagtgcttttttctgactgccacaatgcaacagaatctcaatcaaggttgatagaggaatgggcaacaaagaattcggctgaagacattttcatgttgactcgtcaaacacaagaattggtggggttgttcatatcagcaaaagatttatatccaccttgttgtgcttcccttcaaggtttaattttgtcatctttgcaactgtag

SEQ ID NO: 84857 - DNA, 276 bp, Glycine max
  Peptide Sequence Number=SeqID_201635
atgggacgaacagcccaggtaaatatcatatgtgggaaatgtttgaatggacaatgtaaaggtcgtcctggatgcatatgtaatgtcacaaatgaatcaaactgcagagttttagttgatcttgcaattccatgtgataaaccgggccctccagtatttcaaggcttcactgttggttttcatccaagatcatgggaacttgtgagcagactctaccacttccacttatatgtatttgtttgcttgaaggatatatgcatattgcatagcacctag

SEQ ID NO: 84858 - DNA, 201 bp, Glycine max
  Peptide Sequence Number=SeqID_201636
atggcttataaagcaggggagaaggtattaaaaaagaaaaaggatgagatctgggagcaaaatgtacgggttgtccccctacttatatactttaatttggtcatatctctagtcgttgtgggactaaaccaccaccctcgaggttgcaacttaggcaaccccaaagaggccgcaattaaggcagagctggactgcaattaa

SEQ ID NO: 84859 - DNA, 225 bp, Glycine max
  Peptide Sequence Number=SeqID_201637
actggtggaccaagctggctagtatccttaggtagaagggactctcgagatgcaagtataagtggctccaacaacaacataccagcctcaaactgcacattccagatcctccaaacaaaatttgagcaacaggggcttaacattactgatctagttgctctatctgttaaagctataagttcaccctcaagccatattgccaatgcatgcattgaaggagtttag

SEQ ID NO: 84860 - DNA, 267 bp, Glycine max
  Peptide Sequence Number=SeqID_201638
atggtgatgcaatggtgcaatattggagggagaaaaaaaaaatgtcgaggtggaaaagaggtgaagctattcaaggtagggaaaccgaatgaagtggacagggcgagtatgggagtggaggtggtggagtggggtgcgggacttcatgtcaaagcgaaaagaggtgcaggcgacgatgtcagagaaggagttcagagaaggagtataacgtatcgcaaaaaaaagaaaaacactttagtcaatgtagaagaagctttgaagaaataa

SEQ ID NO: 84861 - DNA, 672 bp, Glycine max
  Peptide Sequence Number=SeqID_201639
atggcggattcagtgtcggtggacatggaagccatctctcctccacctgaggaacatataataagaactcgtcatggtcgtgtctccgttgctgtgtatggggaccaggacaagccagcgctaatcacgtatcctgatttggctttaaattatgtctcctgctttcaggggttattattttgtccagaagcctgttcactgctgctccacaatttctgtatatatcatattagtccacctgggcatgagttgggagctgctgccattgatccagatgatccaattctttctgctgatgacttggctgatcaaatagctgaagttcttaactattttgggctatggtataaagttttagagattttggaacagaacaaaaggaaagggaagatgaagtatagacatcgtgttcttggtttggtactagtttctcctttatgtaaagcaccatcttggactgaatggttgtacaacaaggtcatgtcaaatttactctacttttatggcatgtgtggggtggtaaaagaaatattgctaaagcggtactttagcaaggaagttcgaggcagtgattatttgtcagagtcagatgtagttcaagcatgccaaaggtcattggatgagaggcagagtttgaatgtgtggcggttccttgaagcaattaatgggtaa

SEQ ID NO: 84862 - DNA, 696 bp, Glycine max
  Peptide Sequence Number=SeqID_201640
atgtctttgactaacatccaagacaatgatattccaatccagaaatttagctccacagaggtatacaccgtgaaatcaacataccatcccttgatggaaagaatgatttgcaacaagcacctcaaagtccaagggaactggaacatgctttggaatttacaacttccaccaaaaatcaagccttttctatggcgttctcttcgctgctacctacccatgagaacaaggcttcaaacgaaaggagtgcactattcgagctataggttaaaagtgtttgggaagcaacaggactctggtattaggttagccaacacatgggaattgttgaatcagcttctgaatttgacatttactcttctcgagaaacttcctatggagcttaaaaggaaatttgctatcaccctttggtgtatatggaagcgccgcagtgaaaaagtttgggaatcaaaaactactcttccaaacatatccatatcacatgccatgcaatacctttatgagtggaccaatgcgtgcacaacaacaacgaattcagttctcaacaattcaaaggtgcttgcttcttatctaacttggatcaaaccacatcatggttttgtcaaattagacattgatgcgcattcaacgatttttaaagatcaaaatctctttgaagctggcttggtattgcgcgacaatcaggggtgttttctctaa

SEQ ID NO: 84863 - DNA, 384 bp, Glycine max
  Peptide Sequence Number=SeqID_201641
atgcccgtaacaaggagggagcaaaaagaaaagttagaagaagggaaagatccaagtgtggtcattgccaaaaatataggagacacaagagaaaaatgttgtgaggttaaatggtacccactcaactggaagaaatcaggccaagaaaagaaagacaacgcaggatcatggaatgagaaaagtggaccgaaactatcttacatggacattgatggaagcctgattcctagtaagaatgtgaaattgccaaatgacattgatgttcacattcttttaaacattctagacttcaagtgtaatttacttctagacttgtttatgaggaacctgagtagaatgggtaagcaacaagatgggctatataccttctccagccttatataa

SEQ ID NO: 84864 - DNA, 454 bp, Glycine max
  Peptide Sequence Number=SeqID_201642
aatttgatgagttcaaggatgagctgatgagaaggaaatgggatgaggaattaactagttttgctaaaggtagcatcgatgttgccattgtaaaggaattttacgcaaacgtctacgacctagaagataactcacctaagcaggtgcgggtcagaggtcacttgattaagtttgatgaggccacactgaatacattcttgaggacccctgtaatcatcgaggagggggagacattatcagcttactctagatttgcactcttgaggcctgatcctcaagagttggctactaagctctgcatcctggggaggggatttgaactgaatgctgatggtcagcctctgaagattttaaggaagaacatgatcacacttgctcagacttggagtgttctttcttacgccaacttggtccctacctcccacacttctgacatcacaatggatcgggccaa

SEQ ID NO: 84865 - DNA, 333 bp, Glycine max
  Peptide Sequence Number=SeqID_201643
atggagcttaggtctaccttcaccacctgcttccttctcctgattctcatccttgccctcccttgtttctcaaaaggggaatctgaagaattgcacacagagatatatgagattgattatagaggtcccgagacacactcttcaggtgttcctcctcctcatcatcacttccatattggtaagcagcattcaactcatcattctcaaaaaggctcagtcagaggaaccaaagctttgggcttaagggatggtacttacgatgaaaataaggcaagtcttttttacttcttcaatgtctctctttaccgcagagtattcaactattcatcatga

SEQ ID NO: 84866 - DNA, 903 bp, Glycine max
  Peptide Sequence Number=SeqID_201644
atgaagccacccacgaaacccatttcgagtcctggtcgaaccgagaagtttcctccaccattaatgagattcttgagaaacaatgcagcaagcagaagcagaggaaggtcaagaaccaccaccaccatgtttctgagaaagaagaacaccaacattgaaacacaagaaccctcttcccccaaagtcacttgcatggggcaagtccgcgttaaacgctccgccaccaaaagggtagactcagacgccaaaagggtaccctccgccggcgccggagctccgaccaagtgccggtgttgctcgtgggtcccacatgctctgttttttcaccgtttcagaaaacccggttttagtttcccctttcagtgcaaacaagttcggcccaattgggggttcttaaaaagaaagaaaacggattccaaagtcacagaaacttcttcgccgaaaacagagttgaatttcaggggaaggcataaccctagttacgatgactcagaacatgaagacagagttaaccctcccgcttttgtttccaacacttcaactactccaccgaggaacgctttgttattaactcggtgcagatccgcgccggggagaaggttcttgaacaaagagacagaggtggttgaaaacagagtaaacagagaacactctgagaataacagagacccgaagttggaggcgaagttgcgattcttcaaggagcttgaagagtcgctgagggagagaataatggagtcagaaaaacaaagggaagaatctgattctgttcatcctctggtgctgacgaggtgcaaatctgaacccgcgagaaccgcgcaaaaactcgatcctgaattgaacgttctttcggagaagacaacgttggggttcgctcgtgcctggttttcacatgttttgtga

SEQ ID NO: 84867 - DNA, 1170 bp, Glycine max
  Peptide Sequence Number=SeqID_201645
atgtggcaccttctcttactcgttgccgtggccggatccaccggtttcgccaccaaacgtttccttactcaccacagaaacaccggtgagggtgaaaacgtcaacctccacgatccaaatgagttagacttttccggttccgaaagcatttctcagacacatcacagtgacggggtcttcacgttttccagttccaaatctgagtctctgacacaacgagatggacctaagagtagaagatcccgagcctccaagaacggagttagggctccgaaggttgaggcgcgatcggagaagaggagcggtggaacgagattacactttcgcttgaagaagggggaaattacaaagaatgtcgctgcgaaggctccggttcgttcttccaaagatgactgcttatttggttggggattttgctttggcatcatgtatatgatgtcagctggaaaagctgagatcaataagctgaacaagaccatggatgagacagctaaacttgttcaggaactgaaatctgagctcaacagaagaaaatcatcacatgctcttcaaattttggattctgttggcaatggtgttaagaactcttgcaaaatcagtggcaggaatgaagtgatgctcaagaatacaaacattgagctcagagacgttgatgtcaaaatttgtagtccttgtgtaaatgattgtggtgaatgtggaagcagtgctcttactgaagaaccagaaccacaggttctggaaatggatcaactggaagcagaacttgagtttgaactccaaaagctttctgggtgtgctactgatggcccttgcaatgaaaaaataaagccaaacttagatgagcttgaagctcccaatgaaggctatcatggaacagatgactggaatttaaattattctaattcccatggagtatcagcatctgaactgcatcagaaactaagccacttgctgataaaacagcaagaaaatcagatcgcggagctagaatctgaactgcaccaagctcaatcaaatctgcatgagaaggaggctgaacttcaggcacttaaggactgtgtcaaatgccttactgaactctcgctatctacagtttcaggcatgattatctctatattagtgacacatttttcatgctcacaaactcctttcatgtttgtcattggataa

SEQ ID NO: 84868 - DNA, 252 bp, Glycine max
  Peptide Sequence Number=SeqID_201646
atgtcgcaccttagtcacgctgtggaggaaagcggtaacgggaagtggtctgaacttacacgagggagagttctgcaattaatcaagctccataaattaaagctatccttgtcgcaagtggctctatccagcctcagcgatatgcctccatttctaccatttgaccaagtgagatcaacaccagaagtggggaggtgcaccaggctacaactatctgtccaggcccaaaaagtcattaaaggagtgcaataa

SEQ ID NO: 84869 - DNA, 201 bp, Glycine max
  Peptide Sequence Number=SeqID_201647
atggagtatgggggtggtgaaaaacagtcatataagagaatgaattacctgattgaaactacagtgttgatgttagtgttgaatgctgaagtcgaactccaacggaccgcggcggtcacgaaccccagcgacaacgatggtgtggaggagaccacagtgacaggtcttcgcggtgagggagaaagaggcttttgtttctga

SEQ ID NO: 84870 - DNA, 225 bp, Glycine max
  Peptide Sequence Number=SeqID_201648
atggataagccatatgttagtgatttgggttattctcactttcccacctcgaaccagatgtctactcttggtagagatattggtgtggggagagtgacattgccaatggctgttttgagtgactttgaatcggaggaggaagaagatctttacctaatggaggaaaaccccaaggaaaatctagatgtgacttctcgtggttgtttttctagaggatttgcttag

SEQ ID NO: 84871 - DNA, 237 bp, Glycine max
  Peptide Sequence Number=SeqID_201649
atgggtcgatggttgtctccttgtcataaggatttgaaaaatgttgggcgtatgagaatgactccccaacgactctccctactagattgtccatcaagattcagtgtggattccttgtcaacggtacctaactatagtcgtccatggagattccctctccctcacaagcatagtagccccaaatgtgaccctgacttccacaacatgtcctctagcatgaccggaattcccagctga

SEQ ID NO: 84872 - DNA, 315 bp, Glycine max
  Peptide Sequence Number=SeqID_201650
atgggttttcacccaaccaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 84873 - DNA, 901 bp, Glycine max
  Peptide Sequence Number=SeqID_201651
atggatgatcgagcgcaggtgcagtttcttggtggtgaccagcgggaagccgtcggccaggttgaaaagcatctgccagccgaacacgctgcgggtaccggtgccggtgcggtcgctcttctcggcgccgtgctcgagcacgtgcgagagcaggtccagctgcggctgcagtaccggcgcgcggcgcgacatcaccagcagcaccaggccgaaggcgatcagcggcaggctgaggatctggccgcgggtcagccagtcgaaggccacgtagacaccgttgtcgggcatgcgcacgaactccaccgcgaagcggaacagtccgtacagcagcgcgaacaggccacccaccaggtaacggtggcgcggcttggccgacacggcccacagcaccacgaacatcaccaggccttccaggaacgcttcatacagctgcgacggatgacgcgcgaactggttcagcgcaccggtcgcgaactgcgtctgcagggtcgcgtggtccagctggttcagcggcgccggcaggccggacgggaacaccacgccccacgtgccgtcggtgtacttgccccacagctcggcgccgatgaagttgccgatgcggccgaagcccaggcccagcggcaccagcggcgccatgaaatccatggtgtcgaagaagtgcagcgcgtgcttgcgcgaccaccaccagcaggcaccgagtacgccgagcaggccgccgtggaagctcatgccgccatcccagaccttgaacagcagcagcgggttgtgcaggaaatcgcccagcgcgtagaacagcatgtagccgatgcgtccgcccagcaccacgccgagcatggcgtagaacagcaggtcggagaagccgttggcatcgacgcccggcaggcgaccggcggcgatgcgc

SEQ ID NO: 84874 - DNA, 129 bp, Glycine max
  Peptide Sequence Number=SeqID_201652
atgcatctagcgacaaatatcagcaaagaggtttggggcacagaaattgaggacatgatgacgatgggcactggaacaacgacaatggtcacaatggaaacgatgacaacaatgagaggcgagatctag

SEQ ID NO: 84875 - DNA, 321 bp, Glycine max
  Peptide Sequence Number=SeqID_201653
atgcgccgcttcaaggaaactgaggattgcttcatcgtaggttttgacccttccgccgctgccgttcctctcttggttgattcttctgccaatgatgtctccgtcattgctgaaaagggccaaatatatgtaaagcatttacttgctattttatgtttattactcactaccacaaaaacaagcttctacatcggtggaaaaccagcatctacgacgggcccaacaccgtctttgttccaggtgtcgttgtatgtcgacaacaacgacatcggtcaactagcacccgtctttgtaatggaaaaaaacaacgtcagtggctag

SEQ ID NO: 84876 - DNA, 333 bp, Glycine max
  Peptide Sequence Number=SeqID_201654
atgggggtgcaaatagcaattttgaaattgggctttcaaagctggattgcttctggaggaagcaacctagctcgcttgggcgagctgggcggcaaccttctccccttttttcctataaataggctgaagggggctgttctaagggtcccggatccccctgaaaatccaagccgaggtgctttcgtaacgctttcgagatgtttccgtaagcaaatccatgaaggttttcctccgttattcaccgttcttcatccgttcttcgttcttcaacgggctaaaatcaactcgcaaagtcaagctcgtctccgaaaaatcactaaaaaaggattttaa

SEQ ID NO: 84877 - DNA, 447 bp, Glycine max
  Peptide Sequence Number=SeqID_201655
atgcataccggggcaagctttcacccagccgctacaaggagacgagtgtggatcgtgcgcaccaacatatggatgacgttgctacttagcaaccttcttcccagtgaccaccactccgatctccccctgccaaaggatcgcgcctgcaagacacccagtggacccgaagaagtccaacagggccctagggttctagctctgattacgggcctctgtcggttctacggagtgaccaccactccaatctccccctaccgaagtgtcagctgggattgcgcccacaagacaccaagtggacccgaggaagctcaacagggtcctggggttctagctctgattacgggcctctgtcggttctacggagtgcccgtcgcccccaacaaggtcatcaggccaccaattaaccaggctttcatcaagaagtactgcgcccccaggcaggcgtag

SEQ ID NO: 84878 - DNA, 304 bp, Glycine max
  Peptide Sequence Number=SeqID_201656
atgcgtttacaaggcaatgcccaattaattgatgatcaagaaactactaaatttgcaaagtggattctagatattggagatggagttattgggaatcaaaatgatggatatgctactattgaaattcctgagtacctactgattactgaatataatgaccccattgatgctatagtcaaatcaacatttccagatttatatcaacatcacagtaatcatgaattcttcaaatctagagcaatattagcttccaccaatgaaacagttgaagaggtcaatgattatatactttccttgattccag

SEQ ID NO: 84879 - DNA, 159 bp, Glycine max
  Peptide Sequence Number=SeqID_201657
atgaccaggccttgcttaaagggaatagaagagaagactgccaagttgaaaggaagtgagaaggctctagttgcacggcatgaagctagtcatgctgtagtaggtactgcagtagcaaaccttcttgctggacagccacatgttgagatatgtggatga

SEQ ID NO: 84880 - DNA, 441 bp, Glycine max
  Peptide Sequence Number=SeqID_201658
atggttgtattggcaacagggcctggtataggaggtggggtgctggaaaagccagttattgaaaaagtcacccctggcctaaaagccagcctaaaacgggtgaaagtatcttgtggaagcacaaagatgagtaaaacaaaagaaagaatatttgattctggtttttctaagatgtgcaggaaatcacggaaatcggcaccgccctatcgtgtaatattgcacaacgacaactttaataaacgggaatacgtggtccaagtgctgatgaaggtcatccctggaatgacccttgataatgcagttaatatcatgcaagaagcacactacaatggattgtcagtggtgatcatctgtgaccaagccgatgctgaagatcactgcatgcagctaagaggcaatggattgctcagttcaattgaacctgcaaatggtggttgctga

SEQ ID NO: 84881 - DNA, 381 bp, Glycine max
  Peptide Sequence Number=SeqID_201659
atgctggagaacaacctattcagtggcgttgcccatgaagatcctatgccacacctgaggaagttcaccaagttaaccaacatggtgagacagaaccgtgtaccaatagagacaagtttagatgctgcttgtaggggtaacctcatgttaaaaacccctattgatgccatcaggatcattaaagatatgtgttctaacccctataacaactcaagggataggaggattatgaagagaaacatcaacaaggtggagaaagatgattcccaaattgaattgggaaagcatatgcaagctctaacactaaaaattaagacactcatgagagctcaagctcaagttcccatcactacacctctattcccaacctatgatagatga

SEQ ID NO: 84882 - DNA, 762 bp, Glycine max
  Peptide Sequence Number=SeqID_201660
atgccaaatgttgtgatgactagaagcaagagaattctagaggactccgaggagaaggaaggttatttcccaaaagctgtagatgacgtctttattgagatggatcaagcacttaaaaaagttgaggttcctactgatgagaatctagtgccaaagaaggatgggaatgaaaagcaggagatactgacatctcatcaggtaagtctaccctttcctcatagagttaagaatgaccaacgagatgtgcaatttagaaaaattcttgaggttatgagtaaagtgcacatcaacctccctattgttgagaaattgggcataacagacttagagccaactaacatctcccttaaccttgatgactattcaattgtctatcttagaggtgtaattaaggatgtgttggttaaggctaataaggatgtccctatcatattgggacaacctttccttagtacttgtgatttgcttgttaagttgaaccgtgaagtggaggaaatactaatgtttcttcactctcaacatggtcctaaaccacctagttatgaaagggacaagagggaaacctttgggtggagcattcatgtcatgaagggtttgggccccacactctacacccacaagatcaacactaaagatgggtctttacctaaatggtcatcccaaaggaaacttattcccaacatgatggaagttgtcaaaggagaggatgttaagcccattgtcaagatgaagacatacgatgagggattccaacaagtgtaa

SEQ ID NO: 84883 - DNA, 315 bp, Glycine max
  Peptide Sequence Number=SeqID_201661
atggagaagggtacaatcaaacagttacatcataactttcggactgggggactagccgctcatgatcaaagcaaaactagaaatcctatacaagatagacacatatatactaataaggtaggaatgatggttacgatccatcctcacagtgttgtccatgcttcacaactcttaaaagccctaaagatatcagtgtctgaaaaggctacaactgtggtaaaatccaccatgatggttgtcgaaagtttcactaaagctttgaggtattgtggattgaatatgaccctcatagttgaccttgaccctcatagttga

SEQ ID NO: 84884 - DNA, 204 bp, Glycine max
  Peptide Sequence Number=SeqID_201662
atggattactcaatccagagttatgattcccatcactgcttccatttcacgatgaccacactttttgactcattcgatgtcaatgtgcgtctcccttctattgccttctttcctgtcaccatgcatcaaacttctgttaagctcccacactacgccacccttaggctcaaactcgttgccaccatgagaagtggcatggagtaa

SEQ ID NO: 84885 - DNA, 177 bp, Glycine max
  Peptide Sequence Number=SeqID_201663
atggtgggttatctcattgaacaaagtgcacagggtagtgagcgattgagcgtcacagatcgagagagtgagaaacgagagagacaagagttgagacacaagagagatcgagagagtgtagcgcagttcagccaagcaccgttgcttttgaagcacaattgcttacttggctattga

SEQ ID NO: 84886 - DNA, 1221 bp, Glycine max
  Peptide Sequence Number=SeqID_201664
atggctcatgcacaacctgaacctattgatggctccttcttgcacttacaagacaatcatatttcagatcaagaaaccataactttacaagatgtggccttgcagttgggccttaagattggcagactgcctataaccggtgccattactggtgatgtacgtgttgcttgtcaggccttactaggggacacttcacctgataagtatatcaagggaaaaatgacttatttaacctggttgcggcaaaattttcagcaacttcctattgatgttgatgatgttgtcattgcacaacatgctaaagctcatatcatgatgctcataggcgaatgtttgatgctagatacattaggagcaagagttcattttatgtatcttcttttgctatcaaatttgattgaggcaactcattatagttggggtgcaacagtattagcatctctttttcgagctctagattgggttgtaaagcctttacaaattgaaattagtggatggagaccagtcgaggtcacgctgttttacgagaatgctccaaccatgtgggatcggcacaggcttaaaagagcactcaaaccgggtgtatttacccccaaggcctacactttgaagagtccgtcagggcctctccctcttgattcagcacgcttagcgcgactatggaccactaaacatgcattagtggatttcgacttagcacatgcttttctcgctcagcggatggactggagcggtgtgcttagcgggattacccttcactcaacgcaaatgcacagctcatctttcttccagattcttcctcgcgctcagtcgaggagtgttgcgctcagcggatggctcgctaagccagaagattggcttaacgagcggatgaaaatcagctcttcacatacttgcctaattaacctaaaattgagaggaaatggagtttcgttgctggtaatcgattacagacatatggaatttagaattcctgtgactggtcctgagtatcctatgtctgagcctcctcctcatctgttagaaggaaaaataggggaatcagagagagctaaagcttctccagatggggaatcggaaatgataatcaaaggtggagatgggggaactacttcaatctcgcagacatccggtcctatggttgctgacggaggagctggagtggatgatgaagggatgtcatatgctctagccctttttctcgatgccatctgtaactaa

SEQ ID NO: 84887 - DNA, 219 bp, Glycine max
  Peptide Sequence Number=SeqID_201665
atggtgcattgcctgaggacgtggaggcactacgagcctggatcggctcccgcggaagcaagtcgggaactggagctggagcgaaagaagaaggagctcgcagacgagacagtgcgaagagatgagatgattaagtctgcttcacgcttggctacccgcatcaagaacgcagtggaacggaagaaagaaagaacaggagctattcttgaggattgctga

SEQ ID NO: 84888 - DNA, 222 bp, Glycine max
  Peptide Sequence Number=SeqID_201666
atggcttttgtcttcgggtgccttgcctttaagttaaggcttcgttccactcctcttctgtcgctctcatctctgcctttcatttacatagatacccccttcttttcccactcgttagggcagcggttggagaggggagctaggcagggaagagccctttcaggcctgaagaataaaaaagatgccccatctcttatttcatatttaagaaaggggcgatag

SEQ ID NO: 84889 - DNA, 282 bp, Glycine max
  Peptide Sequence Number=SeqID_201667
atggtcactgacgacagcaacgattacgatgagggtagtcctatattatacacaattgtggactcaagtacagtgcttcaaaaacaggacttaacttggttaaaagaaacacttcccactgatttgcaaatgcaaacaaattattcaacaaatatgttgttatgcaacctctttgtaatcaaggctcgggatggatatgataggggatcttctatactgtctctcagctgcaaacaaggtgcgggtggtgatgctgacattgcaaagtttgcctgggactag

SEQ ID NO: 84890 - DNA, 174 bp, Glycine max
  Peptide Sequence Number=SeqID_201668
atgaagatgaatcagtacatcagggacattggaaactttgtgcaaaaggagaaagaaagtctactgaggcctaggaaaggttgcaagagatcattagaaattgtccacaccatggcattactcaaaaaagataggaggattatgaagagaggcatcaatcaggtggggacatga

SEQ ID NO: 84891 - DNA, 213 bp, Glycine max
  Peptide Sequence Number=SeqID_201669
atgaggaccattaagggaaaaggaaggagatgcttgccacccagctcgcccaggcaagctagattgcttcctccaaaagcaaccgtcttctggatggcaaatggcgcaaaattcgtctatgcgtgtttatcacccaatttgcgaaatctgaatggcaaagggcgcataattcgtctatgcgtgtttaccactcgactggctgctcctgaatga

SEQ ID NO: 84892 - DNA, 369 bp, Glycine max
  Peptide Sequence Number=SeqID_201670
atgatgtttgcatttacttctgccggtattaaatttgacaaaacaattagtcattcaagaggtcctcctacaatcagaattcaagaaaaagatggtcgtagatataatgtaccaagtgttccagaagttgctgcacttattgcaggatacacaatgattgaatccaaaagactttcctatgttagaaacaaccaaaagaaactcagagttgacaagttttgtagcttgcagcagtcatcggatgctggaaatacagaaggtttaggccaaggcaagaggatcatcttaccttcaacctttgttggcagcccacgttacatggatcaactttattttgatggcatagttatagtatatgcagtcacgtag

SEQ ID NO: 84893 - DNA, 315 bp, Glycine max
  Peptide Sequence Number=SeqID_201671
atgggcccagttttgtcagacccgcagagacccctcgtgggaggatgtgagaaaaaaagcataggccatccagaagcaaaacactgccccccccccccccacgtgttgtctcgtgggggttatgaatatttagaacaaaagcttatggcggagaagacaaagaaaatactggaggaagctgcccaatccggaagcactgtgggcgtcatagaccctccatctccgatcagacgccacatgaagtggaagatggcccgcaccaagaaaattgggcagatgacgtctgagacagcaaaggaaattactgagaagatt

SEQ ID NO: 84894 - DNA, 783 bp, Glycine max
  Peptide Sequence Number=SeqID_201672
atgtcacagaacttcacggattgtgcaacaatgctttcttttgacttccgccatgtcacagaacttcacggattgcctaacgatgggtgccaagtacctcgaagtggtcaaatgagggtcacatcccaacaaacggatggtccccggacgaaattgggcccactcatccaagatcaagtccaagattatccactaagtatgcttaggtgtcatgaggcatgcatccttctttcacagaccgcacccaatcccaaggaggaagtggatgttgagagtattagaagtggacaacctataatagaggagaaagccactccaccacaggaaaaagaggctcttattgaagagatccaagaggcaaacaaggcgggtgagaatgacgtactgacacctcctcaggcaattgatcaaatgcaaaagcacgccaaatatttgaaaggaattttttcaaataaaggaaagttggtggacttggctacaattggtctcaacaaaaagtgttttgctatatttttaaggaagttcccacctaagcttagtgatccaaggagtttttcaatcccttgtactattggcaacttaggaattgatagcgctttatgtgatttgggtgctaacattaatttgatgtcttattctattgataagaagttggcgttacaacaaccacaacccactaacatttatcttttgttggcagaacaagaacgcgaaagataccgaaagagagggtcaaaagggtcatttcagggagttttatggaccctggcttgcccaggctag

SEQ ID NO: 84895 - DNA, 942 bp, Glycine max
  Peptide Sequence Number=SeqID_201673
atgtcctccacttcagaggactacatgtcctccacatcagaggactacacgttctcccctttggaggactacatgtccttgccttacgagggctacacggcctcaccttttcaggactacacgccctcaccttcagaggattacacgtcctcgccttcagaggactacacatcctcaccttcagagggctgcacgttctcgcctttcataggagtacacgccctccccttcatagggctacacgtcctcaccttcaaagggctacacgtcatcgccttcagaggagtacacgtcctcgccttcagaggactccaagctctcgccttcatagggctacacacccccgccttaaaagggctacacgtcctccccttcagaggacaacatgacctcccctttagaggactgcacgccctcgccttaacaggactgcatgttctcaccttcacaggactacacaacctcgccttccgaaggctagatgccctcgccttcagaggagtacacatcctccccttgagagggctacacgccctcgccttcgtagggttacacacccttaccttcaaaggagtacacgtactcaacatcagaggactatacatcgtcgccatcagagggctacacgtcctcgccttcagagggttacacgtcctccacttcagaggactacatgcccataccttcaaaagataccttcataggactacacgcccttggcttcgtaaggcttcacgccctcaccttcagaggactacacatgctcgcctacagaggactacacgcctttgccttcgtaggactacacgccctcaccttcagaggactacacatcctcgttttctgagcgatacatgccctcgccttcagaggactacacgcctaacctttcaggggtctgcacgtccttgccttcagtgggctacacgtccttgcctttag

SEQ ID NO: 84896 - DNA, 237 bp, Glycine max
  Peptide Sequence Number=SeqID_201674
atgatagatgaagcactaacagatgatgattggatcattgcaatggaagaagaactccatcagttcaccaaaaatgatgtttgggcacttgctcctaggcttgaaaacaagagcatcattggaacaagatgggtgttcaaaaataaattagataaacaagatgaagtgtacgccaaacaacctcatgattttgaagatcatatccttccaaaccatacttttaagcttaaaaattaa

SEQ ID NO: 84897 - DNA, 372 bp, Glycine max
  Peptide Sequence Number=SeqID_201675
atgttagctgtaaggatgctcaagtccttcaataaaacaaagcttaccagtcaccgagtcactttacttcaaagtcccaagttgaagtacattgatctgtgcacttggcatgtcactttgctgtcaaagttgatacagaaagaagtggtaattacaaaatgctaccacttgttctgctactcatgtatccagaaagttgctgggagtaggcatcgcaagtgtccacaatgtgaaacttggttctctcccggatgtcgagaagaggctggtgttcttttgaaaaagatctggtgtatggatacctacataggaggttcaattgtatgcttagtgccaactgtcgagataaggaacattggcagcgatcaatga

SEQ ID NO: 84898 - DNA, 522 bp, Glycine max
  Peptide Sequence Number=SeqID_201676
atgtggaatatgttccctcaccaggctaggttttgggaagatgggtggttggctgatgggatccctctaatggcaaagtaccctagactttacctgaactcaaaccaaaaaaaccagtacattcagcagttagggagtagttcaggtggaacctgggagtggtgcctgcaatggaggagattactttttgaggctgagatacctatggggtccagttttttggaggaaatccaaggtctcaacataaatgagcagcaacaagacagaacgggggagaaagtgaaagggatcacgggttctgaaactggaaagagagaaagaggagtgagtgaaggcagtttcgttcctgtgaagaaattaagggaaggaggtttttcaggccgcaaatttttggggttttatttcgggtcacaaacccaacccgtgttcgagccaaacagaaactcacagatcagtgtcgtgccgcaacgagcaacaatcttccacggcgatccagcaggatcaggtgaagacacaatctag

SEQ ID NO: 84899 - DNA, 522 bp, Glycine max
  Peptide Sequence Number=SeqID_201677
atgccttataaatctcatgctagaatcccatacttccaatgtgggaatcaagacccataccttaggaggcatttgtttcacggaaggttcttacattcccatgaatgttattcccaggaatataacatgggaataatatcattcccggttttagccatccccatcctcagcctatgttctcaagaggtttcagtcatctctgacctctggccattttctggcaatcctgtcactgtcttgtataggctcaatttatatctatattcggccagaggcatgacacaaccagagaccatgcagttgaggggattaattggggatgtttctgtattggtgcagtttgataaatgtgcaagccataacttcattgctcaagagcttgttcaaaaactaaggttgaaggtgccccctaccacccgctacggagttcagctgggtggtggatttcacaagcaatcacagagatactgtaaggatttgaaactaaatttagctaactatgagctctctgcaaatttctaa

SEQ ID NO: 84900 - DNA, 483 bp, Glycine max
  Peptide Sequence Number=SeqID_201678
atggcctttggaaccatggcagctcacccaggcgagctgatgcttcatcctgaagtcatagctatttctgaatcaaaagaccgtgccaccatgacacatgctgggttgtttgggaagctaggagaatatgtaatggacttgacaagaatggctaaaaaagaagctatagttaagaagaacagaggtttagcgttgaagactagcattcaatcaagtgacgaaagtgaggatggcaatgcagaagggtcgaatgctgaaaatctaaatttgcttgtgaaaaggttcaacaaattcctcaagaaaaagaagaactatggaaacataacttttcacctaagaagaatctcaagaaaggaagaagcaaatttccgcttgatggcaatcattgaagctgagagtgagggcagcggaatggagaaggaagagagagaggagacgccacttcaaggagaagatgagtctagaagaagctcaccaccatag

SEQ ID NO: 84901 - DNA, 366 bp, Glycine max
  Peptide Sequence Number=SeqID_201679
atgtcgggggagtttgaaatgtcaatgatgggagagttgaactatttccttagtctacaagtgaaacaaatgaaccatggaacttttctccatcaaaccaactattgcaaggaacttctaaagaagtttgatatggataaaattaaggaggctgcaactcctatggctaccaattgctaccttagtgtggatgaaaaaatgaaactcattgaccaaacaaagattttaggacaacactacccattgatgcaatcctaccctctaagggcattggatagaagactccaagaagattgggccagagatgcaagagaaggccctagggttctcatgagccttagggtagatttcggctccatgggctaa

SEQ ID NO: 84902 - DNA, 423 bp, Glycine max
  Peptide Sequence Number=SeqID_201680
atggtgtttgtacttctctatatggtggaagttctaaaagatcttagaacaattggattggaattaatctcaagagccatcataataggttctgctaagggtgcatccattaacagacaaccattatttcgtagcatgaactactcttttgggaaagttcggatgaaaatcttcatggagtctattaaaaaaggcatatggagtgtagtggttaatggatataccattccagcccatgtagttgataacaagactatagagaaaccttacgagtcttggttacaagaagagattagaaaaggtgaatatgattccaaggcaatgaacattatacattcctcattatattctgatgagtttttcagggtgtccatatgcatagctcccaagagagatgtgggatttaatccaagtcacacatga

SEQ ID NO: 84903 - DNA, 390 bp, Glycine max
  Peptide Sequence Number=SeqID_201681
atggactacctcacccctaccttaggagaccccaataccatcctattgccaaagcttctagatggacccatttttgacttcaagtatgggttcctacaaatgttggagaacctgaggaagttcattaagtttactaatacggtgagacaaaacaggtacctaagaacaacatcactacatggaactaatgccaccagtaccttcttaaggaagtatttctctcctatgaagacaaaccaatacataaaggacattgggaatttcatgcaaagagagcaagaaagtatacctgaagcctgggagagattacaggagatgatcagaagttgtccacatcatggcttctcccaacaaaggccagttcacattttctatggtggagtgtgttag

SEQ ID NO: 84904 - DNA, 1457 bp, Glycine max
  Peptide Sequence Number=SeqID_201682
gtggagaagcggctgtggcagatcagtgaagacgtcacgccagcggaaggcgtcagccagttcaatcaggcaatgatggatctcggcgcgttagtgcgtactcgcttccgctcgaaatgcgacatttgcccgctgaatagcggctgcgcggcctatgcacaaggcaactgggccgattatcccggcaagaagccgaaagtcacgctgccagagcgcagcggctggttcctgatgctgcagcacggcgacgaggtgtttctggaacagcgtccgccggtgggtttgtggggcggcctgttctgcttcccgcagttcaccagtgagcaagcgctgactgactggctggcggcgcgcggcatccacgcgaagccgcagcagcttaccgcgttccgccacaccttcagccatttccacttagatattgtgcctatgtggctggcgtggccttcctccgggtcgctgatggatgaagccggcgctgcgccatccccggcagcttcaactgcgaaccagtttgaccgaagaggaagagtaatgagccgcaccattttttgtacttatctgcaacgcgacgctgaaggccaggactttcagctctatcctggcgaactgggtaagcgcatctacaatgagatttccaaagaagcctggcagcagtggatgtctaagcagaccatgttgatcaacgagaagaagctcaacatgatgaacccggaagatcgcaaagtgctggagaaggagatggtgaatttcctgttcgaaggcaaagatgtgcacattgaagagtgggttaaggacaccaacggttttgacattctgatggggcaatttgccgccaacatcgagaatatctggggaatcaatgaggttctgatcgccggacccaaggactacgtcaaatacagcgataactattacacccgcagtcacatcaacttcgacagcggtagcatcaccattgagaccatttccggcaccgatccgatggccagcctgcgtcaggccatcatcaccacgctgttgattggtgacgatccgggcaacgtcgatctctactccgacgccaacgatattcagatcagtaaagagccgctgctgtacggccaggtgctggataacaccggtcagccgatccgctggcagggacgcgccggtaactttgccgattacctgatccagaacaaactgcagaaacgcacctccgggctgcatgttatctggtcggtgaccattccgatggtgcctaaccacctcgacaaacgtgcgcacaaatatctgccgctggtgcgcaaagccgccgaacagtatggcgttgatgcctcgctgattctggcgatcatgcagaccgaatcgagctttaacccctatgcggtaagcaacgccgatgcgctgggtctgatgcaggtggtgcagcatactgccggggtcgatgtgttccgcatgaaagggcaaatggg

SEQ ID NO: 84905 - DNA, 369 bp, Glycine max
  Peptide Sequence Number=SeqID_201683
atgattaatgcaaactatccgcaagaatcattgcatccaatctcaaacgggaatctaaggatagacttccataaaagattttgtaaatataatttcgaggagcgaacctgcagatctgacggcacggagtggaggtccttaaagtggctggagctgcagcaagagcgatcggagcaaaaatcgccggaaacaaccgtgccggtagaactgacggaagcttccggcgagacggtagtgtcgggaaactgcgtatcggaagagcgtaactggaaggaagcggtggtttttcttttcttggaaatggaatgttggcttgaagaaggttgttctatggcggcaattgtgagagagcagcgaatacacacctga

SEQ ID NO: 84906 - DNA, 1500 bp, Glycine max
  Peptide Sequence Number=SeqID_201684
atggcattcaagggctatttccttctcggcctcgttactcttgttcttgttaaatcttccaaagttacatgcgaagaagaatcagttaatacagtttcacccattattgacatttcactcaatcggaagagtttcccagaagggttcatatttggggcgggatcttcctcgtaccagttcgaaggggcagcaaaggaaggtggtagaggaccaagtgtatgggataccttcacccataattatccaggaaagatcatggatagaagcaacggagacatggcaattgactcatatcacaactacaagaaagatgttgggatgatgaaggatatgaatttagattcatatagattttccatatcttggtcaagaattctcccaaaaggaaagctaagtggaggtatcaatcaagaaggaatcaactattacaacaaccttatcaatgagctactagctaatggtatacaaccacttgtaactctctttcattgggatcttcctcaagctttagaagatgagtatggtggctttttaagtccgcgcatagtgaaagattttcgagactatgcagaactttgcttcagggaatttggcgatagggtgaagtattgggttacattgaatgagccatggagttacagccaaaatggctatgcaaatgggcgaatggcacctggccgttgttctgcatggatgaatctgaattgcactggtggtgattcttcaacggagccttacttggttacacatcaccaacttcttgctcatgcagctgctgttcgtgtgtacaagaccaagtaccaggcatctcaaaatggtgtgataggcataaccttggtagctaattggtttttgccgctcagagataccaaatctgatcaaaaggctacagaaagagcaattgacttcatgtatggatggtttatggatccattaacatctggagactatcccaacagcatgcgatcacttgtgaggacaagattaccaaagtttactgcagagcaatccaaactacttattggttcatttgattttattggcctaaactattactctacaacatatgcctctgacgcacctgatctaagcgaagcccgtcctagctacttaacagattctcttgtcactcctgcatatgaacgtgatgggaaacctattggaataaagattgcttctgattggttatatgtttatccaagaggaattcgtgaccttttattatataccaaagaaaagtacaataatcctttgatttacatcactgaaaatggtataaatgagtataatgaaccaacattatcacttgaggaatctcttatagataccttcagaattgattatcattaccgtcatctcttttatcttcaatccgcaattaggttatacatcacgttttgggatgatcttcgtggattacaaaaatggtttgaagagataccaaaagctttcagcgcaatggttcaagaattttctcaagaaagaaagaagactttatag

SEQ ID NO: 84907 - DNA, 1635 bp, Glycine max
  Peptide Sequence Number=SeqID_201685
atgaaaggtttcgcagagagaacatcaaaacaatcaactaagaaaaacatatcacacaatatggcattcaaaggttatttccttctcggcctcatagctcttgttattgttaggtcttccaaagttatatgcgaagaagcagctaatacagtttcacctattattgacatttcactcagtcggaagagcttcccagaagggttcatatttggggcgggatcttcctcttaccagttcgaaggggcagcaaaggaaggtggtagaggaccaagcgtatgggataccttcacccataattatccaggaaagatcatggatagaagcaatggagacgtggcaattgactcatatcacaactacaagaaagatgttgggatgatgaaggatatgaatttggattcatatagattttccatttcttggtcaagaattctcccaaaaggaaagcgaagtggaggcataaatcaagaaggaatcaactattacaacaaccttatcaacgaactagtggctaatggtatacaaccacttgtgactctctttcattgggatcttccccaagcattagaagacgagtatggtggctttttaagtccgcgcatagtgaatgattttcgagactatgcggaactttgcttcagggaatttggtgatagggtgaagtattgggttacattgaatgagccatggagttacagccaaaatggctacgcaaatggacgaatggcaccaggtcgttgttctgcatggatgaatctgaattgcactggtggtgactcttcaacggagccttatttggttacacatcaccaacttcttgctcatgcagcaactgctcgtgtgtacaagaccaagtatcaggcatctcaaaatggtgtgataggcataaccttggtagctaattggtttttgccgctcagagataccaaatctgatcaaaaggctacagaaagagcaattgatttcatgtatggatggtttatggatccattaacatctggagactatccaaaaagcatgagatcacttgtgaggacacgattgccaaaatttactgtagaacaatccaaactacttattggttcatttgattttattggcctaaactattactctacaacatatgcctctgatgcacctcagctaagcaatgctaggcctagctacttaacagattctcttgtcactcctgcatatgaacgtgatggaaaacctataggaataaagattgcttcagactggttatacgtttatccaagaggaattagtgatcttttattgtataccaaggaaaagtacaataatcctttgatttacatcactgaaaatggtataaatgaatatgatgaaccaacgctatcacttgaagaatctcttatagataccttcagaattgattatcattatcgtcatctcttttatcttcaatcagcaattaggaatggcgcaaatgttaaaggatattatgtatggtctttgattgataattttgagtggtcttcgggctatacatcgcgatttggaatgatcttcgtggattacaaaaatgatttgaagagataccaaaaattgtctgcactatggttcaaggattttctcaaaaaagaaaccaaactttatggctccaataaatag

SEQ ID NO: 84908 - DNA, 1572 bp, Glycine max
  Peptide Sequence Number=SeqID_201686
atggcatttaaaggctatttccttatcggcctcattgctattgttgttgtcacttccaaagttacatgcgaattagaagcagaaacagtttcacctattattgacatttcactcaatcggaacagtttccctgaaggcttcatctttggggcaggatcttcctcgtaccagttcgaaggtgcagcaatggaaggtggtagagaaccaagtgtatgggataccttcacccataattatccagctaagatcaaggatagaagcaacggagacgtggcaattgactcatatcaccactacaaggaagatgttggcatgatgaaggatatgaatttggattcatatagattttccatttcttggtcaaggattctcccaaaaggaaagctaagtggaggtataaatcaagaaggaatcaactattacaacaaccttatcaatgagctactagctaatggtatacaaccactcgtcactctttttcattgggatcttcctcaagcattagaagacgagtacggcggcttcttaagtccacttatagtgaaagattttcgggactatgcggaaatttgcttcaaggaatttggtgatagggtgaagtattgggttactttgaacgagccatggagttacagtcagcatggttatgcaaatggaggaatggcaccaggtcgttgttctgcttggttaaattcaaattgcactggaggtgattctgcaacagagccttatttggttacacatcaccaacttcttgctcatgcagcagttgttcgtgtgtacaagaccaagtatcaggtgtctcaaaagggttcaataggcataactttggtagctaattggtttataccgctcagagataccaaatctgatcaaaaggctgctgaaagagcaattgacttcatgtatggatggtttatggatccattaacaaccggagactatccaaaaagcatgcgatctcttgtgagaacaagattgccaaagtttactacagagcaatccaaactacttattggttcatttgattttattggcctaaattattactctacaacatatgcctctgatgcacctcagctaagcaatgctagacctaattacataacagattctcttgtcagtccagcatttgaacgcgatggaaaacctatcggtataaagattgcttctgaatggatatatgtttatcctagaggaattcgtgaccttttattatataccaaggaaaagtacaataatcctttgatttacatcactgaaaatggtataaatgagtatgatgaaccaacacaatcacttgaggaatctcttatggatatttatagaattgattatcattatcgtcatcttttttatcttctatctgctattaggaatggctcaaatgtaaagggatattatgtatggtctttgttcgacaattttgaatggtcttccggttttacatcaagatttggaatgatttatgtagattacaaaaatgatttgaagagatacaagaaattctctgcattatggtttgagaattttctgaagaaagaaaccaaactatatggttctagcaaatag

SEQ ID NO: 84909 - DNA, 675 bp, Glycine max
  Peptide Sequence Number=SeqID_201687
atgatcaaattggccacgctccaatccgaggggtccgattactccacaatcaagctcaaatgcgagcgcacactcaccacgctccactgcgggaaccacacgaaggcaacgaaggcaatgaagcagttgaggcagtttaaaatcatattaattaaaagttttggggcctctgttgagcaccattatgagaagacaatttttctcacagaattggcacatactctacttttattcaagttgggttacttcttttttatgcatttgttcattaactatgcttcattactaattggcttccttccaaatactccagctcaatttggtcttgctgttgatttttggaagctgcttgtagaagctaaggagcaaaagcttttggatgaaatcgatcggcttaaagaagaactacagcattgtgatgagaacatgaacagcattgtgccctccttagcaaaagtagaaaggagaaacatagtaagctgcaaaagtatattatttactacttttcatagtcaagaaaatatttcttatgagtttaaattgttacgttataggtccctatggggcaaagagaatgaacttactgctgaaattgataagctgagagctgaagttgagaaggctgaaaagagtcttgatcatgcaattcctggtgtgagtaacccctctttctaa

SEQ ID NO: 84910 - DNA, 576 bp, Glycine max
  Peptide Sequence Number=SeqID_201688
atggatccattaacatctggagactatcccaacagcatgcgatcacttgtgaggacaagattaccaaagtttactgcagagcaatccaaactacttattggttcatttgattttattggcctaaactattactctacaacatatgcctctgacgcacctgatctaagcgaagcccgtcctagctacttaacagattctcttgtcactcctgcatatgaacgtgatgggaaacctattggaataaagattgcttctgattggttatatgtttatccaagaggaattcgtgaccttttattatataccaaagaaaagtacaataatcctttgatttacatcactgaaaatggtataaatgagtataatgaaccaacattatcacttgaggaatctcttatagatacctttagaattgattatcattaccgtcatctcttttatcttcaatccgcaattaggttatacatcacgttttgggatgatcttcgtggattacaaaaatggtttgaagagataccaaaagctttcagcgcaatggttcaagaattttctcaagaaagaaagaagactttatag

SEQ ID NO: 84911 - DNA, 362 bp, Glycine max
  Peptide Sequence Number=SeqID_201689
ccattaccattactcgttccaacaccaatgcactcattcatgaggtttcttatctcaaccggagcagtttcccgctaggctttattttcgggacagcatcctcagcatatcagaagctaagatacataattttgcggtgtagtatgaaggtgctgcaagtgaaggtggaaaaggaccgagtatatgggatactttcactcataaatacccagaactcagaggtggttgacagagtggggggagagatcatagagatggaagtaaaggagaggattcttagagattctatagttgatggaataatgtctttgattgtatctaataaggaaacaagagagacatctaactgttcatctgactaa

SEQ ID NO: 84912 - DNA, 2193 bp, Glycine max
  Peptide Sequence Number=SeqID_201690
atgtccttgaaacaatccacctcgatggcttccctgagggtcctattaatttcattgtgcctcttgggttcactccaagtcgataatcctaccaaaaggtgttacttaccgcgagagacaccgagtggtttaagaagactacgtgaagaagaattgagtcatctgagagggaatggagaaggagaacggaagagctttgaaagaatatacgattatgatatatacaatgacattggagatcctgataaaagccttgaacttcaaagacctcctttaggaggtaaagagcgaccttatcctagacgttgtcgaactggtcgtccacatagtgaagcagatccattgtcagagaaaagaagtagaaatttttacgttccaagggacgagtgcttctcagaggtgaagcagctcacgttctcaaccaagacattacactcggtgttgctaatattgctcccaactttggggaaaattatcaaagaaaaggagcttgcattttcctacttccacgacatagattcactcttcagccatggacttgacttgcctcccgaagaaaccgagaagggtttcctaggaaaaatcatgcccaggctcgtcaaatccatctctggcgacaggacacacgtgcttcgcttcgagaccccagagactatgagcagggacaggtttttctggtttagggatgaggagtttgctagacagactgttgctggtctcaacccgtatagtatacgattggtcacagaatggccattgaggagtaaacttgacccagaaatatatggtccaccagaatcagcaatcacctcagaaattatcaacaaagagattggaggcataatgtctgtagaaaaggcgattgaaaaaaagaagctgttcatgttagactaccatgacatacttttaccctacgtcaacaaagtacgcaaactcaaggggaaaacactgtatggttcacgaactttgttctttctaaactcagaggggacactgaggcctctagccattgagttgactcgaccgccgtcatcttcaaataatacgggccaatggaagcaagttttcacaccttcttggcactcaaccagtgtttggctctggaggtttgccaaggctcatgttcttgcacatgactctggctatcaccaacttgttagtcattggttaagaactcactgtgtgacagagccgtatgttattgcaaccaacaggcaacttagtgagttgcaccccatatacaaattgctacaccctcatttccgttatacaatggagattaacgctatcgcacgagaagcacttatcaacgctgatggcaccattgagagctcatttgcaccaggaaagtactccatagagattagctctgctgcttatgctctcgaatggcggtttgacaagcaggcactaccagcagatctagttagcaggggaatggctgtgaaagatccattttctccacatggcttaaagctcaccattcaagactatccttttgccaatgatggactccttctgtgggatgctataaagctatgggtcactgactatgtcaaccactactaccctgaaccaagtcttgtggagtcagacgaagagttgcaggcatggtggacagagattagaacacttggtcatgctgacaaaaaagacgagccatggtggccacgtcttaaaaccccaaaagacctcattggaatcctcaacacaatcatatgggtaacttctggtcaccatgcagctgtgaactttgggcaatatgtttatgggggatatttcccaaataggcctacaattgtcaggaccaaaatgccctcagaggaccctacagaggaagagtggaaaaagttcattgcaaaccctgaaagagcactcctcaagtgctttccttcacaacttcaagcaactagagtcatggctgtcttggacatactctcaactcattcacctgatgaggaatacataggagagaagatggaaccatcatggggtgaagatcctgtcataaaggatgcctttgaaagatttagagaaagactgaagaaattagaaacactgattgatgagaggaatgaaaacacaaagttgaagaacagaaatggagctggcattgttccgtacgagcttttgaaacctttctcaaagcctggtgtgactggaatgggggttccctgtagtatatctatttaa

SEQ ID NO: 84913 - DNA, 1458 bp, Glycine max
  Peptide Sequence Number=SeqID_201691
atggcattcaagggctatctatacattctcattggtgtcttcactctcgttataagttcctccgttaatatcacacaagcagttgcaccttctctaaatcggaccagttttccgccaggtttcatctttggcaccgcctcctccgcctaccagtacgaaggtgctgcaaatgaaggaggcagaggaccaagtacatgggatgcctattctcataaatatccagaaaaaatatcggatagaagcaatggagatgtagcagttgatcaatatcatcgctataaggaagatgttgggatcatgaagtatatgaacactgatgcttacagattctccatctcttggtcaaggatattgccaaaaggaaaaataagcgcaggtataaaccaagaaggaatcaaatattacaacaatctcatcaacgagctactggcaaatgatcttctgccatttgtgaccctttttcattgggatcttccccaagccttacaagatgactacggtggcttcttaagccctcatattataaatgatttccaagattacgctaagctatgcttcaaggaatttggagatagagtgaagcattggattacttttaatgaaccatggagttacagtatgggttcagagccctacctgagctctcactaccaactactggctcatgcagctgctgtcaaaatttataaaaccaattatcaggcatctcaaaacggtttgataggcatcaccttaaattgtcactggtttattccattctcaaatgacacattagatcatcaagctgccctacgcgctcttgatttcatgtttggatggtttatgcaaccacttacaacaggaaattatccagaaaccatgcagtctttgctgggaagtcgattaccaaacttcacagaagagcaatccaagctacttattggctcatttgattttgttggactcaattactacaccactaattatgctgcccatatattccaaacaattaataacacaagcaatactagctatttccaagatactcacatcaactttacaactgaacgtaatgggacacccattggaccaagggctgcttcatcttggctttatgtttatccaaggggacttcgagaactattgttgtacataaagatgaagtataacaaccctgtaatttacataacagaaaatggtatggacgagtccaatgatccaacactatcccttgaagaggcactcatggatacttgcagaattgactacttctatcgtcatctttattatattctaattgcaatcaaggatggggtgaaagtacaaggatattttgcatggtcacttttggacaacttcgaatggagtgctggctacaccttgcgttttggaattaacttcgtcgattacaaggataatttaaaaagacaccaaaagctctctgcccattggtttaggaattttcttcaaaaatactag

SEQ ID NO: 84914 - DNA, 195 bp, Glycine max
  Peptide Sequence Number=SeqID_201692
atgagagttataaaaattgagccaattagttcaaattccatgccggtgatatacgtaccagtggtaggggctgacttgatgctatcgactggtcccttcttttggctgttttttggtagtagaattgtggggttattggaaggtgttagaatgctcaacggttctgttctgaaggtatcttattttggactttga

SEQ ID NO: 84915 - DNA, 384 bp, Glycine max
  Peptide Sequence Number=SeqID_201693
atgccaatctccccctacagatgtatcagttgggatcacgcccacaaggcgctcagtggacccgaagaagtccaacagggccctggggtttccagctctggttacgggcctctgatcgcgctcacaagacgcccagttgacccgaagaagtccaacagggccctggggtttccagctctggttacgggcctctgtagtcctacagggtgcccgttccccccggcaaggtcacgtcatcatgacatagggatcgcgcccgcaagacacccaatggacccgaagaagtccaacagggtcttggagttgccaagctctaattacgggcctctgtcagttctacggagtgcctgtcgcccccagcaaggtcatcaggccccctactaa

SEQ ID NO: 84916 - DNA, 300 bp, Glycine max
  Peptide Sequence Number=SeqID_201694
ggtgagaatccttaccctcggaagaaaaaatgggaagaaggaaagttcccaatcaaagagtgggagaaagcaaaaaagaaaagaaggaaagttcccaatcaaagagtgagagaaagcaaaaaagaaaagaaggaaaattcccaaatcaaagagtgggagaaagaaaaggagaagaaagaaaatccccgatcaaagatcggaagagaaaagaacaaatatgcagaaaggtcttgggaccagacaatatctgaacaaatttgtcaccaagtaaacaagaaaagaaaggaaaccacgacctaa

SEQ ID NO: 84917 - DNA, 756 bp, Glycine max
  Peptide Sequence Number=SeqID_201695
atgtttcaacagaaggcggtgccttctggtggaagcaacccagctcgcctgggcgacaaccacctccctcttttcccctataagttctcacccaatagtaccctcaccttcagaggactacacgtcctcaccttcagagggctacacgccctcaccttcagaggactacacttcctcgccatcaggggactacacgtcctcgccttcagaggactgcacctcctcgccttcacctttagaggactatacgtccttgccatcagagggttgcacgccctcaccttcagaggactacacgtcctcgccttgaggactacacgtcctcaccttcaaagggctacacgccctcgccttcagaggactacacatcctcgccttgaggactacacgtcctcaccttcagcggactacacaggactgcacgtcctcaccttcagaggacttctcgtcctcgtcttcagagggctgctcgccctcaccttcagaggactacacgtcctcgccatcatagggttgcacgccctcaccttcagaggactacacgtcctcgccatcagagggcgggatgccctcaccttcagagagcggcacgccctcgcctttagagggttgcacgcccttgccttcagaaggcagtacgtcctcgcctttagagggctgcatgccctcccctttagagagctgcacgcccttgcctttagagggctatgcgtccttattttcagtgtgctccatatccacaccttaagagattaa

SEQ ID NO: 84918 - DNA, 555 bp, Glycine max
  Peptide Sequence Number=SeqID_201696
atgtccagcaagggaaaggaggtagcagaaggatcatcaacaacaagaccctctcatggtggtgatgatgatcatcatcacaatcaacaacaacagttaccactgagtcgatatgagtctcagaagagaagggattggaacacttttggacagtacctgaggaaccaaaggcctccagtggcactctcacagtgcagctccaaccatgttcttgagttccttcgctacttggaccagtttgggaagaccaaagtgcactcacaagggtgtttgttctttgggcaaactgagccaccaggaccctgcacttgccctctcagacaagcttgggggagccttgatgctctcattggaaggttgagagctgcatatgaagaaaatggaggccttcctgagaccaatccctttgcaagtggcgccataagagtctatcttagagaggtgagagattctcaatctaaggctagaggaatcccttataagaagaaaaagaagaagaggaatgttatcaagcccaacggagacacctcctcctcaaacttgcctatgcagtaa

SEQ ID NO: 84919 - DNA, 248 bp, Glycine max
  Peptide Sequence Number=SeqID_201697
atgacttgttcccaagatgcggacttgagagggctggcagctccgttgccaaccacagccaccatcctcaccggcggcgtagcggactgctccgctgtcagggcggagaagacggttgtcggagggcgaaagcgagtttgtggtttgtggttagctttgcaaaatggttttactgaagtagagctccaggtagattttgaatctgtggtgaagaatctatctggcaacaaacaaggttgtgctgctag

SEQ ID NO: 84920 - DNA, 333 bp, Glycine max
  Peptide Sequence Number=SeqID_201698
atggcgctctccgccgtgaggcagcggcgctcggagccgtcggatccgtcaccatcagaaccgtacacgaagctggacaagcccgagaaagcggaggagaaagacgaaggcttggggtgggtttttccgtttgtggctcttggattattgaggtacatgagtgccacctccaacatcatccacgattgcgacgaggtcttcaattactgggagccccttcatttccttctctacaaaactggcttccagacatgggaatacagtttggggaagatgggtcaagggagaagagaaaaagttttgatttttattatttggggtgtgtttgagtaa

SEQ ID NO: 84921 - DNA, 360 bp, Glycine max
  Peptide Sequence Number=SeqID_201699
atggtttttgtcatcctgacccatgaagtcaggagacatgcggggtaccgtatggttatccgcacctttcgtcaaccaggggcaaacgagctcattgatgcgcagagactaacatcgtcttctgcactttttgtcatcctgacccatggagtcaggggttccgtgtggttatctgcacctttcgtcaaccagcagagactaacatcgtcttctgcaccttttagccatccagggacagcgagtcgggtggcaggcagagataccttatggtttttgctctcatcgtccgaaggcattcaagcccgacgacgcatgggattcttctttgatgggcgaggacgatcaagttcgatgatgtag

SEQ ID NO: 84922 - DNA, 357 bp, Glycine max
  Peptide Sequence Number=SeqID_201700
atgtcgccaattgcaccaccatccgacgtcacatgtgttgtaattcgccaccatactccggtgtgtgaagctcatgtgccaccacttgatttggcatgtggcgtgtttttccaacacgccctcctccaaaaaccctctcgtcgttcttctccacctgtagtgacatggtttgggtattgtttggctactgtttggttgtttcaacaactgtttggcattgttctcatgactatcaaatttgcatcgagttttgttgtgacatttaccaatgttcaactgattcggtgtgaaaaactcgctaggacaaccaactacaacacttgggccgttgtcgttcaattgtggttccaaggctaa

SEQ ID NO: 84923 - DNA, 795 bp, Glycine max
  Peptide Sequence Number=SeqID_201701
atggtggatgccatgaagaaggtggcgaagctggacgttgaattgagtgtggaagagaggaacctgttctctgttgggtacaagaatgtggtggggtcacggagagcttcatggaggatcttgtcatcgatagagcagaaagaggagtcaaaagggaatgagttgcatgttaagcgtatcagggattacaggaacaaggtggagttggagctgtccaacatttgcagtgacattatgatagttttagatgagcatcttattccatccactaatattgcggagtccacggtgttttattataagatgaaaggagactattaccggtatttggcagaattcaaggctggtaatgaaaagaaagaggtggcagatcagtcacttaaagcatatgaggtatttgctggaggattaggtcttatgttaataaactgtcttgaaaaagcttttctaagagtgagtatgtctgtaatgtgcacaagggagtattcatccttaaatttctgtgacaaggccttttcctctgcaacagcttctaccactgctgagagtgaactacaacctacacatcctattcgtttgggtctggctctaaatttctctgtgttttattatgagataatgaattcacctgaaagggcctgccatcttgcaaagcaagcctttgatgatgctgtctcagacctggataccctgaatgaggattcttacaaggacagtaccttgattatgcagctgttgagggataaccttactttatggacttctgatatccccgaagagggtggtaagatatag

SEQ ID NO: 84924 - DNA, 237 bp, Glycine max
  Peptide Sequence Number=SeqID_201702
atgcatcctttgtgttcaagtggagcgtacatccacttgtttgttcaaagagaacaagggagggtacatcccttgtggatctttgcatgtaaaggattttacaaggcttggcttagcgcgaggatcaaaccgcttagcgaggtttgcagatccaaaaagctgcaactctcgctaagccagattttggttggcttagctaaaatgatgcatcttaagtacaaaggagcatgtgcttag

SEQ ID NO: 84925 - DNA, 613 bp, Glycine max
  Peptide Sequence Number=SeqID_201703
atggtttacgctactttccttgatatctgtcttatgcctaactccatctatttgttcaggacaagcaaaactgtaaatttgggggagttgttagtcgcgtttgctaagcgcaacactcctaggctaagcgcgaggaagactctggaagaagatgagttgtataggttcgctaagcgcaccgcttcagatttagagctttgcatgtctagggtttctagagatagaaaggtccaagttctagagagttttgagagattttgttgtgtgaagacctatagagaccagagcttgaagcaggagccggcttcctggtgtggacaacgtggtattcactatcactacaacaagaattggggtcatgttgaagcagactatcacatcaaagctagagagttgtcccagtcagttaatgtggcccaagtcatcacctctacttcagatattactatcttcgctattgaatataatgagcttttccagcttctagcagccaacgaacctgcatcacctgttacctctgtggctcagtctggtaatcctataacctcgttttctcaatcctcctctattggacttggggttcttgattctgatgcctttgattatatgactg

SEQ ID NO: 84926 - DNA, 244 bp, Glycine max
  Peptide Sequence Number=SeqID_201704
tcttgaatcaatcacttgggcttttggcatcatcaaaatttctaggttcatcatcatgaagcttgcttctacaacgatgaacttgctaagcgagcgtgctgcactaagcgagttcatcaaaattcattgcagatatgcgtttccagaggaacttgctaagctcacctaccacactaagcgagttcatcttgtgaggatgaatactcatcctcctattgaaatccttgtggctaagcgaggctga

SEQ ID NO: 84927 - DNA, 1798 bp, Glycine max
  Peptide Sequence Number=SeqID_201705
cagcaacaacaacaactccggtgaactttctggttcaagtgagaacagccccaccgcgcgtaaaccgggtcacaggagatctgactccggatctgcgctggtgccgttgatatactccggtcagacggcgacttcgccggccatgaatgttcttccgaccgggaacatttgtccatctgggaagatcttgaaggcggggatgatggcgaatcggagtagcagaactagtagaagcgatgttttggggtcggggatgggaaactacggccacggaagcataatgcgtggcggagggaaggtggagccggcgagttctcgcggcggcggcggtgggaatgagacggtgaagaaaggggggcacgtgcagagtgtggatccggaagagttgaagaggttggggaacgagtgttacaaaagggggaactttgctgatgcgttgagtctctatgatcgcgcgattgcgatgtcgccggcgagtgccgcttaccggagcaaccgcgcggcggcgctgacgggcctcggacggttgggtgagtctgtgagggaatgtgaggtggctgtgaggttggatcctaattatggaagggctcatcagcgtttggcttctcttttcctcaggttgggacaagttgagaatgcaaggaagcacctttgttatcctgggatgcagccagagccgtctgagatgcagaggttgcaagtggtggaaaagcatatcagcaaatgtggggatgtacggagggttggggaatggaagagtgttctcagggaagttgatgctgctgttgctgctggagcggattcttcgcctcagctctttatgtgtagagcagaagcgtttttgaagctccaccagattgatgatgcggaatcaattttgttgagtattcccaaatcagagctgcaaattaattcctcttctcaggcaaggttttttgggatgctatcagaggcttattcctattttgtcagagctcagattgagatggcattgggaaggtttgagaatgcagttacagctgctgagaaagcctgtcagattgattcccggaatgttgaagttgctgttttgctcaacaatgtgaggatggtggcaagggctcgagtgcgcggaaatgatctttttaaatctgaaaggtacactgaggcttgctcggcatatggggaaggtttgagactggacccttcgaattctgttctatattgcaatagagcagcttgttggtttaagcttgggcaatgggaacagtcaattgaagactccaaccaagctttacatatccaaccaaattacaccaaggcccttcttcgaagagctgcatcaaacagtaagctagaaaggtgggaagaagcagtcaaagattatgagatcttgcggagagaacttccaaatgacaatgaagttgctgaatctcttttccatgcacaagttgccctaaagaaatcacgaggggaagaagtatataatttaaaatttggtggtgaagtggaagaagtctcaggtcttgagcagtttagagctgcaatttctttaccaggtgtatctgttgtccattttgaagttgcatctaacttgcaatgcaaacaaatatggccatttgtcaatacactatgtggtcgatatccatctattaacttcctcaaggtggacattcagcaaagcccaacagttgcaactgcagagaacgttcggattgtaccgaccttcaagatatacaaaaatggcagccgggtgaaggaaatcgtatgccctagtcgcgacatgttggaacactctgtgaggcattacagcttttag

SEQ ID NO: 84928 - DNA, 645 bp, Glycine max
  Peptide Sequence Number=SeqID_201706
atgagatttactttggtagaccttgataaggttgcttacaaagacaagcctttcatcacaatagaacaagcaatacagggaagaacaagttgtgttagtatcaaaatgatgattgtgcttgacatttgtgagactccttctttctccacatgcatgccttccacaattgaagaacatgaagtggatgatttggataagcctaaggtagtgtttcatgtcaatcctgccactgggagagcttcaagcccacataaaaagaagttccacagttatttagggatagtagctcgagataagattaatattttgtattccaattggaaagatgttctagaagctctgaagaatctgatttgggatgacattgtgggaacatttgatattccagaagtatttaacaccaagaagaagttcatttcatcagttgcaacactatggaggaattttatgtcatccatgaccactaattatatgacacatggatgctttgtaccccatggtcaccaggatatactaactattgccattggacgacctgagcactcaagtcatgtttgtgctatgggagttagtatgaccattagccaatactttggacatgcatcacatggctcgaataattctacatccatcatcccacaatag

SEQ ID NO: 84929 - DNA, 210 bp, Glycine max
  Peptide Sequence Number=SeqID_201707
atggatgaaataggcaaatgcaaaaatggtaaaaactgtttttgccaaaactgttgtccttttaatttaatctctactagcaaactcactcgcactcttgatttttctgtcctatttgttaataatttcattcttgtacaagatcgacacattggacaaacgattggagcaggacataagtctggaggattatatcaacttatgccttaa

SEQ ID NO: 84930 - DNA, 391 bp, Glycine max
  Peptide Sequence Number=SeqID_201708
atggaaagagttacactttggtatagtggacagagaggtttgaagaacctaggggaattagcaagtagtgactacccgacatctggtgcactcattaggcatggggatcaatgtacgttgtttccgtatgcggtgatcactcccaattgtcatccacatgattctgtaagacgatcaaaacctaggaggattggtggtagaggagtgcaagactcaccactactgatgcaatcctatcccgcaagggcattgggtagaagactccaagtagattgggctagagatccaagggaaggccctagggttctcatgagccttaggctaagctctagcttctttaggaatcttcttaaggaagcttctcaaggaggtgagcttagttatgagagag

SEQ ID NO: 84931 - DNA, 210 bp, Glycine max
  Peptide Sequence Number=SeqID_201709
atggaggatgagttctctgaggccaccattccagagccatttactgcaggggaggaggcaggtgacacacagatgacacaagtagctactgccacttctgagagatctcttgaggccacttcagagcctcctgcatcagcagtggacctaccttcacctcagcacgcaacagacccttctactcctgtcctagagatacctaaagactag

SEQ ID NO: 84932 - DNA, 174 bp, Glycine max
  Peptide Sequence Number=SeqID_201710
atggaggatactacagtcagggacttcatgaggattgatgcacattacaaggaaaggataaaaattaagagtgaagttgtatctatggttggtgtgagcgccatgtcctataccggtatgttgggtgtcctcccaatcgtcatccacatgttgtgtaagaccatgaaggcttga

SEQ ID NO: 84933 - DNA, 258 bp, Glycine max
  Peptide Sequence Number=SeqID_201711
atggtcaaggtgcttattgaagaagtccgagatgctgatgctcaagtcctttttccaactttagaggttcagtgtgtggggcaggtccacagcaccttcattgcatggctgagacatcttgtgaagcctgtttcacatgaggattcacatagacgtccaaagaaacatgttgaatctattcgtgagtcgaatcccattggtgatcccttagcttatatgattaagaatttgcttgacctttacatgaagcctttttaa

SEQ ID NO: 84934 - DNA, 690 bp, Glycine max
  Peptide Sequence Number=SeqID_201712
atgagattgaatcaacatgaggagaatgataagaaaaagaaaggaatttgttttaaagcttcatcatctactcaagaaggaagtgataaggaggacacaattgaaatagacgaagatgatgatcttagtctatttgtaaaaagattcaacaaattcttgagaaaaagaatagagaaatctgaaaagaaagtttttaatgaaaagaaggcaaagaaggcctacattacatgggatgccaatgatatggactcatctgaagattcagaaaatgaagtagtaaacctaagtataatggccaagagttatgaaagcgatgaagagtacatagaagaaattaaagatttgaaaaactcttgcaaattttccattggtaaaaataacttagatatcatattaggaaagcaaaaatgtgtctttgataaggcaggattaggatataagtctgacaaacaacaaaaattttataaaaatttctttgcattcacacaaaaatatagttctcctttcttaacatgtttttactgtggtaagaaaggacatggcatatgtcgcaacctactcttcggcgggagggtgacgcgagggctcacgggtgagtcttccaagaaaggaaaatgtgcggagtcgccaccaatgtttattcgaggaaaacgtcgggaaaaccgaaaaggtgtggtctacgaactttaa

SEQ ID NO: 84935 - DNA, 483 bp, Glycine max
  Peptide Sequence Number=SeqID_201713
atttgcgctcccggttacgggggccacggtttcctttcaacggttcttgggctaccccctgatattggagggcgaccaactgtgcgagcacatccagagaggaaggctatcacgcatcaactatgcataccggggcaagatttcacccgtgccgctgcaaaaagacgagtgtggatcatgcgcaccaacatgaccacttttacatggatatggatgacgttgctatttagtaacattctgcccggcgaccataatgccaatctccccctgcagatgtatcggttgggatcgcgcccacaagacgcccagtgggcccgaagaagtccaacagggccctggggtttccagctctggttatgggcctctgtagtcctacagggtgctcgtttcacccctgcagatggatcggttggtctgtgccgtcatcatgacatagggatcgcgcctgcaagacacccagtggacccgaagaagtccaacagg

SEQ ID NO: 84936 - DNA, 174 bp, Glycine max
  Peptide Sequence Number=SeqID_201714
atgggtgttaagtacgtcaaagcggtcaagcgaaggttgcatgtgaccaaacaatggtccccggatgaaattaggaggattcctgaacacaagggaagggttgtccctgtgtggttcagactttgtaaaaggagttttacaaagagagtggaaaatctcaagtgggttgcttga

SEQ ID NO: 84937 - DNA, 408 bp, Glycine max
  Peptide Sequence Number=SeqID_201715
atgaaagcactaagcgcgcctgctgcgcttagcctgttcatcgcaactgttaaaattttggatttccagatgaacgcgctaagcggaccatatcgcactaagcgtatggcatctaaaaataggaaagctccttctacacctacccaggccagatatgacagatccaggttcacatccaaagaagcttgggagagatatacagatattgtggtgcccaggaaactactaccggagaggaatgtggtagtttattacatcgagtttgacgagttcaaggaggaactcgagagaagacattgggatgagaagttaactgattttgctgacagtagcatagacattgctattgtgaaggaactgaggaaagcctttgaagatcccagggaggggattcgagctaaatgctga

SEQ ID NO: 84938 - DNA, 603 bp, Glycine max
  Peptide Sequence Number=SeqID_201716
atggaagagaacataaatataactgtcaataacagatgcttgtttgctaaggcacaaaccagaccatccctttctctctctctctctttcacagttcatgttcccactctgaaccacctctcgactacacccaccaccaccttcactacctcattgcacccttttaaccttttctgtttttctagtcctaaaagtagagatgagatgaatgagaaaacagatgtggctgatgtggcttcaactgcaatgagtaggccaatggttagcttggaagaagccactggattggcttttaggtttgtgatagatcaaagatgtctgcacttcagaaggaagtggcacaatatgatgatttcatttttctggatattgaagagaagtacatttgttgctgagaagaatttggtcatttattacaggttggcgttcttcaaagctgcttatgcactttttgaagctgacttttgtgtcaaagctgatgatgacatatatttaaggccagaccgtctttcattacttctggcaaaagagctatctcaccctcagacttacataggatgcatgaaaaagggccctgttttcactgatcccaaactcaaatag

SEQ ID NO: 84939 - DNA, 138 bp, Glycine max
  Peptide Sequence Number=SeqID_201717
atggggctaaaggggtattttgagattcatatcaaagagagatgtatattgcaaatcacaatggtcagagtctgcaaaattgggttggaagcgtacagtccaaatttgaaagcaatccaatggctaatgaatccatga

SEQ ID NO: 84940 - DNA, 1488 bp, Glycine max
  Peptide Sequence Number=SeqID_201718
ttgtgcagccagcttgatgagtgtagaagcctttgttttggttccaatccggggagaggtgccaagttcattttgaaggatgtgaattgtgaggcaaggccaggggagcttactgctattgctggccctagtggagctggaaaaaccacactgcttgagattcttgctgggagaataccctcctttaaagtgtctggccaagttcttgtcaatcataggcctatggatgtgaatcagtttagaagaacatcagggtatgtcacacaagatgatgctttgtttccatcactcacagttaaagagacactcatgtatagtgccatgctgaggcttcccgggggaagaaaagttgctgccatcagagttgaagagttggtgaaggagcttgggttggaccatattgcagattcaagaattggaggtggatcagaccatggcatatctggcggagagaggcgtagagtttccattggtgtggacttggttcatgaccctgcagttattttgattgatgaaccaacttcagggttggattcagcatcagctcttagtgtggtctcattgcttagacttgttgcatttaaccaaggtaagactattatcttaaccatccaccaacctggtttccgaatcctagagctatttgatggcctcattttgctgtctgatggatttgtgatgcataatggatcattgaatcttcttgaggctaggcttaagttagccgggcaccacattcctgaccatgtcaatgtactcgagtttgctcttgatgtcatggaatgcttggttatacatacttcagaatctgtggacaaccagtttctgctcaaagagaaccaagatcacaaaatgaggatgcagtactctaaggttgccaaagaaaaggcacttatgtactcaaattctccaacggaggagatttcaatcctaggacaaagattttgctgcaacatattcagaaccaagcaactctttgtcacccgggtcatacaagccttagtagctggttttatactggggagcatatttttcaatgttggcagtcaacgcagtcatgtggcattgcaaacaagaagtggtttctttgctttcagccttacttttttgctatcatcaacaacagaaggcttgcctattttcttggaggagagaagaactttcatgagagagacctcaagaggagcttatagagtttcctcctatgttttagcaaatacccttgtgttccttcctttccttctattggttggtcttctgtattctactccagtgtattggcttgtaggattaaggaaagacattgatggtttcctttacttctccttactggtttggttggtcctactcatgtcgaattctcttgtggcttgtttcagcgctctcgtgccgaatttcatcctcggaacctctgtgattgcagggtctgagagattcacaaaaatggaccaatttggctgtaatgttgagcttcatagtgggttatag

SEQ ID NO: 84941 - DNA, 1332 bp, Glycine max
  Peptide Sequence Number=SeqID_201719
atggcattgcgtcatttacgattcttccctcacacacttcctctaactctcactcccactcccaatcccaataacagtaaccgtttttccttcttcactccctcactctcttccaccacgctcatggccactgctcacaaggtcctggttcccatcgccgacggcaccgagcccatggaggctgtcatcaccatcgacgtcctccgacgctccggcgccgacgtcaccgtcgcctccgcctccgacaacctcgccgtccaagctctccatggcgtcaagatcatcgccgacgcccctgtccgagacgtcgctgccacctcctttgacctcgtcgctctccccggagggttacagggtgttgagaatctgagagactgtaaagttctggaagggttggtgaagaagcatgttgaggacggacggctctatgcggcggtgtgtgctgctcctgcggtggtgctcggaccttggggtttgctgaatgggaaaaaggcgacttgttatcctgcattgatggagaaattggccgcttatgcagccgctacttctgagtctagggtgcaggtggatggcagagttgtgaccagtcgtgcgccgggaactaccatggagtttgccatcactttgattgagcagttaattggaaaagagaaagcagatgaagttgcaggctttgggaattgggaatgtatgagtgaactggtcatgcattccaatcatgatgatgaacatacttttaaggagtttaacccagtgcagtggacatcagacaatccacccaagattcttgtaccaattgcaaatggttcagaggaaatggaagctgttatcatcattgatattctgcgaagagcaaaggcaaaggttgtggttgcttctgttgaggataaactagagattgtggcatcacgcaaagttaaactggaggcagacatgctccttgatgaagcagccaaactttcatatgaccttattgtgttacctggaggacttggtggtgcccaaacttttgcaaactcagaaaccttggtgagtttgctgaaaaagcaaagagaatcaaacatatattatggagcaatatgtgcatccccggctttagtcttggagccccatggcttgctgaagggtaaaaaggccactgcctttcctgtaatgtgcaacaagttatcagatcagagtgaagtagaaaacagggtggtagttgatggcaatcttattaccagcagaggtccaggaacctccattgagtttgcattagctattgtggagaagctgtttggacgcaagttagcactagaacttgcaaaggcagtagtgtttgcacgcccttag

SEQ ID NO: 84942 - DNA, 678 bp, Glycine max
  Peptide Sequence Number=SeqID_201720
atggaaaacgtccaatatgggacgtgggcaaaactattcaagatttatgcatgttctcacaaggtcctccaccacattgtcccaccggagaaaggtagggagaagatgcctaaaattgatgaagaaaagaaattgtggtcaacccttgatgttgcggcttacaatggggttgtcacactcattcgccaaagctatcatcttccaccattttatcaagcccgctctatgctcaccttagaagaagttggtctcgcgaagaaggctgcaatcagtgggggtgccgccatggtggcttgcgacactaatgactctcactccctctccaaaaattcccatcaaaattggaatactcatgatgataaaagggtcaaaaccacaacaatggtggcaatcgcggtggcatcaagagcaatgatggtggcaaccgcaatagtggctagcagcagcagtccagccagtagcaaccggggcactaacagtggcctactggacaatagtaatggtcatggatgccttgggctcttccaccttgcccatacccctcatccaacggcccacccccttcctcacattggattaggccaaatttttcgcaagcccaatagcaccagacaagcatccttaggccaaaaccactacaggcctacatggcggcaacaacacctccacccactttaa

SEQ ID NO: 84943 - DNA, 285 bp, Glycine max
  Peptide Sequence Number=SeqID_201721
atggctaacgtgaccatatcgaattgtcaagaaatgtatttatcaacaaattacatgttcaatgagaaaagtgattatttaacaaaaagaaaaatgacaccccaaagggtggataaggcgatacatttaatccaatgtgatccgaatgagcaactacagctaaacatgagctacctgcaactccgaatagcttccactgtagaccaaaatggatgcatatggctaactccatttgtaacaaactggaccacaactttagagtcactctcaaataacagtttttga

SEQ ID NO: 84944 - DNA, 423 bp, Glycine max
  Peptide Sequence Number=SeqID_201722
atgaacgaacctggcggttcgggacagagcagcaggtttggggattcatttgttgacgtggaagggttgcttctgttcatgctgtgttcgaagtctggggatttggctatggcggatatgcggtttttgaaggacgatccttgggtttatttgaaggagaaaaaccctagtttggtgagttatggtgaagtaaggaatattgtggtgcattgttataggggacaagtgtttgtggctaaagaagagcattggaggtttggtcaagtgtggaacaaagggaaaatagtgggagtggtgctgaagggttttatagaagggattttatggataagagagaggattcagagagaggggttgtttgttagtagggaagatgttgagggtattgaagtgtgggagagattggcaaatttagttaggtaa

SEQ ID NO: 84945 - DNA, 480 bp, Glycine max
  Peptide Sequence Number=SeqID_201723
atgtctcttgctactttgtttggaaaactgcaagaacatgaaatggaactccaacatcttaatcaaaatgaagaaactgacaaaaagaaaagaagtatagcacttaaagcctcttcatcaatgcaagaagaaaatgaagaagatgaatcagacttctcactctttgtgaagaagtttcaaaaatttgtcaagaagagaagaatcgagaggcgtcaaaacttcaacaatggaagaaaatctcaagaagactctcaaattcttagatactacaaatgcaatcaacttggtcacatcaaagcaaattttccctcaaatgaagaatggcctaagaaaagtgataagaaaaggtatgaagaaagaaggaccaagaaggcctacattgcatgggatgacaatgactcatccgatggttcagaaaaggagatcaaccttctgaccaaggactatgagagtgatgagaacatctctcaagaaaattaa

SEQ ID NO: 84946 - DNA, 150 bp, Glycine max
  Peptide Sequence Number=SeqID_201724
atggtgttggatggttgggtgcaagcaatgatggccttgaacgcaatcaaggtgaaccatcaactagggggtggaaataggtcaggccagactttgaaaaacctgagcttagcctacgatgaatttttgagacctgagtctagcctatag

SEQ ID NO: 84947 - DNA, 465 bp, Glycine max
  Peptide Sequence Number=SeqID_201725
atgtggatattgacaaatgcggaaattctaggatcattgaaggctcaatgtcctctccttctacgtattattaatgggtttggtgttgacaaattaacatctgttgcaaattgcaataggagagaaagttttgctttagttactttgcgtatgtcatactttgaatgtcctacttatatgctacgctttatcctgcagggattaagagggttatatgcaggcttccttcctggggttcttgggtcaactatttcatggagtttatatttcttcttctatgacagagccaaacagagatatgcaaggaacagggaggggaagttgagcccaggtctgcatcttgcctcagcagctgaagcaggagctatatggttccatggccaccatggtggaatggcatggcagattttttgccaaccgccatggggaaaatgtgaagggatgcctgctatggcagcgccatag

SEQ ID NO: 84948 - DNA, 456 bp, Glycine max
  Peptide Sequence Number=SeqID_201726
atgagggaggaaggatttagtgcactttacaaagggattgttccagatgcatttaggaccataatgagggaagaaggatttagtgcactttacagaggaattgttcctggtctatttctggtctctcatggtgctattcagtttacagcatatgaggagctacgcaaagttattgttgattttaagagtaagggaagtacagtagataatcaaaaccctgataaattgctgaattctgttgattatgctgttcttggagcaacatcaaaacttgctgcagtacttctaacctatccatttcaggttatacgggctcgattgcagcaaagacccagtggtgatggggttccaagatatatggacactttgcatgttgtgaaagaaactgcacggtacatattaaaacccatcctagatttagtttacatctttatattggcaaataagcaaaggtga

SEQ ID NO: 84949 - DNA, 513 bp, Glycine max
  Peptide Sequence Number=SeqID_201727
atgagatggaactccaatggtcttaatcgaaatgaagaaaccgacgaaaagaagagaagtatatccctcaaagcctcatcatcaatgcaagaagcaaatgaagaagaagattcagatgatgaagaagacttctcactctttgtgaagaagtttcagaaatttgtcaagaaaagaagaatcgagaggcgtcagaatttcaacaatggaagaaaatcacaagaagactctcaagttcttagatctaattgcccttcaaatgaagaagggcctgagaaaagtgataagaaaaggtatgatgaaagaagaaccaagaaggcctacattgcatgggatgacaatgattcatccgatggttcagaaaaggaaatcaaccttctaaccaaggattatgagagtgatgagaacatttctcaagaagaaccatcaaagaagcgaaagggttcttcgagtcggagtcaacgtcattctgagactcaggaaacgccgattccttcctctattccctctgcctaa

SEQ ID NO: 84950 - DNA, 276 bp, Glycine max
  Peptide Sequence Number=SeqID_201728
atggaggaaactctatgttgggtcatctgtgcattttttgggaagcttgatagagaaatagaaactgtcagagctagattttcatatatgcaaaaattgcattgtgcattgagttgcaatgtaatttgtctctatgtgagtagattctctgtgaagttttctctgagtagacgtattcctagggagctaaaaatccaaaagcaaaactacctacttataacaccatttggcaaatccaagatgacctatactatggtcattcaagcttgtcattga

SEQ ID NO: 84951 - DNA, 210 bp, Glycine max
  Peptide Sequence Number=SeqID_201729
atggcaacagtcaagaagactggatggagatcaaggaaccaatggttctatttcttctatgagaaggtgagagaaagaaataagaagcatttgaggagtagaggtgacgtagctccatgtggagcttgtaggccatgcatcttcttcataaatggagtccttttcttcttgaagatcaacggtagtggaatagagatggaagaaagatga

SEQ ID NO: 84952 - DNA, 237 bp, Glycine max
  Peptide Sequence Number=SeqID_201730
atgacaccacatttactcacggctacagcgacctcattcttcacattgtgcctagtccttcaccctcctacaatggcagggaccttgccctctaccgtaccaacccttgcactctccccacaatgttgcaccaccaccttcctcttccttcctttaagcatagccattgaaggttttggtgcgaggtggattttggtggagataggtagctattccaaaacaaatgttctggaatag

SEQ ID NO: 84953 - DNA, 189 bp, Glycine max
  Peptide Sequence Number=SeqID_201731
atggttccgagaaagctttccgcaaagagatctagcaggacgccgcgactaaaggaactagtgccgctcctgagttcgacatccatcgtttcaagagcactgagcaccagcagcgtttcaaggccatcaaggcgccctcaaccagctcctgggatacccgctagtgttggaggagggccaggagtgtga

SEQ ID NO: 84954 - DNA, 646 bp, Glycine max
  Peptide Sequence Number=SeqID_201732
gtatgttcctctacaggcgtgcatgcacaagttgccgactgacaaggacgagagaggaactagatggcctgaaccttggcctcgtagactggaaaaagccccatattggttaaacaacttgcagggtggaaaacaagcttctcatgattttgcaacagacaatgaacgttggaaaaacgttgtagatgagttgagtaacgttggggtttcttggtctaacgttagaaatatcatggacatgcgagctacttatggaggatttgcagcagctctgaaggatcttcctgtttgggtattcaatgtggtgaacacagatgctcctgacacacttgctgtcatatatgaacggggtctcattggaatataccatgattggtgtgaatcctttagtacctatccacgaacttatgatctactacatgctgatcatcttttctcaattctaaagaataggtgcaatcttgttcctgttgtaacagagattgatagaatagtaagaccaggaggtaatttgatagtccgtgatgaatctagtgtcattggagaggtggaggctttgttgaaatctctgcattgggaaataacctccacaaatctagagggattgctctgtggcaagaaagggatgtggcgacctagctcttga

SEQ ID NO: 84955 - DNA, 348 bp, Glycine max
  Peptide Sequence Number=SeqID_201733
atggtgccgggccgcgacgtggtctggctgcaggtgccgttctcctccctgccgggcgagcagaagaacgtcgacaccaagctgcctaacggcgccaactacggcttcccggtcaacaccatgcgcatcgccgccaacaagcagtgggccgaagccaatccggcggccgccaagctgttcgccatcatgaagctgccgatcgccgacatcaacgcgcaaaacctgcgtatgcatgaaggccaggcttcggaagccgacatccagaaccacgtcaacggctggatcaaggcgcatcaggcgaccttcgacggctgggtgaaaaccgccgccgaggcggcgaagccgtaa

SEQ ID NO: 84956 - DNA, 318 bp, Glycine max
  Peptide Sequence Number=SeqID_201734
gcgctggcggaagtgccgctggtggatttctacagcggcaccggtgcgcggcgccaaaccgatcgcgccttccaggcggcgggcatccgccggcacgtcagttttgaaatcgatcatatcgaatggttggagaatctggtgcggcgcggattggcggcgggcatcgtaccgatctcgaccgcgcaacgcctaagcacgctggtgtcgattccgattgaagacgggccgcgacgccaggtgtattgcatctggccgcagcccttgtcaaacgccgccgcacgttttttacagttcagcggcattgatatggcggggtag

SEQ ID NO: 84957 - DNA, 420 bp, Glycine max
  Peptide Sequence Number=SeqID_201735
atggcaataggccaaggggtgcccaagctatggaggttgttaggaggagtgcttagaatgtctacaaactcttggcatcgtctgcacctcctagtgaagtcgtgggtgttgaccttgagtgtcggccaacagtatcttgcatgcaccactttggttgcaagggagcatccccagcatttgagcaatggtgttgtcaaccctcttttgaatagctcgccatcaaggattcatccagtccggttcctccttttctcctgccatgacctccttggtgtcaatggtcagagcttggagtgtcacctggatgatggttttgagatgcccgacctttttagtgctagccaccttggagagcaggtctgctctagtgttgctctccctgggtatgtggatgttgcccttgctcctatgtatcctcag

SEQ ID NO: 84958 - DNA, 1286 bp, Glycine max
  Peptide Sequence Number=SeqID_201736
atgggttggtcagatcacatcgtggtgcaaattctaagggcgtcatttcaactctcgaaaattactagagggttgcatcctcacttaaatggggtgtacattcggtttcggtcaccgtcattcttgagttttggttcattttctgtaatctctttgcatcttctgtgcggatcttgcaatttccttctctcttttgatcgtcttcctcacttcaaggtacatccttattccattatgtcttttgtttctgattccgctatgggtatgaccggaagtgatttcgaggtattcaacaaccccttgtggatcgtgaagttgttccaatcggtgacttctcctcggaggagacatgacgtgaagcttctgacaacgagtcctcttcctccaagaggttggtggacttgtgccatatcagtaggggtacctcgtcctcacagtagggtaaggccttctgatgcccctttagatgaagagtttgtccctgtcaccatgatccttccctgtgtacccagaatgaggtatttggatgttgtagagacttgttggaaaaagaggaatgatttggaatgcaaggtggagcgtattactaaagagaaggaagatcttgcagtgataatgactgaatccgctaaggagtctatgctcgaggtgacaaaggagatagaaacaaccaaagagttggaggaggagctcttgatgtttaagaaggaggctatggagcaggacgagaagggattttacaaggccgttaggcaagccgggtttttcaccaaaggtcttgacttgggtctttttgaaccatttaaggacgtgaaggatggtgaactgattgatgtggaagaaatagccgccacagaggagggcatcgaagaggagcaagatgttggggccaatggatgcattcgtcttgggttttggcaaggctcaccaagggcagaccttaggtttgacaagcctttggagattcaacaagggatgcgttcatcctgggtttcagagagactcaccaaggggagagccttgggtttgatgagcctttggagattcgaccagggacgtgctcttcctgggtttaccttggacttgccatatgtagaagcaagcttcatgatgatgaatcaagttgattcaaagggtacatctacttgggttgttgtgactgagaacaagagagggtacatctcttgtggatcagttcaagtggagggtacatccacttggttgttcaaagagaacaagggagggtacatcccttgtggatctttgcttgtaaaggattttacaag

SEQ ID NO: 84959 - DNA, 345 bp, Glycine max
  Peptide Sequence Number=SeqID_201737
atgaaagacagtggactgcttgacaaagaggaaatagttgttgtggaagaggatgctggctcaccaagggcggactttgggtttgtcaagcctttggagatacgagactcacacacagcggaccttgggtttaacgagcctttggagaagcaaggctcaccaaggatggaccttgggtttcatgagcctttggagaagcaaggctcaccaaggatagaccttaggtttaatgagcctttggagaagcgagactcaccaagggtagaccttgggtttgacaagcctttggagaagcgagacgcaccaagggtgaaccttaggtttgaaaaacctttggagaagtga

SEQ ID NO: 84960 - DNA, 1101 bp, Glycine max
  Peptide Sequence Number=SeqID_201738
atggagtgccacgtcacttgccacatccattttgtggaccctaaacaatacataagccccccaagttttgagccagcttgttggcgaaagagattgtctagtgtcaagggtagagccttgacaagtaggagggtcgtgagcttgttgagcccccaagcttggacaagtgttgtccggtgtcgaagggaggacacacttcttgttttgcaggaaaagtcaaacatgtcaagcaagggaagtcctttgcagtgcacgcatgttactctagcatatgtgtcacttgaggagtggacacgtattggagatgtggtgcatgggatagtagggctacctcgtgaggggactcgccaagaagcttctaatagcaagtcttcttcctttgaaagggaacctgttccagtcaccatgatctttcccctgtctgcttctaggggagtgagaaggagtggcagcggggatatcaggatttctccctacaataggggtagctgcaatgctaggtcaccttcgtcctctcccactgttgttggctatgagttggtatggaacgatgtgttgaaatatcgattctccattacctctgtggcaagcgtttttgctctgaagcgccaactgaaattggccaactcaaaggattcctacaagatggtcatccaggcttgtgggagtgatgattttccctttcttagggtggtcgtgtccaagaagttgttcgagattgacttgaacgtgtttcgccacttcaaggactattttttcaaggtcctggcaactgacatcgtggctaatggggttaacaaggccattttggagcagttgccagcctcattggatgctcgggccaccttgtctcttccttcgtcagacgatcatttcattgtattagatggtcggacatgctggtgggactgtgcccgccttctattgtcgatcctcttattagaaaaggagggtcaaattactactagggttgaccctaacatagatgaagttgtcgaggtcacccttaacattccttcctctgttttggctaagaggaattcaggtcacccttctactgctggttcgcaaggtccgcctttggctccgtcggccgtctag

SEQ ID NO: 84961 - DNA, 360 bp, Glycine max
  Peptide Sequence Number=SeqID_201739
atggacatattgggaccactatcaaaagccctaagagcaatcaagttcttactagttgccatcagctatttcaccaaatggattgatgcaaggccattacgggaaatctcagccaatgaggtagaaaaaactccccaatataatctgggcctatcactgttcaccccagacaacaaccaacaaaacttctttccaacttacatacgacacaatgaagagaaaataagggtgggactagagacaaaggaggaagttcgagggatggctagaatcaaagaagaggccaccaagcttcaagcatcaaggagattcaatacaaaggttcagcctcaagcttttaaacctagcaacctaatgtga

SEQ ID NO: 84962 - DNA, 243 bp, Glycine max
  Peptide Sequence Number=SeqID_201740
atgaaagcgaaagctgcgcaacctccagtggctaggcgcaaccttcagtggctaagcgcgaggaagaatccagaagaagatgagttgtcaagtttgctaagcgtaccgctccaagtcatcaagcacaccgcttcagctcatccgctaagcgaaacaagtgcgctaagccagaatccacttatgcacgctaaacgatccatatctgtgctaagcacacaagcacgaacaaggccacctatttaa

SEQ ID NO: 84963 - DNA, 210 bp, Glycine max
  Peptide Sequence Number=SeqID_201741
atgactttgagcttagctcatcagtgggctaagcgtgcatccaccactaagcgtagcttcagtgcacttagtgctacagaagaatctggcagagcatcaatatcaaggccgcgcgataagcgcgagatcagtgcgctaagcacaacagttgtcttcagccaggctcagcgcacgactggcgctaagctcaaatccacttactcgcgctaa

SEQ ID NO: 84964 - DNA, 204 bp, Glycine max
  Peptide Sequence Number=SeqID_201742
atgccttgggcacgagaatgtgtgttcttttcaaagatgtatatatgtgtggaaatggctttgaggaagctttcctcgaagagatctaggaaggaagtcgcggccgcaggaactagtgccgctcccgagtttgatagccatcgtttcaggagcactgagcaccagcagtgtttcgaagccattaaaggatggtccttccactga

SEQ ID NO: 84965 - DNA, 546 bp, Glycine max
  Peptide Sequence Number=SeqID_201743
atggcggcttgtggtggccaccgatggtcatgggtggtggaaaaggagtttctagcgcaacatttcatgctgagggcaattcctctcaagttggaatttgcactgagcgcgacattttgtgctgaatgcaatttgtctcgagttagaattgcgcttaatgcgcttgtctcactaagagagattcccagaagtgttattttgcacatcccaatggtttatactggagatcaaactctaatagttctacggtccatgctgtcatccttcctaccagctcaggctttcactacacctgttgatagggtagttcatcttgactaccacttggtgactttgaaagtatggcttgaggcattgagcctaggtaatgagtgtcagcgctaccttttatatcatctggtactatttctcagcatcatgaaggatatgactggtaaaatagatgggaagattggtggcgtggcaatagttttcttaaaggctaagaaagcttgcttgcaagcttcatcccatgaaaatggcttaattttcctaagtaacttgtag

SEQ ID NO: 84966 - DNA, 375 bp, Glycine max
  Peptide Sequence Number=SeqID_201744
atgttgaccaactacaccgatctcaacaaggcgtgccccaaggatgcatatccattgcctagcattgacaggcaagtcgacaacgcgtctgggttccaagtactgagttttcgagatgcctatttaggatacaatcaaatcaaaatgcacacccaagacgaagagaaaacaacattcataactaaggatgctaatttctactataaggtctacgtggatgacatggtcgtcaagtcctatagcatagcccaacacatggcagacttagaagaggtatttagagaactccacaagtacgagatgcgcctcaactgggaaaaatgtgctttcaaggatggtggaggcaagttcctgaggttcatgatcacatgttag

SEQ ID NO: 84967 - DNA, 291 bp, Glycine max
  Peptide Sequence Number=SeqID_201745
atggggggtgcagtgaccaagttggatatccctgatgggggaaatagagtgagaaaatacttgtacttgggagcatgtcactcggtttggaactcccttgtgactcagggtgatcacatgggagggggaaggggagttgcctatgcacgacagggtgatttcgatacttgttacctagttttcatgagtgtgagtatcgggtggacatgctcaggctatttcctgacgaatggtaccacattgcatttaaggattaaggtcaagtgcatgcatcatattgaacatgattga

SEQ ID NO: 84968 - DNA, 417 bp, Glycine max
  Peptide Sequence Number=SeqID_201746
atgtcgtccggcggccccaccacgacctcctccaacaccagcccaagggtcgccgcgggccccaccaccactcgccgtcgcgtcgccgacaacaacaacaacatcgtagacgccgaaaaacagcagcaagttacctcaagcttctccgatttctccgaggtcgaagccgacgagaatgtcccccacccccaccccctccacgcccacgcacaccaccaccatgtgcatcccgtcacgcgatacctcctcctccgcgcgcgcatcctcctctgtgtccccgagtccttcttccagcgcgtggagcacctcgtcctctggctcgccggctccgtccaaagcctccggtccggaaaacacgtcggccgcaaaatcttcctcgccctcatcttcatgctcgtcatgtcggtcttcctcaag

SEQ ID NO: 84969 - DNA, 395 bp, Glycine max
  Peptide Sequence Number=SeqID_201747
atgttgggtactgagaagttggctctgaccgtaacactgactccagaaatatggatgaagccaaacagtgacaaatattacaaatgcgtttctcgacccaggaatgtaataaggctaaaaaagacaaatggctatcttcttgttcatgcaaatggtggattgaatcaaatgagaactgggatatgtgatatggttgcagtggcaaaaataatgaatgccacccttgtgcttccctctcttgaccatgattcattttggactgatccaagtgactttaaagatatctttgactggaggcacttcatgaaagttttgaaagacgacattgagatagttgagtacttgccggtccaatatgcatcattgaaacctcttgtgaaggcccctgtttcctg

SEQ ID NO: 84970 - DNA, 1889 bp, Glycine max
  Peptide Sequence Number=SeqID_201748
atggcacaagctaccaagtcacgcaacagcaggaggccatcatcatcttcctcttacacatcaaccctaacaaccctaatcttcatcgcactatgcgttttgggcttatggatgctaacctccaacaccgtagtcacacccaaaacacgcactgccattgatgataatatctccgaaaccaccaacaccgacctcacccaagacaccaccgccacaaccacaacaacaaacaacatccccgatgattttgctgaatccatcacaaccatctcccaagacctgccacgtgagaccgccacaaatataccacatgaaatccacaccaaaattcaagaccaaaaggacgctacggtgttcggcgacaaccccggaaacctccccgacgatgccataaagaatgatctcaagaaagaaacttccattattgcgaacgaagctactggttccgacagcgatcagaaagcgaacgagagcgagaaagaatcgcaaaacaacatcatcatagctcaagatgaaaaagaaaacctaaactcaaaacaaaacacagaacctgagattgcaaatgtgagtgagaatattcaagaagagggcacaggaggaggaggtaagagcaacaacaacgacgatgacgcgaacgtgcagcaactgagagaagacaaaggtgaggcagtggcggagagagagcaaaaggaaaaagaggagaatgagaagaggaagaagaacaatagaaagaaatcaaacaagggtttgaagaaggaggggtcatcaacagaatcgaatgatgatgagtcgacacagcggggtgagaaaaagggatcatcaactgaatcgaatgatgatgagtcgacacagcggggtgagaaaaagggatcatcaactgaatcgaatgatgatgagtcgacacagcagggtgagaaaaagggatcatcatcacagaatgatgaggaatcatcatcatcagaagtgatgcaattgcaggataatttgaagtggagtttgtgcaatgtcacggctggtatggattacataccgtgtttggataatgacaagtatttgaaaacttcgcgcagaaagcactacgagcatagagagaggcactgccccgaggatgctcctacgtgcctggtgccacttcccaaaggttacaaaacaccaatacagtggcccagcagcagagataagatatggtaccacaacataccacacactttgctagcagacgtgaagggacaccagaactgggtgaagttaacgggtgaattcttgacattcccgggaggtggcacccagttcattcatggcgctctccactacattgattttcttcaacaggctgaaccaggtattgcatggggaaagcacactagggtgattttggatgttgggtgtggggtaggtagtttaggaggttacctatttgaaagagatgttattgctatgtcttttgcacccaaagatgagcatgaagcacaagtgcaatttgccctagagagagggataccagccatatctgctgtcatgggtactcaaaggttgcaattccccagcgaggtctttgatcttattcattgtgctcgctgtcgtgtaccttggcatgaagatggtggcttgttgcttttggaattgaatcgcctccttagaccagggggttattttgtgtggtgtgctacacctgtgtaccagacaattgaagaagatgctgagatatggaagcaaatgaaggcattaaccaagtccatgtgttgggaactcgtgaccataaaaaaggatgcattgaatcaagttggtgctgccttctaccgcaaacccacttccaacgaatgctacgagcaaagggagcaaaaccaacctccaatgtgcaaaactgatgatgatccaaatgcagcatg

SEQ ID NO: 84971 - DNA, 201 bp, Glycine max
  Peptide Sequence Number=SeqID_201749
atgtggatgacaagagtagcaggacaacactatatccgagtgtatataggagattcaaatgctgttgaagattttcttggttatattggagttgaagttcagataacaactttccatctgtattttttggggcacctttggaagattatcatagggcaacagcgtttcaaagtaataactaagaagaactatggatattaa

SEQ ID NO: 84972 - DNA, 1077 bp, Glycine max
  Peptide Sequence Number=SeqID_201750
atgaccggggtctgttccatccgacaaagagaaaattgcatgaaacctgcgcttcgtttagccggtgcattgctgttgtcctgtttcggactgtctgcacctgcgtttgctacggaataccccctgccagccgctgatagccgtttgattggcgaaaacaccctgaccaccgtcccggatgacaaacggccgctggagagcattgccgcgcgttataagataggcatgcttggcatgctggaagccaacccgggcgtcgacccctggctgccgaaagccggaacgcagcttaccgtgccgctgcagatgctgctgccggatgcgccgcatgaaggcatcgtgatcaacctggccgaactgcgtctctactattatcccaaaggagaaaatcgcgtcgtggtttatccgatcggcatcggccagttgggtgctgccacgccgagcatggtgacaagtatcagccagaaaatccctaaccccacctggacgcccaccgtcaatatccgcaaacgctacgccaaagagggcatcacgctgcccgcgatggtgcctgcagggccggataacccgatggggctgtttgcgctgcgtctggcgcgcggcagcggccagtatctgattcacggcaccaacgccgacttcggcatcgggatgcgcgtcagctccggctgtattcgtttgcgcccggacgatatcgaagcgctgttcaatagcgtgccgcagggtacacgcgtacaggtgattaaccagccgatcaaatatgccatcgagcccgacggcaaacgctacattgaggtacaccagccgctgtcgcgtaatgaacaggacgatccgcagaccatgccaattgcgctgagtgcgccgctgaaagcctttataaagagtgcgaagagcgacagtgcgctgataaaggcggcgattgaacgtcgttcaggcatgccggtgctggtgagcagtggggaaccggtgaatgaggcgacgccgctgccggcagtgctgcagacgcagcagggggcaacaggcggtgcgcaagccaccatcagtcaggcgcagggcgaagccgctgcgacaccgtga

SEQ ID NO: 84973 - DNA, 3331 bp, Glycine max
  Peptide Sequence Number=SeqID_201751
atgccgactgcgactaacgcgcgtaacttcacccagtgtgactcgatgctgattgggccagactgcggtgcgcacaccttcccgtatgtggaaacgcgcaacaacagcgcgcagcttgagcacgaagccacgacgtcgcgcatcggtgaagatcagatgttctactgcctgcagcgcggcattagcgaagaagatgcgatctcgatgatcgtcaacggcttctgtaaagacgttttctccgagctgccactggaattcgccgtggaagcgcaaaaattgttagcgatcagccttgagcacagtgttagcgttgaagacaaagagattttgcgcggtctgaacctcgaggttaagccgggcgaagtgcatgccatcatgggcccgaacggctccggcaagagcaccctgtctgccacgctggccggtcgtgaagattatgaaatcaccggcggttccgtgacctttaaaggcaaagacctgctggagctggagccggaagagcgtgccggtgaaggcatcttcatggcgtttcagtacccggtcgagatcccgggcgtcagcaaccagttcttcctgcagacttcggtcaatgcggtacgtaaataccgtgagcaggaagagctggaccgtttcgacttccaggacttcatcgaagacaagatcaagctgctgaagatgccggaagatctgctgacccgttccgtcaacgtcggcttctccggcggtgagaagaagcgtaatgacatcctgcagatggcggcgctggagcctgagctgtgcatcctcgatgaaaccgactccggtctggatatcgatgcgctgaaaattgttgcagaaggcgtaaacagcctgcgcgacggcaagcgctcattcatcatcgtaacgcactaccagcgcatcctggattacatcaagccagatcacgtgcacgtgctgtatcagggcaaaatcgtgaagagtgataacgcgctgcagcagtggcatcacctgtttgagtcacgcggcgaacagcgttcgctgcaggcacagcagcactggcagcagttgatgcgtgtcggcctgccgacgcgcaagcatgaaaactggaaatacaccgcgctggacagcctgctggctcagcagtttgtgcaggcggaagcgccaggcgtgagcgctgagcaggtggctgcgctggcgctgccgctggacgcgatttgcctggtgttcgtcgatggtcgcttccagcctgagctgagcgcgcgtgataccggtctgtttgacgtgcagcacagccgtgccgctgagcgacgtccgttaccggctgcggtacagccggaggtgttcctgcacctgacggaaagtctggcggaagaggtgacctcgattcgtctgccgcgcggcaaagctgcggcgcagccgctctatctgctgcacattaccagcggccaggcggatgcgcttaacacggtgcatcatcgtcaccatctggagctggagtccggcgcggaagcgcaggtgatcgagcattacgtgacgctgaatggcagcgcccacttcaccggcgcgcgctttacctttgcggtgggcgacaatgcgcagctgaagcataccaagctggcgtttgaagagagcagcagctatcactttgcgcacaacgacatcgtgattggccgtgacgcgcaggtgagcagcaccagcttcctgctgggtgccggtttgtcgcgtcacaataccagcgtgcagctgaacggtgagaacacccagctgtcgctgaacagcctggtgctgccggtaggcagcgaagtggcggatacgcgcagctatctggagcacaacaaaggccattgcctgagtcgccagctgcacaaaaccatttcgcgtgacaaagggcgctcggtgtttaatggccacattaaagtggcgcagcacgcgctgaaaactgacggccagatgaccaacaacaacctgttgctcggtcgcctggcggaagtggacaccaagccgcagctggaaatctacgccgatgacgtcaagtgcagccacggcgcgactatcggtcgcatcgacgacgagcagatgttctacctgcgctcgcgcggcatcgccgaagacgcggcgcagcagatgatcatccatgctttcgccgctgaactgacggaagcgctggaagatgacgcgctgcgccaggtcaacggacatccgctggcctaccttgacagcgcggccagcgcacagcgcccgctcgcggtgatcaacgcggaaagtcacttctatcagcacggctatgcggccgtgcaccgtggtattcactctctgagcgcacaggcgaccagcgatatggaaaacgtgcgcgcccaggcggcgcgttttctgcgtgccgcggcagccgaagagatcatcttcgttaaaggtaccaccgaaggcatcaatctggtggccaacagctggggcggcagtcagctgcagccgggcgataacctgatcgtcactgagatggagcatcacgccaacatcgtgccatggcagatggtggcccagcgcaccggcgcggaaatccgtgttctgccgctcaacgacaacggtgagctggcgctggaacagctggcggggctgatcgacagccgtacgcgcctgctggccgtgacgcacgtttccaacgtgctcggcacggttaacccggtgaaagctatcgtggcgcaggcgaaagccgcgggcgtggtgacgctggtggacggtgcccaggctgtgatgcaccaccccgttgacgtgcaggatatcggctgcgatttctacgtgttctccggccataaaatctatgggccgaccgggattggcgtgctgtacgcgcgtaaggcgctgcaggagatcatgccaccgtgggaaggcggcggttcgatgatcgatcaggtcatgctgcccaccggcaccacctggaatggcgcaccgtggcgctttgaggccggcacgccgaacactggcggcatcattggtctcggcgcggcgctgacgtggatcagcgaactcggtctggagacgatccatcagcgcgagagccagctgatgcgttacgcgctagacaagctggcgtcagtgccggacctggttatttacggcccggccgagcgcagcggcgtggtcgcgtttaacctcggtaagcaccacgcgtttgacgttggcagcttccttgaccagtacggcattgccatccgcaccggccaccactgtgccatgccgctgatgcgtcattatgcggtgcccgcgatgtgtcgcgcctctttcgcgctctacaacagcgaagatgaagccgatcgcctggcggctggcctgacgcgcattcatcgtctgctgggcg

SEQ ID NO: 84974 - DNA, 1572 bp, Glycine max
  Peptide Sequence Number=SeqID_201752
atggatgatcatctgctgcgccgcgtcttcggcgatgccgcgcgagcgcaggtagaacatctgctcgtcgtcgatgcgaccgatagtcgcgccgtggctgcacttgacgtcatcggcgtagatttccagctgcggcttggtgtccacttccgccaggcgaccgagcaacaggttgttgttggtcatctggccgtcagttttcagcgcgtgctgcgccactttaatgtggccattaaacaccgagcgccctttgtcacgcgaaatggttttgtgcagctggcgactcaggcaatggcctttgttgtgctccagatagctgcgcgtatccgccacttcgctgcctaccggcagcaccaggctgttcagcgacagctgggtgttctcaccgttcagctgcacgctggtattgtgacgcgacaaaccggcacccagcaggaagctggtgctgctcacctgcgcgtcacggccaatcacgatgtcgttgtgcgcaaagtgatagctgctgctctcttcaaacgccagcttggtatgcttcagctgcgcattgtcgcccaccgcaaagcagatagagcggctgcgccgcagctttgccgcgcggcagacgaatcgaggtcacctcttccgccagactttccgtcaggtgcaggaacacctccggctgtaccgcagccggtaacggacgtcgctcagcggcacggctgtgctgcacgtcaaacagaccggtatcacgcgcgctcagctcaggctggaagcgaccatcgacgaacaccaggcaaatcgcgtccagcggcagcgccagcgcagccacctgctcagcgctcacgcctggcgcttccgcctgcacaaactgctgagccagcaggctgtccagcgcggtgtatttccagttttcatgcttgcgcgtcggcaggccgacacgcatcaactgctgccagtgctgctgtgcctgcagcgaacgctgttcgccgcgtgactcaaacaggtgatgccactgctgcagcgcgttatcactcctggtcggctgtttacgccttctgcaacaattttcagcgcatcgatatccagaccggagtcggtttcatcgaggatgcacagctcaggctccagcgccgccatctgcaggatgtcattacgcttcttctcaccgccggagaagccgacgttgacggaacgggtcagcagatcttccggcatcttcagcagcttgatcttgtcttcgatgaagtcctggaagtcgaaacggtccagctcttcctgctcacggtatttacgtaccgcattgaccgaagtctgcaggaagaactggttgctgacgcccgggatctcgaccgggtactgaaacgccatgaagatgccttcaccggcacgctcttccggctccagctccagcaggtctttgcctttaaaggtcacggaaccgccggtgatttcataatcttcacgaccggccagcgtggcagacagggtgctcttgccggagccgttcgggcccatgatggcatgcacttcgcccggcttaacctcgaggttcagaccgcgcaaaatctctttgtcttcaacgctaacctgtaa

SEQ ID NO: 84975 - DNA, 441 bp, Glycine max
  Peptide Sequence Number=SeqID_201753
atgcaggacttattgacaaacaatttctactttatgaaaaaacgacttctttctgttgctgctgtagctttctttggagtgatgctgaatgcacaacaaatcaaattcgaagagtatgatttaccaaacggtttacacgtgattcttcatcaggacaatacagcaccggtagttacaacaggagtaatgtaccacgtaggtgccaaggatgaagtaaaaggaagaaccggtttcgctcacttctttgaacatcttttatttgaaggaacacctaatatcaagagaggtgactggtttaaaatagtttcttccaacggagggcaaaacaatgccaatacaaccaatgacagaacatattactatgaaactttcccttccaacaacgaacaactgggactttggatggaagctgaaagaatgcgtcacgctgttatcaaccag

SEQ ID NO: 84976 - DNA, 441 bp, Glycine max
  Peptide Sequence Number=SeqID_201754
atggactatttgaaaggactcaatgaatcacaatacgaagccgttactactttacagggacctttaatggtacttgcaggagcaggttcggggaaaacgcgtgtacttactatgcgtatcgcccatctgattacaaacggtgtcgatcctttcaatattttagcccttacctttaccaataaagcagcacgtgaaatgaaggagcgtattgcaaaggtagtaggccccggtaatgcaagaagtttgtggatgggaacttttcactcggtatttgcaagaattttgagaagtgaagctcattatctgggatttccatcgaattttacaatttatgatcagcaggatgcgttgaatgtaatccggaaagtgctgaaggacatgaatatagatgcggatctttataaacctaaaaaaagtccaggcaagaatttcaaactataa

SEQ ID NO: 84977 - DNA, 375 bp, Glycine max
  Peptide Sequence Number=SeqID_201755
atggttgcttacgaagcagagaaggatgtgagctcaccattgaagactgttgaggaggaaaaggcagttgaggttattgatccattgggagagttggtgaagaacttgttcgacatttaccaaaggcccgttgaggtgtcatgggatggtgctaaatttggaatcaataatgtccaagatggcttctttatcacacatgctgatgtgagcgagataatattaggagacaagtgtttaaacatctccattctacagctatggcttatgtttattcatgattggagtgcgagcattggttatggagcattgtatgggttccttgaacctcagtgtatccacaatgatgcaatcctaccccgcaagggcattgggtag

SEQ ID NO: 84978 - DNA, 184 bp, Glycine max
  Peptide Sequence Number=SeqID_201756
atggaggcgtttgtaatcttgaatactcgtggaagctacatgtctctgtttatatgcgaaggggttagcatctttggaactttgctccgcaaaattaatggctgtgattctgccacgatgcagtgcgattgtggacaccgtttctccgcgagctcgttgatttgggttttgccgtcttttcttg

SEQ ID NO: 84979 - DNA, 216 bp, Glycine max
  Peptide Sequence Number=SeqID_201757
atgacaagttctataaaaattgagtgtgtctgtgatggagcagatgaatgcattttggagacaactacagttggtgttgcaagttcaaatggaggcccagaacaactagttatatttgtagttttaaaggaaggatacaattccaatgcagaaactctaaagatgaaattcagtaaagctattcaaagcaacattaaccctttgcttaaggtctga

SEQ ID NO: 84980 - DNA, 646 bp, Glycine max
  Peptide Sequence Number=SeqID_201758
tagtccttttccaaacgtggatggtttagtggacctagcagcaattgacgctttcctcgcctttcaccacagcaaggaaagcccggtcgtcaccgtcttggccgacatatacgacacattcgaccagaggggttgtattaactgtaatcccgtcctcgcaataagtcagcttggctaccctatgagaggagcaccattggtggagagcctcacacctttcatcacacggggtttcagtgaccccaacgcaagggatagagaacttagggggagtagcaatgggactgtcgacgggtatcataggtggttgagagcctacacacgaggtctggattggctcccgaagctgagagctgctaaagaggaagaggctgaagccccagaggaaagtgaagaggtgcaagctctcaaagcggagctcgagaaagcccaagcagttaaggaaagattcaaaacaagagccgtcagaattcaaagggagaatgacgaacggatggacatcaatgcagccactgccaaagccttggagcaagaaaccaagagggcccggaagggaaaacacgcccggaaggagctttgtggggcagcaacaacgagcttaaactctggagagaagaaagagactagtcacgagtggaaggcatga

SEQ ID NO: 84981 - DNA, 457 bp, Glycine max
  Peptide Sequence Number=SeqID_201759
tctatccctccacgacaagagttgccaaggtggtgaaaatctcagcacaagagttggaccgtgtaaagcaaaacaggaatggggtagtcggagtaccaaggaagtgtttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 84982 - DNA, 270 bp, Glycine max
  Peptide Sequence Number=SeqID_201760
atgcaagggtactccaaggagtttgcaaggcatgggatgcggcgtgaagaaaggacagagagcttaggggaagcaactgtgagagacaatgaggttaaagcttcggaagaaagtgatgaggtacaagccctaaaggcaaagcttgaaagagcccgggtagtcaaagagaagttcaaggcagcaatagtgagctcaagctccggaaaggtgaaaggaatcatcatgggtcaaaggcatgatctggaaggacgagcaaaagacttgccttag

SEQ ID NO: 84983 - DNA, 261 bp, Glycine max
  Peptide Sequence Number=SeqID_201761
taaggtgatccgatcctcgatcactcaggccttcatcgagaagtattgcatgcctaggcaggcgcagggtgatgcacctcaggccgcagacgcaccgccaccacctcatcaggccgatcccgctggatcacttggcatggagcgttatctaaagcacttggtaggggaggagctcgcgggatcccccggtgccgcagaggaggcctgtatggatgaagaaatgatggacttgcttggtttcttgggaggaagcggagccac

SEQ ID NO: 84984 - DNA, 201 bp, Glycine max
  Peptide Sequence Number=SeqID_201762
atggttggttcgattgttaacggagacgaagctggtgtgaatgaagaacaagatgattgttctgatacgttcaatacttctcaggatttttctacccgatatgatgttttgcattgggctcgatctgttgcttatgaaattgaatttgtggcggtgattatgaggtcatatacaaacactggtatgagaggaggaacttga

SEQ ID NO: 84985 - DNA, 252 bp, Glycine max
  Peptide Sequence Number=SeqID_201763
atggaggatagggtcacggccgaccgtcgtctcttcccggcactagacaagcggataacgtcgctgcaagacagcccagttagctcgcctgggcgagctgagctcgcctgggcgagcaacccctgcattcaaaatataaaaacgagggaggggaacgtttttgtacccaaaaacttcccccctcccccccattcaaaagagagaactcgcgaaggcttgcgttttttgctcccccaagtcacttttggttga

SEQ ID NO: 84986 - DNA, 831 bp, Glycine max
  Peptide Sequence Number=SeqID_201764
atggccactgcatacggcggcgccatcctcgtctccactccggtctctgccagcgaccacagcgtcggagggtcgcacctcgccgccgttcgggagaagatccacgaccccttcgccgtcgtgccggcgagagaggtccagcggtcggcgctgaccggcgccagcgccgcgaaccctctagacatgctcgtcatcggcggcggcgccaccggctccggcgtggcgctcgatgctgtcacccgagggctccgtgtcggtctcgtcgagagggaggatttctcctccggaacttcctctcgctccaccaagctcattcatggaggtgttcgttacctggagaaagctgtctttaaacttgactatggccaactgaagttagtattccatgcacttgaggagcgcaaacagcttattgacaatgcaccacacctatgccatgctttgccttgcatgacaccttgttttgactggtttgaagtagtgtactactggatgggcttgaaaatgtacgatttggtcgcaggagcacgactcttgcacttatcgagatattattctgcaaaagagtctgttgagctttttcccactctggcaaaggagggaaaaggtagaagcctgaggggcacagttgtgtattatgatgggcagatgaatgattcacgacttaatgttggattggcttgcacagcggcattagctggtgcagcagtgctgaaccacgctgaagttgtatccttactgaaggatgaagccagtgaacgcataattggtgcacgaattagggacaatttaactggtaatactttcttttatttctatctgttactatag

SEQ ID NO: 84987 - DNA, 324 bp, Glycine max
  Peptide Sequence Number=SeqID_201765
atgggttctcaagactatgattttggagcaagtctatgtgtcaatttgacgtcgcaaggtgccaaaagcaacaaagtcccactacgaaaggaaggacgctccgaatatggaggttcattgaggagactctcctcgaagttgttggatgaccacaattggtacttagaaaatgattgtaggacatttattgttcttgggggtgaggatcatacagcaaacaaagagccaacgctccatcttgaggatgagtgcacttggaggcgacggatacctaatgtgatcaatgacatggatcacttccttgggtatcccggttatgcatga

SEQ ID NO: 84988 - DNA, 552 bp, Glycine max
  Peptide Sequence Number=SeqID_201766
atgggtaatggcacccagatcgaattgtctacagctaaagaagctaaatctggcgttgattttttacctctttcagtagattatcaagaaaaatatgcagcaacaggccgtattccaggaggtttcttacgtcgtgaagctagactatcggattatgaggtcttgatctcccgtttggtagaccgtgcattacgtcctttgttccctgaaaactatcacgcagatacacaagtggcaattagcttgatctctgcagataaagatattatgcctgacgctttagcaggtttggcagcttctgcagctattgcggtttctgatattcctttcaatggaccaatttccgaagttcgcgttgcgaagattgacggtcaattggtgatcaatccaaaattatctgaacttgaaaaagcaactttagaatttatcgttgctggttcagcgcaagatatcggtatggttgaaggtgaagcgaaagaaatttctgaagcggaaatggtcgaagcaattgcttttgctcatgaagcgatcaaaaaacaagttgcggctcag

SEQ ID NO: 84989 - DNA, 102 bp, Glycine max
  Peptide Sequence Number=SeqID_201767
atggtgggagcaggtgcgatgatttacttcacgggcgaggtctctggttcaagtccaggatggcccagctgcgtcaaggaaaagactagaaaactgacttga

SEQ ID NO: 84990 - DNA, 411 bp, Glycine max
  Peptide Sequence Number=SeqID_201768
atgagtgaagtagaggaggtgcaagaacagatgaaggctgacatgaaggccatgaaagagaaaatggccacaatgatggaggccaatatgagcatgaaggagataatggagcacaccttattgccatatggtctgcctcccaactatacaccacccgatgtggcgtacactcccagtgagaatgtcaataactccactcctatacccattgagagccaacaacctcaatctgatcatgaacatgtctctcaacccatgggggagacacatgaaattccccaccacaatctagctgacttcgagccttgcctcagatatgccactggagggcaagcagttggtggtatacctatgccaaacactttggagggccctcagtttcgcccacaaccacaacccttgcattttgcg

SEQ ID NO: 84991 - DNA, 225 bp, Glycine max
  Peptide Sequence Number=SeqID_201769
atgacgttctacatcggttctgaaagaaaccgatgcattaacaccttttctacaaaaggcttgaaagagaaaatcggtgaagttgttgcgtgtgtctttatcgaggaagctcacaaacacatcacgagagatgatgaagagttgtattggatgatggcgtcagaagccattgctattggcaacagtggaagaaaacttgttgggaatgatgtgtattggtattaa

SEQ ID NO: 84992 - DNA, 636 bp, Glycine max
  Peptide Sequence Number=SeqID_201770
atggggaaaccaacccttgaaacagggggggggggagggttgttggcagccctctctgtggtggcgccggagaaaggggctgcgcatggcggtgctaaatggccgcaatcctttggttgttggccgataggcattgacggacgtggtggcagacagagagaggctaagattgggacttctgataccaacttggaagataaagaacttaatatttcagttggagttcaagggctgcagatcatgaagccccacacccaaaaggacattcctatgtcactgataactgtaaacggagttaaagaattcactgaaaaaattgggggaactgatcttgaagtaagcttgatactatctgaggataatgaacatgaattggttaattgggaagtcgaaaacctaaagttttttataaggcaaccggttgtgtgtgatgaagattttaccatacagaatgaggcagttgtaaccaaggaagaggtccaacacctcacttttctgtgcaaatctgaaattgattctgctggccggataacagctggagttctacggctatttaagctagaaggctctgttggccagtctgcaattgatcagcttggcaacctagccttacatacagctgggaagtatacttaa

SEQ ID NO: 84993 - DNA, 378 bp, Glycine max
  Peptide Sequence Number=SeqID_201771
atgagggtggattattcaaaagaaaagggacttcggaaaggggggagctgggtgattttaaaaactgagggaagaggaagtgaaggcattaacaagattttttctcctgagaagcatagcttagatggtagtgtttgtagctgtggaggattctctccattacaaaacctgacaaatgaaagtccaagcaaaactatggaaccaacattagctttgcttgaggaagcagttgctgattcaaaggctaagattaattctttgatgactgatattggtacttccgagtcttccttccagcaccttactgttgtcaaagacctcagtcaaaagattgagtcgttgcagggtttagtgctgcaattgcgggagcaactttaa

SEQ ID NO: 84994 - DNA, 312 bp, Glycine max
  Peptide Sequence Number=SeqID_201772
atggcattacggaatttcgaaaaaacgcctccaaatagcggtggcgttgcgggttgcgtatcgcgacaccatggcggtcatggtggaatagcgcttttttttttttgcgcgataggtgtcgggctgacccgacccaaccctacccgagattctattgcaaaagcgcaacacacaaccgcgagcacacacagaacagaacagagcacgaatagaaaagtctcccgcacgaccagcagcacaacaacaactaacggcagcgacagcgaaggcaatgcacatgacacccgcacctgcacgcaaccagcagcataa

SEQ ID NO: 84995 - DNA, 1374 bp, Glycine max
  Peptide Sequence Number=SeqID_201773
atggtaactgctgatggaaatccattgttaaaggttcctcctccagggggtattgtgagggttggtattgcttgtgaacagtatctatccaacacttcagttgaacagttattttttgtcctggatctctatgcttattttgggagagttagtgagaaaatagcaatagctggaaaaaagaaacaattgaaggatgtcaggaacaaatcttttagtggaaagctgatggacaagataccaagtgacacatctgtaactttgacattaaaaaatctccaacttcaatttcttgagccatcttctgtgaatgctgagggaatgcctctagcacagtttgtcggagatgatctgtcttttagtgccactcacagaaccctaggtggtgctattgttgtttcatccactttaaattgggagacagttgtgatagattgtgtggattccaaggagcccttggcatgtgaaaaggactcatattttagtaccgtagaaaatgttccctcaataagtgatgtaggatacccaaaactaagacctgttttctgggtgcataacaaaaaagaactattgaatggaaatgctcattcatacccatttctggacataagtgtggtgcatgtcgtaccattttgtatagtagacatggagtcacatactttgaatgtctcagctgttgtatctggtgttcgtcttggcgggggagtgaactactttgaggccctcctgcatcgatttggaatactagggcctgatggtggtccagggaagtgtctgtctaaagggttggaaaacttacaaactggaccattggcaaaactttttaaggcaacacctctgatttctgataattcagaaaatggagaagggagagataccagttttccaaacttgaagaacccagatattgtggatgtaactatagagttgaaagactggttatttgctctcgaaggtgctcaagagatggctgaaagatggtggttctcagtccatgaagatgtaaaaagagaagagaggtattggcacacaactttccataccttgcgagtaaatgcaaaaagttgcccaaagaatattccagacagaaaatcacaatcacgcagaatacaaccatatccggtggaactggttacggtaaagacacccatccttctttcttcaagtttgatgcagtgtgcactcaagcacttggggaacccaaccttaaaagctagttgttatgggggagaaccatgcactcaaatactgcaccaagcatcctatactactcaatgtgggacttacgcatcccataatccccaagtccttatcatagcaccacccttgacagctgacgtctcagcggttcacactctacgacacttcactcgttga

SEQ ID NO: 84996 - DNA, 801 bp, Glycine max
  Peptide Sequence Number=SeqID_201774
atgctgcggagggtggaccgcagaggcgacgacgacgtggttgttgatagcgaaaccactttcacgatgctgccggagagtctatataacttggtggtggctgagttcagccggcgagtcgggcgagttcacaagcgtgcgagtgagattgcagatggaatgactatacaaattgatactgttaatctattacttgaaactcgtggaagtgctagtcgccaagggggagcaacatggacaccacctatggcatctatcaccatacacaaccttttactgtataccacaaatgaaagctgggaggttgtgaatcttaaagaggcacgggaattctccagtaataagaagtatatatacgtcttcaaaaaactagaatgggaatctttgtctattgatcttttgcctcatcctgacatgttcacggatgctactttaggccgctctcaagagggagcaaacctgagagacgaggatggtgcaaagcgggtattgtttggaggtgagcgttttatagaaggaatatcaggagaagcatatataacgatacagagaactgaattgaacagtccatttgggcttgaggttcagttacatgtcacagaagctgtttgccccgctttaagtgaaccaggactgcgtgcgcttctccgctttataacaggattatatgtctgtctaaataggggaaatgtggatttcaaggctcagcagcgatcaactgaagctgctgggcgttctcttgtctcaattgttgtggaccacatatttctttgcattaaagacgctgagcatgcaaagtaa

SEQ ID NO: 84997 - DNA, 219 bp, Glycine max
  Peptide Sequence Number=SeqID_201775
atgcaaggcatggctcaggcccttcgcgctaacgagcacctccgtcgtgtgatgggaagcaacgactgctcgcctgacttgcggataagtgccaaagaagtcatcgcgctaagcgagctcaatgtgcttagcgcgcatcagcggctaagcccaacaccagcgcgcttagtgagtaaagaggaatctagaaaggcatctgctatgcaagcatgcgcttag

SEQ ID NO: 84998 - DNA, 396 bp, Glycine max
  Peptide Sequence Number=SeqID_201776
atggagtcgatcctgggaagggctctggagtacactctcaagcactggctcaaatcgttctcaagagaccagttcaagctgcagggtcgcaccgttcagctttacaatctagatttgaacggggatgtactgcattccagcgttggattcccgcccgcgctcaatgtcaccgctgccaaagttggcaaattggagatcacgcttccgtccgtgagcaatgtacagatagagccaatcattgtgcaaattgataggctcaatttggttcttgaggagaattttgattttgagccatctgaaactcaacccagttgttccccatcaagtgcctccacaaagggtagcggctatggttttgctgataaggttgactctttcatctctaagtgtaaatag

SEQ ID NO: 84999 - DNA, 252 bp, Glycine max
  Peptide Sequence Number=SeqID_201777
atggaaaaacagtgggtgtggatgggggttgttgcggcaaaattacgtgccggagtgtgcggtgagggaggaggaagaagagattgcaatctagaagcaaaggatgtggatctgggaggggaagttctaaatcttgtttggagaaggtgttggcagtggcggcgagacacaaagagggtggtggaagatgaaggtgaagaatggttgggtcgcagaacgaagaggttggtggagagtctcaaagatttgtga

SEQ ID NO: 85000 - DNA, 2421 bp, Glycine max
  Peptide Sequence Number=SeqID_201778
atgcggcaaatacttcttctaggctattggtccggtttccaggtttgggatgttaatgattcaaataatgtccgtgacctagtttcccgacaggatggtcctgtttcttttatgcaaatggtaccaactccaattgtatcaaagagaccagaggataagtatgcaggcaagcatccattgttggtaatttgtatggatggtggaggcaaaacacaagatgggttgggtgccacttgcaaagggggcactttaaaccatcatgaccaagtgaatgggaactatctgccaactactgttcaattttattctatgaggtcccaatcatatgttcatgtactaaagtttagatcagttgtttactctgtaagatgtagttctcgaatagtagctgtttctcaagccactcagatacactgtttttctgccacaactttagaaagagagtatactttacttaccaatcctatagtcacaccttgttttggttctggaggcattggctttggaccgcttgcagttggtcctagatggctggcctatagtggaagcccagatgcaacagccacttctggacgtgtccgcccacagcatttgacaccttctgcaagctttcctggtatttcttcaaatgtgagcttggtcgctcactatgccaaagagtctagcaagcatcttgctgctgggattgtgacacttggagatatggggtataaaaaactttccagatactgttcggaacttcgcccagatagcagcagttctatacaattggtaaattctagcccaaaaggaaatggaatcgttaatggccattcaacagatgcagataacattgggatggtcattgtccgagatatagtcagtaaaaatgtcgtttcccaattccgggcccacaagagtcctatttcagctttatgctttgatcctagtggcaccatattggtgactgcctctgttcaggggcacaatattaatgtttttaagataatccctggatatgagagagtgtcagcatctgatgctggcccttcttatgttcatctctacaggctgcaacgtggcttgacaaatgcagttattcaagatatcagttttagtgctgatagcaggtggattatgattagttcctcaaggggcactagccatctatttgctataaaccctcaagggggacctgtaaatattctgtcatgtgacaatagtttaacagaaaaaaatggtggattggatgtcatgaataatcaagcagtttgttggcctcatagttcagccttagaaatttgtaaaccacagagcctctgtactgctggtcctcctatcacactttctgtcgtaagcagaattaggaatggatctaatggctggagaagcacggtaactggtgctgctgcagctgcaacaaataggatgagttccctttctggggctattgcttcatctttccgtaactttgaaggcaacagtaccttgtttgttaatgggaactattccaaggaaaagtgtcatctgttggtattttcacccaccggttctatgatacaatatgctctgcagacaattaacagtcaagattcaggtgttgtttctggagtaacacctgcgtatgaatctgccccagcgactgatgtaagagtagttgttgagcctatcaagaaatggaatataagtcagagacaaagttggagagagggagaagataatattgacatatatggagagaatgtagtttcagacagcaataaattatattcagaggaagtgaagaaggataatatcattagccctaaaatgaagaatgtagctgtgaaatggaattcctgttctgagaaagagcatcagttatatatttcagaagctgaactgcaaatgcatcaagctaagacaccattgtggggaaaaactgggatatattttcattcagtgggtaaagaggctattctgatgatggatgaagaagctgcttccggaggggaatttgagattgacaagattccaactcgtgtaatacaagctaggtcaaaagacttggttccaatttttgattatattcagacctcaaaatttcaacaaataaggactcctgctgtgggtaacgtgttatatgaacagcttctgcgtcaaagttcctttgaaaatggaaggatttcaaccaggggttttttgagttctcctgattgcatacctaattccgaatttaaaagtatgattgaaggaagtgagtggggtgatagtttgctttcagcaaaaacaaaggctttcgtaaataaaaacaacacccttaaaccaaatacttggccagagattgcaaataatagaagagagaacttaaacatgaatgctcatcaaatctttgtaaatagtgacagaaaaggcctgaaactggagaatcactgcaaagaaaaaggagatgaatttgattga

SEQ ID NO: 85001 - DNA, 228 bp, Glycine max
  Peptide Sequence Number=SeqID_201779
atggctggaatgttttctgatatctatgcatgtttgttggcaattgacgaggttgtctttcgccatgtctcatcaagaagatcctatccatcctcagttagcaattctttggaggcttctaagttggctattaatcagccggtggcaacgaggcgagaattcaatcagaggttcaatacaaagtctaatcaaaagaactgccatctaaactctattaactccatttag

SEQ ID NO: 85002 - DNA, 222 bp, Glycine max
  Peptide Sequence Number=SeqID_201780
atggttgaagtgcggaagcgggaatctttagatgtgctattctttgaagaagaaaaatggagcaaggaaagtgagaagcttcaagttcaggaggagagcgaagaaggtgtggatgaccagcaagttagaggaactagatctctctctgatatttatcaaagatgtaatgttgctgtaatggagcctgtagactacaatgaagctgcaactgattcgaagtgg

SEQ ID NO: 85003 - DNA, 240 bp, Glycine max
  Peptide Sequence Number=SeqID_201781
atgcattttacggacacgagagcccgagaaactgtctccttcttagatacaacgtctaggggtagcaaagtgcctcaacaggggatcaagacagaacccatgtgcgatgcatatgcgaaaggtgcaacacgggaattttctagaggtatcattctcttcgaaaaacatattgcagcagtagggactactagcaacaataagttttcaaagaaaaaagctctagatgagggttcactgtaa

SEQ ID NO: 85004 - DNA, 222 bp, Glycine max
  Peptide Sequence Number=SeqID_201782
atgggtcttagagacattggtgcttcactgcccccagggtttcggttttacccgagtgatgaggagttggtccttcattacctttacaaaaagatcactaatgaggaagttctgaagggtaccttgatggaaattgatttacacacgtgcgagccatggcaactccctgtagaatcatcacaatggttactcacattcacaaacgaggcttatatagcctaa

SEQ ID NO: 85005 - DNA, 801 bp, Glycine max
  Peptide Sequence Number=SeqID_201783
atgggagtcccttgttctgaagtacattgtggaggatgtggtcagacagtgattgaggataaagacatcaaggtgattgaggataaggacatcaaggacatcaagggccaaagcgttatctgtcaaggcaaatatggtgcaagacaaaccccctcaaaaaaggtcaatgttgtgaccaatgtgagtaaattggtggtagactctggggataccaggcacatatgtgctgataaaaatgtgtttacctcctacactgctatgagggatggagaagaagtttatctaggtggttccaagactacacctgttctaggaaaaggaaaggtttttctcaagctcgcatatgggaaaatgttggctttgagtgatgtgatacatgttcccaccatcaaagtcaacttggtctttgtagcactgttggggaaggttagggtgaaagtgtcctttgaatcaaacaaaattgttatgattgagaataatgtatttggaaagggatattgtgatcaaggaatttttgtactgaatgtttctaaagtgattaatggaaatgcaattacttctgcctacatgattgattcctatgatatgtggagttgtgagtacactttgtttaatgacttctatgaaaaggaagaacatagtgatccctatagaattcttattctcaagagtaatgtgcttgattgcaataccaccatagaaactaagaatgctgatttctttgaggacatattccctttaaggtcttgtgctagttctagtaccaatactagttttaagcaacctattgagaaaaactaa

SEQ ID NO: 85006 - DNA, 777 bp, Glycine max
  Peptide Sequence Number=SeqID_201784
atgtgttcatgcatgcgtacgtgctctacagaggtggctaagcttaatgcaaacgaatggtacttcttcagcttccgtgaccgtaaatatgcaactggatttcggaccaatcgtgcgacgacatctggctattggaaagcaacggggaaggatcgtacggtgcttgaccctgccacgcgtgaggttgtagggatgaggaagacattggtgttctacaggaacagggctccaaatggtgcaagtttcccacgtaagaaatacaaagcttatgattgtagtttcatttatcagctgaaacacttagatattttgagtgaatggatatctccacctaaagaggactgggttttgtgtagagtgtttcacaaaggcaaagcagacaacagtgccaaactcatcatgtacgagagcacagttccatccctaactttggcttcgtcatctccaaccaacctatacaccacaccatcaattgggtataaccaattacttgccccattctcttcctcaatggcaacccatcatcatcatcatcatcatattccaaaccaaagccaaaacaacaactccttgatgagtctccttcagttctctagggaaacaaacaccaacaactctagcaccgttactcaaattagtcccaaatgtgatgataatggatatgggttcttatgggacatggacctcgaagaaaatagcttccatgatggcggggcatcaaacttggatggaatgagattcgaggttgataataataatagtgtggtgttgttatga

SEQ ID NO: 85007 - DNA, 283 bp, Glycine max
  Peptide Sequence Number=SeqID_201785
atggcatcactcaatgaccttaaatcaagaaagcttcacttggtcatataccaaagtgtaacaatccattgccatccttcaatggtgcatgcgattggtgaaggagacatcctcaccacttgtatttttgcaatctttcatcttgttcttctctttgttgtaaagaaggcttcctggttatggaaagctaaatcctctgttggatcttcccttggaaattggtctgattctaaagtccttgatagtatagggctaagttgtcgtactatcacgaggaatcagg

SEQ ID NO: 85008 - DNA, 210 bp, Glycine max
  Peptide Sequence Number=SeqID_201786
atgtcagaattcacaagcgattatcttcctcaaaatttagccagcctgcatctatcagattttgcaccttatgtttcagggtcatacaatgctcaatggaatgctccagaactcctccatgataaacacatgctgcgttcgagttgtatcctcagaaaaatggaggttgaggaaccttggctggggttatggctaccattgcattattga

SEQ ID NO: 85009 - DNA, 228 bp, Glycine max
  Peptide Sequence Number=SeqID_201787
atggacaagtgtcatttgaagttgcagacaaaatttcgagaagatccaacggttaacgaaggctgggcagcgtttttaccgaggcagcttcatggtgttaccctggttgagtttagtcttacaagaggaatctgcgaacaatgcttgatcaggatttggctaaactatcataaggaatcggggtttagtatctcaggagacaccataagaacacatgagcattgttag

SEQ ID NO: 85010 - DNA, 264 bp, Glycine max
  Peptide Sequence Number=SeqID_201788
atgtccgttagtctaaggatgttcaacagaggtgacaaggtgcttgatccctatccttgtcaagaagtcttcgtaagtctgagctttgaattgagtgtcgttgtcggtgaagatagcatatgggaggtcgtacttggagataaggtatctctagctcctagggcctttggtagcagtcccagtatgtccattccccacatggcgaaagggcaagcgccacatggccgaaggaccaaggggagcttagactgtgaaggttgttag

SEQ ID NO: 85011 - DNA, 707 bp, Glycine max
  Peptide Sequence Number=SeqID_201789
atgggtcaacttcaacggcaagccttccgcaaagcctatggtaagatttgggacctagctagggtagaagtctccatggaatcgattgcatccctttcccaatattatgaccagcccctaaggtgcttcacatttgaggacttccagctagtgccaactgtgaaagagtttgaagaaatcctgggatgcccactgggaggaaggaagccatatcttttctctgggttctatccctccacgacaagagttgccaaggtggtgaaaatctcagcacaagagttggaccgtgcgaatgggctttcttttattgacatcttggcgcttttgatctttggagttgtcctctttccgaatatggaagggttagtggacctagcagcgattgacgctttcctcgcctttcatcatggcaaggaaagcccgcttggctaccccatgagaggagcgccattagacgaaagcatcacgcctttcatcgcacggggttttagtgaccacaacgcgagggacaaagagcttaggggaagcagtaataggatcatcagcagctatcataagtggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaa

SEQ ID NO: 85012 - DNA, 927 bp, Glycine max
  Peptide Sequence Number=SeqID_201790
atggcagaatcatcaaagaaacgaaagggttcttccgcctccgcttcgacttcaagagctcatcgttccgaagccactagcgcatccacaacaccaattccaccatcattgtcctcttccccagtgttttcttccgacgaacagcagaaacgatactccaatcttttctcatctcgttccattatcaaccctaagtttattgatatggaattcttttctgctgaaacctttgattgcattcaagcctttcagaacttaggtcttctaccttttatgtcattacaattgcctatttatcctgaattggttaaagctttttattgtaatcttgaaattcaggacagcactctgatttctaaaatctttgggataaaaatggtcattgaccagtcccttttccatgacttaaccaaattacccagtgacggtgtaccatttgaaggtacactgaatgacgactggaaatttgatttctctgcccatgatgcccgccagttggtttgcaccaacaatgcggatatgaccggacatcttcttgccgggtcattggcttttgaaagccgcatccttcactatttaattgtgcgtattttgcttccacggtcttccaaccttgcccaggtttctgaggaagatctaattatcatgtgggcctttcatacagggcgtcaacttgactgggcacacttagtcagatatcgcatgcataaggcattgcgattaaatgctccactaccatatccacagcttgtcactctctttttccgccattttcaaattcctcttgattctaaaccttacgttccaatcaagagatcctttttaattggtgctgttgtgattgcttcttttggttaccgcaaagagcatgatggctcttgggtcaaaaagggtgctccacccgctgatgatgaaggcaaccaacca

SEQ ID NO: 85013 - DNA, 1182 bp, Glycine max
  Peptide Sequence Number=SeqID_201791
atgggaatcgaaggatacagagcggaggttgaaaaaagaacaggctttgccttcgatcccgccagggaatttaagtttgaacaaagaaaagaccgttacggctggacacaaaaccatgaaggaaattggttctacaccgcatttgttgaacatggaagagttctcaacacggataattacccgttaaaattaggtttattaaaaattgcagaaaccggcaaggttaatttccgctttacttgtaaccaaaaccttattcttgcggatattaaagaagctgataaacctgaaattgaacgtctcctgaaagaatatggtatttctgggtatacaaccggagccagcgcattgcgcaaaaactccgtagcatgtgtagccttaaatacctgttccctggctttagcagaagcacagcgttatctgccttccctggtaaccaaaatagagcccgtactcgaaaaatatggccttttggaggaagatatcacgatcaggatgacaggctgcccgaatggttgcggaagatcacctaatgcagagatcggttttgtgggtactgcttatgaagcgcagcagcagcttgtagagttaagcggaacgataaaaaataccgatacccggaaagggatcagtatcgtaaagctggtagatggggtagatgtacaatctgccacattgggtgttccattaggaaatgcaataggacctacagagctggatatacagtctatggaggttacacccggtgcagcttctgcgctctacggaatgaatgccatcaacggactggcaagccttcagacaaaagatccttttacctccgaagggctcagcgtttatttccggggcggcgtgaatcatgtagacaacgttaatcataaaataagttctctgggggagagtgcaatacggtttgcaaaggttttaaataaaaatctggcggtaaaagttaatgcctcttatttcagcggagtcgattggatctccaataatcaaaccgatcagaacgccaatccattgattacggccaatcccaatttttcattggctaataaccctgcagaggatctctggaacaaatacggagatgaaagaaacaaccgggttgccgtaaaagtagattataacggcaaacctaccacattcaatgtatcgagaacagggtatcttgaaaaagacctt

SEQ ID NO: 85014 - DNA, 249 bp, Glycine max
  Peptide Sequence Number=SeqID_201792
atggaaaaacaagctttgcaaaaagatcttagcagttctaaaattgacaaaatcaaatacaaacttattcaaaaggaagataacgataatgaagcgaagcttggagcgacggcgacggaggaccgcgaggcagcgacggcgacggaggacggaggaccacgactgaggactgcgagtgagggctttcaaagcagaataacggtgagtagcagcttcagcacaacacgaccacggagtcgcgactcgtga

SEQ ID NO: 85015 - DNA, 456 bp, Glycine max
  Peptide Sequence Number=SeqID_201793
atgtcacattctgattggaccataaacaggtgcaccattttaaccgagagcgaaagcataagaaccctaatgtttctcatggaaacatggggcattcttggcaaccaccacacaagaaaatcaccaccagtgtcgacagtttcccgacgaaaactctatacgaccatgtctacgatggcatggcaaagttcaccgacagccaccaccaccactccctctcgtcgcgctttgaggactatggggagattttcgcgagcttccatgtgccacacacctctacctttttggtgttggatcttccggcgctcgacgccacgatctaggttttcttcgactcctgaaacaccgcttgtgaatactccaaaatcttttgtggcgtcggcagccttaacttttggctctcctacgaggacttgttatgcgacggcgtttcagaagaaaaagaagcctgtttag

SEQ ID NO: 85016 - DNA, 252 bp, Glycine max
  Peptide Sequence Number=SeqID_201794
atggacggctctggaaaccacgtgtcgttcgacgatgatggtataagcaaacctttagtcgcagaagctacagttcccgcccttctagttgcagaagttgctcccaaaccaccccaacggcgtcgggctcagtgccttcgccagcttcgacatgaactccatttgccacttgccttcatttttcttaaattaaaaaaaacaaaaattaatgatgtggatgcctatgcctacatgtttagtgacaaggcgtaa

SEQ ID NO: 85017 - DNA, 198 bp, Glycine max
  Peptide Sequence Number=SeqID_201795
atgggagggaagatcactctaatcaattcagttgttaatgctctgcctatatacctcctgtcattcttcaagatccctcaaaagcttctgatcaccaacagctttgggttaggattatcaattctaagtatggaggttgggaggccttgcagtctgctcgggctcaaggaagacattctggttggtggagggatctaa

SEQ ID NO: 85018 - DNA, 162 bp, Glycine max
  Peptide Sequence Number=SeqID_201796
atgggttgtactagaactggaaggtatagtcaaaatagtattccttatgaaatatatcccgatatgggtcatcgaactaaaaggttaattaggcaagctttgaaagtgatgtttttcaccttctcgctaagccaatctgttggcttagcgagcttctgctaa

SEQ ID NO: 85019 - DNA, 110 bp, Glycine max
  Peptide Sequence Number=SeqID_201797
atgaaagaagttgacagcccgcttagcgcgcagctcaagcttagcgcgcggaaaagcccacaacaaagtccaaaggcacacttagtgcaagaactcgctttaagcatgaa

SEQ ID NO: 85020 - DNA, 570 bp, Glycine max
  Peptide Sequence Number=SeqID_201798
atggcctatggtaatcgattaccaagggtgtgtaatcgattaccaggcctaaaaatgggatcaggaaagcttagaaatggagacagtatgttgtggaggcctctgagtaacaggccactggtaatcgattaccagttatgtgtaatcgattacacagtgcatattgcaggttttcatgttctgaagttgtgtaactcgagttgggcctctgatcgcgatggcagcgcaattaatccatcaccgagtggagatggagtgcctagagggagtttgggagaccctcgaaggcaatgcaaggtgccgattacggggcacgattcgattcacggctacttcattgtggagccagtccaagtgatagaggtgatgtcatctgaagaagaccctgaggaggacccagaggagctaactcctgagcctgctgtggatgctcttgactttccagagggtgatgaggacccactccctgaggtggattctcccgaggacgtcatgtcagcatctgaggcagactctacggaggagagcggtcctggagggatagcgactagcggaggttcttcatcatag

SEQ ID NO: 85021 - DNA, 336 bp, Glycine max
  Peptide Sequence Number=SeqID_201799
atgtcagatctggaattatacatagaaaaggatgtggctggtggttctatgtttcattctgcaaattctcttacatcatgtggaaataatttatctaataatgaggtgcaaccgccaagaaatgtgagcaatttacatggtgatgaagatgatgatgatgattatcttgtgtctaactcatacgttgaagagtctttagacaaagatgatagtgttgacggtatatctgatacagatgatgaagtcaccgacatgattcaaccagtaagaattgttcacccagcagaagtaagaattgttcaccctaaccctaagcctctaacccctaaaccctaa

SEQ ID NO: 85022 - DNA, 207 bp, Glycine max
  Peptide Sequence Number=SeqID_201800
atgttctctactggtttctttgctgatggcgaaaatgcatattcctttgggtcctcgggtttctactctctgttcttcgacaatgacaacattctccgtcttctttacgatggtcttgaagtttctgccattactggccacatccatggctggcatcttggaaagctcattaggacgcagtgcatgcccgacggagtagtgaagtga

SEQ ID NO: 85023 - DNA, 359 bp, Glycine max
  Peptide Sequence Number=SeqID_201801
atttcagagctccttttgagcacaaaatttcgtgctcttctctccctctcccttcattcatctccttcttcctccaagctcttatccatggcctcctatggtgtggcgtctcctctctctcttccttctccattccactgccatttatcttccaagaagcaaaggaatccattgatgaagaagatcctaggcctacaagctccaatggagcttgcatcgaggtcgcatggcccggagattggcctgaggcccaggcaggggaggcacccacagaggctcccaacgatgcagatgaggcccgcatggacgaggagatgatagatttacttgatttcttgggaggaagcggagccacatga

SEQ ID NO: 85024 - DNA, 456 bp, Glycine max
  Peptide Sequence Number=SeqID_201802
atggctggtacattcttccttttgaaacagcaaaatagtttagagattataagcggtaagaaagaaatgactccgaatagagttgtgaactggccattcaggactctgtatgttatggcacgttctccaaacaagataaagagcatcaatggctcaaaagaaagtcttaaactcagtgtgaggatcagtgatctatggtttattggcacgcctaacaaatctgagcaagctgaaatggtgtttgtggactcggattgtgttctaagggacatcccttttagaaaatacaggtttgctggatttgcggatgttgtggctggccagtttgaacctggactattgttggaggttgtctttcaccaagtttcaggaaaaggtagaagggtagtctttaaactaaaggacttgagccagcaatttctatcttgcactttgtgggatgattattgcttgtag

SEQ ID NO: 85025 - DNA, 345 bp, Glycine max
  Peptide Sequence Number=SeqID_201803
atgaagtcctctttaagatcccgtgcattcccttactacgtcatatcgtgcatccctttttttctaatgttcctagttgcaaagtttaagggaagaagatatatgagggggatttattgtaggagtaaaaaggataggggtatcaagtgtgagtttgaaacctcaaggggggtcattagaaaatgcactcctaaattactatgcatgtatgtagagcttcatgcagatggcctcccagaaacgccgagcagtgcccgcacaaggaggagagtccacttgggattcttctcgcttcactttagaggtagcttggcacagatatcaagacaacattcacctccataa

SEQ ID NO: 85026 - DNA, 333 bp, Glycine max
  Peptide Sequence Number=SeqID_201804
atgaacgaagatcaatgcatgtatgacactataatgtttgaagaagttgatacggatgatcaaaatgaacaagaatgtggtgtgaatgaaccacaagttgattattcggatgcgttcaatacttctcaggtgtttgacagtcgagatgatgttttgcagtgggctcaatccgttgcttatgaaaatggacttgtggcggtcattataaggtctgacacaaacactggtagtagaggaaggacttcgtttgtgttaattggctgtgaaaggagtgacgagtataggtgtaggaagaaagaattttttaaaagagatactgggactaggaaatga

SEQ ID NO: 85027 - DNA, 258 bp, Glycine max
  Peptide Sequence Number=SeqID_201805
atggcgagaatagccaaggtagtcaaaatgtcagttaagcacttggagcagaaaacgagggctttggcggatcaaggtgaatgggcttcgttcattgatgtcttggctctattgggatttggagtcatcctttttccaaatgtggatggattagtagatctagcggtgattgacgccttccttgcttaccaccatagcaaagaaagctcagtcgttgctgtgttggccgatgcctacgacacatttgaccgaagatga

SEQ ID NO: 85028 - DNA, 872 bp, Glycine max
  Peptide Sequence Number=SeqID_201806
atggttagaactagaggtcttggtcgggctttaggctgggcaataggaaaagtcttggggaggagagacgcgaccgcggaggaattgaacgaagagcagccaaaagcacatattgaagaagttgttactaatgttgaggattttgaaaatcacattgctttgagaatctggaatggagaggaacgtcctgagctgaagctatcttcccatggaaggaagatggctaagttcgggaggcctgctccagagattgaaggccttgtggcggctagtggactaagtcctttgataacctgttccctagataccggcgaccgaaaacaaatggcgttccatagctttaagctacttcatgtcgacgacgctttcaaaatgttggtggaattactcaaggtcaacgttgcagaggcgagagctgagacgattcaatgtcatgactcttatgttcgactatcgtggttatgtgacgtgtatgagatgaagatcgaggtatgtcactggatcgtagcagtgcgagcgtatttgttgcatctgcttggatgtacactctttgctaacaagagtgccacacacgtgcacgtggtattcttggatgcactacgtgacttaacgcagagtgggggttacgcttggggcgttgctgcacttgtgaacatgtatgataatttaaatgatgcgtccaagagcacgacgagacagcttgcaagatatatcactctattacagtgttggatctacgggtattttccatccgttggttccgctgttcctgccaaggattatgatgagaggagagtgcgtcttgatagactgacccctgacgtggtgtgctggattccgtacggtgaccaccgttcatttagagaattggg

SEQ ID NO: 85029 - DNA, 2520 bp, Glycine max
  Peptide Sequence Number=SeqID_201807
atggcatctcatattgttggttatccacgcatgggacccaagagagaacttaagtttgctttggaatctttttgggatggaaagagtagtgctgatgatctgcagaaggttgctgctgaccttaggtcagccatctggaagcagatggctgatgctggaataaagtatattcctagcaacactttctcatactatgatcaagtactggacacaacagccatgcttggggcagttccatctagatataattggaatggtggggagattgggtttgatgtttacttctcgatggcaagagggaattcatctgtaccagctatggaaatgaccaagtggtttgacacaaactatcattacattgttcctgaattgggtccagatgttaagttctcctatgcatcacacaaggttgtggatgaatacaaagaggctaaagttctgggaattaatactgtacctgtgcttgtgggacctgtttcttacttgttgctgtcaaaaccagctaagggtgttgagaagtcattttcccttctttccctaattgacaagatccttcctgtctacagggaagttgtggctgaactgaaggcagctggtgctacttggatccagtttgatgaacctacccttgtgaaggatctcaatgcccaccagttacaagcatttacccatgcctacgcagagttagagtcaagtttatctggtttgaatgttctgattgagacatactttgctgatgtccctgctgaagcgtacaaaacactcacctctttgaaggctgttactgcatatgggtttgacattgttcgtggaacaaagacccttgatttgataaagcaaggatttccatctggaaaatttctttttgctggtgttgttgatggaagaaatatttgggccaataattttgcatcttctctgaacacccttcaggcacttggagacattgttggaaatgacaaggttgtggtttccacgtcgtgttctcttcttcacactgcagttgatctggtgaatgagaccaaattggaccaagagattaagtcttggcttgcatttgcagcacaaaaagttgttgaagtaaatgccttggccaaggcattgtctggacagaaggatgaggttttcttttctgctaatgctgctgccttggcttcaaggaagtcctccccaagggtgataaatgaggctgtccaaaaagccgctgctgctctgaagggctctgatcatcggagggccacaaatgttagtgccaggttggatgctcaacagaagaaattgaatctttctgttcttccaacaactacaattggatctttccctcaaactgccgatcttagaagagttcgtcgtgaattcaaggctaacaagatctccgaggaagattatatccgtttcattaaggaggaaatttacaatgttgtaaagctccaggaagaacttgacattgatgtcttggtgcatggagagcccgagaggaatgacatggttgagtactttggagagcaattatctggctttgcatttactgccaatgggtgggtgcaatcatatggatcccgctgtgtcaaacctcccatcatctatggtgatgtgagccgtcccaagcccatgacagttttctggtcttcaactgctcaaagtttgaccaaacgaccaatgaagggaatgcttactggccctgttactattctgaactggtcctttgttagagatgaccaaccaagatttgaaacatgttaccagattgctttggctatcaaggatgaggttgaggatcttgagaaagctggtattactgtcatccagattgatgaggctgctctaagagaaggtttacctctgaggaagtctgaggaggctttctatctaaactgggctgttcactcatttaggattaccaactgtggtgtggaggacactactcagattcacactcacatgtgctactccaacttcaatgacatcattcactcaatcatagacatggatgctgatgtgatcaccattgagaactccagatcagatgagaagttactttcggtcttccgtgagggagtgaaatatggtgccggcattggtcctggcgtttatgatattcactcacccaggattcctcccacagaagaaattgctgacaggatcaacaagatgcttgcagttcttgaaagcagcattctctgggtcaacccagattgtggccttaagacacgcaaatacactgaggtcaaacctgccctcaccaatatggttgctgctgccaaacttattcgcaaccagagtgctattgtcatgctcagaaccctcagaaggatatccttgcaagctatagtaataggggcgagccctggtgcagcggtaaagttgtgccttggtgacttgttagtcatgggttcgaatccggaaacagcctctttgcatatgcaagggagtgctattgtcatgatcggaaccctcaaagatatccttgcaagctatagtaatagggtctgtttctttttgtgggatttggaggtgtaa

SEQ ID NO: 85030 - DNA, 324 bp, Glycine max
  Peptide Sequence Number=SeqID_201808
gtagttgtcatcatcaaaaagggggagaatgtaaatcatgaagattttgatgatgtcaaaaagatcaagccttggataatggttgtcatcatcaaaaagggggagaatggggagaatgtgaatgtatgtatacatgattttgatgatgccaaagaagaatcaaacaaagttgcttcaaaggataagtgtggcttcaagattaatacaagattgcttcaacaaacaaagccttgcttcaagattaactcaagatcaagccttgtcttaaaacaaagtgctttcaagacattcaaggctctggtaattgattaccaggcagtgtaa

SEQ ID NO: 85031 - DNA, 372 bp, Glycine max
  Peptide Sequence Number=SeqID_201809
atgatcacaattgagaatgaaaatgcttgggatgaacaatgcacttcgcataaatcggctaaaccgtttcgattcaaggtgcttcaaaactgggatgatatagtggatttgtgtgctaaagatagagccattggtcatggagctgaaatggctatggatgctgatgaagcgatgagtagagaaacaaataaagtggaatgcatcgggttaggtgttactgctaccatagacttagaagaaccaagctctaatacaaaaggaaaaagacaaggttcaacttgttcaggcacacattctcacaagagaagatgggagaaaaaagaaggaatatcagcttctttggataagatgaccaactcttttaaccgaatg

SEQ ID NO: 85032 - DNA, 930 bp, Glycine max
  Peptide Sequence Number=SeqID_201810
atgggtgtcgttaggggtaggaattacaatcaggtgcagcgtcgggtcatccagcagtgcctgaggatcggccaccacctgcaccgacggccagtcagcgtgcactttactggcatcgctgctggagatcgccgccagctcaacgtctggcgtaccggcgatcagtggcgcatggaagtcagtaagaacaaggcggaatcacctgaaagctcaggagatcgcactccgtgccggttgccagctctcctgggccaccagcgcgtcgtgcgcatcctgactgcggcggcggaaatcgctcggactgacgcccacccgcttgcggaacacgcgcgagaagtagagctggtcgtcgtagccgacctcgcgccccaccgaggcgatcggttcctgagtggtttgcagcagcagcttggcgcggatcacccgctgatcttcgcgccagcgcagcaggttgattcccatctgctcgcggaacaggtgggccagacgcgacggcgacagacagacgtggcgcgccacttcctcgattttcacctcgctggccagatgattggtgacgtactggcaggcttcaatcacgcgtgggtcgcgaatttgctgatggctgcgcggatcctcttccaccgcacgcagcagcaggcgctccagcagattcatcgccagctcctcggcaaagcgacgtccggagttgtgcgtctgttcgatgctggcaaacaggcggtcaaattcggcgcgcagcgcatccggcagccgcagccggccaacgccctggttctgatcctgccactgcagccagtcggtccagtaggcgcgcggacggaaatagacccagcgatgatgccagcacggactgtccggcgcgcggccataatagtgcggcgttttcggctggaacagcagcaggtcgcccggctggcagtcaaacgctga

SEQ ID NO: 85033 - DNA, 488 bp, Glycine max
  Peptide Sequence Number=SeqID_201811
atgacattgaccatcccacagctttttttgaagccattgcaggttatgtgggatgctaccttgtttggcctgtttaatgaaaacttccccttgtacataaagcatgaagatctgtctgaaattgcacacggtggtcaatgtctcagcatatctgttatacagttgtggattctgcatatgactgagacaagtatacgagccgggaatatcgatgtgtatggattcctcgagccacagtctatccagagatctggccaatcacaatttgaatcagaaaattacatgaagaactggatgcaaaattcaaaacgggatgtgtaccttggagcctacctgaatggtgcacattggcaaatggccgtcattttgcctaaggaaaatgttgtcatttggttttgttcgttgcataataagccagacaactaccttaaaggcataattaatatgtcagtgttgtttttcaatacatttgcattagcaatagtcag

SEQ ID NO: 85034 - DNA, 444 bp, Glycine max
  Peptide Sequence Number=SeqID_201812
atgtccgaatcggtaaacccgccgcgtattgccggctggctgctgctgccgctggcctggctgattatgacgatgctgaccagcgcgctggtggtggcgctctatctgcggccgctgtttgacacggaactgcgcaccacgctgttttctcacgccagtattttaatgacgcagtggctggtgtctttactcaccgccgccgcggtgtggctatacagcatctgggtgtgctggatcttttgtcagcgctcgcaccgtctgccacgtcactacattcactggctgctgatgaccgtattgctggcgctgaaaaccttcgcttttacgccggtggctgatgggaaagcgatccagacactgctgctggccctgctctcggcggcagtctttgtgccctacttcaaacgctcacagcgggtcaaacagacctttattcagccctga

SEQ ID NO: 85035 - DNA, 1627 bp, Glycine max
  Peptide Sequence Number=SeqID_201813
atgatgatcgaaaccattcgtaaaaacgcgttcacgctgggcatgtttgccgtgatcaccaccggcgtgacggcggtggtcaactatgtcaccaaaccgacggtcgatcaccagaccgcgctgcagcagaaaaacctgctcgaccaggtggtgcccaccgatttgtacgacaacaatattcagcaggagtgtctgctggtgaccgatgcccgcgcgctcggcaacgaaaaaccgcatcatctgtatgtggcgcgcaaaggagatcaaccggtggccgccgcacttgagaccactgcccccgacggctattctggcgcgatacagatgctggtcggcgccgattttcacggcaaagtgctgggcgtacgcgtaattgaacatcatgagacgccgggtctgggtgataaaatcgagctgcgaatttccgactggatcaacagttttaacggcaaagtggtgcacggtgccgacgataaagcctttgccgtgaaaaaagacggtggcgaatttgaccagtttaccggcgcgaccattacgccgcgcgcggtgaacaactcggcgctggtgcagctactggggctctgtccgctgctggcggtgacctcaaccgccactaacgcgctgggcctcggactggcaaccacgctggtactgaccatcaccaacagtgcgatttccgcttcgcgccgctgggtgccgggtgaaattcgtattccgatctacgtgatgatcatcgcctcagtggtgagctgcgtgcagatgctgatcaacgcctatgcctatggcctgtatcagtcgctgggcatctttatcccgttgatcgtcaccaactgcattgtggtgggacgtgcggaagcggtggcatcgaaaagcagcattcccctctccgcgctggatggctttgccatcggcatgggcgctacctgcgcaatggtgacgctgggttcgattcgtgaactgattggtaacggcacgctgttcaacggcgctgaccagctgctggggccatgggctaaagcgctgcgcattgaagtggtgcattttgattcaccgatgctgctggcgatgctgccgccgggtgcgtttatcggcctcggtatgctgctggccggcaaatacctgatcgatcagaaaatgaagcagcgcgccgcacgtcagctggacgctgctgctgccgcgccgcagggcgaaaccgggaaggctgcaaccgatgtcagcgtcaataaagccaccgcccgactctatccggtggccaatacgccagcggcaatgctggcgctcggcgtggaaggcgttaaagagtacatcaagaccattggcctgtttaacagcaaagcggaaaacgtcatcaaaacctgccgcattctgcaggagcagcacggcggtgtggtgccggaagaccgcgcggcactggaagccctgcccggcgtcgggcgtaaaaccgccaacgtggtgctcaataccgcctttggctggcccaccattgccgtggatacccacattttccgcgtcagcaatcgcacccgctttgcgccgggtaaaaacgttgaggaagtagagcagaagctgctcaaggtggtgccgactgaatttaaggttgactgccatcactggctgattctgcacg

SEQ ID NO: 85036 - DNA, 237 bp, Glycine max
  Peptide Sequence Number=SeqID_201814
atggattctcttgaaattagtgagaaaaattgtttccgtgaagaaaatccaagtcgaggtgcttctgtaacgcttctgagacgtttccgtgagcgatttcatgaagattcttcaccgttcttcatcgttcttcggtcttcaaccgttctcaaagaactacgtaggtcttatttgcttatcacaattaaggaatacgtaggagcgagggaaacacccttattgaccacaaaaagataa

SEQ ID NO: 85037 - DNA, 300 bp, Glycine max
  Peptide Sequence Number=SeqID_201815
atggaggcaaaaggctcacccaggctagcctctggctcacctaggccaccaaatagcttcatggtgaagaaaccaactcgcctaagtgagctcattgctttagcattaagtttcaactcgcctgggcatcctaggggttttataaagggttccaagggtcagaaggtgagggaatttagagaagatagaaagaagaagaagaaagaagaggaaacgaagccgaggcgctaccgaatcgcgatcgcgatcatttcctgcatcattttcttgttctgtgttcttcgtgcgactgtcagttag

SEQ ID NO: 85038 - DNA, 561 bp, Glycine max
  Peptide Sequence Number=SeqID_201816
atggaccctcgggtactagtaccctggtcttcagaggactacactcctcgccaacagagggctgcacgccctcaccttaagaggactgtgtgtcctcactttcagaggactgcatgtcctcaccttcagagggctacaagccctcgccatcagaggactgcgtgtcctcacctccagagggttacacgccctcgccatcagaggactgcatgtccttaccttcatagggctactcgccctcaccttgggtactacacgtcctcgccaacagagggctgcacgccctcaccttcaggactacacgtcctcaccttgagaggactacatgtccccaccatcagagggctgcacgccctcacctccagaggactacacgtcctcgccttgagagggctactcgccctcgccttgggtactagttaccctcatcttcagaggactacatgtcctcaccttcgtagggctacacgccctcaccttgagaggactacatgtcctcaccttcagagggctacatgtcctcgccttgagagggctacacgccctcaccttgggtactag

SEQ ID NO: 85039 - DNA, 246 bp, Glycine max
  Peptide Sequence Number=SeqID_201817
atgtttggtcgtgtacagagtatatgcttacatccaggattggatgtcatcacagctatagcttccattcccacataccaaccatctgagcgaattcgccagtttaacgacttggctcgattttttggagatgaaagggctcagaatgcacgtaacatatggaacaggcctcttacgagtgtttatattagtgattgtggggagctgaaagtgacaaagccttccctcacgccttctttgccataa

SEQ ID NO: 85040 - DNA, 264 bp, Glycine max
  Peptide Sequence Number=SeqID_201818
atgactatcattgccaccaccaagaccactgttgcagccatcaccatgatcgtcgtcaccacccctgttatgaccttcgtcatcgttgttgccaccaccatgatcaccattggaactatcatcatgattgtcatcatcactactaccgttgcaaccaccaccgtcttaatcgttgtcatcgtcgttgtcgccaccaccactactaacgtcaatggtgatggtgtcaacaatgacaacgacaacgatcatgccaacaaacaatga

SEQ ID NO: 85041 - DNA, 435 bp, Glycine max
  Peptide Sequence Number=SeqID_201819
atgaagcaacaactatcttactatggaatccttcttgatcatatacccattagacatagacataggtactttgggtttttgatgttgcaaaagggagagagaaacaggcttagaaatcaagagataaatttcagaacaattaggcataacctccaaaagaaagggggagtatgggatgagtgcacgatcaatcaaaacttaagcaaggcttcaagaagatgttttcatgatgccaaaggaacacgcttctcaagttttattcaagacaagaatccaagatatccgagaaactcaagaaatatgatcaagataattcctaaagtcttaggaagaaagttccaagttgaaacaacaaaaggtttggccaaaggaattaacttaaaatgttttctaaaagagttttactctctgataatcgattaccagaagatgtaa

SEQ ID NO: 85042 - DNA, 537 bp, Glycine max
  Peptide Sequence Number=SeqID_201820
atgagccgtttagccgatatccgtgaacaagatgccaccggtaaagccgccgatattttcgccggaattaaaaaagcgatgggtaaagtgccgaatgcctatctgaccatcggcggccactcgccggcggcgctgcagcaggcgctggcgcacaacgcgatgctgcataaaagcagccttagcgcgcaggagctggaggcgattaatttatcggtcagtgaagcgaccggctgtgattactgcctggccgcccataccctgatggccaaaaaagcgggcttcagcggcgagcaaatccacgccctgcgccgcggcgagtatacggaagatgcgcgcctggacgcgctggtgaacttcgcccaaaccctggtgaccaccaccggtacgctgccggaagcggatgtcgccgcgctgcgtcacgccggttttagcgaccagcaggtgattgagatcatcagcgccgtcagcgccatcctgttcaccaacatggtgaaccgggttaacgacacggtagtggacttcccgaaagccgattaa

SEQ ID NO: 85043 - DNA, 225 bp, Glycine max
  Peptide Sequence Number=SeqID_201821
gataatcgcatcgccgtacgctttgcctacgagtggtgcgacgacagcggcaactggtttcgttcatacggcaatgaaaactggcagtttgatgagcacgggctaatgtccacgcgctacgcctgcatcaacgatttgccgatcgcggaaagcgagcgcctgttccactggccccagggtcgccgccctgacgatcatccggggctaagcgaattgggactgtaa

SEQ ID NO: 85044 - DNA, 540 bp, Glycine max
  Peptide Sequence Number=SeqID_201822
atggaggcagacatacccttagggtggaaaccacttaacctcgaccggtacgatgggacaacaaatacaaacgagcatctggatgctttcctgacacaggcaaacctctacaccaatgacgacacgattctatgtcatgtcttccctatgtccctcaaggtggcaacattgacctggtcttactgcatgacctcgaccgccttagccagtttgcgaccagaagacgatgaataccttagaaaactcatggacagatttgggcgcacaggtgtccagatccaaaatcttaaccccaaggtagcattgcattccatgttcatcgccttacacccaagcaagatcatagatagtctgcgcgaaaaaccacccggttgcatggatgagctatgcgagcgagccaagggctacatccagatggaagaaatgtctagattccggaatgaagtccaccaagccggacagaggcacgacaagaacgaatcaaacaccaaagccaacttgcacaagtcagacaagaggcataagccaaacaagcgctag

SEQ ID NO: 85045 - DNA, 430 bp, Glycine max
  Peptide Sequence Number=SeqID_201823
atgactacaattttgggtattcacttaatcttgttaggtataggtgcgtttcttctagtattcaaggctctttattttggagggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttag

SEQ ID NO: 85046 - DNA, 252 bp, Glycine max
  Peptide Sequence Number=SeqID_201824
atggcacatcagctgcgcaacaacactgattttgtgagtatttatagacgaggacgagttgttgcctgttcttgtgtaactgattacactgtgtcgcaacatgcccttttgcgggcgagcgaaggcgagactcacaggaaggtcgacaaaagcgggacttttgctcctacgtaccctcctttggagaggaaatcagacccacgtagttctttcttaaaggtgaatcaagcgattcttttacttgaaaggtga

SEQ ID NO: 85047 - DNA, 235 bp, Glycine max
  Peptide Sequence Number=SeqID_201825
agtggtacctggagatatgtcgcgggggtcaagagaccttggggacgtcaggcgagctcctagcagtcaaccaataaaagaacaaagtccacgaagcaaggaggcttgtgtggcggctggccagctatgtatcttgggtgggcttaaaaatggagacaggatgttaaaatggcctctgggtgacagggcactggtaatcgattaccagttgggtgtaatcgattacacagggtga

SEQ ID NO: 85048 - DNA, 591 bp, Glycine max
  Peptide Sequence Number=SeqID_201826
atgcagagtgggtcccaatctgaacggtttgatgtagaaatgggagatcgcttggaggacatgattcgtgaccttggacaagagtcttttcagcaagcacatgtccttgtgtatgaaggattgcatagtgattcaatgaagcctttatatatggggtgcaagaattccttaaccctgttgtctgtggtattatgtctggttaatgtgaaggccaggtatgggtggagtgacaaaattttttcctcactgcttgaggtagtgcacaatctgcttccagaggacaacatgctgcctaaaacttactataaggcgaaaaagatattgtgtccgatgggtatggagtatgagaagattcatgcttgccccaatgattgcatactgtataggcatgacttccaagaaatgtccaaatgccctatctatgggacttcatggtacaaagtggaggatgaagaggaaagcagttctgatgaaaactcaaacaagggccctccagtgaaggttttgtggtatcttccaatcattccaagaagattgatggtttgtatccggattttgggaaagagccaagaaatcttagacttggactag

SEQ ID NO: 85049 - DNA, 255 bp, Glycine max
  Peptide Sequence Number=SeqID_201827
atggatctcatcaattgttttctagagaaagagagctcaccaaagcaagattcctgggagagggagaaagaggtagggattccatggcgggtgcaagagagatgggtagggttaaaccattcccaggtggacttgatgcaatcctacctcgcaagggcattggatagaaaactccaagtagattgggccagagatgcaagagaaggccctagggttcttatgagccttggggtagatttcgggcccatgggctaa

SEQ ID NO: 85050 - DNA, 261 bp, Glycine max
  Peptide Sequence Number=SeqID_201828
atgcaggatatgctattgggttcaatggatacttcggctacagcaattgagtggacactttcagagctcctaaagaatccacaggtgatgaagaaagtccaaatggagttggaaactgtggtggtgtggacagcaaggtcaatctctggagctaacaagaagatgattgaaacactagctactaggaagaaggaagagtatctgaagaatctgaagcttggtcggatttttaaactatacaaattagaaaaggtcgaataa

SEQ ID NO: 85051 - DNA, 657 bp, Glycine max
  Peptide Sequence Number=SeqID_201829
atggattcattactggaacaagcaacacaggggagttttgttccgcatgggcgacaggacatactcaacacgacccttggccgacctgagcatccaggccgtgttcgcgtcgtaggaacaggtgtcacaataagccaatactttggccaagcctcacgtgcttctagcacatcgtcaccatcgatcaaccaacaacaattggctgatatcatcggtgtaattaaggatgacataagaaagctgctacaagatgagataagaaaggaggtacaagatgagataagaaaggaggtacaacaagaacacaagcagcaacaagaggattggatgagggcagttgaagaaaaacagtggcaaaatttggagctgatgaagcaagagttaaaaaaatcattgaaagtagagctatctcatattgcatcacatcagtcagcccccattaaggcaccagaaatacaagctctacttgcacgtgttagtacaaagggtagctgcgctggacctgaaggaagcggattacttaaagagcttttgagtggtggtgacgatctgatgggcttgttcgtagttgttggggaaaatactgtgcttgcgggcttgggaaaagtgtttgagaattcatccaccatacataatgttcgttatgaaaatgatgtt

SEQ ID NO: 85052 - DNA, 300 bp, Glycine max
  Peptide Sequence Number=SeqID_201830
atgctaggttacagtgtctgcaaagttagcttagctggcaaggagcccgctaaggcaaagggctgctcagctcagcagatgccgcaaggaatttcgcttggcgcagaagatcctggcttagcgcgcgaccaatcaataaaaaattttacgaagttacctaggcttagcgaattaggctcgcttagccacatgtactatactaggcggatgagtgttcatcctcaagaaataaactcgcttagcgcggcaggcgcgctcagcgagttctttaggaaaacacctatatttaacgaatattga

SEQ ID NO: 85053 - DNA, 1164 bp, Glycine max
  Peptide Sequence Number=SeqID_201831
atgtgcttgccgccgccaggagccttttgcatgactaagttacggctggcgattgtccggcagaaataccggccggacggcggtgccgagcgttttatctcacgcgcgctggaagcgctggacagcgagcagctcgatctcaacattattacccgcagctggcagggcacgccgaacccggcctggcacctgcacatctgcaatccggcaaagtttggccgcatctcacgtgaacgcggctttgcccgcgcggcgcgcgcctgctgggagcgggaaaagttcgatatcgtacagagccacgagcgcatcgccggttgcgatattttccgcgccggcgacggcgtgcatcgcgtatggctggagcagcgcgcgcgcattgtttcgccgtggcagcggctgagcaccagcctgagcccgtaccatcgctatgtgctgcaggcggaagcggagatgttcaacgcgccctcgctgaaagcggtgatctgtaattcgcacatggtgaagcaggatattttgcgccacttcgcgctggatgccagcaaaatccacgtgattcacaacgccattgatagccagcgttttcagcctgccagcgatacgctgcgtcacgccgcgcgtcagcgactcaacctgccgcaggacgccacggtgatgatctacgttggctccggcttcgaacgcaaagggctaaaggccgctatcgaagcggtcgctaatagcgatcgctacctggtggtggtcggccaggacaaacagctggcgcgctatcagcagctggcgaaccagcttaactgtcttgaccgcctgcgctttgcgggcgtgcagcaggacgttcagccgttttatcacgctgccgatgcgctgctgttgccaacgctgtacgatccgttccccaatgtggttctggaggcgatggcctgcgggctggcaatcattaccagcaccggctgcggcggcgcagaatttatcaccaacggtgaagagggttttgtctgcgatgcgttggatatcaaagcgttaaacgaagcggtaatcgcaacgcccgcactttcgcacaatccggcgctgggcgaagccgcacgtcgcaaaattgaaccttatggtccgcaaagactggcgcaggcgctgacttcgctttatcagcacgtcctgcaaacccgttga

SEQ ID NO: 85054 - DNA, 144 bp, Glycine max
  Peptide Sequence Number=SeqID_201832
atggcggcaggcagcgcctcgagcggaattttacctaccagactcaccagattgtggtcgaaaagccgacaccagattaacggcggaatgggtggcatgtttgggataactctctttggtaaaagagcgatcggccagtttcag

SEQ ID NO: 85055 - DNA, 1683 bp, Glycine max
  Peptide Sequence Number=SeqID_201833
atgacagcgcagcccgatagctcatccccgctactcagtctcattatcccgatgtttaacgctggtgctgactttaccggctgtatcaatgcattgctggcgcaaaccctgacgtcgctggagatcatcattgttgacgatggctccaccgacggctccggcgagcgcgccgacgcgctggcgcagcagtacccacatatccaggtggttcatcagccgaacggtggcgtgtcgcgtgcgcgcaatgccgggctggctgtggcgcggggtaaatatgtcagctttcccgacgccgacgacaccatggacccggcgatgtaccagacgctggtcgacatggcggagcgcgatcggctggacgctgcgcagtgcaacgccgagtggtttttcaaggccagccagacaactaagccgatgattccgcgggatcgcctcaccagcaccggcgtattaagcgggccggagtggctcaacaaggcgctgaaaacccggcgttacctgcacgtcgtgtggctcggtatctaccgccgtgagctgatcgaacagcttaatctgcagtttgaacccggtctgcatcatcaggatatcccgtggaccactgagttcatgctcaacgttaagcgcgtgcgctacaccgatcgggtgctgtatcgctactacatgcacgatgcgtcgatcagcaaccgcaagcgcaccggccagcacaatgtcgactatcagcgtcactacctgaaaatcgcgcgcatgctggaagagatcaatacgcgctatcgtcacaaggtgaagatttacccgagcttccacgcgcagattacccgcgaagcgctcagcgtgtgccacgctatccggcgcgaaccggacgccgcagcgcgccaggcaatgatcgccgatctgtttagcagccagacgcacaaacgcatgctgcgcaatgcgcgcggcgcgcagacgcgcccgatgctggaagcgcatccggcgatccgtcagctgcatatcatcgatcgcaactggaaaaaggaaggcggctggcagaagtttcgccatgaggtcgcgctggtgcgggcggtgcgcgcctgccattacgatgtggtgattaatctggccgaccagtggcgcagcgccattattaccggcctgtctggtgcgccggtgcgtattggctttgcgtaccgcaagcgcgacaacgcgttctggcgctggtgccataaccagctggtttccaccgaccgtcaccatcagctgcacaccgtggaacaaaacatgacggcgctgcagccgctcggcattcccaccgccggggcgacagcctccatgcatttcagcaccgccgaccagcaaaaagtgcaggatgtcctcgctcagcagtcgattaccggcccgtttgtggtgctgcagcccacctcgcgctgggtttttaagtgctgggaagatgaaaaggtggcgcagctgattgatgcgctggccgctgatggtcgcagcgtggtgctgaccgccgcgcccgatcagaaagagctggcgatgatcgctcatatccagtcgctgtgccgcacgccgaacgtggtgtcgctggcgggccagctctcgctgccgcagctggcggcgctgatcgacgccgcacagctgtttattggcgtcgattccgcaccgatgcacatggccgcggcgctgcagagtgggatcctctag

SEQ ID NO: 85056 - DNA, 972 bp, Glycine max
  Peptide Sequence Number=SeqID_201834
atgcacgttttgattgttaaaacctcgtcgatgggtgatgtgctgcacacgttgccggcgctgaccgatgcgatgcaggcgattcccggcattcgcttcgactgggtggtggaagagaattttgcgcaaattcctggctggcatccggccgtcgacaaagtcctgccggtggcgattcgtcgctggcgcaaacactggtttggcagccagcagcgcgaagagcgcgtgcaattcaaacgcgagctgcagtcacgtcagtacgacgtggtgattgatgcccaggggctgattaaaagcgccgcgctggtgacgcgcctcgccaaaggcatcaaacatggccaggacagccgcagcgcacgcgaaccgttcgccagctggtggtatgacaagcgtcatgagattggcaagcagcagcacgccgtggaacgcacgcgcgaactgttcgcgaaaagtctgggctatgaaaaaccggccacgcagggcgactatgccattgccggtcattttctcgcggcgcaaccgcaggatagccaaccgtacctggtgtttctgcacgccacaacgcgcgacaacaaacactggccggaagatcactggcgccagctcatcgcgcgggttcagcccactggcctgcgcgtcaggctgccgtggggcgccgaacacgagcaccagcgcgcgcagcggctggcagcagggtttgatcacgcagaggtgttgccgaagctaacgctggagcaggtggcgcagcagctggcgggcgcccgtgcggtggtctcggtggataccggtttgagccatctgaccgccgcgctgaatcgccccaacatcaccctgttcggcccgactgacccgggtctgattggtggctatggcaggaatcagcatgcgttacggcccgcgcagggcagcagcagcatggcagacattcagcctgacgacgtgatggccatgctggctgagatcgcgctttaa

SEQ ID NO: 85057 - DNA, 943 bp, Glycine max
  Peptide Sequence Number=SeqID_201835
atggtgattgatggcctgccgggcggcggtgccgaaaaagtcgtactgactctggcggggggcttcctcagtcagggacaccaggtttcgatcttctcattgcggaaggtatgtgattaccctattccggctggcgtggattaccaggtgattcttgatcgctgtaaccacccatggcgcaagctgacagaaacatggcgccgcgcgcgcctgctggatcgtgcggtgcgcgacagtgaagcgcggcacggcaaatttgatctgatcctctctcatctgcataaaactgaccgcattgtcaggcaaacgcctgcgctcgatggagacagaacctggttttgtctgcacggcgtgttttctgcttcgtatctggcacgtaaaaccggcttctcgctgtggctgaagcgtctgaaaatccgtcacgtttatcaggatcgccaaatcgtcggggtttcgcagtacgtcatcgacgatatggtgcaaaacattggcgtacagccccgccaggccaaagtgatcgctaatcctttcgattttgacagcctcgcccgactggccgctgaaccctgcccgttagccggcaccgatttcctggtgcatgtgggacgcttccatgaaaccaaacgccatgaccgcctgctcgaagcctatgccctgagtggcatcaccgcgccgctggttttgctgggacagggaagcgaaaaaataacgcaaaaattgcgtgagcaggcgcagaattcaggcattgcggagcgcgtgcgcttcgaaggttttcagcgcaatccttatccctggatacggcacgcgcgcctgctggtggtcagctccgacagtgaaggttttggtaatgtgctggtcgaagccctgagctgcggcaccccggtggtcagtacgcgctgtccgggcggtcctgtttcgatcctcaccggcgaactgtcacgcg

SEQ ID NO: 85058 - DNA, 966 bp, Glycine max
  Peptide Sequence Number=SeqID_201836
atggaaaaacctgcctttttaattacccttgataccgaaggggataacctgtggcgcaatcgcagcggcaaggtcactacccataacgtccggtttttaccgcgcttccaggcgctgtgtgagaaatacggttttaaaccgacctggctgaccaactatgagatggccagtgacccggcttatgtcgagttcgggcgcgatctgctggcgcgcggtcagggcgaaatcggtatgcatttacatgcctggtacagtccacctgaatatgcgctgaccgacgatgagtggcgttaccaaccttatctgatcgaatatccagaaaacgtcctgcgcgataaagtcgcctttatgaccgatctgctggagaacgcttttcagcgtaaaatgaccagccaccgcgccggccgctgggcatttaatgaagtgtacgcccgcgccttgatcgatcagggctatctggttgactgctcggttacgccgcgcgtgagctggcgtaatgcgcagggtgcaccgcagggacagggcggaacggattacagccatttccccgatcgcgcttatttcctcgatgaacaggatatttccaggccgggcgacagcccgctactggaactgccaatgagcattcagtatcgctatggcgcgttcaccaatcagctcaaacaagtgtggaatggcatccgcggcaggcagcgtggaccttcagtgaactggctgcgtccggtggggggaaatctggcccagatgaaacaggtggcagaacagacgctcgcacagggcaacgactatgtggagttcatgctgcattcatccgagtttatgccagatggcagccccacgtttaaaacggaggctgatattgaacgcctgtatgacgatctggaaggtctgttcagctggctggcgacccggacgcagggcatgacgctcacggagtttgccctgctgaagcaacagcagcgctaa

SEQ ID NO: 85059 - DNA, 243 bp, Glycine max
  Peptide Sequence Number=SeqID_201837
atgtgtttccatgaagaaaatccaagccgaggtgcttccgtaacagttccgagacgttatcgtgaacaaatccgtgaagattttccatcgttcttcaccgttcttcgttcgttcttcggtcttcaatcgaactacgtaggtctgagttcctcatcgcaattgaggatacgtaggagcaaaagccccgcttttgtcgaccaccccaagagattgttcatggtcgaacgccgtgggatcctctag

SEQ ID NO: 85060 - DNA, 282 bp, Glycine max
  Peptide Sequence Number=SeqID_201838
atggaggaaaggagacccgagaagaaggtccttgaagtaggaactctgttggatcctggtaataggattgatgcaatcctccctaggaaaggaccagttaccagagccatgagcaagaggctccaagaggattgggctagagctgataaagaaggccttagggttctcatgaaccttaggggcattttgagtagtctttgtagtatggaattttttgtattttcatgcattttgtcatggggtgagcttagctattatagggggtgtgtagctaagctctaa

SEQ ID NO: 85061 - DNA, 762 bp, Glycine max
  Peptide Sequence Number=SeqID_201839
atggtatcccaatgtgtgaagagcttttcattcgatgcttcaactgtggcaaatgttgtcctaagaaaaaggaaaggaggtcaacaaagctacgtgagggaaaactggggggaccatcagaacatctcttcgttctatttcactcgattccttgaagacacaacagaggaggaattgtggcaacacttcaaaaaagcgggtgatgtaagagagattttcatctctaggaagaggaacagaaatggaaggagatatggttttgcaagatttaagggaggggaagacgtgaaccagctagagaagagattggataacattgtcgtgggaggcctaaaactgtacgttaacataccaaaatatggtagagctacacctggagggacacaaccagagaccagaattccaacttttgctagacaacacgaacaggagggtagaggcacataccaggcaaagaagtctgcagcggttccgggcctcaagcgtggatcatttgcggacgttgttgcacggagaaacccacgaatggaccagatgataccatcaacaggtgtgagctacataagccacagttcaagatcagaagtgcaccttgacataccgctatctgggagaaaatggctgcaggaggcatgggtggggaggttaaaaaatctcaccatgtttgatagacttgaggaggacatgctctgggatttcggaattaacatagtgccaaaatatatcggggatgacatggtcttgctcctcggtctcacataa

SEQ ID NO: 85062 - DNA, 498 bp, Glycine max
  Peptide Sequence Number=SeqID_201840
atgaccaaatccacctatgatatggtgtgggggaaaacatctgaacaacaacaggatggagtatttaaggagtcgtggaagatcaagctgccacctaaaattactatgttcgcatggaggttaatcagagatagactaccaactaaagcaaatttgcggagacgacagattcaggttggggagtccacatgcccattctacagagaagtggaggagagggcaggtcatctattctttcattgtggcaagataactccagtatggtgggagtccttgtcttgggtgggtatgtcgggtgtcttcccaaaacacccaatgcaacactttctccaacatatacatggagtgaaagagggaatgaggtctagcagatggaaatggtggtggttggcactaacatggaccatttggaagcaaagaaataacattattttctccaatggtacattcaatgccaacagcatcctagatgatgcagttttcttattatggatgtga

SEQ ID NO: 85063 - DNA, 252 bp, Glycine max
  Peptide Sequence Number=SeqID_201841
atgagaaattttgggaatggggaattgtgttggagcgtggaggaggacgaggaggatctagacccaagcatcgggcgcaaatgcttggcggaggcacgcagcaaagttaggatagaatgtgagagttgtgatcctcaaagagctaaaagcctccttgaggagttcttgaagaagaagagagagaagctgagaataaggaaagaaataaagggtcacaaaaataaaaaggtctctctagcacctataagatga

SEQ ID NO: 85064 - DNA, 378 bp, Glycine max
  Peptide Sequence Number=SeqID_201842
atgtcaagctcactggctcactccctgacctcacacagtacccttttctttcctattgtgaattcaatagacaatagtagtgttaagttaggaatggaaggtactaccaagcctcttacaggatcatcaccttgcacagaaacatcagtcattaatggaacttataagggatttatgaaaattatactgcagaacaatgatactaagatgcatacctatcacatgagtggatatgcattttttgtagtcgggatggattttggtgattggtttgagaatagcaggggtacatataacaagtgggatggaatagctcgcgctataacatatatatacacatcacagtttattcgatatttaacatcgatggtgacataa

SEQ ID NO: 85065 - DNA, 420 bp, Glycine max
  Peptide Sequence Number=SeqID_201843
atggagagggaaaaaagttgctaccaacaagaaacaaacacaatcttgcttgattccatggtggcgagaaccgacaaaaacatgggtggtgaaggaagaaagagaagggtgcgacaggatattgggaatctcgtgactaaacaaggccatggaaatggaattaacgaactttcgtgctcaactattggccaatgcacaagccgcaacataaaagaacaagttgttatccagaaaccaagcactgaagtgaacaatggagcagtgttggcaactgatggggttgatgtgcataggaagatgtttgtgtgcatgactacatggtctactaacacgtttgatgttatcaaagagagcattacagggtcaatggctgcttcaggatccgtggctgtagaacttgcagagaagctcaagatttaa

SEQ ID NO: 85066 - DNA, 315 bp, Glycine max
  Peptide Sequence Number=SeqID_201844
gcgggggaggaagttggaaaatggaacagcgttggagtcaccggaaccgtgccggagaggttcttgtcagagacttcaaagaattttagcaaggactggttaaaaagagggattgaactgttaaaagagttgaagcttaaacggaggctgtggaagcagtctagggagagaaccagtgaagtagttgttatcgaggaagaggcttttgagattgaagagaccgttgagaatgagacggatcactttgaggccattgcattccacgccttgccacgcgcagaagcggaggccgcgcgtgaggggcaagaagttaag

SEQ ID NO: 85067 - DNA, 354 bp, Glycine max
  Peptide Sequence Number=SeqID_201845
atggcgaaaaggcatcgagtcttacagatagcaaaacgtgcggatgaccataatttgtcttcgcatgtcatcgggcacgatcgcctctggatgacaaaagggcgcataatgaccataatttgtctctgtgtgccatcagacacgactgtgtctggatggcgaaaaggtgtgcgaaataaccataatttgtctccgcatgtcatcgagcatgatcgcctctggatgacaaaagggcgcagaatgaccataatttgtctctgtgtgccatcggacacgatcgtatctggatggcaaaaggtgcggaatgaccataatttgtctccgcatgtcatcaggctcgccgcctttggatga

SEQ ID NO: 85068 - DNA, 150 bp, Glycine max
  Peptide Sequence Number=SeqID_201846
atgggtgtctccgcatgtcacccgattctcaccagtcggggtaacatatttataactgctgggtatatccgcttgccacctgactcatgggccggggtagcagattgtctgtgtatggataaccactgggtatatccgcctgccacctga

SEQ ID NO: 85069 - DNA, 213 bp, Glycine max
  Peptide Sequence Number=SeqID_201847
atggcacatcaccttcgcaacgatcacgactcagaaggttcagaagttcgcatggaagaacatcatctacaaacaagctctcaagcgtgctatgggggtgccattgtactcctagtttaccatgcaagaaacttagttcaagttaacccacaacaccgaagctatgatacctatggagacgggcaaacctttactctgaagaagcatgtttaa

SEQ ID NO: 85070 - DNA, 255 bp, Glycine max
  Peptide Sequence Number=SeqID_201848
atgattgcaaatttcaaatccatgctcattgatatgtgggatatagtggaaaatgggaatcacattccatttgataaagagctaaaggagatccccagaagtataacttttgataactatgatcatattgataaaattttgggaagtttgtctagaaattggagaccacgagtaacaaagttaagagctttgaagaatctagataccatatcccttgaagagctcgttgaagctattaaggttcataaacaataa

SEQ ID NO: 85071 - DNA, 187 bp, Glycine max
  Peptide Sequence Number=SeqID_201849
atggccaacaatataatcagcaccagggatagtggagaactcaccctggcaatcagttcaataaagaccagggtggaccatctaccagaccgactgttaagcagctttggagccaacatagagaggaatcctaaggaggagtgcaaggctgttatgactagaagcaaaatggtgaacatgaataaag

SEQ ID NO: 85072 - DNA, 159 bp, Glycine max
  Peptide Sequence Number=SeqID_201850
atggagaagatgaaatatgcacaagggggccccttaagggtgaagggtcactttggggcagttgtagctcgcccaggcgagctgaaacttagtgctgaagcaatgagctcacccaagcgagctggagctcgcccatgcgagttggtttcttcaccatga

SEQ ID NO: 85073 - DNA, 126 bp, Glycine max
  Peptide Sequence Number=SeqID_201851
gtgtacagtgctaaagggttaagtttgaaacctagcctgctagttgcatcatcaggggacattaccacccggcaaactgagccagaggtgatagttgaggatgattatagtgatgaagaaattgat

SEQ ID NO: 85074 - DNA, 1395 bp, Glycine max
  Peptide Sequence Number=SeqID_201852
ggtgatggcggtttcgaggctcccggccacgcccgccgtgggctgcagcagaaatcgatcattggccgccggggtgccaccgaccaccagcttgacgccattgatcaccagcggatcggcggcggtgccagtgccggtcaatgcaacggtggcacccgtgtcggcgcgggtggcctgccactgggttccatcgaacttgaggacgatgttctgtgcctcgagcttggacaggtcgccgtaggtcgcgctgaggctgccggttccggtattgcccgcgttgggcgtaacgcgcgggttgccgatgttgaagaagtcgccccccatcttgccgtacaggtcgacgccctggtggtgggcctggttgaacgattcggccaggccgacggcgagcttgccgagttcggcctgggccggggtcagcacggtgtcgcggaactccagcatgccgccgatctttccgcccacagccttggggtcgagcgtgatggtattgccttgtgtctccagcgccagctgcaggcgctcgggctggtacggatcggtcaccgtggtgaccttggacgccgtcgtgcccaccaccagcgcattgccaccagcggtgtagacgttcatcacgccaccgtcctggacaacggcggtgccgccggtgtaaccgatcagctgcgagatcagctggtcgcggcgatcaagcaggtccggcgcagcattggcgatgttggtgccgatcgctccgttgatctgcgcaatctcctgcgccaggcgattgacttccgtggcgccggcgatgagtccgttgttgacctcgctgccgaggttgttcatctgcgtgttgagctgcacgaagcggctcgccaaggccttgccaccatcgagcaggctctgccgatcggccgtgccggccgcgttcgacgacaggccgctgacggcatcgaagaagttggaccaggagccggcgacattcgtggccgggtccgagaacagggcattcacccggtcggccatgccggagagctgcttcaggcgcgccagctcaccgctgctgtcgagcaggcgcgagatggccagctggtcggcagcgcggcggatgtcggtgatgcgggtgccgctgccaacgtccccaaagccgtagttctgcggatcagacgtggcgaagtcgaccttctgccggctgtagccgggggtgttgatgttggcgacgttgtggctggtggtcgccaatgcacgctggaaggcgagcagggcaccggtaccggtggaaagtacgctggacatggggttcctcaacgacgagtgatacccagcgccgcggttgcggtgctggcgaagggcctgctggtaacgcgggctggtcttcagcaggcgcacgtagtcggcgaagctctcggccggcgaact

SEQ ID NO: 85075 - DNA, 961 bp, Glycine max
  Peptide Sequence Number=SeqID_201853
ctcgtccagctgcttttcgagcgccttgatctgcttgttcaaggtcgccgtgcgctgggtgatcgtgccggtggtcgcgtccaggctgctcttgagcagctcggtcatcggtttgcccagtgcgccctctgcaccgaacagtttggtggcggcctcggggttcttggccaacgccgtgtcgagcttggcgccatcaaggctcatgctgccatcggcagcaatggtgatgcccagatccttgagatcgttgacgttcgcactcagctgggcgcgcagctgctgctgcaggccgcggaccatggcgtcgccggtcatggtcgatgcagtgcgcgtctcggcgttgtaggcgctggagttcttcagtgtcgcctgaatgccgttgtaggcggtgatgaaggccgtgaggttggttttcagcgtgctgttgtccggagtgacggtcagcgtctgcgtctcgccctccttcgccttggtcagggtgaggctgatgccgggcaccagatcggtgatggtgttggagctgctggtgcgggtgaagccatccaccacgaccacagcgtccttggcgggcaccatttcggtcatcttcgacgccggtgtgccgtcataggccagctcggagagcccgccattgccgccactggcgctgaccttcaacgcgcccttggtgccggaatcaacggcggtcaacaccaggtgcatgccatcgtcggcggtaaccacggccgcggtgacgcccttgctctcggcggcggagttgatctctgccgcgatcttctcgagtgttgcgccgggttcgatgttcacgcttatggacttgtcgccgtacccgatcgtcagcgtaccgtcgccaaccacggcatccttcgtataggccttggagctgagcttctggttctgcgccagggatttgacttccacctggtgactgcccgcggcggccttgcctgccgtggtgctg

SEQ ID NO: 85076 - DNA, 249 bp, Glycine max
  Peptide Sequence Number=SeqID_201854
atggtggaagagctagatcaatttacaaagaacaaggtttggaaccttgcacctccaccaaaaggtccatatgtgattggcacaaaatgggtattcaagagccagttgaatgatgaatgggaagtaacaacccctggctttgaagacaagaaaaagccaaaccttgtgtacaaacttgttaaagcattatatggcttcaagcaagcaccaagagtttggtatgaaagactaacctcattcccaacttag

SEQ ID NO: 85077 - DNA, 123 bp, Glycine max
  Peptide Sequence Number=SeqID_201855
atgaatacatacataatgtctgagaggacccataagggaatgcccaagcaagctggttgcttaggcctgaaggcatttcatggctcaggcgagccagatgcttgtagatgcaattgcctttga

SEQ ID NO: 85078 - DNA, 285 bp, Glycine max
  Peptide Sequence Number=SeqID_201856
atgtctaaggtgttgcccgcggatgctttaaattttttagttgcatccaaaaaatatatccatgtcaaacggagtcgtggaagacgctacctttggaagatgaccatggataacggcctcccaactgttgttgatccatggtacaaatacttaacgaaaaatgatttgacgtcggacgatgaggttgtcttctactataggttcaatgaacgtgcatgggaggtcatgtttcggaagcaggttaaatgggatgaagccgggtgttcgcttctgtttgatgattaa

SEQ ID NO: 85079 - DNA, 851 bp, Glycine max
  Peptide Sequence Number=SeqID_201857
gctttgacatcgattcctactctagtttctcctctttcctccccaccgccgtagccaactctataggctatatcattaatccgaagattccacataaatatgcttcgattgaagatcacaatgctgataaagtcactagcgagtatagcgtgaagtatgaacaagatcaatttcttcttgcgtggttgcaatccaccatcttcggcggcattgttctgcaagtcatcggatttcgtaatgagctttgcaatctctcttttgataattgctctattttggatcatcttttgcatgttcagatgcttgttaatgagcttactttgattggtgaaactgtttccaattctgaacatcttgacctaattctcaatggtctccctgatgagtatgagtcttctgattctcttattactagtcgatttgatccatttactattgatgaagttgaaacattgttgcttgcatgtgaagtgtgcattgagagatcttgtaagaaagttttaggttctattaatcttactcaagcaattgtgttggtcatggttcaagtcgtagtggtggtagagtcactcatggcatctgctcccactcaaactcagacttggtatcctgattctggtggttcccatcacatgactaatatgtcacagaacaaacaacaagtgacaccttttgagtggcctaaccaaatcactattggtaatgttcagggcctcaacattaactcctcagctaagttacctctttattattgggatcatgcctttgtgtccagcatctatctcatcaacagattgccttcatcttccattgataatggagttccttatcagaaattgttcaacaagtag

SEQ ID NO: 85080 - DNA, 1122 bp, Glycine max
  Peptide Sequence Number=SeqID_201858
atggtaaaaagagaaagaataaatatcttatgtctacaagagactaagagggagcaggttgataaggctgtatgccaagccttgtggggtgatgcagatagtccatctgaaagagtaggcagctgtataaaggaagggtactgcaactcgcgcctttttcatcttatagttaattatactcggagacataatgtgctgaaaggggtgcttgttaatgggcaatggactacagaacccaacagagtgaaagaggaaatcagattgtttttcaagagatttcaggattctgaggagaacagacccaggttagatagggtccgatttcaggctataggccagtaccacaatgagatcctggtggagcacttccatgagaaagaatccaacgatgcaattgttcttattgctaatgaagtggttgaggaagcaaatagatgtaacaagccctgcatggtgttcaaagtcaactatgagaaggcgtacgactcagtatcatgggaaattctgatatacatgttgaagaggttggggttctatccaaagtggattgcgtggattcaggactgccttaaatctgcttctgtctccatattgatcaatgggagtcccttggcagatttcattccgcaaagaggactcagacaaggggatcctttagccccactcctctttaatattgttgttgaaggattaaatggtatgatgagagaagcaatggagagaaatatgttacaaggtttcctagttggtagagagaaagtggaaatcaatattttacaatacgctgatgataccattttctttggggtagcttctatggagaatgtcagagttttcaagggctctagtgaaagttttggacaaattgatgaggttgcaaagaggaacttagatgaggaaaaaagatgcaatagcaaatcactatggtggcgggacctcagcttcatttgtcagtctaatgaggagagaaggtggtttcaaggtgaggtcttgccgctttggtgggaatcattgtcttggatagagatagtgggacctctcccacaaaactcgaggcaacatttcctagaacactcctcttccagggcgtcgagtatcaggaaaaagcgatggctgagttag

SEQ ID NO: 85081 - DNA, 469 bp, Glycine max
  Peptide Sequence Number=SeqID_201859
tcgtcgatggccctcttctaaaagagctaggaagaccgctacaggagaaggatctagtacaactccacctgtagaaattgattttgatggacaccactttcgaagtgaggagcatcagcgttgctttgaagtgattaaagattggccttttctcaaagaaagacgggcagaaattgctaggaggcattggacacaactggcagagctcgtgactaaatatgatcctgaagtagtcatggagttttatgcaaatgcctggcctactgaagaaggcgtcatggataagtgttccagagcaagaatagaagttggggcaagatcagtagcagccgctggtagcagatgcaccatcgccgcctccatatttgccaccatccttggagtccatctcagcccacatgtagaggatggaactccaaatgcacacatacatgaggcatttggcttatcattaggcaacaaatcatag

SEQ ID NO: 85082 - DNA, 882 bp, Glycine max
  Peptide Sequence Number=SeqID_201860
atgacgatattcgcggcgggcgcgctgatcgccctatttgcgccgtcgctgagtgtgctggtgctgggcagtgcggagcagggattgggtaccggcgtggctggcgtgatggcgcgcaccatgccgcgcgatctttactccggcattgcgctgcgccaggccaacagcctgctcaacatgggcattctggtcagcccgctgctggcgccggtaatcggtgcgctgctgacccatctgtttggctggcacgcctgctttgctttcctgctgctgctgtgtgttggcgtaacggcggcgatggcacgctggctaccggagacccgtccaatggatgcgcccgcgacaccgtttctgcgccgctacatcacgctgctcagcgacggcaactttgtgcgttatctgctactgctgatcggcgcgctggcgggcattgcggtatttgaggccagctgcggcgtactgatggcgggcgtgctggggctggacgggctgacgctgcctgctggcgggcctgctgatgtggctgccggcgtggtttggcgtgatgactatctggacgctgctggtgccggccgcgctgttcttctttggcgcgggcatgctgtttccgctggcaacttctggcgcgatggagccgtacgcgtggctggccggcagtgccggtgcgctgattggggggctgcagaatctgggttccggcgtggtggcgtggctctcagcgctgctgccgcagcacgatcagtcgagcctcggcatgctaatgtttgtgacgtcgctggtgatgctgctgtgctggtggccgctctcgcgtcatccggagagcggcaaacagacggttacaggataaaagggtgcagtgccgcgtctttgcggtccagatag

SEQ ID NO: 85083 - DNA, 970 bp, Glycine max
  Peptide Sequence Number=SeqID_201861
atcagctggaagcaggcgctgggcgtgggggtggcgcagtgcctggccatgatcccgggcacctcgcgttcgggcgccaccatcatcggcggcatgatcgccggcatccagcgcaagacggccaccgagttctcgttcttcctggccatgcccaccatgctgggcgcggcggtgtacgacatgtacaagaacatggacctgttgacccagcacgacctgtcgggcatcgccgtgggcttcgtggcggccttcctcagcgccatggtggtggtgcgcgccgtgctgcgtttcgtggccaatcacacctatcgcgtgttcgcctggtaccgcatcgtcttcggcggcatcgtggccgcctggatcttcacccgttgatccgccggccgcgttggcggccaggcaagagaaagggccgcgtgatacgcggccctttctctttggtcggcatttcgagggctgcaaggcccgcgccgcggcgcgccagcctaggcggcggcttccagatcgtagaactgcaggccgtcgcggtcgatgaccagccagccgccgcggggcggcgagacgtggtcacagtcccaatcgggcagcacccagcgctcgcgcttgctgccgtcgacctccagcacgtggcgggcgggacggtgcgtgtgtccgtgcaccatcagggccacgccgctgtcgcggaaggcctgctcgacggcggcggcgttgacgtccatgatttccatggacttggactggttggccatctggctttcgccacgcgcctgttgcgccatcgccaggcgctcggggatggtcttggccaggaacgcggcctgccattgcgggttgcgcaccatctggcggaactgctggtaggccgtgtcgtcggtacagaactcgtcgccgtgggtcagcagcacatcgccatagtcggtctgcagcaacgccggctcgggcatcagccgggcgccgacggcgccggcca

SEQ ID NO: 85084 - DNA, 184 bp, Glycine max
  Peptide Sequence Number=SeqID_201862
atgtctgagcaagaacttaaatccagcaacagtatcgttaacgtgattgtcgtcatcgataccgatgccctgatagaagcattcgagaataacaaccccagtcaggactccagcaacccaacaggtatcggccatcaatacgcttatatggtcgtcacctccgaacaggtgatcggcggttccg

SEQ ID NO: 85085 - DNA, 399 bp, Glycine max
  Peptide Sequence Number=SeqID_201863
atgtccctaaagataaaagaagaggtgaagaaacaatttgatgctagttttttggctgtcgcccggtacccagaatgggttgccaacatcgtgccaatccccaaaaaggatggaaaagtgcgcaaatctcgttttgccctattctctttcatggatgggttttcaaggtataatcagataaagatagcaccagaggacatggagaagatgactttcattactctatggggaaccttatgttataaggtgatgtcgtttgggctaacaaatgttggggcaacataccagtgggccatggtggcattgttccatgacatgatgcataaggagatcaaagtctacatagacgacatgattgaaaaatcaagaatggaggaagagcacttagtcaatttatga

SEQ ID NO: 85086 - DNA, 825 bp, Glycine max
  Peptide Sequence Number=SeqID_201864
atgaagaagaagaatgcaaaagcaatcccatctgtgtgtttgcatattagaagggagggctatcaaactaagacattgcatgcatatggggtgtgcataaaggcgactggtgagaagagtgcggagggtgaccgacgaagagaagagaagaggacgacgaagaagaagaatccaaaagcaatcccatctgtgtgtttgcatattagaagggagggctatcaaactaagatctttgcagcactcgagcctccggtgcgagctaaagacccgaagggaaaggcgaaggtgggcatggaagagagcgacaaggcgagcccaattcttgatgaggaagtcccagctggaaggtttgctaaggaagaagaggactttagcaaaaaaggaatatccactgaagaagcaactgagttcttacgaatcatccaacagagcgagtttaagcctcattgggtgttattggtcaaaatcttgaacgaagcccacgtagcccaagacatatctgtggagggtttcgggggaattatcaacaaaatcacagccaataattacctcacattcgttgatgaagaaatacccatcgagggtcgaggacacaatagggccttacatgtatctgccaagtgtttagaccacatcgtggccaaagtgcttattgacaatgactcttcacttaatttcatgcccaaagctatgttggacaaactacctttcaacgcgccacacctaaggccaagctccatggtcgtgtgggctttcgacggtagccgccaagatgtgaggggggagatcgatctcccaatccaaattggcccccacgtcttctag

SEQ ID NO: 85087 - DNA, 420 bp, Glycine max
  Peptide Sequence Number=SeqID_201865
atgaaggaaaaaatcaaggaaaaagaagcaaaggaagaatctcagcagaaggaagaaaagatgctgccaaaccctccctggaaaactcaatcaagttgctgcaaatatatcatcagaaattatgcaagctacaagcaaaggagaaatgaaaaagaacagaaaaaaaggaagcgacagcgccccaatgctctcccttatgttgctggagaggcttgtctctacccatgtttacagcattctgataaacgggaagtttccaaaacttcagaaaaagatttgactaagaaaaatgcggagttgtataatatctcaatcatgtatgacaacttgaatctaacaatcccacaaaatctaatgattgggaagtctccgatacttaaagaaaaagatttagctgacgaagcaagaaaaaatctctga

SEQ ID NO: 85088 - DNA, 1170 bp, Glycine max
  Peptide Sequence Number=SeqID_201866
atgatgttggatgcagttgtagactgtagagtcaagtttgcaaggccgaggttgaaggttgtacattcaaatttcatgatgccatgttttgggtttttgaaaggtgataaagcactttcattttggtcttttttgaaggtagagcatcactctggtgtagagttattcaattcctctctaacttggctagatataggtggtgagatgaacctagctgctggcattcaggttgcacaactggctcttaagcatcggcaaaataaaaaacaacagcagaggattattgtctttgctggaagccctgtcaagcatgaaaagaagatgttggagatgataggaagaaagttgaaaaagaatagtgttgcacttgatattgttaattttggtgaagaagatgaggggaagacagagaagctggaagcactcctcgcagctgttaacaataatgataccagccacattgttcatgttccatctggtcctaatgccctttctgatgtacttataagtacacctattttcactggtgatggggaaggtggaagtggttttgcagctgctgctgctgccgctgcagctggtggtgtatcaggatttgagtttggcgtggatccaaacttggatccagaattggctcttgctctaagagtttcaatggaagaggagcgagccaggcaggaagcagctgcaaaaaaggctgcagaggatgctgcaaaacaagagaagggaggtgagcagcaagccagctcacaagatgcaacaatgactgagcgtgccagtgcagcaatgtctgaagctgagaataagacaagtgatttgatggatgatgagaatgccttactacagcaggcgcttgcaatgtctatggatgatcctgccattagccatgatgtaaaagatacagatatgtcagaagcttctgcaagtgatcctgacttggctctggcactccaattgtcaatagcagatagtacaaaggatcaaggcagccagtcagacatgagcaaattgttggccgatcaatcctttgtatcttctatccttgcatcgcttcctggggttgacccaaatgacccttctgtcaaggatttgctggcttccatgcaaaatcagtctgagcctcaacagaagaatgacgacaagccatcaaacgaggaggagaagaagtaa

SEQ ID NO: 85089 - DNA, 189 bp, Glycine max
  Peptide Sequence Number=SeqID_201867
atggcgaggaggcgggatgggatagaagatgaatgcaagaagaataacgaaggggaggggacagactcgcggggcagcagcgaagggaaggaggcatcaatggcatcaatggtgttgcagcatagtaggagggaaggaggtgtgagtgaatggaagaataacccaaaaaactgcactcactttttttag

SEQ ID NO: 85090 - DNA, 783 bp, Glycine max
  Peptide Sequence Number=SeqID_201868
atgattcagcagaggcaaagcaacaacgtgcatgtggttgttctgcattacccagtacaagggcacataaaccctcttgttcaatttgcaaagaggttagcctcaaaaggtataaaggccacagttgccaccgcccattacactgccaactccattaccgcaccaaacatcagcgtggaaccaatctccgacggcttcaacgaagccggcattgcccaaaccaataacaaagttgaactcttcctcacctcgttcagaacaaacggttcaagaaccttgtcccaactcatacagtatggtttgattgagctccctgtgaacgtggaagatctgcccctgcgtgttcctggccttcctccgttggatttctgggcactcccaattctcttgaggttcccagagagctatcctgcttacatggcaatgaaattgagtcaattctctgacttgcccaaagctcattgggtgtttgtaaacacctttgaagcattagaagccgagtggactgaccaatcgtctaatgccgtgtttttggagcaagtatgggaggtgggagtctggccaaaggaggatgagaaaggaattgcgaggaagcaagagtttgtcacaagtttgaaggttgcaatggagggtgaaagaagccaagagattagatgggatgctaataaatggaaaatgttggctagagaagcatttgatgaaggaggcagctctgataatcatatcaatcattttgtgaatcatttgatgaatattagggatgtgcaaaaattagttcaataa

SEQ ID NO: 85091 - DNA, 423 bp, Glycine max
  Peptide Sequence Number=SeqID_201869
atgactgagaaagtagcaaatggttttctctctggggtcgtgaaagtgtctggatttttcaccagttcagtgataaactcaaaagccggaaagaaatttttcagctttctaccgggggaagttctgcttgcatcgttggatggattcagtaaagtgtgtgatgctgttgaagtagctggaaaaaatgtcatgtcaacatcatcaactgtgacaactgagcttgtcgatcacagatatggagaacaagcagctgaagcaacaagtgaagggtttagtgctgctggtcatgctttgggtactgcatgggctgcttttaagattaggaaggctctcaaccctaagagtgttcttaaacctacctccctggccaaagctggtgctaaagctgcagcttctgaatttaaggctaaaagttccaagtaa

SEQ ID NO: 85092 - DNA, 3015 bp, Glycine max
  Peptide Sequence Number=SeqID_201870
atggcaaagaaagtgactatagtttcacattgtttctctgcttttctcctgttttatttatgtgggacagtagtttgtgtcaagtacaatactggagctagtgttgtgccaggcaaattgaatgttcatctcattgctcattcccatgacgatgttggttggctcaaaaccgttgaccaatactatgttgggtccaacaatagtattcaaggtgcatgtgtggagaatgtgctggactcggtggtagtgtcccttcagcttaaccaaaagagaaagtttgtgttcgctgagatggcttttttccatagatggtgggtggaacaaactccacagacacaggtgcaagtgagaaagcttgtggatgctggccagctagaatttataaatggtggttggtgcatgcatgacgaagccacgactcactacatagacatgattgatcaaacgactcttggtcaccgcttcatcaaaaaccaattcaacaaggtccctcgtgcagggtggcagattgatccctttggacactctgctgttcaggcttacttgcttggtgctgagcttggttttgattctgtgcacttcgctaggattgattatcaggacagagctaagcgcaaagttgataagactcttgaagttgtgtggcgaagctccaagacatttggctcttcagcccagatttttgccaatgcttttcctgttcattatagtcccccaagtggttttcattttgaaatcaatgatgactttgttcccgtacaggatgatccccttctatttgattacaatgttgaacagcgagtcaaggacttcattgctgctgctattacacaagcaaatgtgactaggacgaaccatattatgtggacaatgggcgatgatttccagtaccaaaatgcagagagttggttcaaacaaatggataaactaattcactatgttaataaggatggcagagtgaatgctttatattctactccatctatttataccgatgcaaaaaatgctgcaaatcaaccatggcccctgaaaactgatgattacttcccgtatgcggatggaccaaatgcttattggacaggctatttcactagtcggccagcgtttaagcgatatgttaggatccttagtggatactatttggcagcacgacaacttgaattttttgctggaaagaaatccactgtaggccacactatagaccttggagatgctctcggcgttgcacagcatcatgatgctgtctctggcactgccaagcaacacacaactaatgactatgcaaaacgacttgctattggagcctcaagggctgaagctgttgttagttcttctttgtattgtcttactagcaagaaactaggggttcaatgctcagcacctacatcggcattttcccagtgtcaattactcaatatcagttactgcccaccaacagaagacggtattccacaagcgaagagtttggtattagtggtgtataacccacttggatggaatcgcagtgacattgttagaataccagttaatgacgcaaatcttgttgtaaaagattcattgggaaataacattgaaacacaatatatagaagtggataatgttacagcaaatttaagagaattctatgtcaaagtttatgtgggagtgtcaccccaacaagccccaaagtactggcttctatttcaggcttctgtacctccacttggatggagtacgtatttcatttctaaaacagcaaaaaaaggcaaaaacaggattggatttctctcataccaaagcagtcaaaacaaagataccattgaagtaggtccgggaaatttaaagctgtcattttcttcagagtctggacaactcatacggatgcataattccaaaactggagtagctgtaccaattcagcaaagctatctctggtatagttccagtcaaggtgaaggtcaggattctggtgcatatatatttcggcctcatacccctccaaatattgtttcaagatcagtgcccttcaagataatccgcggaccattagttgatgaggttcatcaggagtttagttcttggatttaccaggttactagggtctataaagacaaagagcatgcagagattgaatacactattggtccaattcctatagaggatggaattggaaaagaggtgatcacccaaatgacagcaaatatggttacagacaaagagttctatactgactctaatggaagagattttttgaaacgggttcgagatcatagggatgattggccacttcaagttcatgaaccagtagcaggcaactattatccactcaatcttggaatttatgttaaggataagaaatctgaattgtcggtcttagttgatcgggccactggaggaggcagtatcaaagatggtcaggtggaacttatgcttcataggcgcatgctctttgatgatggcagaggagtagacgaacgtcttgatgaactagtgtgccaaaatgatagatgtcaaggactaacagtaagaggaaattattatgtgggcatccacaaacttggagctggttcacactggcgccgtacaactggtcaggaagtttattcaccactattattggcttttgcacatgaggacttaggaaactggaaggcctttcatgtgaccagaggaactgtcattgatcctaattacaacttacctcccaatgttgctctgataactcttgaggtgttggataatggaatggtgcttctccgtttggcacatctatatgaggctggtgaagatgctcagctttcaactttgaccaaagttgaattgaagaaaatgtttgccacaaaaatgataaggggattgattgaggttagtttatcagcaaatcaagagaaggaaaaaatgaagaagaaaacatggaacgttgcaggggacaagggacaagggtctaaatcagttaggggtggccctgtcagccatattaatctcgtagttgagcttggtcccatggaaatacgttctttcctgttgaaattctaa

SEQ ID NO: 85093 - DNA, 1011 bp, Glycine max
  Peptide Sequence Number=SeqID_201871
atggctctgttttcaaatcaccgacactcttccgaagcgctcttgggctttctactcttcctcgtattcagaggggtttcagtttcaggggcaacatttaccttcgtgaacaagtgcgattacacagtatggccagggattttaggtacgccggaactcggaagcacaggctttgaacttgcgaagggaggttcaagaagcttccaggctccgaccggctggtccggtagattctggggcagaaccggttgccaattcgacggtttggggaaaggaacgtgcgccaccgcggactgcggctccggcgaggtcaactgcaacggcgccggagcctccccgccggccacgctagccgagtttacactcggcaccggctccatggactactacgacgtcagcctcgtcgacggctacaatctgcccatgatggtggtggccagaggcggctcggggtcctgcggcgccactgggtgcggtgaggatctcaaccggcggtgcccgtcggagctgagggtggagggcggcgacgcgtgccagagcgcgtgcggcgcgttcgggaaaccggagtattgctgcaacggtgcgtttagtaacccttccacgtgcaagccttccatgtactcgcaaatgttcaagtccacatgccccaaagcctatagctacgcttacgatgatgccactagcaccttcacgtgttccggcgctgactacacaatcacattttgtccttcttctccaagtttaaagtcttcaacggattcaagtccaaagggaatagatggagggtcagggtctgtgggaggttcatcggttgagcaatctgaattagcttctacttcgtggttagccgacatggcaacagctacaggggcctcaacacgaacacggcctcttgttgcatcaaagcttctgggtccccctctcctagtgacgtctcaactacatccttatcttccttcttccctttcacacagacacaaaaacaagatcgatagcattgatacgcagtga

SEQ ID NO: 85094 - DNA, 507 bp, Glycine max
  Peptide Sequence Number=SeqID_201872
atggttattagtcttgaatggtctatttacaaggacaatgatgttgcaaaggcaaaaaaagtgaaagaaactttgttggatgatatttggtggaacaagattgattacattctttctttcattgctcctatttatgatgttcttagaaagacaaatagtgatatgacttgtcttcacttggtatatgcaatcttggattcaatgattaaaaatactaagagtaacataactcttcattgtctagtacattcttcaaacccaagatattatagtcatgaatggttaagtgaagatccatcaagagttcccccacatgaagatgtggaatttactgatgaaaggaagaaatgctttaaaatatactttgatgatgtggatgtaaggagacaagtcgatttggagtttgtatatttttatggtagaagaaaaggctttgatgatgttgactctttaagggatagaggtgaattggttacaaaatcttggtggcttgttcatggtattcat

SEQ ID NO: 85095 - DNA, 414 bp, Glycine max
  Peptide Sequence Number=SeqID_201873
atgacacgcgcattctcgtcctccgctgccgccgtgtcgccgccgtcgaaggcaatcgtgtacgaggcgcacggtgacgaaatgctggctgctcctattaacccctccgatataaatagaatacagggcgtttatccggtgcggccagacccaccagcagtgggtgggtacgaaggcgttggagaggtacactctgtgggttcctcagttacttctctctctcccgggacgtggctgacttatattgtgaaggatgagaaagtttggcacaagatagagaagggtgtgcctatggaatatgctgctacaattactgttaatcccttgactgcacttctcatgcttgaacactgcgttgccttgaactcagttaacatgattttaggaaaattttcgcatgttcagcaagattaa

SEQ ID NO: 85096 - DNA, 192 bp, Glycine max
  Peptide Sequence Number=SeqID_201874
atgagcttccaactcttaaccaaagcgacaaagcgaactgcgacaaagcgaactgcgttttcgtatcctttctcactcggattttctcaccgatcggaacgagctagcaggtcttcattcggcatcgctttcgacatcgacggtgtccttttgttcggaacctcccctgcggtggttctcccggtgcactga

SEQ ID NO: 85097 - DNA, 429 bp, Glycine max
  Peptide Sequence Number=SeqID_201875
atgccatttcacattggtgccctaaattctgttgacattccaaatgttcttcccttgcccaaacctgattgctgtgcagatttgataacaatctcattgttgctgtgggaaaagggggaacctgctgccatgatgacagaatatggttttaaatatgctctttcaattgatgaatatgcctcgtgctttgaaaacattgatccactggctccatacaagaaatggacaaccaagctggctgctacattgaatgcaaagtttaatgagagtgttccaaggaatgatgtcttctctaaaagggttcaagcagcatttgtagttagtgaccctgttgattggagcagggacattcaggttacgaaattctttggcttatttaaatgtatcccacagggatcaaagccatctgctttggtggatgttcaatag

SEQ ID NO: 85098 - DNA, 273 bp, Glycine max
  Peptide Sequence Number=SeqID_201876
atgataatagtttccaaaatacattttcacaatagccactcagaaagcttcttccttttctttatcccccaaaaattctgtttcgatcccatggatccaccaagaggcactcaaatggttcagccgaggagaggtcgaatcaagatgatggtgttcaagagcgtcgcggcggcgttgtcgtgttccggtcgtcggaagaagaaggacgccgctcctctcagctcaacctccacaaccccagttgttccaagtggctacacttccgaagcctga

SEQ ID NO: 85099 - DNA, 1047 bp, Glycine max
  Peptide Sequence Number=SeqID_201877
atggcgaacaagctcatcaaccagatgggattgcccaaatccattgttaatatcttcactgctcgcaacattatcaccgccaaggatgcattatctcacactgaatttgagttgatggaattgctggacgttgggaaggaagaagtaacatccgcaatggctcatgcattacttctgttggagcagcgagtactcaatgagagtttggccggtcatctttccactcgtttgaaaggtttggatgaagccttgtgcggtggtataccgtttggtgttttgacagagttggttggtccagcaggaattggcaaaactcagttttgcttgaagctctcactgctggcttcattgcccacaaattgtggaggcttagatggccgtgtgatatatatcgatgttgaatccaaatttaggtcaaaaagattgatagagattggaataaacagttttcctgagatatttctcaagaagggaatggcacaggagatggccggtagaattctgattttgcatcctacatcactttctgaattcgctgagaggttatgtatgtgtctgagtttgcaccagatcagagtatcactcctccaacaacaagtgaaattgctcatcattgatagcatggctgctctagttttaggtgaacatgatagtgaggcttctagacaacaagcattgggttggcatgcatctaggtcacttgctgaattttcacgaattccagttgtattgactaatcaagtaagatctcaaattggtgatgaatctcgcatgtattcctttcaagcacaaagccactctataataaaagataatcctgccacatatgattctcatctggttgctgctttgggaattaactgggctcatgctgtgaccatccgccttataccacctggacttaaattgttggagtgggtggggatttgggtagaggttgtaagttcaagccataggatgataggaatgacttccaagacacctaagacacattacttaataacaaattctgttgtccttggagtctctacatcattatttgtttga

SEQ ID NO: 85100 - DNA, 841 bp, Glycine max
  Peptide Sequence Number=SeqID_201878
atggtgactggtaccaaagagcacttggtatcacagtctagggtgctaccattaccaatcatggcacgcatcatggccatggatgaagtatccagatggaggaaggcgacgagccttgactggatgaaatttgttgtagatacgaaaggtctctggctcgggcatcccttacaattcgttgaggctgatttggggcacacccaaagggtccggagacgaaggggtggaaatgggacattcatcttcatcatctgcaataagaagataaagtcatggccagcacctgtgactgagaacccatttctcatcacattggtaaggtcggcagacccactggagacgggaagagcaaagacggaggaggccaggagtgatgtcgtctgtcctggagtttctcctcttgcagcttcgccaatgccaccgcctggacttggagggcttggactccctgcgaaggattgttggagatttgggggaagtggggttgatggtaagagcagcaagatgatcaaggatggaatccatcttgctgttcattgtggtttaggtttgagtgagggaggcatggttcaaagaaagggtggcttagtcttggcatggtgctgggttgaaagcggggcagaattgagcactacggctggggccccttcgcacataatccttcaagtgtgttggcctgttatggttgcgggttggtctgggtggattaagaaagagggtgagattttggaaggaggcaaatgggaatcagaaagtgttgaagatgagtttagaatgggtatgggttggtgggacgaaatcaagagtgagatgaagcaagataaactgaaaaaagacggag

SEQ ID NO: 85101 - DNA, 297 bp, Glycine max
  Peptide Sequence Number=SeqID_201879
atggtcgagtttagtccaacaagaggaatctgcggacgatgcttgatcaggattaggctagactatcatgaggaattgagatctcccataggcaatttagttcctttggatttagaaattgaagctacattaagaaggaacaaggccgagaggagaagaaaacttttgcgagacaaaatagttgcatccattcttgaggaagaaactcatttctctgattcattatcacctgattcaccatcatcaagggaatccgctactcaattgcctgaagccattaccatggcagatgagtag

SEQ ID NO: 85102 - DNA, 423 bp, Glycine max
  Peptide Sequence Number=SeqID_201880
atgaccagaaggcttcttgccggttcattggttattgagagtcgcatccttcattatctcattgtgtgtatcttggttccaagatcttcaaaccttgctcagagatcctttctaataggcgttgttgtgattgcatcctttggttaccgtaaagagcatgatggatcttgggtgaaaaagggtgctcaacccattgatgaagaaggacatttacatggtggagaagattcctctcttcttcaaaagattttggacaggttcgatggtcttcaaacctttgttggtgaaaggtttgatactttggagttacaagtggacatgcgattcaatgagatggagtcaaggatcaccaaggtcgaagaagatgtttcttacatttgtacaagctttgatctaccaccaccaccgccaccatcatcttag

SEQ ID NO: 85103 - DNA, 348 bp, Glycine max
  Peptide Sequence Number=SeqID_201881
atggcttcgccttttcgacaagctttgggaggaacctggacagggatgctagccaaccatgcaatttctagacttattggatgttggttgggttgtgcatctccaatatggcactgcatttgtcaaggttcacttcaatcccccaagttccctaaagaattcttccaagtctgccacatgttgggctatgctttaagacatgacaaccatgttgtccacatatacctcaatgtttcgtccgatctactatttaaagactcagtcgttgcacctggaacccagaggctccatcgactagcctatcgatgttgggcagagggtatgcatctttggggtatgccctgttga

SEQ ID NO: 85104 - DNA, 279 bp, Glycine max
  Peptide Sequence Number=SeqID_201882
atggtgctgcccaaaccaagtgttggccttaaggggaaacctcaccaacatgctctcactcatcatgccttcttgtatttcaacaaacaaaagcttgggccccctaggcctaagtcatgttttggcatttatcctaattctcgcaagctgtccgcatccaaaaaatggatactaggctgcctcctagctgcgcctcccgcttgtccggagctgggcatgggacgacgatccatcgatcatgggcctagcctctactcgcgtccgtccctaagtacctga

SEQ ID NO: 85105 - DNA, 375 bp, Glycine max
  Peptide Sequence Number=SeqID_201883
atgaactaccctatcaagcataactttcagagttcgacatccagtactaaccttgctggaaacaaaaaaaccaccccagattggtggaatctctatgtggacggtgcgtctaacgtaaaaggaagcggggcaggaatcatccttgaatgccttgacaatgtcaccctagagctagctctcaagctcaacttcaaggcctcaaacaaccagacaaagaggaagctcctatgcacaaagatggtacgtgctggctactactggctaacactcgaggcagacgcccttgacttcacaaagagatgcagacgatgccaagagtttgctgacattccacgtacccctcctgacaatctccacaatctgatctccccttag

SEQ ID NO: 85106 - DNA, 2076 bp, Glycine max
  Peptide Sequence Number=SeqID_201884
atgtcttcgttcctttctgattctgccattggcatgggtggtagtgattctggggccttccccaattattgtgatcctttccccttctgcttttggggagtaaggagaggtagtagtggtggagatattaaggcatctcctcacatgcgacgtagccatagcgttgggtcactatcgtccccacctgtcgttattggctatgagtgggtgagggacgatgttttgaagtataagtcatctctcacctctgcgacaagtgtcactgctctgcaatgccaggtgaagttggcaagccctgaggactcctggaagatagtcatccaggcctgcgacagtgatgacttccctttcttaagggtggcattgggtagtccgcccttcttctttatgtataaatgcttgtttgaggaccattgcttcaaggtcctggatgcaggtgtcgtggctgatggtttgccattgatgctcaacaaggacggggagtcttgcttcccgttttactgtccactcgtgaagcaggccagacttgcaaatgggactatgccaccgtctactgctgctcccactgaaggaagtcaaccggtggttaaggttggccctattgttgttggtattgttgagattgctcccactgccccttcctctgtattggttaagaggaaacgagatgatggtgttgggctatcgggtcgcaagaagccaagggacccttcgtgccctaaggcaagctataaggttgacacccggtgtgggtcgcccttcaagtgtgcaagatgtgcctccgactccaccaatcttcaaggttcctgtgagcatgccaactgctttggttggttttgctgcggttccctcgtctcccatcgttgcactacacctttactaagtgtcgatgtggctaccattagtgcccttatggtgcctccctcttcctcttcagctccaatgatccttccctccactgcattggctttgacttcaacctcatctcgctcctatgtttccctggatcacatctacatttccaatgatgttgattccttgtcagccgagttccagcatgctacaaattttgccaaggctaaagttggcaaatggagggcgactgcttgcactatttggagagtggagcgccctaaggtagctagtgccaccgctgcttttgctgaggctatgaggttgaaccaccaactgtcttctaaagttggcagtgcgttggcgaagttgttgtgcaccaagttggacagtgatgaactatccaattgctacaaggacttgcaagaagagaaaaagaacttggctaagaaggtggatagcatggcgataaagaaagatgaacttgccaaggctgctagagaagggaaagccaacaaagagcttgaggaggagttgcttgtttacaagaaggagatcatggaacaacatgaaaagggctttaacgaagccttcaggcaggccgggttctttgccgaggaacttgacttgggtctttttgacccattcaaggatgtgaaggacggtgttttgcttaacgtggaagaaattgttgcggaggaggaggttgctgccatcatgatgataagtgtggaatctttgacgacacatgaagtgagacctagtcaaaatagaggtaagatcgtagtggttaaaggtcttgtcacccatctagtggagcttccttctgcttcacggagcttctcccttgatgtctttgaggagcttaatggcgtgctcttgcgtacatgtcactcgttgtgggtagcatgtactcgaggcttaatggcttgctgtcaccatgaatgggctatcccaattgagaccaagctttcccgcttagggatcttttctggcttcaccttaaactcgtcatacaaggtcaccagtctccttgtcgatggttccccaacttcaacggggatcatggcatttatgtcatatacccttagacttgtcgagtctagtgcgcaaggccctaaggatgactttgttggttgcctctgcctaaccgttgatctgaggatgttcaacaaagtgacaatggcgtatgggaggtcgaacttgcaaatgaggtatttctag

SEQ ID NO: 85107 - DNA, 480 bp, Glycine max
  Peptide Sequence Number=SeqID_201885
atgatgataacaaaagatgatgacaaaggtgatgacaaaaagctcaaaggtcaatcaaaggatgagttcaagatgttcaagaagaaatcaagaacgattcaagactcaagaggaaaggttgaagaacacttcaagattcaagaggaaactaacatacccctggggtggaaaccactcaacctagagcggtatgatgggaacatagacctagatgagaatttggatgctttcctgactcaggcgaatctatataccaatgatgatgtgattctatgtcatgccatcccaacatccctcaaaggggcgtcattaacctggtacggtggattcccaccaagatccatagacatctttgacactctcatcgagcgtctcaatgcgcagtacgcaaccagtagatctcaccggatgacctcggccagcttggctagtctacgacaagcagacaatgagtctcttagaaaattcatggagatttag

SEQ ID NO: 85108 - DNA, 255 bp, Glycine max
  Peptide Sequence Number=SeqID_201886
atggagaggaatgtggagcttgccccatggatgtacgatgagttttatggcaagctccataggcgctactggcacaaacgactcaccaggcttatagagaagaaaattgatgtagccttggtgaaggagttctactccaatgtctatgattcggaggatggatctccaaagaaatgcattgtacgacggaggacgattaggttcaacgcgcagacgttgaacgagtttcctggggatgcctgtcacaattgctga

SEQ ID NO: 85109 - DNA, 915 bp, Glycine max
  Peptide Sequence Number=SeqID_201887
atggcatcctcaactcaattctccaccactcttgttacactatgtctcttccaattcctagcaggttcgtattcaacgacattcacgattgtgaacaagtgcagctacacagtttggcccggcattttatccggcgccggaacctcgccgctccccaccaccggcttcgtcttacaaccaggcgagtccaacgtgatcgccgtgccggccgcctggtccggccgcctctgggggcggaccttctgcacccaagatgccacaggaaaattctcctgcgtcaccggcgactgcggctcctccgccgtggaatgcaacggcggaggagccgccccgccggccacgctggcggaattcaccctgaacggcgccggcgggctggatttcttcgatgtgagcctcgtggacggttacaacctccccatgatcgtggagccacagggcggaaccggcgccggaaactgcaccgccacggggtgcgtggtggatttaaacacgccgtgcccggcggagctgatggtgatgagcagcggagagggcgtggcgtgcaaaagcgcgtgcgaagctttcgacgatccacagtactgctgtagtggcgcttacgcgacgcctgacacatgcaaacccagttcatactcgcagttctttaagagcgcgtgcccacgcgcttatagttacgcttatgacgatggctccagcaccttcacttgcgccacagcggattataccatcactttctgcccacaaccatccactagttcgattaaatcgggaaatgggaaatacccaatggcggtggacaattcgggtgctaatgtagacgtaagaacaaacaatgttatggcggtgattgcttctgttttggtggcatttgtggcaactcaattaggtgtcccttcactgccaaagttgcattaa

SEQ ID NO: 85110 - DNA, 348 bp, Glycine max
  Peptide Sequence Number=SeqID_201888
atgtggaatgtagctcgacatgattttagatcacttgatgattgtggtattcttgaaatttctaatttgtctttagatgaaccagagttagaagaatttgaaaagatgaaggataaagtacctgataacttcatgcttgactttgctgtgagcagagagcaaacaaacgaaaaaggagagaaaatgtacatccaaacacgaatggctcaatatgcagaagagctatgggagttactgaagaaagataacacttttgtctatatgtgtggactgaaaggaatggaaaaggtaatcaatgacataatggtgttattggctgcaaaagatggtaacaacacttatctttag

SEQ ID NO: 85111 - DNA, 4094 bp, Glycine max
  Peptide Sequence Number=SeqID_201889
atggctgatcacacccgttcccaaacactatctcgcctcgaggaagccattactctccttacccaaaaccaacacaccctcacctcaacacagacttccctacacacccgtctcgacgacatcacctctcgtcttcaagctctcgagaccccttcccccacccattctcggcctcaccctccacgtatgaacctcgacgtcccccgtttcgatggttccaacgcacctgcatggatttttaagattaatcagttttttgattaccatcggacgccagaggatgagcgtctacaggttgcatcattttacctggaagggaccgcactaagctggtaccaatggatgtaccggaattaccaattgccttcgtggcccgctttcctccaggccttggaactccgtttcgccccttccttgtacgacgaccctcgcggtgccctattcaaactctgtcaacacggctccgtctctgcttacctcgccgagttcgagtccctagtcaaccgcatcgtcggcctccccacccctttccttctcatttgtttcatttccagactctcaccggacatccgccgtgaagttttagccctccaacccttatccctcgtccaggccgccgcccttgccaaactccaagaagacaaactctcagatgctcgccgcaattaccccccaccaaaaaccacatataagcgtctcactcaggccgaaatggcttctcgccgcgagcgcggattatgttataattgtaacgaacgctacgggccgaaccatcgttgcaaggcaaaattcttcctcatagtggccaccgaggacgaagaccccataccattcgaccactctattcccctttcacctgaccccccacagacacccccctccccaacagaccaccccccggcccaattaagcctccatgcactctcgggccaacccgcatctgcgacccttcgcgtctctgccgccattaagggccatggagtggtggtcctcgtggacagtggcagcacccacaattttgtccacgaccgcctcgcgcacttcctccacttggccttcgaacctgttccccctttgacggtgatggtgggaaatggcacggagatcacctgcactcacgtctgccgcggcgtcaccatcctaatccagggtcacccatttaccctagacctgcacgtgatggcattaggaggcacggacattgtattgggcatctcctggcttcaacacttgggcccaattacaactgactactcccacctcacaatgtcatttgtgcaccatggcaagcccatcactatccacggaagtaagaatcccggcccagcagagattaaccacggccagatgcgccgactgctttccacccaacgagttgcagcccttttccacatacaggtccacgagcatagcccagttactcccaacacccccatcccacctcccattcgtcgtcttctcgaccactactccaccctcttcctcacacctcagctcctccctccaccgcggccaacagaccataacatacaccttgaacccaatgccaagccagtcaatgtgcgaccataccggtacccctactttcagaagcaggagattgagcgccaagtcgaggatctcctccgccgggaattcattcgtccaagtcgaagcccatattcttctccggtgctattggtcaggaagaaggatggctcatggaggttttgcgtcgactatcgtgcgctcaacgacctcaccatcaaagatcgtttccctttgcccacaatagacgaattacttgacgaattgggccaatcctcttggttttcgaagctcgatcttgcccaaggttttcatcaaatccgcatggtggacgccgacgtacccaaaacagctttccgaactcatcagggccattatgaatacgtcgtcatgcccttcggcctttgtaacgcaccctccacgtttcaggccaccatgaacgacttatttcggcctttcatccgcaagttcgtactcgtcttcttcgacgacatcctcgtatatagtcgcgattccatgctcatctggaacacctcgaatgcgtcctccaaactctgcgacaggggagtcgaacctgacctagccaagatacaggccatgcaggactggcctcttccatcttcacctaagcaactcagaggttttctcggtttaaccggtttttatcgcaggttcgttaagaactatgctcagatcgccacaccattgaccaacctcttgcgtaaggaccagtacgagtggtctccggcggcccaatcagcttttgagcatttgaaacttgcaatggctaccactccggtactcgcgctaccagacttctcaatcccctttgtgattgagaccgatgcttcaggcacaggaatgggtgcggttctcatgcagcgcggtcatccaattgcttacttcagtaagcaattttgccccaagctcctccggtcatccacctacattcgcgaactccatgctatcacttccgccgtcaaacggtggcgtcagtacctcctcgaacactcctttgtcatcctcaccgatcacaaaagcttgcgtgaactcatgacacaactcgtgcaaaccccggagcaacatgtttatctcgcgaaactacttggctacaactacacaatccaatacaaagccggccaccataacgtggtggcagatgccctttcacgaacaactgaatcagattccccagccacacacttctccatcatctcattccctcatgcccagtttttggatgaccttaaaagggagctcgccaattctgatgagttccaagccctttgtgagcgcaccggtcaggacaacaaccccaatcctgacttcaccctccgcgacaatctcctgttgtttcaaggtcgtgtttggctcaatcgtggcaacgcgtttattccccttcttttggaagaattccacaaatctccactgggtggtcatatgggattagccaagacgcttagccgcctgaaacaaaatttcttttgggaaggaatgcgctccgatacgaaggacttcatcagccgctgcactgattgtcttcaaaccaaatatactccacagaaaccggccggtcttctccaccccattcccccaccgacacggccgtgggaagacttagctttggatttcattacaggcttacccaattcccaaggagcaaccgttattatgaccgtcgttgaccgcttctccaagggagctcattttggatcccttccttctcatttcacggcctatacagcagctcaactgttcatcgacatggtgtgcaaactacacggctttccctggagcttaatctctgacagggacccaatcttcgtcaacagaggtgctcaatcggatcctcgagcaatatctgcgaagcttcgttcatcagaaaccatctcaatggggcaggtcactttcggcaaaccacctcctggcatccttgactaccttcctggttcgtcctccgtcgaggcagtggacttcgttctctcctctcgccaggaactatttgagctccttcgtcgaaagttgcaacggtcacaggaaaagatgaagcaaaccgctgacacccaccgtcgcgatgtccacttcaaggttggcgattgggtctacgtcaagcttcgtccctatcgccagacttcactctcagctaagtatcagaaattggggaagcgattctatggcccttaccagattacggacactgtgggcagcgttgcctaccgcttagcccttcccccgacggccaaactacaccctgtctttcactgctctaaactcaagccccatcgtggacccatcctggcagaacaatccctacccccagttacttgggaggacaacccggtcattactcctctcgctgtcctcaatcacaagtgggacgatcaagatcctcctcaattgtctgttttggtacagtggaacggattgccgccggaggattccacttgggaaaattggacggagctcaagcgcctataccaccttgaggacaaggtgttccttgaaggcatggggattgatagcataccagcaccaagaaccagaagaactgctaagagaccaccagg

SEQ ID NO: 85112 - DNA, 273 bp, Glycine max
  Peptide Sequence Number=SeqID_201890
atgggtctccccgtccggggcaagtcccttgtggccaaggaggttaagggcataagggagtctaggaataaggaagagttatttctttcgtctccttcaaagagaacaaaggatttcttggtgattgttggtgagggggttcatgagaagatgatagagatgggggtgaaagccaaagaagggataacaacttgtcgaggatggattctaagatgctccactataactaaggtaaaggctacttacaagaggataagattcatcaacctctga

SEQ ID NO: 85113 - DNA, 126 bp, Glycine max
  Peptide Sequence Number=SeqID_201891
atgcctaaactgatcgagctgaggacattggtgcttgggccctacatcgagtgtgggagtgctcaggcgatcaggatgactctcagatgttttgtcattttgggaagcgtaatggagcgcgtgtaa

SEQ ID NO: 85114 - DNA, 280 bp, Glycine max
  Peptide Sequence Number=SeqID_201892
aggacatgctggtgatccagcgagtgctttgttagagcttctggatccagagcagaatgctaattttcttgaccactatcttgatgttaccattgatctatcaaaggttgttgctattgctgggtatattactgatgagaaaatgcacattgctagagattatctggagaagaccattcgtgaagcttgtggaataaagcctggacaagtatttatctttgctacctgttttgcagtccattctcctgcagagaatgggattttcaaagttttaacatag

SEQ ID NO: 85115 - DNA, 231 bp, Glycine max
  Peptide Sequence Number=SeqID_201893
atggctattaacgcttggcaattgcagattccacatttaaggccaacagaatataagagattaaggttacccagaaatcgaaggactgtgaaccgtgcatatggtggtgtgttgtctggcagtgttgttagagagagaatcattcgagctttcttggttgaagagaaaaagattgtgaaaaaggtattgaagatccaaaaggcaaaggaaaagcaagctttgaagggctga

SEQ ID NO: 85116 - DNA, 927 bp, Glycine max
  Peptide Sequence Number=SeqID_201894
atggcattcgtcgtgactatggcaacaacttgtaatgtccgtatgggaaattcaactaaaatggcatccatcgtgactatggcaagtctatttttcttccaattcctatctggttcgtgttcaacgagactgaccatcaccaacaagtgcagctacacagtttggccagcaattttatccgccaccggaagctcgccgctctccaccagcggcttcgtcctccaaccgggagacttcaagatcgtccctgttcctcccgcttggtccgggcgactatggggacgtactctctgctccctagacattaccagcaccaagttctcatgtgtcaccggtgactgtggctccaccaccatagaatgcgttggaggaaacgccaccccaccggttactctggtgaagttcactctgaacggaacaggcgggctcgacttctacgaagtgagtctcgtcgacggtttcaacctccccgtgagggtggagcctcgtggcggcaggaaccgcagggctactggttgcgagatggacttgaacttatcgtgtccgacagagcttaaggtgataagagacggagacgccgtggcgtgcaagagctcgtgccaagcagagccatgcttgacttcacagtttttcaagactgcatgcccaggcgctcacgtccatacttgttcttctcatgattatactatcactttctgtcccccacccacaccctcttccagttatcaagaaatatccaggggaagcggcggtggacaacccgggagctcacccatcaacgtcgtcgttgccgtggttgttgctcttgcttctgtttgtggcctatttatagcatgcaaaataaccattcgcttatcaaatggagattgtgtcttcggcatcggcgccggaactagaactggaacaatccaagatgtcactgtttaa

SEQ ID NO: 85117 - DNA, 855 bp, Glycine max
  Peptide Sequence Number=SeqID_201895
atgccctttccagatcctagaattgaacctttgttggttcagtctggtttttcaaatgttacaaagctcggacaagttaaaatcggtggtgctttagtggctactttggttgaaaggtgttattcccttagagaatgcactggtggatcaacacttaaactaaagtggttaaaagaacacatgttgactcttctagcagaacccacaccacaaaaactagcaggccattgtaaggcatacattttagggctcattggtggggtattaatgccagacaagtcagggaacaaagttcacctgatgtatctacccctgttaatagattttgatcagttccattggataccttacagaggttttgacttatttctgccagaaaatgcatacaaagatttcaaaatatggagtgcttatatagctttaatctgttttctagtggtagtatggcatcaaactgacaggatcatgctccaatttggactttataaaaatataccagatccactgcataatcttgacaaagtccatcatattgacatgagaggacatagtgacacaattggacagaggaacatcaatggtggattgcaatttggactttataaaaatataccagatccactgcataatcttaacaaagtccatcatattgacatgagaggacatagtgacacaattggacagaggaacatcaatggtggattgcaatttggactttataaaaatataccagatccactgcataatcttgacaaagtccatcatactgacatgagaggacatagtgacacaattggacagaggaacatcaatcgtggattgcaatttgaaaggaaatacacaaatatatgttaa

SEQ ID NO: 85118 - DNA, 106 bp, Glycine max
  Peptide Sequence Number=SeqID_201896
atggacaacaatccatgggagtttctcgacattgatgactcagacctctcatcctttgttcgcccaactaatcagtcatcctccagttcaacaagacttattcctg

SEQ ID NO: 85119 - DNA, 1968 bp, Glycine max
  Peptide Sequence Number=SeqID_201897
atgggtgacatagtgaagcaaatattggcgaagccgatccagctggcggaccaagtaaccaaagccgccgacgaggccagctccttcaagcaggaatgcggcgacctcaagtccaagacggagaagctggcggcgctgctccgtcaggcggcgcgtgcgagttccgaactctacgagcgtcccacgcgccgcatcatcgacgaaaccgaacaagtcctcgacaaggccctcgccctggtcctgaggtgccgcggcaacgccctcatgaagcgcgtcttcacgctcaacccgggagccgcgttccgcaaggtctccttgctcctcgagaactccaccggcgacgtctcctggctcctccgcgtctccgccggcgacggaggcggcgactacatcggcgggctccctcctatcgcggcgaacgacccgatcctctgcctcatctgggagcagatcgccgtcctccacacgggctcggcggaggaccggtccgacgcggccgcgcagctggtctcgctggccagcagcagcgaccgctacgggaagctgataatcgaagaaggcggggtgggcccacttctgaagcttctgaaggaaggaaaacccgaagggcaggaacacgcggcacgtgccatcggggttctggggcgtgaccccgagagcgttgagcacgtgatccacgtgggcgcgtgctccgtctttgcgaagatcctcaaagaaggtcctatgaaagtgcaagctgtcgtggcctgggccgtgtcggaactcgccgccaattaccccaagtgtcaggaccttttcgcccagcacaacatcataaggctactcgtcggtcacctcgctttcgaaaccgtcgaggagcacagtaagtacaccattgtcagcaccaaacccacttccatccacgccctcgtcatcgccagcaccaataacgtcaagatggaagatccatttctcgacaaccaaaacaaagcacgaatgccacatcccttgggtgaaagaccacgaaatctccatagagtaatcactagcacaatcgcaatgcacgctgccaccaaacacggaaacgaatcaaatcccaagaccaatggagttggtaatgatgccaagcaaggaaatcaggatcagaatcagaatcaccagccaaactattcacattcggggataaacatgaaaggaagggatcatgaggatcctaagactaaggctaacatgaaggaaatggcagcgagggctctctggcaattagcgaaaggaaactcgccaatttgtcgtagcattactgaatcaagagcactgctctgtttcgctgttcttcttgaaaaaggaacggaggctgtgcagtacaattcggctatggcggtgatggagattacagcagtggcagagaaagatgctgaattaaggaaatccgcgtttaagcccaactctcctgcttgcaaagccgttgttgatcaagtggtgaagataatagagaaagcggattcggagcttttgattccgtgcataaagacgattgggaatctggcgaggaccttcaaggcgacggagacaaggatgatagggccattggtgaagcttcttgacgaaagggaagcggaggtgtcaagggaagcgtcgattgcgctcacgaaattcgcgtgcacggagaactaccttcacgtggatcactccaaggcgattataatcgccggcggggccaagcacttgattcagctggtgtattttggaggggaagagatggttcagattccagcgctggttctgctctcctacattgcaatgcacgtccctgatagcgaggaacttgctcaggctgaggtgcttggagtcattgaatgggcctccaagcaatcctccattgctaatgaccaagcaatcgaggccttgttgttggagtccaagaccaagttggacctttaccagtctagaggtcctagaggattccataaattgcatttgcatcagtag

SEQ ID NO: 85120 - DNA, 2337 bp, Glycine max
  Peptide Sequence Number=SeqID_201898
atgccgtcaagattacttgtgaattctgcggacgaattggtcacaccgaaagcgtttgttacaagaaacatggtgtatccacaagctatgaaggaagaagcaaaacctacaacagaaacgggaaaacgtaagcacgactaccctccaggatacaagtttggcaacagcaaagtagtaaataacattgtagaaggaaaagttacgagtgatcaaatgcaacgacaagagtctcatgatttggaagctcaatccctacccaatcccaggttgcgtccatatcttcgtgcaccactaacacctcaccaggataccaacaccaaagcgaagattggtacagttgaactatacacacgcccctgtgatatctcgaaccttcaggtttttggttgcctatgctacataagcactctcaaatctcacagacaaaagctcgaccaccgtgcccacccatgcatcttcataggtttcaaaccaaacaccaaagggtatttagtctatgatctccattcccatagcataaccacatcccgtaacattgtcttctatgaagaccactttcctctcttccctgatagtccagaatcatccacccctcctacttctatatcacctctccctttctccaataatcccgacagctttgaacatcccattccacccaatgacaatccctcatcctcacatataccttccccttctctacgacgttccatgagactcaaaaaggcacccacttatctccaagattaccaccatgcactcacttcacaagttgataccaatacgcgtggagttaggtatcctctacaatctgtcttatcctactcccgactttcaccttcccatagacacttcgtgatgtcaatatcggtaaacactgaacccaaatcttatgatgatgcttcccaatttgactgttggattaaggctatgcaggcgaaatacaagctcttcaacagaatcaaacatggacccttacaccactaccaccacacaagacagctatcggatgtcgatgggtatataagatcaaatataaagcagaagctcaccactgtgagattgcttctcgctcttgctgcccttcacaattggcatctccggcaactcgacgtcaataacgcatttcttcacggcgaccttgacgaagaggtatacatgactcttccccaaggtcttcatgtgcatgatcacaatctagtttgccgacttcaacgttcattatatggtttgaaacaagctagccgtcaatggttcacacgactctcttctttcctcatctctcacggcttccgccaatctgcagcagaccattctctttttctacacttcaataacagtgataccatagctgttcttgtttacgttgatgatataatcatagcaggtaacaatctcgacaccatcacgcatatcacaaacctccttgatcaaactttcagcatcaaggaccttggcaccttgaagttctttctcggtcttgaagttgctcgcaataaccagggcattcacttatctcaacgtaagtatgtattggatatcttattcgactcaggcatgcttgcctctcgacccgcttcaactcccatggactactccacccgattaacagcctcgatgggcacccctctatcagaaacttcttcttcctcatattgccggttgattggaagactcatttacctcaccaacactcgtcccgatatcactcatgccgttcaacaactcagccaatatatggctcaccctacttcagctcactcacaagcaacatttcgtgtcttgcgatatctcaaaggctcacctggttcgggcatctttctcgctgccaacggccctctgcaactcaaagctttcagtgactccgattgggccggttgccgcgatacaaggcgttccatcaccggcttttcggtatatctcggctcatcccttttttcttggcgttcgaagaaacaacctactgtttcgagaagctcctcagaggcggaatatcgggccttggcgtctacaacatgtgagcttcagtggctcacataccttctgaaagactttcgggtctccttccttcagcttgcaaccctttactgtgataataagtccaccattcaaatagcttgtaatcccgtcttccatgaacgaaccaaacatatagaaatcgattgtcatatcgtgcgtgataaggtgaatcaaggatccctcaaactgcttcctatctcctcgcaactgcagctagctgacatttttacgaagccactcttgccctctttgtttcaaggtctctgttctaatctgggaatgatgaatatccattcccagcttgaggggggctcttag

SEQ ID NO: 85121 - DNA, 675 bp, Glycine max
  Peptide Sequence Number=SeqID_201899
gataagttaaagtttggtaaatctctaacgagctaccgactactcgagtctcagatcgcctccgaggctgaagcagcgacagttgccgctctgagcagattgaagtggcattccgatgacgaagacgacgacgatgcaaagcatgaagccaacaccgttcaggaggtgaagaaggcgaagcagaagaaaccaaagaagccaaaggtgacggtggccgaagctgcttctagaatcaacgtcgatgatctcgaggcgtttcttgctgagattatcttgagtgcttcgtatgaatcgcaacaagatattatcctgatgcgatttgctgactacttcagtcgcacattctcgtcgggtatttacaaaatatcaacggattggatcaatcatcgatcatatgaagcacttggttcctttgtgctatggtcattggacaacattcttgcagaccttgccagtcatcagggagttaagaaggcaatccagcaatcatcattgaaatctctgagatggactagcttgtcaaacaatatgagaatgggttattattttatgtgtcctatgagacaatatgagaatgcattaggatttaaggatggcaaggatatgccatcaaggctgagagggaaaagtttggatgtgggttgtgcctccttggacaaatctattgcagtctaa

SEQ ID NO: 85122 - DNA, 375 bp, Glycine max
  Peptide Sequence Number=SeqID_201900
atgctagataccgtgggtccagaactacaagttgtcaacaaaactgagcacccaatttcccttcaggctgacacattggttgtcttaactcctgatcagaacaaagaagctacttcaaatcttttacctgtaaattttagtggactttcaaagtcacatgcaagttgtctagctgcacatttggatttatttttcatctgtttacttgtgtatcttggtgtttcatccatattatatcacgtgaggggaaacttggttacttggagaagcaagaagcagattgtggtagctagaagcattgctgaagcagaatttagggctttggccaatggtatatatgaaggattttgttgcaatggatgctcaaggaactag

SEQ ID NO: 85123 - DNA, 1797 bp, Glycine max
  Peptide Sequence Number=SeqID_201901
atgggcctctgtttctcctccaccaaggtcagcggctccagcagcaacaacaacaacaacaacaacgcctcatccaaccgtaaccgcaaatgttcggccgcgccggcggctgcagcgccgccggagccggtgacgccgcagaagaaacaaccgtcgcaggctcaacggcggcgagtgccagaggagtcgcggaagaacccacgcgccaaagacaaagcgggtgcgcgtcggcaagggacacgtgttccgtgcggaaagcgaacggatttcgggtacgagaaagacttcgagaatagattctcgctcgggaaattgttgggacatggacaattcggttacacctacgttggaattgacaaaaaaaatggggaccgtgtcgcggttaagagactagagaagagcaagaaaatagtaccagtcgttgacaattccgttttgcatttcactttagctctcaccattatgtcgtggcatcctcctgggaagatggttctccccattgcggttgaggatgttaagcgagaagtcaagatattgaaagaacttacaggccatgaaaatgtggttcagttctttaatgcttttgaggatgattcatatgtgtacatagttatggagttatgtgagggtggagaactgctagatcggatattggccaaaacttactctgccttcacatttatcaggaaggacagtcgttatactgaaaaagatgcagctgtggttgtaaggcagatgctaaaggttgcggctgagtgtcatttacatgggttggtacaccgggacatgaaaccagagaattttcttttcaagtcaaccaaagaagattcacctttaaaggctaccgattttggtttgtctgatttcataaaacctggaaagaggtttcaagatattgttggcagtgcttactatgttgcaccagaagtgttaaaacgtaagtcaggtcccgagtcggatgtatggagtattggtgtgattacatacatattgctttgtgggagacgcccattttgggataagacagaggatggtatcttcaaggaggtcttacggaacaagccggatttccggcggaaaccatggcctactataagcaatgctgcaaaagattttatgaagaaattgttggtaaaagatcctcgtgcgagatatactgctgctcaggctctttcacatccatgggttagagaaggaggagaggcattagagattcctattgatatatctgtcctgaacaacatgcgacagtttgtgaaatatagtcggttgaaacaatttgcactaagggcattggctagcacacttaatgaaggagagttgtctgatctaaaagatcagtttgatgcaatagatgtggacaaaaatggttctattagtcttgaggagatgagacaggctcttgctaaagatcaaccttggaagttgaaagaatcacgtgtgctagagatattgcaagcgatagacagcaacacagatgggctagtggatttcaccgagtttgtggcagctactttacatgtacatcaattggaggaacatgattctgacaagtggcagcaacggtcacaggctgcttttgagaaatttgacttggataaggatggctatattactccagatgaacttagaatgcatacgggtttgagaggctccattgatccattgcttgaggaagccgatattgataaagatgggaaaatcagcttaccagaatttcgtagacttctaagaactgcaagcatgggttctcgaacagtaatgagcccaagtcaccgtcatcatcgaaagatttag

SEQ ID NO: 85124 - DNA, 828 bp, Glycine max
  Peptide Sequence Number=SeqID_201902
atgtcgggttgttcgacaacacatgataataacaacgttttcccccaaagtgttgccacaaaaatacaccagcacgtgacaaatttaagtcatcagtatcatcgtgaagatgattttcatggtagccatgatgactccgatgaggataatggaggtcaaacacaacaaccactatggggttcgtcaccacatttttccaatgtgaattgggattatgctgaccaagagatggatgtcccaggcttggatatacctggttcatggaagattggttccatgattgagaatgacccatctgtgtccatatccataattcaagaacacatttcaagccaaaaacattttaagatattatatcgtaaagcatggaaagctaaacaaatagctttagtaagggtttatggagattgggaagaatcatacgatctgttgcataggtggttggagtggatgtttaaaaaatctccaaattctatttacgaaatcgaaaccaccgaattttggtatggaggggcattttacacacaattccaacaatttaaacatgttttctggacatttaaacatgttgttaacacgtttaacttgtgcaaaccaataaaccaaatagatggcacattcttgtataggaaatgtgaaggaaccttgttgattgcaacctcccaagatggaaatggttgtgtactgccaattaattttgccattgttgaaaaggagacacaaagtgactggttgtggtttttgtctaacatacaacaacatgtcacccaacaacaagacatatgtttgatccagatgaacatcaaggcatcgaatcaattgttgtga

SEQ ID NO: 85125 - DNA, 516 bp, Glycine max
  Peptide Sequence Number=SeqID_201903
atggggattatatgggtggaggtctgcttgatatctgcacatggactccagctttcaacctcactttggaagcgtcaatggtttgctgttgggtggattgatcataacaacaaatattgcaccaaagttgttaattctgggaatgcaaatcctgtatggagaaccaagtttgtcattcctgttgatgactcggtgtcaaacatccaagatttggccctgaacgtggaagtttacagtatagaccccgttttcttcacggaaaagcttctaggctcagcaacagtttttctaagagagtttcttgtcaagcgggtaaaaaattctgaggtgtcaaaaccaaggcaagaggaagttggaagataccaattacgaaagaaaaaatccagcaaaccaagaggtttcattgatattttaattcatatttttgacaaaaagaaagccaaattcccacccagaggtactctaaagtacagatataggggtcagatttttggttccatggcagacttaatgtag

SEQ ID NO: 85126 - DNA, 417 bp, Glycine max
  Peptide Sequence Number=SeqID_201904
atggtgacaataatgagagtcgcagcacaaacccagacacagttacagttgaagaaacacatgatagagggtttcggttccaaatacatggaattaaaatggaagctatcatcaaaaccacctttcccaatttacatttccaccaacccacgccatgtggacccgcaccatctccgagacctcttcgctgattgcaaccactctacccaccgattccctacccgactcgaacccatggatatccgcaagctctgcattgcattgtctcacagtgtcgttcttgtctctgtcttctgcaaccctcaacatgtaaacggcgttttccttcagaattcatcgtcgtcttcaatcgcggatatcttcatgccggtttctcccacgaatcttcaaggaaaagagtcaagctgcattgtataa

SEQ ID NO: 85127 - DNA, 876 bp, Glycine max
  Peptide Sequence Number=SeqID_201905
atggcgaagggtgaagacgctttgattcgaaagaagaataaaaagcttcgaaagaagaacagcagcggctcttcctctgtctccgccaaggttgccgccgttatcgccgccaagaagcgccgcaaggccggtaaacgccgcatgtgccaggggatgtgctttagtctacctactctggatgatcccttcaatgatcgaggtgggaaagaggaaaccaaaacaaagggtcctaaaaagaaatcccattcaaaaccaaaagacaagatggatcatcttaatgggaagagtgcagatggaaagaaaggcgcagttggtgggaggaaaattgcaagggaattgaatgatttacaaagggaaaatgagtctgtcacagccagcaataatcttactcataaatgtatcattaactcagaaaggaaaaatattgatatgactgagatggctcatctttgcggtaccaaacagcgtgattgtgacatttcagagttcccttctaagtttattttttggtgtttgagttccattgaaaatgcattgcgacatggtgatgcctacactgatggagagggtaactctttctttttgaatccatggggattagaatttttgaagtgttattctacagggaaagatctgatagaaaccagtggaacctctgctactgctgagcaaattgcatggatggtttctggtgcagctgatacttttgtcagaaaagagaaagaagggttgtcctttcccgggccttttcttttattccttgtaccctcccaagaaaaatctacccagaggaactggctagaaagagtaagggaagtgttgtggtgtgcagtcactaggacatcggctattaggggtagtgtgatagagacttag

SEQ ID NO: 85128 - DNA, 1098 bp, Glycine max
  Peptide Sequence Number=SeqID_201906
atggcaccggcaaaaacgctgaattctcttgttgaggaaaagagtattgagtctcgttttgttcgtgacgaagacgagcgtccaaaggtcgcttacaacgaattcagcaacgatattccagttatttcacttgctggattggaagaggaggatgggcgcagaggagagatatgcaagaagattgtggaggcctttgaggagtggggtattttccagattgttgatcatggcgtcgacaccaaactcgtgtcggagatgactcgtctcgccaaacaattcttcgctttgccacccgaagagaagcttcgctttgacatgaccggtggcaagaagggaggtttcttagtctccagccaccttcaaggagaagcggtgcaggattggagagagatagtgatatatttttcacagccaatgaaaagcagggactatacgaggtggccggagaagccagaagggtggagaaaggtgacggaggagtacagcgacaacctcatggctttggcatgcaagttgttggaggtgttgtctgaggctatgggattggataaagaagcagtgaggaaggcgagtgtggatatggaccagaagattgtggtcaatttctacccgaaatgccctcaaccggagctcacactcggagtgaagcgtcacactgacccgggcaccatcacccttctgcttcaagacctggttggtggtcttcaagctacaagagataatggcaacacttggattacggttcaacccattgagggagcttttgtcgtcaaccttggagatcatggtcattatctgagtaatggaaggttcaagaatgctgatcaccaagcagtggtgaactcaagctgcagccgtgtatccatagccacattccaaaacccagcacaagaggcaattgtgtatccgctcaaagttgaagagggaggcaagcctgtgcttgaagaaccaatctcattcgccgagatgtacagaaggaagatgaacaaggaccttgagattgctaggctcaaaaagttggccagggagaagaagcagttgcaggacttggataaggtcaaactagagtccaagcctcttgatgagattcttgcctaa

SEQ ID NO: 85129 - DNA, 639 bp, Glycine max
  Peptide Sequence Number=SeqID_201907
atgttgatgttattctcgaaggtctaccttccaattacaactcggttatcaaaaaagctcgcctctgaaacggcttcattaaacctcactggaacctcttcctcaggtttgcaacaacaatcttcctcttctagtcaagctcatgctgcttctgaacctgtgaattcgaactacaactcgtattctagttttcgcggctctggacgaggtcacggtggccgaaacagtcatggtggcagccgtggtcgtggagaccggtttcctaatttttcccatcccaattctgccactccatgggtaatcatgcccaggcagttgcaatttcctcggcagaatcagcgatatcagcctcaacaacaagctcaaaatcctcctagtgctatgattactaatgctggaatacttggtgcatgtcctacaactagtagcacttggttcccagactcgggagcatcctatcacgtcactgcagatcagaataacatccgccaactcagctctttgaaggtccagaccaaattttcattggtaatggacaagaaattctgcttcgaggcacagtgggttcttatggcttgtaccagtttccaagcctcttgcatcctcagtctaagcagtatcttccagcaaattgtttag

SEQ ID NO: 85130 - DNA, 1032 bp, Glycine max
  Peptide Sequence Number=SeqID_201908
atggagaccccatcatccaccagaagagtaacaagatcacaggctttgtctgcttccaatgatgccctcatcacagtttccagaaagattgaagattctgaaaagaacgcatcaaagtcaaaatcaagggtgcaacaacaagaccaatccgcactaatagacataacaaatgattccccaatcgtgggacttgcgaatggggtaattcttggtaccccattggcgaagcagagaggaagcagaataaagaacacgccagggtctggggaagccttgctgaggggtcaagtgaagacccttttgcttaaagtggaagaggagattgaactttccaagttctcgcttgaaagcacggaacttgttgcaccaatgcccgtgaatacgcctcaaattcagaatctttctggtttggcttcggttaccaccccttctgttgttctccaacaaccactaattcctcaggtggtgaatcatgtatttgatggttctgaatctgaaaagagtgtgataagcagatcccttttatttgacttctcagagaaatctcaactttcgaatgcatcagaagaatgtttctctgagctgagttatgaggaagtagtacaagctgaaagggaaattaggagctgcttcatagaagatgatgatgcttctatgagttctatctggtcaatgcaggtcaatgcaagcacccatgatgaagatgatgaggaaatagctgaagatgaagaaggttgttattctgaaaatgttgaagaagaaaaagaagaaaatgatggagggttgctgcttgatgaattgtgtgaagggttgaacaacattagcatgaatgaaaggatagctccaaaatttgaaggaaagcacacaagatttgcttacaacagtgatgatgagattgtgaaagaagaggtggaagaaaactttggtgagagtgattcttcatctaacatattgcgtttgaaaggattgccaactccaaaagggaaacacttgcgcttttatgaggaagaggagggaaaatctgttttgtga

SEQ ID NO: 85131 - DNA, 801 bp, Glycine max
  Peptide Sequence Number=SeqID_201909
ggtcatagagatacaacgattcttaaagcttatgaagaatcatatacaagctttaaggaaatgtacttttgggtgagacattttaaggattgttgggatgacctatttgttgttgataagaatgaagcattcattgggaaatcaaaggataagcctttattggttgccactccttatgctgccactgaaaatgataagaagactttgaataagtcagaattgtccgacaaaggaaatagttttaccatggagacccactttaagtctaatcatgacatgcctccccttcctctaaaaaggcaaagggtcatcaattttgatgatgatgtggaattgattggctctatcttggtctatgttaagaaatttgttgctccttttatgtggatgtcttcaggagtatctaactcatgttactctagggttcaaaagcttttggaattgaagcaatccttgggtaatgtcaacccactaaacctgattaaggagaaagattttgccttaaagaaaactcagggtcaagttgaggaggaagttaatcaattgaaggaaaagcttgttgatgtagaaacagctagggatcaatgggctcctggaactgtgaatgaaaattttgtgggacaggaaactactaatgtggatacccctgatgacacgatgactaatggatttattaataccctgaaggctaacattgatgatagagatacaaaagcttctaaactaatgcaaatctcgaagaatcttgaaggttggtatgttggtcttgcatgtattggaacgagtttggctgcttgttga

SEQ ID NO: 85132 - DNA, 152 bp, Glycine max
  Peptide Sequence Number=SeqID_201910
atggaggctgcggatatgtcttgtcttcaagaaacaaagaaagaaatgattgacaatgctatgtgtcaggcgttatggggggatgtagaggtttcatgggagattcagcctgctactaacacagcagggaatggatcagagaagcacagcag

SEQ ID NO: 85133 - DNA, 216 bp, Glycine max
  Peptide Sequence Number=SeqID_201911
atgttttcctggtattatgttccaagacattactactctattgctttctgttgttgtaggtattatattccaagacattactacgttctgcttcactggtcggaaatcgtgccacttgaggaagtttttcagactctgaggtgtgattcaaatggactcacaatagcatctgcagaaagcatttcagagtcagagatgtggaaccctgtgtcttga

SEQ ID NO: 85134 - DNA, 1362 bp, Glycine max
  Peptide Sequence Number=SeqID_201912
atgagtcctgttcagaatttcgagcagcattctcgtcacctcgtggaggcagacctcccgattccagcgaggctgcagatggtgatggaggttagggatagtcttgagattgctcacaccgctgagtacttaaattttctgaagtgctacttcagggcattttcagcgattctgctgcaaattacgaagccacagtttgtggacaatcaggagcacaagcttcggaatattgtggttgagatattgaacagacttccgcacagtgaagttctccgcccctttgtacaggacctcttgaaggttgccatgcaagtgcttaccaccgataatgaagagaacggtttaatttgtatccgtataatctttgaccttttgaggaactttaggccaactctagaaaatgaagtccagccgtttctggacttcgtctgcaagatttaccaaaattttaaactgactgttagccatttctttgacaacatggcaatgactggggaagatgtcaaacccatggagacttcactttctgatcaaggtataaacaccaccattgcaactggttcacagcttaatccaagtactcgctcattcaagattgttacggagagtccactggttgtgatgtttttgtttcaattatatagtcgtcttgtgcaagcaaacattcctcaattattgccattgatggttgctgctatatcagttcctggcccagaaagggttcctcctcatttgaaaactcacttcattgagctcaagggtgcacaagttaagacagtttcctttttaacttatctgttgaagagctatgctgattatataaggccgcatgaagaaagtatatgtaaaagcattgtgaatttgcttgtaacatgctctgattctgtatccattagaaaggaactattaatatccctgaaacatgtccttggaacagatttcaggagaggtttatttcctcttattgatactctacttgaagtaagaaggtcaatagtgatgcaaaagtcaaaattcgggctgtttaagatccgagttcctgtagcttctcagataattcaaacttttagggttctagttgggactggacgggcatgctttgagacattgaggcccttggcttatagtcttttggcagagattgtacatcatgttcggcaagatctctccttatcacaggtggaaccaatttttgagaaaggggttgatcaacaatctacagatgaagcaaggattctattgggccgcattctggacgcttttgttgggaaattcagtactttcaaacgaacaattcctcaggatacaaaagggagggagacagctgtttacacttacacaatacagctgtctcctcaataa

SEQ ID NO: 85135 - DNA, 228 bp, Glycine max
  Peptide Sequence Number=SeqID_201913
atgtcagcgctaagcgatccatcatccgctaagtgcatgctcctctgtactcaaagaaattcacccattttgcatctgtgcttccctttcgtattttctacttccaagcaggaaccattcaccatccaaatgtcattgaggaagaaggctagaaccgacgacatcccttcatcagccatcccagctcctcagtcggccaccatagagccagatgtccaacacccgtaa

SEQ ID NO: 85136 - DNA, 189 bp, Glycine max
  Peptide Sequence Number=SeqID_201914
atggaagtgggtcaagaggttctggaagtaagaaccaaaacaggatatcacccattgagctgcgagtctcaagagcttagcgatcaacccttgcatctaaggcttagttggtctgctaagatggccaaggctgagcaaagccaacttcaattcgatctgaatttggctaagctgcagcctaatcgctaa

SEQ ID NO: 85137 - DNA, 498 bp, Glycine max
  Peptide Sequence Number=SeqID_201915
atgggttcaaacgccttcttctcttccattctctattttttcctcctagctacattggtctcctctgccccattcctttctgatgacatatttggagctgaagcatccactggccgtgccctcctacaggctaagaaagttgactttgagaaccagaactacacagtcctcacaagccaatgcaagggaccccagtacccgccaaaggtgtgctgtgaggctttcaagcaatttgcttgcccttttgcaaatgagatcaatgacatgacaactgattgctcctcagttatgtttagctacatcaacatctatggcaaatacccccctggcctgtttgccaatgagtgcaaagaagggaaccaaggccttgattgcagccaagtcaaaccagccaacacttctacctcttccaacaccattcatgtggctgctcctcctcactttttctcactcatgaccattgctgctttcctgggattcttgttccacttgttctga

SEQ ID NO: 85138 - DNA, 207 bp, Glycine max
  Peptide Sequence Number=SeqID_201916
atgagttctcttaggctaggcaaggaatccattacacttgaacaagtcaagtccaatctctattttagagagcttcgactaaaggagtttgggaatggtgatgaagtctttgtgtttggattatcgatgactgattctgctaaaagggagaagaaaaataaagtgaacaaaaacaacaacatcatgaacaatgggtactggacttag

SEQ ID NO: 85139 - DNA, 216 bp, Glycine max
  Peptide Sequence Number=SeqID_201917
atggaagaaatcaatagtggaatcgacacaaatgaagatgaagaggaacaaatgaaagtttacgaagaggaagaccgaaccgtggagaaacacttagatggagtatatgagaacaagtgggactccctctggagtagcatgttgagaaagaggaaagaatatgcgaaattcaaaatgggaggtgcaacatttgaatacctaatttactgcatgtaa

SEQ ID NO: 85140 - DNA, 216 bp, Glycine max
  Peptide Sequence Number=SeqID_201918
attacagaagattgggcaacctatttagaagacaaaggtacaggactagatgaccattatcgtccaccttatctctattttccatcgtccaacaatcagcaatggacaaaaacgtcttcctcctgtcgaagggttccttctcctcttcatcttcctatgcctaggataagatttgtctggaagaggggttcctgtaaaaggaactccgacgcttaa

SEQ ID NO: 85141 - DNA, 219 bp, Glycine max
  Peptide Sequence Number=SeqID_201919
atgaaagacattgtgtcagaaaatgttctcatagaccaactatcacacccaaagaagtgtaacaactacaatagtcaaatacttctttcacttgtagaaaacccctctctcggtattaaaatactgagatggcttaagaggtctatatactggataggtattcaaccatgggagaacaacacacctgagggcagcataaggcgtcctatggatatttag

SEQ ID NO: 85142 - DNA, 243 bp, Glycine max
  Peptide Sequence Number=SeqID_201920
atgggtactccctccgtcaatgagtaccgtcactctgaagtggtgaataaacccaaagagtcagaatgcgtcgagagtcgaggcactggaaaaggaattaaagctaatttgggcgagggtggggtctggggagggtggtatgggaggtggggaaatgggggtctgagaagggtggtcaggaatgattgggagtaccagtgggtaccggtgagggtaagaatggtggatgggctatgtggatga

SEQ ID NO: 85143 - DNA, 348 bp, Glycine max
  Peptide Sequence Number=SeqID_201921
atgacgagaaacttcgtgacgtggctatatggtgagtgtgccgccagcacaactggcgagatgcatggtgacacacggcacagtgatgaagtgaagtggtgcatcaacctcaatctcagtaaatttgccgcaccgaaacttattcatgggtccattgggtggatgcagtatagcaatatgaaggaaggagacaatgtatctcgccagtgggagcagcgagacagcttccacgtcagctatctcgccaacgacaatggcggcaccatcttctctccgccaagcacgcttctcgctattgcgaatagcggcacacctatctcgccaatcctgctggcggcatcagcgtaa

SEQ ID NO: 85144 - DNA, 603 bp, Glycine max
  Peptide Sequence Number=SeqID_201922
atggtgatagtcgaagaattgggagatcttgaagatccatcccatggcgttgttgccgtcgaaatgagagacgtcaagtttgatgtggtggtgggaagaaaggggaaaaagggtggtgggggagctacaactactcttgtatggagtcgaggcgcaaggagaggtcatggtgggtctgggttagacggagaaccgcctcttccaagcgattggtggtcttggagcagggagaagaacgataaacaaaaagctgaaaatgaatattcctcccttcatttagattggcgagataggtgtgccgctattcgcaatagcgagaagcgtgcttggcggagagaagatggtgccgccattgtcgttggcgagatagctgacgtggaagctgtctcgctgctcccactggcgagatacattgtctccttccttcatattgctatactgcatccacccaatggacccatgaataagtttcggtgcggcaaatttactgtaaatgaagcaaatggaacaaaacaccaaatgaaaatagacagagcagctcaagctatttccacaaacacacaaagcaaaaaccttgatgggggttatggttttaacaattag

SEQ ID NO: 85145 - DNA, 396 bp, Glycine max
  Peptide Sequence Number=SeqID_201923
atgccccaagtttccttttgcacttgcatctatcacctgaaaataaagaaatgtgaatggcaaaaagcaaagcttcatggtgaatcaagagtgattcaaagatgttttgatgataacaaagatgataacaaaaagctcaaaggtcaatcaaagaatgagttcaagatattcaagatagaatcaagaacacttcaagattcaagaggaaatttgatttcaagaatcaagattcaagagatcaagatttcaagaatcaagattcaagactcaagactcaagattcaagaatcaagagaaggcttaatcaagataagtatgaaaaggttttctcaaaaattgagtagcacatggtttttttcaaaacatgtttaccaaagagtttttactctttggtaa

SEQ ID NO: 85146 - DNA, 231 bp, Glycine max
  Peptide Sequence Number=SeqID_201924
atggaaaaaaaggaaagtgacgaagtgctgtgtcgcgcagagaggagaagagaactgaaaagagaaagcaatggttggtcacatcggggaagggagacgaacaaatggagggagtatttaacagcgttgcgaaacgcgttatatacacgcgcccttggagaggagctgttggtgatgtgtggccaatgggaatgcgcgtgggaacaactttctgataatggaatggtttga

SEQ ID NO: 85147 - DNA, 768 bp, Glycine max
  Peptide Sequence Number=SeqID_201925
atgacattgcttttggggctcacgaagatctgctccctcttcctcctcttcctcgccaccctcacctccccggagggaacccccatcctccccttctaccgctccatcaccgccgcctcctactccgtcttcgtcgaatccaagctccgccccctccccgtcgtctcctccctcccccctccgccgagcctcgcctacctcgtctccggctcaaagggtgacggcgccgccgtcacccgcgtcctcttggccctctaccaccccaacaaccgctacgtggtccacctggacctcgaatcctcgccggaggaacgctccgatctggtgaggttcgtggagggccacgcgctgttcaagcggttcgggaatgtgagggttataaagaaggcgaatctcgtcacgtacaggggacccaccatggtcgcaaacacgcttcacgccgccacgattctgttgagggagcttggggattgggactggttcatcaatctcagcgcctccgattacccacttgtcacacaagatgatctgctgcatacgttttcgtacctaccgcgggatctgaatttcattgatcatacaagtgacattggatggaaagatcatcagcgtgcgaggccgatcatcgttgatccgggtttgtatatgaataagaagcaagatgtgttttggatttgcagaggaggagtaggccaacggctttcaagcttttcacagcatctgattttgcattgggtgactttgcataggacacctagaaaggtgtga

SEQ ID NO: 85148 - DNA, 801 bp, Glycine max
  Peptide Sequence Number=SeqID_201926
atggagaaggaagctcttgaagaagccatggtccaatctgtcattaaagcttctctcaatgagtctaaggacaacattattgagatagaccctggtgttgaacctatcagatcaaggccaatgtatcatgctaatggaagtcaaattgacattgtcttatctatagtagtgggagaagacaatgccagacgttttgaagccatatatggaccaccaacatttgatactatattagatgtacaagttggcttggaacgaaggaaaaggacatatagttttagaatggaaaacctgcaacaaagtctggagaaacaagatgaaccggtcttcaagacattccctccatggcagaccgttgctctcaatcccaatagtatgatcttcgagcatctacccacaaataaaaagattgctgttgataagactattttgtatcaaaatattaaatactacaaagacaaagaagtatggtttaaagataacgaagatgcaaactctatgcattttgttaaagctcgccctcaatgtttgtttaaacatgagcttgaagcgctcaaacacaagttcgagctcatgactctagatggatatgccataaaaaggttctataatcatgaagttggggagaaaccacctcttgatgattataataatgaagcaattgctccggacttgaaggatcgctcccatattgagaaggaggctcgcaaatggtctctaatcagtgacttcttttacaagaaagctattgagtggaaacctcctcactccctaacgccccaatattggggttttatttga

SEQ ID NO: 85149 - DNA, 150 bp, Glycine max
  Peptide Sequence Number=SeqID_201927
atggcttcaatagatgcaatgatgccgtcttcttcctgtatggcatctttcctttcaagatgtttatctatctttgcctttcgtctaaacttagccagagttaaggtggaaggactaaagagggtgaaggttgaggagttgatgttttaa

SEQ ID NO: 85150 - DNA, 1590 bp, Glycine max
  Peptide Sequence Number=SeqID_201928
atggtgattgagaaatttgacaaaggaggatcagaagtttggtatttggacacgggttgctctaaccacatgattggaaacaagcattggctagtgaatcttgatacttcacaaggcagcaaagtgaggtttgttgatagttcttcaatcagctgtgaaggtgaaggaaatgtggtgatcaagagaaaggatgagagcaatgctgtaattgagaatgtgatgtattgtccaacaatggacagcaatctgctgagtctgggacagttgcttgagaagggatataagatgaggatggaggacttgatgttgaaagtatatgataaaaaacaaaggtttatcttgaaagccaagatgtccagtaatagaacattcaaggtaaatttcaatgtagcagatgttcattgcatgactgctgaaggaaatgatgtcaattggctttggcacttcagttatggacatctaaacttccaaggtttaagtagattggttgctaaacacatggtcagtggtatgcctcaaatcaaagcaccagcagaagtatgtgaaggttgtgttgcaggaaaaccacctaggaattccttcaatgtgtctttacctcctagagctaaagaaccactgggagtagtttgttctgatgtgtgtggtccaattgaaccttgtacatatggtgaaaatttatattttgtaatctttgtagatgagttcacaagaatgttgtgggtttatccaatcaaaaggaagagtgaggtgtttgttgtttttcagaaatttaaggcatatgtagaaaagcaaagtggagcaaccttgaagaccttgaggacagatgggggaggagaatacacctctaaggaattcgaagacttttgtgaaagcaaaggtatagtacatgaagttacaacaccacatactcctcaacacaatggtttggctgagagaaggaatagaactttgctaaacatggtgaggagcatgctaaaattgaaggggctaccaaaggaactttggggagaagtagtcaccaaagctgcctacatacttaatagatcacctataaagaagctagaagagatcacactagaagaagcatggacaggaaagaagccaagggtaagtcacttcaaaatttttggctcacctttttggaaacatgtcccagatgagaaaagaaagaaactagatgacaagagcattgagatgatcatggttggttatcatcccactggagcatataaactgtatgatccaattgagaagaaagtcacttatagtagggatttgatttttgatgaaaaaagcttgtataactggaataaaactgagaaggttaagtcaaaaggcatgtcagtgcttgataaacttggtgaaactagtggagaagaagaaattggcaatagcataggtggggcaccacctacaatgaatggcagcggaatggagaaggaagagagagagaggagacgccacttcaaggagaatatgagtctagaagaagctcaccaccataggagaccatggataagagcttggaggaagaagaagatgaatgaagggagagggagagaagagcacgaaattttgtgctccaaatga

SEQ ID NO: 85151 - DNA, 546 bp, Glycine max
  Peptide Sequence Number=SeqID_201929
atggtggttgtttcttggattggtctaagggttttgggtctgatgatagagatcaaaagactgcttatgaacctcttatgtcacagactgtggttcctccttcttgacttttcctctaatatgttttttagcatattcggggaagttatcagttattcccagtctgaaaaaggtcaatcctttaagttgagtggctcctacaaatggttacataacaaagacatctaccccacaattcctcatgatctaagtgaacaacattccataaggaatagggttcttcttgtccttggcatgaaatttttccttgaaagcttgaagtcagtagaagaagatgacttcaggcagatttaccttttcaattaccatcactttatacatgcaaaatctatctttatcacttacatagtttatcgatcccagtatggcatgcctatgctgaataaaaagctatggatgagttttcacgtatatgtgaggttagttgtccttgggaaactaaccagacccttcttgtcagacgaatgtgggtgctactttccatag

SEQ ID NO: 85152 - DNA, 177 bp, Glycine max
  Peptide Sequence Number=SeqID_201930
atgacagaggtgttgacgccagatgtgaccatggtcggagacgcgaccatgtccttcattgttgacgccagcgaagtgaaggtgaggccagacgaaggtgttgtggccggaggtgttgacgccgacaaaggtcatgcgagacgaatgggtcatggcggagaggaagaagatagatag

SEQ ID NO: 85153 - DNA, 1820 bp, Glycine max
  Peptide Sequence Number=SeqID_201931
aaccagtaggatatgtggaagcactgaaggaagaagtatggaagaaggctatgctggaagaactggcagcaattgaaagaaataacacttggaaactggtcaggctaccaaaagtaaagaagcctatcagtttaagggaaggtcttgattatactgaagtgtttgctctagttgctagaattgaaacagtcaggattgtagtggtcttggctcattcaagaggttggaatatgtggcaattggatgcaaaatcagccttcctcaatggattacttgaggaagaagtctatgtaacacaaccacctggatttgagaacaaggaaggtggagacttggtgttcaaactgaataaggctttgtatggtcttaaacaagcaccaagagcttggaacaaaagaattgatgggttcctactaaaaattggttttgagaaatgtaaggtggagtatggagtgtatgtcgaggaagagaatggagacataatcatactatgcctatatgtggatgatcttttaatcataggcagtaatgaagtcgtgattcaaactgtcaagaagcagctgcaacaggaatttgatatgatagacctgggagtcatgtcttatttcttaggaattgagttcattcacaagaatgaaggactggtgatgcatcaaaagaagtatgcattggaagttcttaaaagatataagatggaagaatgcaatctagctaagattctagttgagtttggattaaagctaggtgctggtcttgatgaaaagccagtggatgccacattgttcaagcaaatggtgggaagcttgagatatttgtgccatagtaggccagatattgcttatggtgtgggtctggtaagcagaaatatgaatgatccgaggacttctcatatggctgcagcaaagagaattttgagatatgtgaagggcacacttgattatggcttgttattctccaaagcaaatcataatcaaggaataaggtgtagaagcaatcttcatgatgatgaaccaagcaattttgatgatgccaaaacccaagtgattgattcaagattgattgaagacttcaagatcaagcaacaagaatccaatccaagattcaagattcaagagaagaaatcaagaagcaacaataaagcgtacatctacttgggttgtaatactgagaacaagagagggtacatctcttgtggaccagttcaagtggagcatacatccgcttggttgttcaaagagaacaagggaggatacatcccttatggatctttgcttgtaaaagattttacaaggttattggaaatctcaagaaccggtggttgcttggggactagacactggagtggtgatgtagaggacagcaaaagcaccactagatatgtcttcaaattacttggatcaacaatctgctggagttctaagaagcaagaagatgttggactttcaacttgtgagtcaaagtacatggttgctgcctcaacaacttgtcaatcatcctggttggagtcactctttgcagaattaaagattaagcttgattcagttgttcaacttaacatggacaacaagtctgctatatgtcttgccaacaacccaatttcacatggaagaataaagcatattgggacaaagtaccactatcttagggatcaagtgaggaaaggaagaataagtttggcttattgcaagtcagaagaacaggaggctgacattttaaccaaagcgcttcgtggagagaagttttacaagtttagagaaaaaacttggcgtagtgaattgcttaaactagaattagggaggaatgttgatgtatctatataa

SEQ ID NO: 85154 - DNA, 327 bp, Glycine max
  Peptide Sequence Number=SeqID_201932
atgatgatgaacaagtgcaatgttgaggatgctgttgatggtgtgtctgatgttgttgatgagctagtaattgttaacacaaacaaacaagtgtctgattataaggatacagagttgctaatgctaacatatttttacttcctacacccgttatttgcttcctacattcgaaccccaacccaattgcaacattcaaacctcaaatgcataaagaacagcgagaatagaggtgcttacggtgcaactctacgtgagcgtgcctgttcgaagagggtttatgtgcgcaagagcaaggtgaaggaagacaatatagggtgtagaaagtaa

SEQ ID NO: 85155 - DNA, 201 bp, Glycine max
  Peptide Sequence Number=SeqID_201933
atggcttcgagtgctgatctatggccatcatttcgagcgtcaattctttggtattggaggcgagattggccttgggggatgaacgacaatggagcacaaatcagggttggagtgtgggtcggagaggaagatgagactatgaaggaaggtctgaaagagagggggaaaatgagagaaagagaagaggtcgtaaggccataa

SEQ ID NO: 85156 - DNA, 306 bp, Glycine max
  Peptide Sequence Number=SeqID_201934
atgactcaagacatccctggtgttcatattgcagaagtatctctttcatcattatatggtccttattatggagttaatggaacaaataacatatttaatccaagagttagtaggaaggatcaagtcagttcttctcacttatgggttcagaatggaccagtggaagctactaacaaaatcgctgcgggatggcatgtggctccacaattatatggtgatgataaaacttatatttactcggcatggacgataatttcaagcggacagggtgctataatattcgatgttcaggctttgttcagataa

SEQ ID NO: 85157 - DNA, 357 bp, Glycine max
  Peptide Sequence Number=SeqID_201935
atgaacaattgtaacaagtccacaatgataaaccatgtgttaataaggctgctttggtccactccgtccagctattttgcttgttgcttctcttttcaaagagtagcggacgagaggacagctaaagccacaaaacttgagcagaaggtggcacttcttgaggttcaatgcgcatgtttaaatcaagaactacaagatatagaagcccgtgtgcacggggaacaaaaaaaggcactagaagaggcaaatcaagcatggcaggaagaattggagtgtgcacgtcaaggtcagagggaagctgaaaacaagctatcatccttggaggcaagattgatttatagtttttttttcttgtga

SEQ ID NO: 85158 - DNA, 627 bp, Glycine max
  Peptide Sequence Number=SeqID_201936
atggacaagaaaggtggtggaatggtgatcatggaacgcgcagagattgacactcgtgccccattcaagtctgttaaagaagcagttatgttgttcggagaaaaagtactagttggggaaatttatgccaacaagctcaaagagatgcgagttgaagcaagtggaagtgggagtccacaagccagaggtggagcattggcaactgagctggaagaaacaaagcaaaatcttgagggagctagagatgaagctagcatgttggttaagcgaatcaagtcccttaagaaggaacttgaacaaacaaagaaagaactagaagacacaaaagcaagagagctcaggttgctgcagcgacgggacgatccggagattgaagacctcaagttcattgcaaatgcaacaaccaatgtggaaatcaaaacacaaagcagtgatgaggagaaagcagaagagttccaaaaaacaagatacgtgaaattcgctagtcctcatgcactagctcaagttattcctaacaagggtgaattgcttgggagatctccttcagttaagaagccaaagaggaagccattgatgtctttgataggatggcttttctctaaaaagaaagggagccacgcaagttga

SEQ ID NO: 85159 - DNA, 366 bp, Glycine max
  Peptide Sequence Number=SeqID_201937
gctccagggcaaggattgttgtatgaagacaaaggaaacactcaagtctcaggatattgtgatgcagattgggctggctggaatattatttcttggaagagcaagaaacaagttgttgttgctcgatccagtgcggaggctgaatatagatctatggctatggctacattctttcataagaggactaaacacataaagattgattgttatttcattggtgagaaactattgtccaaggagattaacaccgagtttattaactccaatgaccagtcggcagatattctaactaagtccttaagaggagctagaattcagtctatatgttccaagcttggtgcatatgatttgtatgcttcagcttga

SEQ ID NO: 85160 - DNA, 199 bp, Glycine max
  Peptide Sequence Number=SeqID_201938
atggagagggatcttaagctgaaagaaccaagatccagctacttgaaatctcctcaagatcttcatgctagagacgctcgcgcgaccatggggcctagatccgcgtctctaatggttggactcgaagccagagattttgcatgtttggtagcttttacatgttgtctaagaggaggggaagaagagaggggcagaggag

SEQ ID NO: 85161 - DNA, 891 bp, Glycine max
  Peptide Sequence Number=SeqID_201939
atgatggaacctcaacaacaacaacaacaagcacaagggagccaacaacaacaacaaaacgaggatggtggcagtggaaaaggggggtttctgagcaggcaaagtagtacacggtggactccaacaaacgaccagataagaatattgaaggaactttactacaacaatggaattagatccccgagtgcagagcagattcagaggatctctgctaggctgaggcagtacggtaagattgaaggcaagaatgtcttttattggttccagaaccacaaagctcgagaaaggcagaagaaaaggttcacttctgatcataatcataataatgtccccatgcaaagacccccaactaatccttctgctgcttggaaacctgatctagctgatcccattcacaccaccaagtattgtaacatctcttctactgcagggatctcttcggcatcatcttctgttgagatggttactgtgggacagatggggaattatgggtatggttctgtgcccatggagaaaagttttagggactgctcgatatcagctgggggtagcagtggccatgttggattaataaaccacaacttggggtgggttggtgtggacccatataattcctcaacctatgccaacttctttgacaaaataaggccaagtgatcaagaaacccttgaagaagaagcagagaacattggtgctactaagattgaaaccctccctttattccctatgcacggtgaggacatccatggctattgcaacctcaagtctaattcgtataactatgatggaaacggctggtatcatactgaagaagggttcaagaatgcttctcgtgcttccttggagctcagtctcaactcctacactcgcaggtctccagattatgcttaa

SEQ ID NO: 85162 - DNA, 117 bp, Glycine max
  Peptide Sequence Number=SeqID_201940
atggaaatttatagacttgtttggctgcgactgcttgcaatccctgtgattgagggcgatcaaggcaacgaaagaattgggttgttgatggctctggcagaaaggaaagtgctctag

SEQ ID NO: 85163 - DNA, 602 bp, Glycine max
  Peptide Sequence Number=SeqID_201941
atggcagagaaggcacttattggggttacaaataatttgggaagtcgaaacttaactgtttcctgcaagattgataatcatccacaccttctcggccccactgattactatgagtggaagttttctcctgaatataatgacgaatttggaacggaaccattattcagtaattgttcctttcaatgggaaggtgcccatcactcatttgatctctacgtacttgttagggatggtgattgcaacaattgctcatggcatattaaactagacgctgcatgtaggtatacggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 85164 - DNA, 6945 bp, Glycine max
  Peptide Sequence Number=SeqID_201942
atggttttacttttcaggcgacaaccaccattaaccccatacaagttgaagtgtgataaagaacctctgaactctaggcttgggcctccagactatcacccccaaacaccaaattgtcctgaagagattctgaccagagaatatttgcaatctggatatagggacacagttgaagggcttgaggaatctagagaaatttctctgacccaggttcaaaattttagcaagaaagttgtccttaattgcaaagaggctattagaaaacggctacgggccatcaatgaatctcgcgtgcagaagcggaaggctggtcaagtatatggagtggctctttcagggtcacaacttgctaagcctggtgttttccctgaacaaaggccctgtcctgaagacttccgaaagaaatggattgagtttaatctggttggacgaagtgtgcaaatatggatggatacaggacatgttcatatgctaaatacaccagtacaggctatagctattcttaatttcaggagagccattggcttatctcaaccgcacaagcgattacgatctttgacggatcttgttcctcatgttagaaggaaatcactttcagaggttcttattaggaataatgtgccattgttgagggctacctggtttataaaggtttcttaccttaatgtggttcggccaggctctgctagtattccttctgggactgctgacaaaactcagctgtcttgttctgagctttggacaaaagatgttattgaatacttgcaaactcttcttgatgaattcttctcaaaaaattcttctcattttactcctcataatcgagaccgatcaccccaagtaccttatactgcgtcatttcagcacagaagtgaccagttattatctgttgctgatggtgaagaaccatctttacattttagatggtggtatattgttcggcttttgcaatggcatcacgctgaagggcttcttcttccttctcttatcattgactgggttttgcgtcaattgcaggaaaaacaattgcttgagatttggcagctgctattgcctattgtatatggatttttagaaattgttgttctatctcaaacatatgttcgcactcttgccggtgtagctcttcgtattattcgtgatcctgcacctggtggatcagatctagtagacaattcccggagggcatatacgacttctgctctgattgagatgctccgatatttaatatttgcggctccagagacttttgttgctttggattgctttcctttgccatcctctgtagtttcacatacaataaatgatgggaattttgtactgaaagcaactgaagcagctggaaagataaaaagtagttcagaagatgttgtgtgtttatttagaagtaaaggatttgatgcacaattccagtcattggcatttgatcatgttatttcgtgcattcaagaatgtgtagaagatctcacaaaggctgtaagcccaggctatccaggtcaatgtctggctaaagctgcacaagccttggataaatcccttgtacttggtgatatacatggagcatacaaatttctttttgaagatcattgtgatgaaactgtatctgaaggttgggttgcaaaagtcagccattgtttaagggattttcggaatgctcctccttgtgatgtaaagttcactggcaggaaagatctttcccatgtccatatagcaattagacttttaaagatgaaactgagggatatgcagatttcaccaaagcataagagtggaagcactcgtggttgtggagtcagttatttagcaaaatgttcaagtcagcagagaaatcagaattttgtgaacaatgcattcaaaataaaatctagttcaagaaatttggatcagaatatctgttcttcagctgtatttgaaagcccaggtcctctacatgatattattgtttgttggattgatcagcatatggtgcataaaggggaaggtctcaaacgcctacatctatttatagtggaactcatacgggcaggcatcttttacccactggcatatgtacgtcagctgatagtgagtgggatcatggatatgaatgtaaatgtagttgacttggagagacagaagagacattgccgaatcttgaagcagcttcctgggaagtttgtgcgtcgggctttggtagaatcagggattagtgaagggccacggctcactgaagcattgcaagtttacttgaatgagcgccgcttcatacttcgtggttccttatgggagaaccatggcaatgccaataatgtgaatatatcttctctcaagcaaaaccactgtacatcttcaacaaaagacaaaacttctacagtgtcaattgatccatggaaaagtgttttttctaataaaacatcctctaaaaatgcaaaggatgacaatggtgttgaagaactgaagacattcatctcaaccctgctacagctcccaaaaagtttatctaatttgagcactacaggattggacgaatctcaaggcagtgtcagaaaacctattgggtctcacaacaagagtgatctagtggaggctacccctgggtgtgaagaatgtagaaaagcaaagaggcaaaaattgagtgaggaaagaagctcatttgttcaagctccgtctccaatactatctgatgatgaagatacttggtgggtgaagaaggggctaaaatcttcagagcatctcaaagttgatcaaccacttaagccaactaaacaggttactaagactcggcagaagactgtccgtaaaacccagagtcttgctcaactggcagcttctagaattgagggtagccaaggggcatcaacaagtcatgtgtgtggcaataaggttagctgtcctcaccatagaactgctatggatggagatacaacaaggtctgttgatggaattcgatcaggtcactgtgaagatattgtttcaattggaagggcacttaaacagctacgctttgttgagagaaaggaagtaacactttggctgatgactgtagttaggcagcttattgaagagagtgaaaagaatgttggtaaagttagccagtttggtaggccttttgccactgtggatgataaaagttcaatacggtggaaacttggtgaggatgaactttctgctttactttatttgatggatgtctcagacgatttagtatcagctgtcaaattcctcttatggttgctgccaaaggtttatagtagccctaattctacaattcatagtggaaggaatgctttaatgctgccaaggaatgtggagaaccaagcttgtgatgttggcgaggcttttctgttatcatcactgagaagcctctttgcatatgcaagggtaaggctgcgtacaatattccctcccccataccttcgcatagcgaagagcctctgggcaatgggatatgagaacattcttgctgcagcagatcttcttcctgaagctctgtcatctataatgcatcgtgctgcggctattatagcatctaatgggagggtttcaggttcaggtgccctaacttttgcttgttatttattaaaaaaatatggcaatgtggtcagtgtcattgagtgggagaaaagttttaagagtacatgtgataagagacttgcttctgaaatagagtctggacggtcagttgatggagagttagggcttccacttggtgtgcctgctggagttgaggaccctgatgactttttccgtcaaaagataagtggtggccggttaccgtccagagtgggttcaggcatgagagatgttgtacagcgtaatgtggaagaagcatttcgtgatctttttggaaaagacagaaagctctttgctgctggtacaccaaaaggtcctgcttttgaaaaatgggataatggttatcaaattgctcaacaaatagttatgagtttgatagattgcataaggcagactggtggtgctgctcaagaaggggacccctctttggttacttctgctgtttctgccatagttggcagtgttggtccaacattagcaaaattgcctgatttttcagctggcagtaatcattcaaatatgtcattggctacaagttcattgaactatgctaaatgcattctgcgaatgcatataacttgtttgtgcttgcttaaggaagccttgggagaacgccaaagccgtgtatttgagatagctcttgcaatggaagcttctaccgctcttgctggagtttttgctccaagtaaagcatctcgagctcagtttcaaatgtcacctgaaacccatgatactggtactatttcgaacgacgttgctgcaaataacactagtaaaattgtggttgctagaacaacgaaaattagtgctgctgtttctgcacttgttgttggtgcaattatatgtggtgttaccagcctggaaagaatagtaaccattctcagattaaaggagggcctggatgttgtacactttgtaagaagcacaagatccaattcaaatgggaatgtacgttcagttggggcttttaagttggatagttcagttgaagttcatgtccattggtttagattgcttgttgggaactgcagaaccatctgtgaaggcttagtggtggatctcttgggtgaaccatccattgttgctctttcaaggatgcagcgcatgcttcctctaactttggtttttccaccggcctattcaatatttgcttttgttatgtggcggccctttgttatgaatgccaatgtagcagttcgtgaagacatgaatcaactttatcagtctctaacaatagccataagtgatgcaataaaacattggccgttccgagatgtatgcttaagagagtgtcagggtctttatgatcttatggctgcagatacaagtgatgcagagtttgcaaccttgctagagttgaatggctctgatatgcattcaaaatctctggcatttgttccgctccgtgccagacatattctaaatgccatgattgattgtaagatgcctcaatctatttatacaaaggatgaaggaagtcggaattatggacatggtgaatccaaaattgattttaccgatagtgaatctacacttcaggataaacttgtagatgtgttagatgctctgcagcctgccaaatttcactggcaatgggttgaactcaggctgcttttaaatgaacaagccctcattgaaaaactgaagacacatgatatgtctttagctgatgctatacagttgtcctcacctagttcagagaagggtgctgcttctgagaatgagaacaattttattgaaataattctcactaggttactggttagacctgatgctgcaccccttttctcggagttggttcatctttttgggaagtctttagaggattcaatgttgttacaggctaaatggttccttgcaggtcaagatgttctctttggtcggaagaccattaagcaacgactgattaacattgcagagactaaaagattttctgttaagacccagttttctgaaccctggggttggtgctccccatgtaaaaatccagttgctctcaagggggataaaatgaaagttgatcctatgcctcttgaagaaggagaagttgctgaagagggaatggatgcgaaaaggtccataaaagggttctcccaagtgtttgactctgaaagctcaaccagtaagcagcagcatgggaccgagagggctcttcttgagttaattcttccttgcatagatcaaagctctgatgaatctcgtaattcctttgcaagcgatttgatcaaacaattaaattatattgagcaacaaataactttagttactcgaggaccaagtaagccaacagcaagtactcctgtgactgaaggtcagacaaataaagtaaatagccgcaaaactataagaggtggcagccctgggttagccagacgaccaacacctgcaccagattcttctccactttctcctgctgctttgcgagcatcaatatctttacgtgtgcagttactcatgagatttcttcctattctttgctcagacggggagtcttctgcaaggagcatgagatacatgcttgcctctgtacttcttcgtctccttggcagccgggttgtgcatgaggatgcaacggtgaatcccatgcactatactccattgagaagggaggcagagtcacatgctgaagcttcttttgtagattcttctgctgagggcctgtttgatcatctgctgttgattttgcatggattgttgagtagttctcctccaagttggctcaggtcaaaacctgtttcaaagacaactaatgaacctacaagggaattttctggatttgaacgtgagccattggaggcattgcagaatcatcttgataatatgcaactgccagacactatccggaggcgtatccaagcagcaatgcctctgctccctccctctatacggtgctctttctcatgccagctgccaactgttccagcttctgctcttgtatctcttcaacccaacactacaaattctgggtttaactccggcagttcaactgtccctcagaggaacctggttccatcatcaaggactacaacctcagggaagtcaaaacagcatgacaatgatttggatgttgacccttggacgcttttagaagatggtgctggatcttgtccgtctgcaagtaatactgatatcataggaagtggtgaccgtgttaatattcgagctgccagctggcttaaaggggcttatgctaacccctcatcaggtgtatttgttgtttcattgtccattattgatggcatgactggcatgaagatgtcatttggtatttgcccttcctgtgttgaagggaagttgaggggtcgtcaatttgagaaacaggtgaaagggatgttttctttgttgaagaaaagtgaagttgatgtcctggcaagctcatcctgttggttctag

SEQ ID NO: 85165 - DNA, 339 bp, Glycine max
  Peptide Sequence Number=SeqID_201943
atgaccaccatcacgcagatctggatgacgttgctgcttagcaacattctccccaccgaccataactcggacctccccatgctgaagtgtcagttggtttacgccatcctgactcaaggagcattcgctaagtgcgacactcagtggctaagcgcgaggaagaatccagaagaagatgagttgtcaagttcgctgagtacacagctccaggtcttcaagcgcactgcttcaactcatccgctaagcgagagaagtgcactgagccaaaattcactaaagtgcgctaagcggtccatatatgcactaagcgcacgagcacgaacaaggccacctatttaa

SEQ ID NO: 85166 - DNA, 252 bp, Glycine max
  Peptide Sequence Number=SeqID_201944
atgaatgaccacgatggtctctgcatgccatcggacttgattgtctctggatcacaaagggtgcggatgaccatgatgggtgtggatgaccatgatggtctccgcatgccatcggacttgattgtctctggatggaaagcggatgaccataatttgtcttcacgtgccaacggacatgattgtctctggatgggtgcggatgaccatgatggtctccgcatgccatcggacttgattgtctctggatggtaa

SEQ ID NO: 85167 - DNA, 684 bp, Glycine max
  Peptide Sequence Number=SeqID_201945
atgatggaggccatgatgaacatgaagaagataatggaagtcaatatggttgccggtaccagtgttgttgctaaggtgaacccgatgccctcatctggcctcaaccaaatgaatcatccaacctcaaatatggtaggcaaagatttgggaagtatgggcggcccctattatgtgcaaattcaaaacaagcacgccttcccgccatatggcttgcctcccaactatacaccacccaatgtggcgtacactcccagtgagaatgtcaataactccactcccatactcattgagagccgacaaccccaaactgatcatgcacatgtctctcaaaccatgggggagacacatgaaattccccaccacaatctagccgacttcgagccttgtctcggatatgccactgaagggacaacagttggtggtatacccctgcaaaacactttggagggccctcagtatcacccacaaccacaccccttgcattccacagcaggtaaaaaccctcatgctatggcagaaatgggaaagttggatcatctagaggaaaggcttagggccattgaagcaggcgaagattatgcctttgctaaggtgccagactttgacaagtacaaggggactacttgctccaagaaccatctaaatatgtattgtcggaagatggaggcatacgcaaaagattaa

SEQ ID NO: 85168 - DNA, 393 bp, Glycine max
  Peptide Sequence Number=SeqID_201946
atggcatgcggagaccatcatggtcatccacaccctttaccatccaaagaaaatcaagtccgatggcatgtggaaaccatcatggtcatccacaccctttaccatccagagacaatcaagtctgatggtatgcggagaccatcatggtcatccgcaccctttgtgatccagagacaatcaagtccgatggcatgcagagaccatcgtggtcattcatttttattgttttcaagattatttcagtcctgtttgccttctagagacaagcaagtccattggcatgtggagactatcaatgtcttctgctctttatctttttcaaaggctactagagtcctttttcgagacttcgatgtctcccttactttgcaagacttcaaggtcttgtgttga

SEQ ID NO: 85169 - DNA, 432 bp, Glycine max
  Peptide Sequence Number=SeqID_201947
atgatgctgatcatcatgttcaatgttgtaatcgatcatatatctcagcgcgcaccagtggacagcagaaatgaggagcattacgggataagtggcaacaacgtaggatgtggcttcctctcatgcagacaaaagttggccacggtaacgaagccaggctcggtaaccgaacctagctacatgataaggaaggaggagtggagtggatatagggttggtttggcctttgaatatgagacaggtgcctttttaggaccttctttggctacccgggaattccgtgtcaactcaactttggctgaaagggacgcaacacactcagaaactaaaccacaaatcctagtgctttgcactttcgataaagtcacgcaatccaactcttttaactcaagtcatcacacggatttctacttttttttagcacgttattaa

SEQ ID NO: 85170 - DNA, 183 bp, Glycine max
  Peptide Sequence Number=SeqID_201948
atggttagggagaatctcatagaacagaggatgggaattgaaggaatccgagaacgatggatcaccttgttgcatgagaacgataagtgttgggttggaagttggaaccctaagcagagtagagagcaacagatatttttggtgttgaccaagacaaagatgcggatctcaggaaactcataa

SEQ ID NO: 85171 - DNA, 1463 bp, Glycine max
  Peptide Sequence Number=SeqID_201949
atgcaaacccatcatcatgtcttgaaagaactcatttcaatatgcaagatagccttccccatgatcctcaccggtctcttgctctactgccgttccatgatctccatgctcttcctgggccgcctcggcgagctggccttagccggcggctcactcgccgtgggcttcgccaacatcagcggctactctatcctctccggcctcgccgtcggaatggaatccatttgcggacaagcctacggtgccaaaaagttctccctcctcggcctctgcttacaaagaaccattctcttgctcctcttcacttgtatcccaatctctctcctttggctctacatgaagcatatccttctattatgtggccaagacgaggctatcgccacacaagcccaatcatatcttctttattccatccctgacctcttagcacaatcttttttacaccctttaagaatttaccttcgaagccaatccattactctgcctctcactctttgtgccactttctcaattctcctccatattcctatcaactaccttctcgtttcccacctcaattggggaatcaaaggcgtggctctcagcggggtttggactaacctcaacctcgtagcttctttgattctctacatagtcttctctggcacccataagaaaacatggggaggcttttctttcgagtgttttacacaatggaaatcgctcctcaatttggctatcccaagctgcatttccgtgtgcctagaatggtggtggtatgagatcatgattttgttatgcgggttgttggtgaatcctagagcaaccgtggcctccatggggattttgattcaaacaacttccttgctctacattttcccatcgtcaataagcttcagcgtgtccacaagagttggcaacaaattaggcgcgcaaaagccctcgaaggcaaaattttcttccatagttggcctctcttgcagcttcatgttaggtgttttcgctttggttttcaccattctggttaggaacatttgggccaacatgttcacacaagacaaggagataataactttgacctcatttgtgctaccggttataggactctgcgaactcggaaactgtcctcaaacaacggggtgtggagtgctgagaggcacagcaaggcctaaagttggtgccaacattaacttaggttgtttctatcttgtgggaatgcctgtggcggtttggcttggttttttcgcagggtttgattttcaagggttgtggcttgggttacttgcggctcaggggtcttgtgcagtgaccatgttggtggttctgagtcgaacggattgggatgctgaggctctaagggcaaagaaactaaccagtgttgttgttgatgacagcaaggaggttggtgcagagaagccaccgaaagctgaaatcaaggaagattctttattatcattagctgattcagatgaagataaacaatc

SEQ ID NO: 85172 - DNA, 360 bp, Glycine max
  Peptide Sequence Number=SeqID_201950
atggtgagacaagaagtcatgaagagctcaacaacgacattctctggcctcaaagcacgcaccacgcgttcacctccatggcggaatcctcagaaacatgggtggttccaatcaaccaaatggaatccggttcgaagaattcggtcctccaataagggacagggccgaaccgcttcatctagaccaaaattaagctcccattgtcagccagttcgagcaactcagggtgagattcggctatggcggctctggaggtgggggtttcacggaaagcatcatgatgttgagagggaaaatgggttcttggtcctggaaattaggaaggttgatctaatcaccgtcatggactccatggaatga

SEQ ID NO: 85173 - DNA, 1348 bp, Glycine max
  Peptide Sequence Number=SeqID_201951
gaaatggacccttgcagccgaacaagacggtgtggacgacactgtctatgaaaaatacgacattagcaaggagaaattggcccagttttgtcagacacacagagacccttcttgggaggatgtgcggaaaaagacacagtttggaagcactgagggcatcattgaccctccatctcccatcagacgccacgtgaagtggaagatggcccgcaccaagaaaattgggcagatgacatctggggcagcaaagaaaatcgctgagaagatcggatcgttcgtccctcatggacgtcaagatgtcctgactgtcgccattgggcgagcagagcatcttggccgtgttcgtgctgctggagccggtgtcaccatcaagaaatatttcagatcggctccacgaatgtcccgcagctcttcctccctgcctcctgaagagctacaacagctaacccaacaaattagggaccagctagaggagtcgatcacagaaaaagtgactcggaagttgatggcatttttcagccagatgcagtcccagtttcaatcccaaatgcgatctcagggacttgcactgcctccagagcctatggttggtccctcaggtcctcgtgtcagtacaaagaagagttgtgttgatccttcagggaatgatcctgagacggatgactcaaacaagtacgggttatacattaaagcaaattctccccgcctggttaccctaggaagagtttatgagggatcaacagttcacaacattcctttgttgcatggccaagtgaaggttggtgttgaggaggttaaagatgcacaggctcccgttcctgtacccactgacgaggttaccttagtggggcagacacttaacaccttccttgcttggccaacgcatctcgtgaagcatttatcagaacaagcagctgtttctccagcaaaacctccacaaaggttggatcctgaggttaactgggatgctaccgtgttcagagtgtttaatccagacttcctgctatatataaagcatgaagatctctccaaaatcgcacacggtggtcaatgtcttagcatatctatcatacagttgtggattctgcatctgactgagacaagtatgcgagcggggaattctgatgtgtatggattcctcgagccacagtctattcagagatttgggcaatccggacactggcaaatggtcgtcattctgcctaaggaaaacgttgttgtctggttttgttccttgcataacagactagacaactaccttaagggaataattaacagtgctttgaaaggacttgatgatactccacagcctaaatccaaggctggtgctaggtggattgttgttaag

SEQ ID NO: 85174 - DNA, 626 bp, Glycine max
  Peptide Sequence Number=SeqID_201952
agatagggaacattgtcaatcttcaaactttggatcttgctcacaacaacttagaaggtcctttgccctctcagctttcaaagtgtaccaaaatggacaggtttgatgttggatttaatttcctaaatggttcattgccatcaagtctacaaaactggacaaagctaaacacattaattttgagtgagaatcactttagtgggggcctcccagctttcttgtcggaattcaaaatgctttctgaactacaacttggtggcaatatgtttggtggcagaattcccagatcggttggagcattgcagaatttgatgtatggtatgaatctaagttcaaatgataggtggcagacgagtccatggaattggatagtctatttgaggaagaagaagcaaccaaacactcccaccatgaacaaatccgccctagtcgccgcctccgtcgccgccgcgtcggccaccgccacttccttttcctcctccgcaaagctctctcttcaggatggtggggctcagagaagccacggcggatcctcgccggttgcgaactcggcgtcgacggagaagttcgcgccacggttcgacgggttgcggttcattgaaacgctgattactgcgcacagatga

SEQ ID NO: 85175 - DNA, 267 bp, Glycine max
  Peptide Sequence Number=SeqID_201953
atggttacccttgggacaactacaactttaaatttacaggcattggtagaggagatcaaggcaagatatgataaagcagctgtcaaagttgttgacctgattcttacacttctacaatttggaggatatacactagtgcaaaattcagttgatctgtatcgaagctttgggtttgatacacagccaatcctcattgggcttatcatatttcaggttgctcgattggaagagcaagacaacactctagtgacaaatgatatcaagtag

SEQ ID NO: 85176 - DNA, 237 bp, Glycine max
  Peptide Sequence Number=SeqID_201954
atgttgtggaggttatcaatgattttccatgtgtattttttggatcctagcaataatggggatggtgtgttgcttcaattggagaatgacatagatatcttacacatgtgctgcataggtggtgtgcttaacaaggttgtggtgaatcaaactaaggatgaagttgaaggtattgatactaaccttaacaaggaaattgaaatgtctgatgatttgaataatgttacaaatgtctga

SEQ ID NO: 85177 - DNA, 384 bp, Glycine max
  Peptide Sequence Number=SeqID_201955
atgtgcaaaggtttgttagcaaattttctgctttccccactagaagtaattttcctcctagtcaaagatggagaggttccctttctagttgaaaaagcaggtgtcactgttttggtaggagtttttgatgcaggctttgaactttttggtgttgaaaatggggatgccttagaagtaggtagcattgatttcttcttagtcttggctgaacatgaaagtgatagtgatcttggtgcacttcagcaactcttggttgatcaacccaatctccaaattgaggaaggagtgattttggccattcttgatcttgcgctcattgttgtttccaaaagtgctcctgcggtcattgctggaaactcatttgtgctcaaacctccaacttag

SEQ ID NO: 85178 - DNA, 153 bp, Glycine max
  Peptide Sequence Number=SeqID_201956
atgcaatcacaggtactcacactacctcctgaatctgaggataaacagggagttgagggaccagcgaaacctgcagataggttagatcctgatgtcaatcccatatatgtgatgacattgaccatcccactggttttccttaagcctttgtag

SEQ ID NO: 85179 - DNA, 922 bp, Glycine max
  Peptide Sequence Number=SeqID_201957
gacgaattggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgggtatatacggctatacaattacaaccggtctttgctcaatggatacaaaatacccatgctttagcaccaggcacaacagccccagtgggcggtaaagttgctttgttacctattccgttaggaactgcggattttttggtccatcatattcatgcatttacaattcatgtaacagtattgatactcctaaagggtgttctatttgctcgtagttcacgattaataccggataaagcaaatctaggttttcgttttccttgtgatggacctggaagaggggggacatgccaatcagatgtttggggtagtataagtgatcaagggatagtaaatcatatcacaggaggaaattttgcgcagagttccattaccattaatgggtggctccgtgatttcttatgggcacaggcatcccagcctagagccttgagcattgtacaaggacgtgctgtaggagtaacacattaccttctaggtggaattgccacaacatgggcattcttcttagcaagaattattgcagtaggataa

SEQ ID NO: 85180 - DNA, 1224 bp, Glycine max
  Peptide Sequence Number=SeqID_201958
atgagagtgcttgaagaagtttatcctcgtatttctgccattcctgatggaccttcagtttcttctaacgtggagaatgaatgttatgatgataatgagagcgtcattcctctcctccctctcattcctgttgaggaggaacaagagtcagtagaggatactgaacctgactttcccaccaaaaaattgcagtcacaaaacttgcagcagcaatatataccaccagcaacatctctcattaacccacaatgcaacaatattaattcacgttgcagtggaaaaccactacctgcaacatcttctgagtcagatatagttgcagcagcttctgctgctgctgtagctgccattataaaaagcaatgagcaaggaagcttgattgatatggatttgctccgtaaattatttactgacccaacaatgattgaaaagttaattgagcaaaatagaactgctaccaccactgtcagtgcaccctcaaatattttgagtataccaacttcttattctaaacctgcagctgtagcttctgagactaaaccaactgcaccaacaaccacaatgggtttatggcctacttctgtgacaaggaaagcaacacatgaaaagccatcaattacatctgttccatctgtttctttggctatgcctttaactcctcaaacagtaacaaggcataaacctcaatcaactcacaggcctgtcaagaaaaatattcctcatatgccaaatggagtgcttccctctttaaacactcactctccacaacaagggttaaagagagcagcaccattggcttctgtttcctccagtgaatttaaaacagtggcagtgccttctgtttctgcaaacatgcattcagttgcaaaacagatgaagtccaccacaagtggtgccgtcaaagatgtcaactattacagaagcctggttaaagaacatggtactcataagcaaggcaagaagagtcttaggaatttacaaggtttgaaacgatcgcagggggaagtgaaattcaaaagcaagaaaccttgcatatacttcggaactccaaggggttgccgtaatggttctgattgcccttttcagcatgatatgccaaatcagtgggaagctggtaacgtcctaatggctcaaaatgctaaaagattgaaaggaaagggaggaggccaggctaatatcttggaaactcctgtaatgtttagccttatgagattgaaaaattag

SEQ ID NO: 85181 - DNA, 2265 bp, Glycine max
  Peptide Sequence Number=SeqID_201959
atggaccgccggggttggctatggaagaaaagatcatccgataaaaacataaaggttgagaatgagaaaccagtgtctacttctgaatttgttggtcctaccttgttttctgtggcacatgtaggagatcagcaagacagcagcaaaaataagaactatgttcaaataacaatggaatcatacgcacatatgtctggattggaagatcaagttgtaaacttggaggatcaagtaaaagctttggaagaaaagctatctgcagtttattcagaattaaataacaaggatgatctagttaaacagcatgcaaaagttgctgaggaagcaatctcaggttgggagaaagctgatgccgaagttgtttccttaagatgtcaacttgaatctttgtctctctctaagcttactgttgatgagaaagctgctcacctagatgaagccctaaaagagtgcatgaagcagataagaacagtaaaggaagaaagtgaccagaaactgcaggaggtaattcttatgaaatctcatcagtgggagaaaatcaagttagaacttgaagcacaaatagacaatttggatgaaggacttcgtgagttagccaatgaaaatgctgcccttctaaaatcagttcaagaaagttcgaacaaaatagtgaaactaaaagaagagaagtctgaagcagaggcagaggtagagcatctagagaagagtgttcaatcaaaagaaaaagaaataacttcactaaagtatgagctgcacatgatttctaaggagctggatatccgtaatgaagagaagaatatgattatgagatcggcagaagtggcaaacaagcaacacactgaggatgtcaagaacatcaccaagctagaaagtgagtgccaacgacttcgtggtcttttgagaaaaaagttacctgggcctgctgcattggcacaaatgaagttagaagttgagagttcacaccatgtcttcagtgcaacccatctgagaaaaactagttcaaaaactgatagcctgcaagaatccgagtttcttaccaaacagttgaaggtgttggaagaagaaacaaagacattgaaagaagcattggcctcaagtaatgctgaactgcaggcttctagaaacttgtatgctaaaacggttggcaggcttaagtgcttggaagcagagatgcatcaagaaagaaacgcccagaaagcaattttggcaaccaattatggaaactccttcagtagagtttatagctatccaccaaccatcacttctatccctgacaatgggcatgaggattcagaaagtcctgttgagtcaagtgcagcatcaattcctgaccattctgatatcaggaggattggaagtgtaggtaaatttgagaatcataagactgaaactatctcagaactgatggatgactttctggaagtggagaagatggcatgtttatcagacaatggtggtgtacctctttgcatcattagtaaagctaatgatgatgctgaagataaaaaggagactagctgtttatcttcaaataaaaattgttttgatgggacaaaccaaacaatagaacctgaggcagctgaatatgatgagcatatgcaagatcttaaggaaaaaaggatgatgttagaggaaaacatgcagcttctagaagaactgaaagcacaattggtgtcgtctaataaatcatgtagtttagctgagattcagctgaaatgcatgactgagtcttacaagtcacttcaaacacgtgtagaggagttagaagctgaaaataagtatttaaaggaaaagatggatgagctaaagaatgatcttgcagaggaaaaacaaagtcatcatgatgctttggtgaggtacagagaaattaaagagaaaatgcaaagggacaagtgcttggtgtgtgcagcaaattcggtggcaaattctgggaaggataaagagctagcagctgcagagaaaaagctggcagaatgtcaggaaactctgtctatacttggtaggcaattgcaagctatgtgccctcagataggggtaaccatgactcatcatagtaaaaggcttcaaatgaatgaaaagttagccaaaccaacttatggctggtcaaattcttatgggtcatgtaactcaaatgaaattgatcatgctgaggcatgtagcatagtgtctgacattcaaggagtgactgatgagttttcatcgcataactctggtgccacatcatgtctttcagacaccgaaggcaacttttggttaaacacttga

SEQ ID NO: 85182 - DNA, 396 bp, Glycine max
  Peptide Sequence Number=SeqID_201960
atggatagaagaagaaggatggataatagaagagaaggagataatggactaagaagagggttttcctcttatagatgttcaagcttaggatgtcttcccttttataggcataaggtagcttacaattcaggctaccttgcgctaagcgggccttctattcttaacgagtatagcgatgatcactcgcttagcgcacagtttgcgctaagcgcgtttttgggtttcttcgtgggtcttcttcgcgttaatcttgagctgacaactaagcgaggagacgtgttgggcctgtgttgggtgttaagcgagttgtctcaatcttcaactttttcttcaagactttttctttacgtttttgcattaattttctttggagcacttgaaattttcttcttttga

SEQ ID NO: 85183 - DNA, 207 bp, Glycine max
  Peptide Sequence Number=SeqID_201961
atggctatacccaaaactaatttgtttccccaccagctttcacagaggaactccttcaacaaaatattacaatatgcaaacaaatatagactcccggaaggcttaaaagagcaaatgttagcacacatgcaattgaagtttaatactgcagagttacagcaacaagtctctgatgattttatcgcccagctggtggcgatagaatag

SEQ ID NO: 85184 - DNA, 666 bp, Glycine max
  Peptide Sequence Number=SeqID_201962
atgggtgcttcagagtctactctctcaagcggaaagacgccagatgacaaaatcaccaccataaccgagcggtcggaagcctctgaccctatcttggagcgccttaaatatctcaaaattacaccgcccatattgacctcacccccaacagaggggactttaactgatattttagtgaggaagccttcgtcgtcctcagtttcaggtgatgatctcttatggctcaatcattctgttattcctgctacagtcaatccgaaggttatactggagctcttctcaatataccatgattggcaggagaaaaaggcccaagagataagcataagacaggaggaaatagaaaacaaaatagaagttgcagatgctctagcgatcaaacttcttcagcgatataatcattcaacttctacaatgaagactgcctcacaacatctatccggagttcattcattgcaggtggaaattggagagctcaaaggaaggttgactgaagttatcagcaactgtgatgctttgtgcaagaggattgcaacagagggtccagaatctctcgtgtcatcaatcaaaccttttgcagttactacggctaatcaagaaacctactcaagttcatctagtttgcggatagtttcaaaaacaaatccaccttcagcagaagaatag

SEQ ID NO: 85185 - DNA, 444 bp, Glycine max
  Peptide Sequence Number=SeqID_201963
gttttggtaattgctgttcaggtttgtgtagagtatagcttggatttgacgttaaagctgagatttttggacgattcaagtggtgggttttttcttcagtttttgcctcttgcttatgcttgtggattgggaatgatttggttaaattttgcaactttgcattgtatctcgtgttataatttattactgttggttgcggattcaagacttgaagttatgattctggcaactgtcggccatgagtttataagcgataggacttgctataggcatgttttggagattcctgagggtagaattaaagcttctaagttcattggtatactcgacaaagccttagtatctggatcatggctagataaatttcgagatgctaaggctttgtcgagcctttctttgacgagcctttctttgactgcattggttgtttccttgacttcatga

SEQ ID NO: 85186 - DNA, 252 bp, Glycine max
  Peptide Sequence Number=SeqID_201964
caaactgccattgtcaatggcgagtttgctgtgcgaagccacgtggcatggaaaacgccacttgtagtggcgagttgcctacaggtggaagttgccaccatgactagcgagttagggcaggcttctgcaggcttttggaaaccgctagtcaaactggcgggttggctggtgcaggcttttgcagtgtttgcaggttgcttttgtaggcggtgtaggcctaaaggggagttgcaactgccactggcgatttga

SEQ ID NO: 85187 - DNA, 471 bp, Glycine max
  Peptide Sequence Number=SeqID_201965
atgagtgtatattgtataatcgttctcttcaatttatcagggcacaaagagcttgaaatgagtgtcacagaaacaccaaagaaaaccggtgccccccaaattgttaagttggacaaggcattgaaattggcagagttatgggtaaataatatgagcaaagatgcagatgatgatagaacaaatgcggatgtagagggtcgaccttctaggcttggtctaggtgcaaaagtttcacgccaatcaaaatttgtgccttcagatgaccctgttgaaaggaaattgtatgccaagttgaatgctgaaaaaagaaaagcagctaatattgctaaagagtctgccacaattgcaagagatgctttagatgacgatgaagacaatgaagacttagatagcagagctaatgcatttaccaagaggaaggcaacagctcctttgatctcgtctatgttgcgaaataagaagcagaagtga

SEQ ID NO: 85188 - DNA, 980 bp, Glycine max
  Peptide Sequence Number=SeqID_201966
atggagtcatgtatcccaccagggtttcggttccacccaacagatgaagagcttgttggttattacctcaggaagaaagtggcttctcagaaaattgaccttgatgttatcagagagatcgatctatatcgtattgaaccatgggatctccaagagagatgcaggatagggtatgacgagcagaatgagtggtatttcttcagccacaaagataaaaagtatccaacagggacaagaactaatagagccaccatggcggggttttggaaggcaacaggaagagacaaagcagtgtatgaaagggcaaaacttattgggatgagaaagacccttgttttctacaaaggaagagccccaaatggacagaaaagtgattggatcatgcacgagtataggcttgaatctgatgagaatggacccccacaggcaagcatatatgttactgaagaaggatgggttgtgtgcagagccttcaagaagaaaaccactgggcaaacgaagactattaatattgaaggatgggactcaagctacttctatgaagaagcaagtggggcaagcactgtggtcgatccaattgaactcatttcaaggcaatctcagagctttgtagctcaaaacttcatgtgcaagcaagagttagaagcagataacttgagttgcatgcttcaagatccatttgtgcaacttcctcagctagaaagcccatctttgccattagtaaagaggccaagcacagtgtcactagtatcagacaataacgaagatgaagacattcaaaacaggttgttatccaacaacaacaacacaaagaaagtcaccactgattggagagcccttgacaagtttgtagcctctcaactgagtcaagaagtagacacgcatgaaagtaatggagtaccctcaagctttcaaccccatgatgataaccacgacatggcactgctgctactgcagagtagtagggatgaggggaacag

SEQ ID NO: 85189 - DNA, 186 bp, Glycine max
  Peptide Sequence Number=SeqID_201967
atggatttaaactcagacacacaacaacaacaacaacaacagcagcagcagcaacagcaacgacaacaacgtaagtcttatatcctattaggtaaggagcataaggctgagatgcagcttggtgagttcactctcaaagcatttaagaattccaatttcactcccccaagtttcctaaccgagtga

SEQ ID NO: 85190 - DNA, 2790 bp, Glycine max
  Peptide Sequence Number=SeqID_201968
atggcaaagaggtgccaaagattccctgtgaattatgagaaagatcagtcaggatgtatgtggggttttattagtatatttgactttcgtcatgcccgctttactcggaagttgattgcggataggaggcatggcagcaagcatgctgttggtgctgcacttaccaagaacaagtttgaagtgttgagcaatttggatgaagaatatgaaggcaattttgacagaggagagagtaagagactaacactgacaaatgatgcagataagcttagtgtgaagaaactcatagaagaagagatgatcattgaccaggatgaaataaaggaccaaggtaatgctgaagtagaatcaaagcaatccagattagggcatgaaggccccccaaagacagattccaaaagaaaaaagaaatctcgcaagaaaagccgtgatatggatagccatgatttgaattcagatgcaaccttgaaatctgaattttcacataaaccgcattcaagacaacagtcaaaagataatctagatttgaacaaaataatggatgatttttgtcatgttgaagctgcttgttccatgatgaatgatgatcatggcaaaattgatgaacagtcaaaccaaaagcatgttatctctgaaaacctagctaatgcaatccatgaatttgcaaatcagatgagattgaatgggaaagatctgcctgaagatggacaattgcttagctcacatgaactcatggaagcacttcaggttataagttcagataagcaattgtttcttagacttctacaagaccctaattcacacttattgaaatacattcaggagttggaaaatgctcaagggagaggtggcaaagaatgcagttcagttaccagctccaactgctctgaacatgaacttgttaaactgaaacaaactagggagactgccaaccgcaagcatcgtaactttttcaggaaaagggtgaagtctcaaccaaaagattcaacaaatgaaaatgagaaaactgaattttcaaatagaattgtcattttgaaacctgccctaacaggcatgcaaatttctgaaagtggaaacaaccttgcctcaacgctaaattctcatgacatcgcccagtacaaaaatccttcagtgagagttggttcacatttttctcttacagagataaaaaggaaattgaaatgtgctatgggaaaggagaggcatggaaaccctgaattgatcccacgcaaactccccgttgaacgtcaaaataagctgccaagaggaaaatgcaaagataatgctggaatgagatctcctaataaagaccatttcttcattgaaaaaattacaagacctatgtttaatgtagtgaaaggaaacaagaccggtacaatgaaagactctgaattgaatgtggaacatgaaagtggtattcccaatcaaagtgtttctaacatatatattgaggctaggaaacatctgtgtgagatgctagataatgctgatgagaacacaaacatttcaagcaggcagatgcccaaaacccttgggagaatactttctcttcccgagtacaacttttcaagtcctggaagggatttagagcatcattccgtgactgcacaggcaacattttcttcctcagacaaaactagggaggttagtgaggataagttgtcccccaaaccagcaacatgtattggtcttccagatcaggaaattaacaattcagagaagcagtcaagcatttgtgatgaaagatctgacaataaagttcaagaaattaagttggtgtcgaatctctcccatgatgttaatcatgtcaatacatctgaagcctgttatcctgttagagatgagatagttactgaaggtaatgtagaatctacaaaagagaaaaatgatttggaatcgtctttggatccaaatggtttcatcataggaaaggaccaaaatattgatatctcagaaattcctgatggtgcaggatgttctgaatgtttgaatcaggacataccagaagagaaccaatcatcatctctactgtcatctcctcaatcttccatcactaagaaaattgaagagctagaaaatggtacagatgtatctgggcgaccgagtcctgtatctgttcttgatacatcattttcagatgatgactttggccctgggcactccagatatcaacctgttaaattaccagtacaacctctacaaattaaatttgaagaacacgactcttcacctgcagaacaatttgatagaagaaaatattgttttgaagaaagtgaattgatatatgactacatcaaagctgtcttgcatgcctctggcttaactacagatcagttgttgatgaaatgcctttcctcagacaagatactggatccttccttgtttgatcaggtagagctcttctcgaacctgctttgcaacaatcagaagctcctatttgactctatcaatgaagttctcatggagatttgtcagcattactttggggcctcaccttgggtttcgtttgtaaatcctagcacaaggctaactccaagtatgaaaagggttactttaaaggtctgggaaggagtgtgctggcatatgcttcccttgcccccaccacgcactttagagcaaattgttaggaaagacatggcaagaagggggacatggatggaccttggacttgacacagaaacaattggttttgagatgggtgaggccattcttgctgaactgatggaagacaccattttgagccttgtgattgaaagtccagaaagtaaatgtttctctgcttcaatttga

SEQ ID NO: 85191 - DNA, 285 bp, Glycine max
  Peptide Sequence Number=SeqID_201969
atgaccaagagaaggggcaaggatccacttgaaggacttggaggacctatgacaagggctagagcaaggaaagccaaggaagctcttcaacaagtgttgtccatactatttgaatacaagcccaagtttcaaggagaaaagttcaaggttgttagtgggtcattactaaaatctgctgtaaaacttcaatataagctgaaccattttatcaataaagacaagttgagttttattcagaaaattagagtttatctcttttatcttagtgagagtgattctccttaa

SEQ ID NO: 85192 - DNA, 306 bp, Glycine max
  Peptide Sequence Number=SeqID_201970
atggcaagttcaacatgctttcaacaaatttcttcacaaataactatcatgaagcagaaacctagcaaaactacccatcatatctcccaaaacccagtacccacgaaaatcaaagatgcgcttcatgactccgaaaatgccttcctttcgcgatttggagcagaaatggctaccaaaggttggagctttgttggagcttcaatggtggaggaagaagaagagaatggcaacgtgagagagagaaggagaaaggcttctgaaattttggggctgagtgaggagagagagtgttgctttttggtttaa

SEQ ID NO: 85193 - DNA, 468 bp, Glycine max
  Peptide Sequence Number=SeqID_201971
atgacgaaaacaacggcttctacgccgaagaaggagaaggtgaagaagggaaggaagagtattagcatgacagagaggtttaattgcagagctaaagatttgtttgagattttgatggataagaataggtggaaggattttacgcagatcaatgtgaggattagtaaggaggttgagggtgagtttagcatttttgatgggtcggttactggaactaatttggagttgcaagagggtaagttgattgttcagagatggaggtttggaagctggaatgatggagttcaatccacagtgaggcttgtgtttgaggagcctgaatcgggtgttacggttgttaagctgacacatactgatgtgcctgaagaggatatgtatggtaatgctactgtggtggagaacacggaaagggggtggcggcatcttattttccagaggatacgtggtgtttttggttttggaatttga

SEQ ID NO: 85194 - DNA, 252 bp, Glycine max
  Peptide Sequence Number=SeqID_201972
atgggtgcaggaggcacttctacaatagtaggtggtttggctgaaatacagtcgttaagtatcataagtgtagaaaaccttagactgctaccatacagccttgcaagtttcatgagcacgaaaaattggcctttgggaaggattaatagtgaatttgaggatgctacacaaccagagaacctaagctggcatgctgcaatacaaccttacatgtttcatgagcatgaaaatttggctttagggaaggattaa

SEQ ID NO: 85195 - DNA, 618 bp, Glycine max
  Peptide Sequence Number=SeqID_201973
atgaagagcactaggagagaaatggagaagaagtcggagataggttcagccattgaagagctttctacgatgaccatagttaaacctggtgaaaatcacgggtctgcccacatccccactaagccttttctctctgtttgttacttcgttcttcaagttcttgataagatagggccaacaatgactgttatgagacaagacgtgcaccagaatattaagaccttggaactgatgcatgaatcaaatccctcattgaactcgaatttggttgagatattgaagtcagaagcaagagaaggcaatgctaggaaagggtcaagctgcagtaaggcccttgtttggcttactaggaccctggatttcgcctcgttgttgttacacacactggcaaaagatcctgaaaagagaatggagcaagtagttgaagaggcttatgatgtggctctaagactggtcccagaaagtaaaacattcgtaaatattcttaaaactgaagatgaaaactatgacaccctaaaggagaacatgcagatgctggtttctctatttgtgccttttcttgaggatatgcattgtattctaagattgtacaacttggacaagctaaagtcaacctaa

SEQ ID NO: 85196 - DNA, 264 bp, Glycine max
  Peptide Sequence Number=SeqID_201974
atgggtgagaatcagaacgggagttgtggggttaaattctggaaacaatacaagccacagtggagtgaaggggaatccgctagctatggagaccttgggagtgccaaacaacgacggagcttgcggcacactatcaacgtcacggcggagggaacgaggtcaaaacagaggttatggcacggcggagggaacgaggtgaaaatgcagatgcacgcaacaagcttaaggggtagtgtagtcatgcatgttcaacaagctagctag

SEQ ID NO: 85197 - DNA, 1947 bp, Glycine max
  Peptide Sequence Number=SeqID_201975
atgtttgcatctttggaatatcaagatgaccatgctccactgtggtcattcgttacaataaaggaaaagataggagatgggggtggtaatagactgtggagttgcaatttttgtgaaaaagttatcaaaagttcatactctagggttaaagcacatttgctcagaatttgtggtagtggaattgctacttgtctgaaagttactgatgcatatttggttgatttgaggagggtttgtaaagaggctgaaaacagattaaagtctaagaatcttcctttacctactgacaaaaggactctaacaccaccaacattaccaccaaaaagaagaaaatcaagcaatatagagagtgcatttaatattgaggataagaatcatcttagagcagagatagcaaggatgttttattctgccggcttgtcattccatcttgctagaaatccacattttgttagttcttattcatttgctgctaactgtaatctaagtgggtttcttcctcctagttataatgcattgagaactagtcttttacagcaagagaggtctcatattgaaaggttgcttcaacctatcaaatctttgtggagtttaaaaggagttacattgattgcagatggatgtaatcaaggaggtagggcacaaaatgtagtccaagtcataactgataatgcttctgtttgtaaggcaactgggttattgatagaagctgaatttcctcatattttttggaccccttgtgtggttcatactttgaatcttggagtgaaaagcatttgtgctgcaaagaatgttgatggtaatgagaatgtcttcaatgaatgttggtggattgctgaagtaattggcgatgcttcttttatcaaggttttcatcatgactcattcaatgagattagcaatttttaatgagttttcttctcttaaagtgctttcaattgctgaaactcgttttgcttctatgatagtcatgttaaaaggatttaaattgttgaaacgttgtttgcaaaatatggtcattagtgatcaatggaatagttatagagaagatgatgtcagaaaagctgcacattgggataaagttgattacatcctttctttcatggatcctatatatagcatgattaaaatatgtgacaccgatgcttctaatcttcacttagtgtatgaaatgtgggattctatgatagaaaaggtgaagacaaccatctataggcatgatgaagtgttagaaaatgaagtttctagtttcttggaagttattcatgaaatacttaattcttggtggagtaagagttgtaatccacttctttgcttagctcattctctaaatccagggtactatagtgataattggcttaatgaggttccaaatagggttcctcctcatagagatgatgaactttctagccaaaggaataaatgtcttaagatatattttccacatgttaatgttaggacaaaagtttatgaagaattctctaaattctcatcttgtgcgggtgactttggttcatttgattcaattgaggatagatgggcattagatccaaaaacttggtgggtgatgcatggatcctctacacctatactccaaaaggttgctttaaagcttctagtgcagccatgttcttcctcatgctgtgagaggaattggagtacatactcctttattcattctttgaagagaaacaaaatggatccaaagagggctgaagatttggtttttgtgcactctaatcttaggcttttgtctagaaaagaggaagggtataaaaaaggagagacaagattgtgggacattaatggagccgtacatgatccacttgatgatagtgctggagttcttgaaatgaaagatttatctcttgatgagccagatttagaagctatgcttttcttagatgatggcagtgggggagaagaaaatgaaacaattagagtttga

SEQ ID NO: 85198 - DNA, 430 bp, Glycine max
  Peptide Sequence Number=SeqID_201976
atggtgatgtcgcgtgacgagcagctgttcaacaaggcctacagcgattacagcgacctggacggggacggggtgctggacaccacctaccaggacaagttcgattactcaggctacttcgattacaacctctgttactcgtacaacagcggtgtcttcaaggccagtgcagaggcaaagggcgccaacaagcacagctgcagcggcgcgtggtcgggcaacttcctcaactgggtgacgatgagtcgcctggatgtgatgcgctacgtgctgtacggcggccagcgcttcaccgatacgaaggaaaagacggtgttggagcgggcgccgatccccagcgatctgcatgcgtgggtcaaggtctacagtggatcggatcttcgcgagttcgccaaccttgctggaagcgggacaaccttcagcttctgca

SEQ ID NO: 85199 - DNA, 645 bp, Glycine max
  Peptide Sequence Number=SeqID_201977
actgcttatgtgttcctcttgacactgcctgagaacactttatggatccctacagccctggttttcactgctgggatcatcaagtttgcagaacggactcggtctcttcaacttgcaagtgttggccactttcgacaatctatagttcgcaaaccagatccaggtcccaattatgcaaagctcatggaggaattgaaatctagggttgatgctggacttcccaccgaaatagtaaccatgccagaaatctcagatgatccatttttagacattgatgagccagaaacaagtggtggcaatccagatcatgaacaccccaaaacagatgatgaagtagttggtgccattaataacacttcccaacaatcagataagccagaaccacatgctaatgataatgcacaggaccagcccaacaatggagaggctcaagacgtagatggtgctcccccaaaaacacttgatgatgatgctaatgccaagatcaatgatcaagaagtgctaaccgatgtggaggtagtgaagggtgcttatgactacttcaacaaattcaaagggcttgttgttgacatgatgttcagcttccaggaacgtagtgacagtcgcaattatttactccaaagaacagcactagatgctttgaga

SEQ ID NO: 85200 - DNA, 261 bp, Glycine max
  Peptide Sequence Number=SeqID_201978
atggcctccatcattgtggccattttctctttcatggcctccatgtcggcctccatctgctcttgcacctcctctacttcacccattactctagctctagcacaggttcgacatgagggcccgaaaaatcatctctccttacttgcgcatttgggggcgcagtgccccatgtgtgcagttaagaagacgatatggatcttccgacttccatcgacaaaagacgagacccacatacaacgcatgtgtgacgacatgatgtag

SEQ ID NO: 85201 - DNA, 297 bp, Glycine max
  Peptide Sequence Number=SeqID_201979
atgaactttatgagaaaaagtacagaaggctggagcattgttaacattctactggacttttctggctcgatagctaactatgcacaaatgtctgtgcaatcaatcgatcaaaattcatgggtgaacttctatggaaacataggaaaactattgctatccctggtgtctctattctttgacatcctcttcatgtgccaacattatctgttataccctgaaaagaaacgcaaattagagggatcccctgaacctgataatgctaagtcttcagatcgaccattgtccgagaatgtctaa

SEQ ID NO: 85202 - DNA, 135 bp, Glycine max
  Peptide Sequence Number=SeqID_201980
atggccaaggagagaaaagacagtactgtcaaaatggttaatgtctctcaagtggattggttagtactggcatacttcccaaagaggataagaattccgaaaattcaaacacacagctttccttttgagaattag

SEQ ID NO: 85203 - DNA, 396 bp, Glycine max
  Peptide Sequence Number=SeqID_201981
atggcttcttggaattcagttccactccatgtctcctatgaagttctgggttgggttgcttttgcttgctggtctatcagtttctacccacaagtcattttgaactttcgcaggaaaagtgtggtggggctgaactttgattttgtgatgctgaatttgacgaagcactcctcctatctcatatacaatgcttctctgtacttcagttctgctgttcagaagcagtacagagacaaatacggtcagaatgagatgatacccgtggcagcaaatgatgttgctttctcagcccatgctgttctgttgacagcaatttccttgttccagattgcaatctatgatgttagtgctacattccctttaattgggcttattgttcttgcaatgaatttatga

SEQ ID NO: 85204 - DNA, 417 bp, Glycine max
  Peptide Sequence Number=SeqID_201982
atggatgcactagattacctctccaacttttgcactgtaaccagcactaggaccaagcagaaagcaatgcagacaacagagataaaagtgagaatggactgcgatggttgtgaaagaagagtgagaaatgcagtgagttcaataaaaggagtgaaatctgtggaggtgaacagaaaggagagcagggtggtagtgagaggatatgtggatccaaagaaggtgctgaagagggtaaggagcacagggaaaggttggctaaatgacgaatttccttctcttaaaagtatgatgcaaagacagcttgaagctgaaaatgagagcattggttttatttatcaagaaaaaaaacataagtggaatcagaatatagaatcacattccgaaatcccatctcccaaaccagctaaagacctttga

SEQ ID NO: 85205 - DNA, 375 bp, Glycine max
  Peptide Sequence Number=SeqID_201983
atgttctcgtcggagggggagaaggtgtacacaaaggtgctggtagggaagtggaagctgtcgtcgtcctcgatggtgacaatgtcgatgtcgttcatgacggggttgatcgtggggaagaggttctacaaagagttgaagactcaagaagctgacgacgggaacgggtggacggtgatgctcgattacagaaccctgaagactccttccaagagacccttcaagcttccctctcttcctcttgccaaagccattgctgctaaatgggaatatcagatccattcttctcccttcaccatcaagccaacccataacccttgtctctcttgttttgttgataccacttttagcggaaaaaatggtttgtttagataa

SEQ ID NO: 85206 - DNA, 363 bp, Glycine max
  Peptide Sequence Number=SeqID_201984
atgctcatgttaactcaacctggggtcccatacttggaccctaatcctgatcgccaggtggagaaaattgatccattgcttcgttgggtggagtcagaatttggctttaagccagttgtttactccagcttttttggtgaaaagcaggaagatggtcttctaacggctattgagaaccttctaaagaaaacagatgattgtgaattggcagcaattgatgctattgcagcatcagcacattcgttaactttagctattggaatggtgcaggggaaattgcaaattgaggaagcaattgaacttattagacttgaagaggatttctcaggtgaacaggtggggcctcgtagaaggtggtcatga

SEQ ID NO: 85207 - DNA, 158 bp, Glycine max
  Peptide Sequence Number=SeqID_201985
gctcgagcacagttcaatatggtgtggcagcgatagagcttgaattcatcattaatggcatccaatctctccttagtgtactcatcacgactgtcacttatccacctgcaaataccaccacaaacaatatctcagatttgaataacccaatcatcaag

SEQ ID NO: 85208 - DNA, 294 bp, Glycine max
  Peptide Sequence Number=SeqID_201986
atgggtgggacttggcatttgtttgtacaaacttacttgctcatgctgtgttcctttgtacaacttttcctacgtgtacaattatctcatggtttctccaaggagtttcgtggacagtggatcaatattgttcgtaagcatgcaaaagtggttgtagatgatgatgttatcttttctgtctttaagaaatattgtaagtatagttctgattctgaaaactggacaagctggtctgaagggttgaactggaaaagtggatcaatggccagacagtcatgcttccagattaactaa

SEQ ID NO: 85209 - DNA, 741 bp, Glycine max
  Peptide Sequence Number=SeqID_201987
atgctggaagaaggagcaatagttatgatccttactccaacacatacaattaggggggaaagacaacccaaacttgtcttgcaagaagcaaagatactagaggcaagcatcaagagtgggaagccctatgcaaagcttaagaagacaactccaccaccaccaaagaaggaggttctcaccaaggaaaacccaaaaaaagtaaaggaaacttctactgaaggtagtttggagaatgaaaaagaaaatgaggtactaacactttatgagaaaataggcatgggagaaacacaacccagaagcatcaccctacaacttgttgacaagtctattgtctgtcccaggggagtagttaaggatgtgttggttaaagaggaaaagttcatctttccaactgattttgtggtgctagacatggaggaggatgaggatatcccgatcatattggggcgtccattcatgaatacatgtgacatggtcatagaggcaagaaatcccattgatgctttgatggaagcctcattcctaagtgtggggatggaggacccctggaaagagtttttattggcgaggacttggactgttgtcattgccccaactttgaatgaaatagaagatgagaaacttttgagggttttaagggacaacaaggaggcctttaggtggaccattcatgacattaaggatattgaccctacatcgtgctcccaaaggatccaaatgtgtaacgccctgaaattttga

SEQ ID NO: 85210 - DNA, 519 bp, Glycine max
  Peptide Sequence Number=SeqID_201988
atgagggatgggtgggttggtgaatttggagggggagtgagggaggggaagcgttcgtggatgggtgttacgtggcatgctggtgatgtcaagggtggttttgagtatggcctcgttggagatggcagtgacaaagtcaacgtcaatgctagcataacagtcaaagttggaccacgcttactgcagttcttgaggcccaagggtagattgaggttcaacatcatcggtaaagtcgcatgggctcgtatggtagataaagaagtgtcgacggttggagaacaacgaagggaagcgggttggaaattgccatcgtcgaagtacagaaagtatggggaacacaactggtctctagagtatgatatttggactttcgagtctacgatactattgcataggagggttgaaattcctgagtacgaccctgagattgaaagagctcgtcacaagaacaacaatgacacaaggaagagaaggatggttgaagcaaatgctggaaacaggggtaatggaggaaattga

SEQ ID NO: 85211 - DNA, 306 bp, Glycine max
  Peptide Sequence Number=SeqID_201989
atgactaatgcaaactgtctgcaagaatctttgcattcagtctcaaacgagaatctaaggtatgacagattcattctatctatgattcattgttatctgagtcttttggactggagagggacgaccttgaagcaacagtcgtgtttggccattgttgattcaatggagtttgttgagtcgaaccctctcttccaaaaccccaaatccatgtcttattttgtgcttctcctccaacttggtgtgggattggcgtttagagagctgatttgtaaggacaagtctgattgtgctgggaatagatcctaa

SEQ ID NO: 85212 - DNA, 280 bp, Glycine max
  Peptide Sequence Number=SeqID_201990
atgcaattaaaaggtgtgcctcaaggcttttattctctggtaaccgattacacagcattggcaatcgattaccagaggccaaactcgagttacacagtttcagaacatgaaaacctacaatatgcactgtgtaatcgattacacacaactgtattggtaatcgattaccagaggcctcctcaacatactgtctccatttctaagcctggtaatcgattacaccccttggtaatcgattaccagaagccatctcaacttccagatcccatttttaggcctg

SEQ ID NO: 85213 - DNA, 177 bp, Glycine max
  Peptide Sequence Number=SeqID_201991
atggtgagcaaagtttggagctttgatggaggcttcaatggtgaggaagaagaagggaataacaactccctcacgtttcactgcacccgtcggggcccgttttcgaaagaaaacggactaaggcacccaaccctagggtcctttgtgaataagagcctaagagaaacttacccttag

SEQ ID NO: 85214 - DNA, 472 bp, Glycine max
  Peptide Sequence Number=SeqID_201992
atgacatgcggagatacccaagtggttctccgtataaacactctttttctatccgttagactcagagtccgagacggcaagtccgatgacatgcgaagatatccaagtggttatccatacaaactaatttttgttaatcctgacccgagaagggcaagtgaacttgttgacacggagagactaacatcgtcttctgcacctttgtcatctagagacggcgagtccgatgacatgcggagatacccaagtggttatccctacaaaacgattttgttaatcctaaccgagaagtcaggggcaagcgagcccgttgacacgcagagactagcatcgtcttctgcacctttgtcatccagagacggcgagtccgatgacatgcggagatacccaagtggtggcaggcggagatacccaagtggttatccgtacaaaacgatttcagttaatcctgacccgagaagtcaggtggcag

SEQ ID NO: 85215 - DNA, 636 bp, Glycine max
  Peptide Sequence Number=SeqID_201993
atggcggaaaccgcgcttgttcagctcctgctggttccagtagcgccgcgttaccatgccggtctgctgcacgcgacgcacatccgcatcgccctgcgccagcgcatgttgcggactgcagtacagccactgctgctcctcgtacagcggcagcgtcaccagattgctggcgcgcagcggaaagtgtccgatggccaggtcgagccgatcttccagcacctgctgctgcagttcgttgggctcgcacacgctgagggtgagaaacaccgccggaaagcgctggttaaaacgggcgataaccgccggcagatccagcgtgctgtcggtgacggtggcatcgaccacgccgagcgcaaacgtgccgccctgcgcgcttttcagcgtctccacctgcgactgccagccgctcagggtcgccagcatttcccgggtgtaggcgtagaactgttcgcctttgctggtcagcgcaaagcctgcgcgcccgcgctggcacaggataaagcccagctgactttccagttcactcatgtaggcgctgatggccggcgtggtcatgttcagcgcctgctgcgcacgcgaatagccctggttttccaccacgctggcgaacacctgcagcagtttcagattgggtaa

SEQ ID NO: 85216 - DNA, 855 bp, Glycine max
  Peptide Sequence Number=SeqID_201994
atgtttgaagaaattgttgatgaacaaaaagaagacgaagctagtgtgaaatcagaacatgttgattgttcttatgccttaaatacttctcatgtgtttgttacccgtgatgaggtattgaattgggctcgagctgttgcttatgaaattggttttgtgacagtgattatgaggttagacacaaagactgatatgagagaaagggcatcatttgtcttaattgattgtgaaaggagtagtcagtatatggctaggaagaaagatttgtcaatggtgaaaccaagaaatattttactaatgttaaaggagcacaatgccaatagtcatacaacaattaagcaaatatatgatgaaagaagtgcataccgttctttcataagaggtagtaatactgaaatgcaacaactaattaagctttttgaattggatcaatatatttattggcatagattgaaggatgaagatgttgaacgtgatatcttttggtgtcatcctgatgcagtgaagttgtgcaatgcctgtaatttagtatttttgatagatagtacctacaaaacaaacaggtacaaactcccattacttgattttgttggtgtcacaccaactgggatgacattctctattggttttgcctatttggaggaagaaagtctaaataatgttgtttgggctctaggacattttcgaggtctttttctcagacatgatgccctccttggagttaatgttatcgacaaagatctagcattaatgaatgcaatgaaaactgtatttcctgagtgcaccaacttgttgtgttggtttcacgttgataagaatgtgaaggcaaagtgtaaatcccgtgggatcctctag

SEQ ID NO: 85217 - DNA, 240 bp, Glycine max
  Peptide Sequence Number=SeqID_201995
atgaggagaggagctaagagaaagacgaagcaaggtcaagaagccaaacacgatgcacccgaagataacaagcccaaagctcagcatcgagctaaacgagccaagacctccaagcctcaatccgaacctaagtacttcgaagacaagcgcaacttgtgcacgctataccttcctctcttctggtttggagctcttacacatgtgctagtttggcatgctggaagcacaaagaaggaataa

SEQ ID NO: 85218 - DNA, 321 bp, Glycine max
  Peptide Sequence Number=SeqID_201996
atgttgcaattcaagccaaaatttccacgtcaagtattgctttgcagagttggggaattttatgaagcttggggaataaatgtatgtattcttgttgaatatgaggttttaaatccttttggagtgcctgccatcttaccagtctatgagtacatgctgctaataaattttggtctcaacactgcattgtggaggaggcaggctcagggcccaactcaagctcgatccaggaaacgtctctttatatctggattaaaagaaggaaggggcatatggacagaggttaaggcatcatccataacaaacagaaatccaacttga

SEQ ID NO: 85219 - DNA, 177 bp, Glycine max
  Peptide Sequence Number=SeqID_201997
atggtggaggaggagcctgcaagactcgtccagacgaaatattgctcacctgggcgagctgatccaactcagactttcctgggagaaattatgcttgtatgggcaaattttgctctagagaatcatactctaaacatgcatttggatgggggatttagaaatttcttggaaatttaa

SEQ ID NO: 85220 - DNA, 585 bp, Glycine max
  Peptide Sequence Number=SeqID_201998
atggtttatcatagcaaggtggaggatggttcccacatccatttattactctacgtggatgacatgctcatagcatctcaaaattcactggaaattcaggagttaaagtcactacttagtagtgaatttgagatgaaggacaaggtatgtactcctctgacaaagtgcattcgtctatctgaactcaatactacacaatcagaatcacagaaggaatacatgtctcatgttccttatgcaagtgttgtaggcagtctcatatatactatggaagaaacattggcaagttgtaaatttttgagcatgcaaggtgttccctccagagttcaagttttaggagaggaaaagacggatggaggaggccaacagtatttatgggatgatccctacccttacaaggtttgcagggatgatatgataaggcattgtgtgccttatgaggagaaggtatgtctaagtgggttgaggaggggacccatcaccagagccatggctaggagactccaagaagattgggctagagatgcaggagaaggccctagggttctcatgagtcttagggtagattttgagcccatgggctaa

SEQ ID NO: 85221 - DNA, 720 bp, Glycine max
  Peptide Sequence Number=SeqID_201999
atgattagcacttggcccttcaaagtcaaccacttggtggttccttgctttgaaataggcccttctggtgttactgatctgaataggagaaggagggtgaaacagggtattattttttctgtttctcatagttcaaaagttagtgtttctcaatgttcaagagggtatgggactgtggtcttttctggacatgcaaagttggatttgagatgtgggattttgttgggattctctaaacccaaatttggtatcattttcaagccacacaagagtcatgttggagacttagctccacccttggggtgggcactggatgaggaaggcgttgggagtgaattggttgaggagaatattgattctgatgattcatcggttaacagtgagtcgaagtgtgtaaactctttgaatttggatcatgttaaggacagtgaccatgaaggaaaaatgcgtggtgatgacaatagcaaggaaagtggtgggagtgaattggttgaggagcagactgattctaatgatgcatcggttaacagtgacttggagggtgtaatgtctttgaaattggatcaagttcaggagagtgactgtgaagtaaaaatgcatggtgatgacaatagcaaggaaggtgctgacgaagagtgtgatggtaaggttgatgtgagagcacttgccctgagattgcagaccgtgaagaaaagtggaggacgtggaggagattcttaa

SEQ ID NO: 85222 - DNA, 594 bp, Glycine max
  Peptide Sequence Number=SeqID_202000
gtcgattctagaggcccccacgaattgcgttttcgttcatgcatcgtccacccacgagtttggagccatgcgtagtgattgcttattgcaattctccattctctaccccttttttcggagccccatgaattgcgttttcgttcatgcatcctccacccacgagtttggagccatgcgtagtgattgcttagtgcaattctccattctctacctcttttttcggtgccccatgaattgcgttttcgttcatgcatcctccacccacgagtttggagccatgcgtagtgattgcttagtgcaattctccattctctaccccttttttcggagccacatgaattgctttttcgttcatgcatcctccacccacgagtttggagccatgcgtagtgattgcttagtgcaattctccattctctaccccttttttcggagccccatgaattgcgttttcgttcatgcatcttccacccacgagtttggagccatgcgtagtgattgcttagtgcaattctccattctctaccccttttttcgaagctccatgaattgcgttttcgttcatgcatcgtccacccacgagtttcgagccat

SEQ ID NO: 85223 - DNA, 242 bp, Glycine max
  Peptide Sequence Number=SeqID_202001
aggaagcactgggtccaacaaagataggagaaaatcactcaaagtgtatcaatctcacacagtgcgtggcgagaaagtcgctagcgcacaggattttgtcggcaatcaaagggagaggaccactttaggtcgtgggcaaggattgacattctcaccctgggtcaaggtttatgataagttgggattttggctcaaggcttatagaacggctggtcatgatatatgtcagggtttggccagtg

SEQ ID NO: 85224 - DNA, 1314 bp, Glycine max
  Peptide Sequence Number=SeqID_202002
atgaagcagtacactgattcagatagaagggatgtgaggatagagcaggttgcttgtaggctgaaacttctagaatgcagtcatgctgatttgtcttccatttttcattttaaagtagtagctagaattgtcagagcgtcaaccactagcatctgcactttcagggaagtgggagctaaaagtacatcttgcaatgtgctgcagatgaaacaggacatgatggtaaacagggggtgctcaatcagtgcaagatcatgggacaatatctttgaatttcaccttgagggcatggtgaaagtgttggcagagattgatagacacccattgctcacgtatagcactaggaagaagaaacattgggctgaatgtagtgggaaggctaagaggttggtatctgagtcttccttcttgtttggcctttcatacgttattgcagcttcggccatttatgatgaatacagcaatgatattcttgacatgccggaaggatcctgcttccctaggccccagtttcgaaaagatgttgatgcatcgcaaagaacttctaattcaaattccgtttcaagacccagctccttccgaaaggctccttctcgcacatcttcaatgaagaacaacaatattgctgagttgaaatcatttgagctgttggatgccttattcaaggaatgtttccatgttggagaaaaaatggtttctgaaggtataattacaagagaagacatagaagaagccaaatctggtaatgggagtagagtcattagtattggtttgccagcatattgcttagtccagggactcttgcgctctgcaaaattaaattccgttggtataatgattagtgatgaaactgaactaactatcacaaacagaccaagggagacattttttgactggttcgttaatccccttttgatcattaaggagcaaatcaaagctgaaaatctttctgcctcagaagaggactacctctgcaaattagttctcttgggtggtgatgcagagagactgaaaaagtctagcgttggccctgcacctgaatcggacgtcaaacgtgcagaactggaggcattggccagaagactgcaaggaatcaccaaatccatgtcaaggttcccaaccttcaagcgacgcttcaacgatcttgtaagatcgttatctgatgatctgaaggagaaaagtggaggtccaataatgaccagatcaaagagtgcctttgctcggttgattagtttaaaatcattcaaggggacaagagctaacggatctgctcaagggtcacaacatgttgcaagagacttagaaaattcatga

SEQ ID NO: 85225 - DNA, 1392 bp, Glycine max
  Peptide Sequence Number=SeqID_202003
atgcttgaggagatccgtaggaatggccttactccatcccctgtatcctattcacaagccttgttggcatatcggaggatggaagatggcaatggagctctaaatttctttgttgagtttagggaaaaataccatcaaggtgaaataggaaaagatgatgatggagaagattgggagaaagaattcatgaagatagagaagttcacgatccgtgtttgttatcaagtaatgcgctgttggcttgttagtcgtgataacttgagcaacaacgtgttgaagtttctttttgatatggataatgctaggattccactaccgcaggttgatcttgagcggcttgcatgggcttgtacccgtgaagatcactacattgttgtgaaagagctgtacacccggataagaggaaggtatgataagatcagcttgtctgtctgcaaccatgcaatttggttgatgggaaaagcaaagaaatggtgggcagctttggagatatatgaagatttattggacaaagggccaaaaccaaataacttatcatatgaactgatagtctctcacttcaattttcttctcagtgcagccaagaggaagggaatttggagatggggtgttaagttgttgaacaagatggaggataaaggcctgaaacctggaagtagggaatggaatgcagttcttctggcctgttctaaggcttcagaaactactgcagcggtgcaaatattcaagagaatggtggaaaatggtgaaaagcccactataatatcatatggggctttattgagtgctcttgaaaagggaaaactctatgatgatgctctccgtgtgtggaaccatatggtcaaggttggggttgaaccaaatgcatatgcctacacaattatggcttcgatttatactgcccaaggaaattttaatacggttgatgccatcattcaggagatggtaacattaggaattgaggtaacagtggtgacatacaatgcaataatcactggctgtgcacgtaatggtatgagcagtgcagcgtacgaatggtttcaccgaatgaaagttcagaacatctctcccaatgagataacttatgaaatgctgattgaggcccttgcaaatgatggaaagccaaggctggcatatcaattatacacgagagctaaaaacgaaggccttaccctctcttcaaaagcttacgatgcagttgtccaatcctcacaggctaatggtgcaaccattgaattaggtcttttaggacctcgccctgctgataaaaagaagaaagtgcaaattagaaaaacattgaatgaattctacaacttagctggtgttcccaaaagaagtcaaccgtttgatagaagtgaaatttatcactcacagacacaagaaaatccataa

SEQ ID NO: 85226 - DNA, 261 bp, Glycine max
  Peptide Sequence Number=SeqID_202004
cacacgaggagatggcgccaccaaactagaggcacaccattagctagcgcctcttgggaagcaaaccatgacctagtgtttcctgcactagtgcatcctcaagaacatgcagtcaacttccaccgctctaggaacacgcgtgtcagcatcaaggaaacaaactctatcagagacatagtgcaatatggtgcttccttggtggagacatatacggtggcaccacctgttttgacagcccacctgaaaaggtggtatagatga

SEQ ID NO: 85227 - DNA, 204 bp, Glycine max
  Peptide Sequence Number=SeqID_202005
atggcctctgagcctaactgccgttcatgcttaatggacgaagggctaactgcctcgatcaatgagccgatttcgaaccaactagtttgcggcaggaaaagcacgagctcattgccagaagcctccgagaggcatggccttcgaaccgcgaatctgacatcaaggggacggagacatcgcatgcccttcgtgaggcggggttaa

SEQ ID NO: 85228 - DNA, 240 bp, Glycine max
  Peptide Sequence Number=SeqID_202006
atgaccacgagttccacaaaccaaatccttgcagcgagcacaacttccacaaaccaactccttgcaacacaaacaaacaaacatcttgtagtgagcacgagttccccaaacaaacaaacaatacaacatgttaaagacaacaaagagtcacaaaacatgtacctaggtaaggtgctgaggtgtcacggtcacaaagaagaagaagacaaagatccttgcagttacaaagaagaagactaa

SEQ ID NO: 85229 - DNA, 220 bp, Glycine max
  Peptide Sequence Number=SeqID_202007
atctcccataggcaatttagttcctctggacttggagattgaagctatgttgagaaggaacagagccgagaggagaagaacattattgcaagacaggatagtagcgtccattcttgaggaagaaactcaattttttgattcttcatcacctgattcaccatcatcaggggaatttgtgacctatttgccaaaagtcgtttccatggcagatgagcactag

SEQ ID NO: 85230 - DNA, 216 bp, Glycine max
  Peptide Sequence Number=SeqID_202008
atggatttgaagagtggatactatcaaatccgtatgaaagaaggtgatgaatggaaaacaacttttaaaacaaaatatggtttatatgagtggttggtgatgccatttggtttaactaatgcacccagtacctttatgagctcaaaaggaatatgtatggatgaagaaaaggtaacggcaatcagggaatggcttgtacctaagaatgctaatgag

SEQ ID NO: 85231 - DNA, 294 bp, Glycine max
  Peptide Sequence Number=SeqID_202009
atgaagaacgtcgaagaacggtcgaaaaccttcacgaaatcactcacggaaatgttacggaagcgcctcggcttggattttcttcacggaaacaatttttctaagcaaattcgaaagagagagaagggagaagcttgccacccagctcgcccaggcgagcagggttgcttcctccagaagcaacaaccttctaatctgcccctaggttcacctgaggctcatgcacgatgcccctcattgccccagtgtaaggctttgaggtaccaattgttatctttcgtcatgaccttgtaa

SEQ ID NO: 85232 - DNA, 138 bp, Glycine max
  Peptide Sequence Number=SeqID_202010
atgtctggccagggcttgaagaaagtaaaaaaagggcaaggatcctgggaaaaggaatatggtatacggtcaaagcaggtcaaaagcttacaaaaggacattattggtcaggctattgtgggaccacccacaccctaa

SEQ ID NO: 85233 - DNA, 453 bp, Glycine max
  Peptide Sequence Number=SeqID_202011
atgaggtttagccgaagcagctccaagcttggaaatgggcacaaagcaacaccacccattgaaaaggattgcagaagcattggtgaaatccaatgggaacttaggcctggtggcatgcttgttcaaaaaaggaagagtaaccaaagtgcaggggagggaatgatcacaattatagtgtcaactatgtcacaatctcaagaaatttctattgaggccacatcaacttttggagaattgaaaatgattctttcactggtaacaagttttgagcccagagagcaaaggcttctcttcaagggtaaagagagagatgatgatgaatatctacatatggttggggttagagaaaaggacaaggttcttctgttggaggatccagcaataaaggagaagaaactgcttggcttaagagaccaacccattaacaatcctagtcgtgccatcagtgtatga

SEQ ID NO: 85234 - DNA, 4137 bp, Glycine max
  Peptide Sequence Number=SeqID_202012
atggcatcaaaccagaccctgaaagagctacaatgggttcagcaagcaatcaaatctgaggccctaaatctgcaaagtatttccttctacctctctcaaccaacctcaggctgttatcaagaaacagacaactccataagcataaacatttccaaggaaaatcttccattcttttccctcctcttgacaacactagcagcacctaggagtaccaactcttcctccttgagaaacttggagttccacagagttgaatgggactcacaacatgtaagaaatcttggcaccttgcttgggaataaccaaaatgtacaacaagtggtttttagaagaaacaggttcaatggaaaaagcctgttagagctttctgacattctgaagacaaataaagtgatcaaagagatcatgctttcagaatcaggtatagggtctgttggagctggactcattgcttctgctcttatggtgaatgatagtttggaggagcttcagatatgggaagattcaatagggtcaagaggtgctgaggagctttccaagatgattgaagttaactcaactcttaagcttttgacaatttttgactcaaatgccatcacagctacccctcttatatcttccgttttggcaaggaacagaaggatggaagttcatgtttggagtggggaaaatggggacaaaagttccaaggtggttgagtttgtacctgagaacaacacacttaggatttacaagcttaacctgtcaggcacttgtagggttacttgctctttagggatgaacttcaccgtgaagttgcttgacatgactggtgtcaagctaaagtcgcggtgtgctaaggaatttcggtgggttttggaacaaaaccagaccctcaaagaggttaacttgtctagaacatgccttaaagacaagggcattgtgtatgttgcagctggcctctttaagaacagaagtctgcaaaccttacatctaagtggaaatttgttcagtggaataggtgtggagcatctactatgccctttgagtagattttcagcactgcaaatgcaagccaacactaccttgacatgtgttacttttggaggagggagaacaagaataggaagggatggtctagctgctattatacagtttcttataaccaatgaaacagtgaggaaattggggattcatgatgatgagagtttgagatcggatgacttcgttaaaattttcaagaatttggagaagaatgctagcttgaaatgcttgtctctacaaggctgcaaacgtgtggagggagagacattgctgcagacaattatggagacactgcagataaatccttggattgaagatattgatctctcaagaacacctttacacaactctggaatgactcgggggatttatcagagattaggccagaatgagaagactgaaccagaaatggatttggtcaaggacatgccactaacagaacccaagagttgcagagttttcttttgtggtcaagaatgtgcgggcaaaaccacactttgtcattcaatatcacaaaatttctctgcttcatcacttccctacttcgatcaagtcagaacaattgtgaacccagtggagcaggctgtcaagacagcaggaatgaagataaaaactttcaaggatgaggatacaaggatttcaatatggaaccttgctggtcagcatgagtttttatccctccatgatcttatgttcccagggcatggaagtgcatcatttttcatcatcatatcaagtttattcagaaaaccaagtaacaaagaaccaaaaagttcaactgaaattgaagaagacctgcaatattggctcaggttcatagtttccaactctaaaagggcaatacaacaatgcatgctaccaagtgttgctgttgtactcacacattttgataaaatcaaccaaccatcaccaaatttgcagcacacagtagattcaattcagagattgagagacaagttccaaggttatgttgaattctacccaactgtattcacagttgatgcaagatcatcagcatcagttagtaaactcactcatcatatccgaaagacaagcaagacaattctccaaagagtgccgcgagtttatcaactttgcaacgatttgatacagattttatcagactggagatctgagaactacaacaagccagcaatgaagtggaaggagtttggtgagctatgccaagttaaagtcccgtcgttgagaattcgatcaagaaatgataataaagagagggtggaaatgaagagaagagctattgctacctgtcttcatcacattggtgaggtgatttactttgatgagttggggtttctaattttagattgtgagtggttctgtggtgaggcacttggtcagctgataaagttgaatgttaggaagcaacactcctcagaaaacaatggatttgttagcaggaaggaactggaaaaaatcttaagaggaagtttgcagagccctattcctggtatgggttcaaaggtatttgagaacttagatgctagtgaccttgtgaggatgatgttaaaacttgaactctgttatgagcaagacccatcagatccaaattctctgctattgattccctcaattcttgaagaaggaagaggaaagcctcagaagtggcagctaagcatgcaagactgtgtttatgcgggacgtcatcttgagtgtgatgattcaagccacatgtttctaactccaggattcttccctcgtttacaggtgcaccttcacaacagattagaggctttaaaggatcaacatggggcaacttacagtcttgagaagtacctcattttaatcagcattaatggaatctacataagagtagaacttggagggcagttgggttactatattgatgtccttgcatgctccacaaaaaacttaactgaaactttaagagtcattaatcaacttataatccctgcgatccaaagcatttgccatgggatcaccttgactgaaaatgtcataagacctgaatgtgtgagaaaattgacaccccctagatacagaaaaactcaatttgcttccctgcagcaactgaaacaagcactactttcacttccagcagatggcatgtatgattatcaacacacatggagtccagtcctagactctggtaggcctattctccaagatggatttgattttgcgcgagaccttttatccgatgatgacttccgggaagtgttgcaccgaaggtatcatgacctgtacaatctttcactagagctgcaagtcccacctgaaaataaccctgaagggcaaggtcaatctgtaaccatgattgatgaagctgcaaaggttgaaccaacctttggtggcattgcaaaaggggttgaagcagttttagaaagactcaagattattgaacaagaaatcagagacttgaaacaggaaatccaggggctgagatactatgaacatagacttctccttgaacttcatcgcaaagtgaaccacctagcaaccttcaatgtccaggttgaggagaggaaagtccccaacatgatctattttgttaagacagaaaactacacaaggagactggtcaccaccatgctttctggcatgaatgctctccggctccacatgttatgcgagttccggggacaaatgcatgttgttgaagatcagatggggtgtgaaatcatgcaagtcgataatgcagccgtgaagtctttggctccatacatgaagaagttcatgacactggtaactttagctcttaaaataggagctcatcttgcagctgggatggggcaaatgataccagacttgagcaaggaggtggctcatttggctggctcttcggttctgtatggtgcagctggggcaactgcagctggtgttgtaggggcagccgctataggtagcagaaacaggtccagggaaggttcaagggacattcaacaagacttaagagcagcacagcaatgggtggttgatttcttaagggaaagaagctgctcctcagggaaggatattgcagagaagtttggactgtggcgagtaaggtatagggacaatggtcaaattgcatggatatgcaggaggcacatgtatgccagatctgcagagataattgaagtgcctgtttga

SEQ ID NO: 85235 - DNA, 414 bp, Glycine max
  Peptide Sequence Number=SeqID_202013
atggaatggttaccccccagccttgagaatttgagaatttctgggtgtgtggcatatgctcacataaggcaaggtaaacttaaaccaagagctctaaaatgcatgtttctgggataccctcaaggagtgaaagggttcaaattatggtgcatggaagcaagacatccttgggaagtcttaagtcaacaacaatcagaagtagatgatgataagagtattcatttagaggtggagccactacacaatttaacaacctcagacgctaaagttgaaagtcaggagcagaatggtgctaacactcaaccaaatttacaagacaatctcttagctagtgatagacaaagaagatctaatagcccaccaactaggtttgattatgctaatgtggttgcttttgcacttaatgttgcatga

SEQ ID NO: 85236 - DNA, 821 bp, Glycine max
  Peptide Sequence Number=SeqID_202014
cgcatagtgcattgatcctatctctgggtgacaaggttctaagagaaatatcaaagaaaaagattgttgatgctatttggttaaagttggacaacctatatatgaccaaatctttggccaacatgttgttcttgatgcaaaagttgtataccttcaaaatgcaaagcattggaaatcacatagatgatttcaataagatcattcttgatctggaaaacattgaaaataagcttgatgatgaagattgggcattgttattacttaggtcattgccaaaattaaagaggaagtctgaagaaagaggtgaacaagatgctgaagggctatacactataagtgggtcagaaaagaaagattttaagaacaagaaagggtcgacatccatgtcaaaggagggaaagaagagaaaatgcttcatttgtgtgagtgaagagcgtctcaagaaggaacgccttgaatacaagaagaaaaagaaacatggcgatcaaagaaatcataatggtgatgctaatgactggttcaactcacatgatgaaagccatggagggcaggttctacttggcaacaacaaggcctacaaagtgataggtattagacttgttaagctaaaacatgctgatgggaaaataagagccttgcaagaagtgaggcatgtacctaatttaaagagaaatataacttctcttgaaatggttgataaacaaggatatgtttgtaaagctgaaggtggacttctaaaggtcacaaaaggttctatggagcttatgaaaggaaaactagaagatggtttgtattgcatctccttcaacaaagcattctga

SEQ ID NO: 85237 - DNA, 228 bp, Glycine max
  Peptide Sequence Number=SeqID_202015
atggaacaagagcttgaaggaaatggaatgtacatgcctgtggaccttaaaactagattggtcaatgctaaagatgaggggaaagaggtttgcatcagctatttgaagattggtagggactattgtacaaggaaaaggatcttgatggaggattataggtttacttgtggatgtgataggtgcaagattgaagctaattgggatggtgaagaaaacaacagtgactga

SEQ ID NO: 85238 - DNA, 333 bp, Glycine max
  Peptide Sequence Number=SeqID_202016
atggctgggaactcttcaaatagtgtgaaggaagacaatatggaagacatagagaggcatcacattgagatagatgagggagagttcagtgatggactcccttataagcctagtttgattcgttacaagggttcatatgctaatcagcctgtgtcatttctatcaagtggcttaatccatttagaaactgtacaagttatagttgatgctgaagagactaataggattggtgtcaacaactctgctaatataggcacagatggagacaatggtggtggaaaagaagaaaggcttcttcaagtggaagtaaatattaggcaagagtgggcatga

SEQ ID NO: 85239 - DNA, 300 bp, Glycine max
  Peptide Sequence Number=SeqID_202017
atggttgtggagacagagccctttggcagcgacgagaatggcaaagaggaggaggaagaaggggtggtggagatttgtgtccctgaccgtggcgaaacacacaatagaaagggagaagcggatgtcggagggatggatgccgtggctggaaggctttgtgtgggaccggagactggcggcagggagggggaaggtgggaatctactatgggaaaggggaggcggcatagtttttgctgttggtggaggcggcgtagataatgctattggtggtggcttagcagaggaaaaagatgggttg

SEQ ID NO: 85240 - DNA, 627 bp, Glycine max
  Peptide Sequence Number=SeqID_202018
atgggtggtgacttcgcagaggcagaagatggagagggttgtctgggtaccatggtattcaatatttggagaatggcatcaagtttggaagccatggaagtttgggctgcagtgagtttggctatggcatcctcaaggtggtcaaaagtttggtgtctgccattgaagagcggcaggatggaccaattgttagcggtggttcctttaagtttgagactaagggaagtctccaaatttccatggcagagcatcttcttcctaacatccaaggtatacccccaccaccatactaggaggagcaacatcacatcaagatttggccaaattctccttcttgcatgtgatcaaaaacacaaaaatctcggtgaagaatggcgtcgttgcgccgatggcctggttgaaggaaacagggaggtagcagagagaggtgttgccgtagacaatggagaagcagaagatggcgctaagagcgaagatcaacttcccaaaacctcgtcacggtcttcagcagttgctgtcacaacatcagcatctgcatctgctcatgcaattggaatcgataatgattccttagttaaaagtatattataccctgcactctccctttccaacattcttcacttcaac

SEQ ID NO: 85241 - DNA, 412 bp, Glycine max
  Peptide Sequence Number=SeqID_202019
gaagccacaatcaagagcttgggcaaaaaataaacatggttctataaagaagaaaaaggatgctgctaatgatgatattgatgattgggaacttccacatggaagctttgaaaatgttgaggcaataagaaaggatggcataaagtgccctttgttgtgcaaagaattcatcatagatgcatggcaactctactatgctcaaactaaaagtgcagatgtagtccttttaattgttgttgttttgcctgatcttgacatcaaatacatgattaaaatatgcaaattactcagattgactgcacttgttgagcaagaattgaagtgtattagattcaaagtgggtcactttgactacgtcgctttcatggccacgaccgatgtagaattccagacgttctacatcggttattag

SEQ ID NO: 85242 - DNA, 606 bp, Glycine max
  Peptide Sequence Number=SeqID_202020
atgcagctgtcttctcaagaggaggctataaaacagaaggatgtcttggctacagaagtttcctctcttagaggagagttgcaacaagtaagagatgagcgagaccggcaattatctcaagaaaaatgttctttgaaagataatcagataaaggcattggaagagcaactagcaactgcagagaagaaactgcaggagttaaaagggaacattcgtgtactctgtcgagtgaggcctttattagctgatgaaagttgtagcacagaaggcaagattttcagttatccaacatcaatggaaacttctggacgaaccattgacctagcccaaaatggccaaaaacattcttttacatttgataaagtttttacaccagaggcatcacaagaagaagtttttgtacaaatctcacagctggtaccaagtgctcttgatggttacaaggtttgcatctttgcctatggtcagacagggtcagggaaaacctatacaatgatgggaaggcctggacatctagaggagaagggcttgatacctcgttcattagagcaaatatttcaaacaaagcagtctcaacaacctcaaggttggaaatatgaaatgtag

SEQ ID NO: 85243 - DNA, 297 bp, Glycine max
  Peptide Sequence Number=SeqID_202021
atggaagaacacgaacaacaggaagcaactagctctctctcgacacaagcaatttcactctctcgattttgcactgcactgctcctaggctactacactgcttcaatgggacgtgacatagcaagctcaaatcgccaatcaacctggcgcttccagtgtggcaggcggaaatcgccagtgagcctggcgtgccccccagcccttgccacgtgtccatcatgcacgaagtcgccactcccacttgcgacttgcatgctgggtacgtgcaaaaacatcaccccctggaaaaatgtttga

SEQ ID NO: 85244 - DNA, 552 bp, Glycine max
  Peptide Sequence Number=SeqID_202022
atggtggactacgtgggcccagtggagagtttggatgcgagcgagatcttccttggttggtctcttgctactattcaccactggaaggaaacaatggccaaggctaacaacaagacaaaaacgatggccgcgaagctgaagtcgatgaaggtcgaggttggcaagactaaggaactcaagctagagttgcccaaaaatcaacaagtgaaagatattagcgccaaggtgaaggagctaacctctgagaaaaaaatagtggaggagaacctaaccactgcaaaggacaaagttgcagatctggagaagaaaattgaagatttgaagagcgagttgcgaaagaaggaggaagtgaagtctacactgacggtcaagtttgacaaggccaaaaggttgatcgtccttaaccatcaagaaggtttcaagaaggcacaacgtcaagtcaaagtgttgctcccttcctccgacttttcacaactcgatgtgaattgtgacgtcgttgacggtgagattgttagagagtcccaactttgctttgagtctaagggagaatag

SEQ ID NO: 85245 - DNA, 164 bp, Glycine max
  Peptide Sequence Number=SeqID_202023
aggaggagttgaaaaggaaagttgacatgacgaccttggacaatgtcgagttgttgatcgtcgagccctgtaggacagaggagtgtgtgtttataagggcatgtaaggaaatcatgaacggctacgactacaagaatttgaagagcttggtggtcgatgactaa

SEQ ID NO: 85246 - DNA, 399 bp, Glycine max
  Peptide Sequence Number=SeqID_202024
atgccgccaaggactaagtcgccatcaacctcggcaacaccatctttgatgctaagcgtttgcatggaaggagattttctgctgcctccattcggagtgatcggcagttatggtgaggacaagcagtttgctgtcgaggtaatttcttccatggttttcatgaagatgtgtgagattcagcttccttccatagttgttgttagcgatcagtttttcggtaaatccaatgttcttgagtatttggctggtattagtctgccacatgaccaaggcaattgtattagggtgcccttggatatgaggctctgcaatccccctattccaaccccagagcttgtgttggagttctatggcaaggccattagtcttaccaatcagagagagaccactctcctctag

SEQ ID NO: 85247 - DNA, 1020 bp, Glycine max
  Peptide Sequence Number=SeqID_202025
atgatatctgagtccctcttgttagtattcctcattgtcttcatttctgcttcccttctcaaactcttgtttgtgagaaaaaacaaaccaaaggctcacttgaagtaccctccaagccccccagcaatacccataataggtcatctccacctccttaaaccactcatccatcactcattccgagacctttgtctccgatatgggcccctcctaagccttcgaattggttccgttaagttcatagttgcaagcaccccatcactcgccaaagagtttctcaagaccaacgagctcacatactcttcccgcaaaatgaacatggccatcaacacggtcacctaccacaacgccactttcgcgtttgcaccttacgacacttactggaagttcatgaaaaaactaagcaccactgagctcttgggaaacaaaaccctcggacacttcctacctattcgaactcaggaagttcatgactttattcaaattttgttccataaatcaaaggcccaagagagcgtgaacctcaccgaagcgcttttgaggctttccaacaacgtcatatcgcggatgatgttgagcattaagagctccggaactgatagtcaggcagagcaggcacgggctttggttcgtgaagtgacgcggattttcggggagtttaacgtgtcggatttcttagggttttgcaaaaacatggacttgcaaagtttcaggaagagggcattggacatacataagaggtacgatgctctgctagagaagatcatctctgatcgtgaggagttgagaaggaaatcaaaggaagagggttgtgaagatggaggtgatgagaaagttaaggattttcttgacattttgctggatgtttctgagcagaaagaatgcgaggtccagttaactcggaaccatgtcaaatcattgatcttggcgagtcctggtgcagcggtaaagttgtgtcttggtgagttgttggtcatgggttcgaatccggaaacagcctctttgcatatgcaaggataa

SEQ ID NO: 85248 - DNA, 666 bp, Glycine max
  Peptide Sequence Number=SeqID_202026
atggaaaaagattattttacggcagctactgacacaactgccatatcagtggaatggacaatagcagaactatttaacaatccaaaggtgttaaagaaagcgcaagaggaagttgatagagtcaccggaaacacgcaattagtgtgtgaagcagacattccaaaccttccttatattcatgccatcataaaagaaacaatgagacttcacccgccaataccaatgattatgaggaaaggaatcgaagactgcgtggttaatggaaacatgattccaaaaggttcaatagtttgtgtaaacatttgggctatgggaagggacccaaatatctggaagaaccctttagaattcaagccagagaggtttctagaaggtgaaggaagtgctatagataccaaagggcatcattttgagttgttgccatttggcagtggaaggagagggtgtcctggaatgcctttggccatgcgtgaattgcccaccatcattggagcactcatacaatgctttgagtggaagatgttaggttcacaaggtgaaatcttagatcatggaagaagcttaatcagtatggatgaacggccaggattgactgccccaagggccaatgatcttattggcattcctgttgcacgattgaatcccactccttttcgtcaaatgtag

SEQ ID NO: 85249 - DNA, 300 bp, Glycine max
  Peptide Sequence Number=SeqID_202027
atgtcgccttcctcggcctcgtcgtcgattccccgtgcaaccgcctcctcgctgaagacggtgttgccgtgggagaggaagatcaagtggtctaagagagattctgtagctaggttagtgaatggacatgatgaagatgaagagcacgatggggttgtggatgatgtcggtgccgatggagacgcggcgacgttcaccaccggagacgctgcgatggcccttgtcgccgatgaccaaaagagggagaagctcggaagacagagagaaaagatctgtgtaaacaatttcatcttatcttaa

SEQ ID NO: 85250 - DNA, 615 bp, Glycine max
  Peptide Sequence Number=SeqID_202028
atggttgattatgagtatttgaagatcgttgttgggggtggagtttctagcgggaataattctatatcagtcgatccagatgatactgatgcaacaacttttgagccagaaaataaaactgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaacgttctggaaaatctttctgttggcattgagactattgctgtgaattttgaaaaaatatccaacatgatggagaaaagagaaaaagatagagatagagatagagagctcgagggtattatttgggatgttataaaagaaattccaaatttggatgacataacgcgtttcaagacagctgaattgttaaatactaaagcaaaaaaggattttttcttgaagatgtcaccggaagaacgctcatcttggataaactttaagttagggaataattaa

SEQ ID NO: 85251 - DNA, 2498 bp, Glycine max
  Peptide Sequence Number=SeqID_202029
atgaattcgtctctgcgtttgttttcttccgagctcacctgtcctgcgagtgaatccacgcaaaacgcgaatgtgaacttccttctgtcaagaccatcattaagggtttcttgtttcgttaagaaaggtggtgatgctcgagtaagagtaagtaatcgcgatggaaggaaaacgaaggcggtggtttgttgccaattgatgcatagccacaaggaggagtcggatgagagaaagagaaggctacaggtggtgcctgtgcctgtgcagaaggcagattttgtgaggacattgttgattgacaactatgacagttacacttataatatattccaggaactatctattattaatggcgtgcctcctgtggtgatccaaaatgatgattggacatgggaagaactttgccattacttatacaaagaaaatgcttttgataatattgtaatatcacctggacccggttctccagcatgcccggaagatatagattttgtgctccaaatgtccattcttgggcgtgaggtgagtgtgttaagatgtcctatgtcagctaggaatataattaaaatactaaggtttggacaatcctccttccttgagttagcttttgtggttgagtttgatccgttgtgggttatgtggccctatggatgtttcaattacaattgtaaaatattttggaacgctgatatccctggtggcaacgtggctcgagaagttggcatttgtcttcagctgttgcttaagtgctgggatattcctattctgggtgtttgcctaggacaccaggcattaggttatgtgcatggagctcaagttgtccatgcatctgaaccaatccatggtcgtttgagtgaagttgagcacaacggctgccagctttttcgtgatataccttctggtaaaaattatggattcaaggtggttcgatatcattcactggttatagattctgaatcacttcctgcagagctcattccaatagcatggacctcttccactagcacacttccatttattgggtccaaagattttggcaagtccaatactcatgaagctcagccagatcaaagcatttccattgatcctcttttagctaaagtaggaaatggaagttcaaaccattttgattatggaaaaactagaagtgcaagagttcttatgggaatcaggcattctacaagaccacactatggtgtgcaggtttcaagtgctaatagactctacagagaggtttgcagaagtattagcacagagaataatgcagtggatcagttaaaagaaatagttcatgcagatagacatttggaatataataaagctgagatgaagcatttagaaatgttcaacatggtaaatactcatcatgcaaccactggttataagtgtttgaagttgaaatggaggaaatttggtcacttggctggtcaagttggtggagcaaaaggtatattttgtgggttgtttggacttgaagctgaaaacaccttttggttggatagttcctccacagagaagggggccaaagcccatgactacaaagcaactctacgggtcataggaagacccatagcatccctacaaattaaaggaacacaccctgaagggaagagcacgcttttcatttatgggaggaaaaggcggatcactttggaagcagttagtgttcagattgtcccatcaaaggtgttggtgaatgggtttcttgaaaataattggtctgcttgggttctgttgtatgcttcacgagttgagcttgatgggagttcaaaaggaggtggttatttgtcaactgaagattctcaaggttctgctgaaacaatatttttggaagaaggttttcttgattttttgaacagggtactacagactgaaaccatgtataacctcaaagttgagtgtggtgtgaaatcgaaccgtcacaaatctaaaactcctgatgcatgctttttctttgctgataatcttgtagctattgaccacaaaaatgatgatgtttatatattggctatacatgaagaaagttcaagtattacacagtggttgaatgacacagaggagaaacttctgagcttaaatggctctgtgagaatggctttggaaagacaaaagtctcttcctttaactttttcctcatgtaaggttggttttgcagctgaaaaatctaaagagcagtacattgaggatgttaagaagtgtctaaactacattaaagatggagaaagctatgagttatgcctcacaactcagataaggaaatcgattgaggaattgaattcccttgaactttatctgcatttgagagaaaggaatccggcaccttatgctgcttggcttaatttttcaaaggtggatctgagtatttgctgttcttctcctgagaggttcctgcagttggataggaagaatatactagaagctaagcccatcaagggaacgatagctcgtggtgctactgaagaggaagatgagcaactaaaatttaaattacagttcag

SEQ ID NO: 85252 - DNA, 360 bp, Glycine max
  Peptide Sequence Number=SeqID_202030
atgtcttctgatcctgcgaaagaccttgccaaatggaaactagaagaagttatttcaattgttatagtgtgtgtcgtctttcttacactgagccattgcttcggcatatttaagcatcatgtgtgcggaatttgctgcggtagaaaccagtctcttcccacgtttcagttcaagaaaaacgagagagaacaagacaagacaattagtgtggagtgtgccatctgcctcggagagtttgaagaaggggagtggctgaaacgtcttccacactgcagccatagtttccatgtttcatgcattgcttctcacacattgctacagcctttgaggagggaggactttgaaagggttcagagataa

SEQ ID NO: 85253 - DNA, 861 bp, Glycine max
  Peptide Sequence Number=SeqID_202031
atgggagaacacgagttaaggcagaaacttatgaatgccagacatgaacttgagaaaatgaaaaatgtcaaggcagaattgcttgatctgttgaacatggcataccaagagagggatgaagcaaggtgtcagttacagaagctgatgaatccattcatgccctctaatccaacccatttgcaaaacgtgtttgatagccaaagtcatctcatgttcccttctgctaaggcaaactcaagcataacagaatctgacaatagtctctcacacggttcctcacaagtggattccttttttgacacagtctcttctccagagtttacaaatgtcaatgcagttgaccctattaacataatgagttatctcaaccagcatgtggttcttcaggacttcaatttctcagcaccgcatgctttgatggttccttcagaaaagccaatgtgtgacactgccgatgcagttatagattgtcttgccaaagacagaggttttccccaaaagggtaaattcgttcaggctgtgatggatgctggtccattgctcaaaacattgctccttgcagggccacttcctaaatggagaaacccccctcctttacaaaacatcaaagttccacctcttaccataaaaaaatgtgatgtcaatagcattgtgcctaatacttttggagacactggaaatacgcttctgaaaccgcagcttccagccttgcattatttaaatgctacctccacgtgttcagcttctatgcttaactttgctggtcaaaccaatggttcatcgtacaatacatcgcagttgaattcaactcctggtgtcagcatccaagtcccttcaagcaagcgcctgaggcatcaatga

SEQ ID NO: 85254 - DNA, 921 bp, Glycine max
  Peptide Sequence Number=SeqID_202032
atggaaattgatctttctccccagttggccaagaaggtgtatgaaagcaatggtgggtcttaccatgcatggtccccttctgagcttcccatgttgcctgaagggaacattggtgctgccaaactagctcttcaaaaaaatggttttgcccttccttgttactctgactcttccaaggttgcatatgttctccaaggaagtggagttgcaggaattgtgctccctgaatcagaagagaaggtggttgcaattaagaagggtgatgctttggcactcccttttggtgtgataacctggtggtacaacaaggaggacactgagttggttgttctgttcttaggtgacacttcaaaagcccacaagactggtgaattcactgatttttacctaactggttccaatggaatcttcactggcttctcaactgagttcgtgggaagggcttgggacttagaagagaaggatgtgaagacccttgttggaaaacaatcaggcaaggtcattgtgaagcttgaaggcaacatcaatcttcctgagcccaaagaggaacatagaaagggcatggcattgaactgtgaagaggctccattggatgttgacattaagaatggtggaagggttgtggtgttgaacaccaagaaccttcccttggttggtgaggttggtctaggagcagaccttgtgaggctggatggaaatgccatgtgttctccaggattctcttgtgattctgcctttcaggtcacctacatcgtcagaggaagtggtcgtgctcaggttgttggtgctgatggttgcagggttttggagacaactgtgaaggctggtaatttgttcattgtgccaaggttttttgttgtctcaaagattgctgactctgatggattggagtggttctctatcatcaccacccccaagtga

SEQ ID NO: 85255 - DNA, 135 bp, Glycine max
  Peptide Sequence Number=SeqID_202033
atgtgggttaaaagtagcactgtttactacttaatgtttgagtctatattcaggattgatgcattgctcggaggtggactacgtggaggaaaattaactgaactcgttgggtcatcctcgtctggaaagacacag

SEQ ID NO: 85256 - DNA, 432 bp, Glycine max
  Peptide Sequence Number=SeqID_202034
atggcttcagccaaatttcaggaagttaaattacaacagattagcaatccaccgaagctagtttcaccatatccacctattctacctactccacccgattttactgtcactaaacctgtgactacaattggagaccatttatcctctacgctgactacgcacaacacacacatttccaacacacctagccaacccaagcaaactattcagagattgacacaggctgagattcaagcaatgtgtgaaaaaggcttgcgtttttaccatgaaaaagatgagtttgcatgcattaaccagtattacagcaccgcaaacattgtgcttcaaagttcaaagaagctacatgagaagatgaagataccattggtactacttatcctgatctcaaccttgaggacaatgttgaagtgtaagggaggaacattgatatga

SEQ ID NO: 85257 - DNA, 1476 bp, Glycine max
  Peptide Sequence Number=SeqID_202035
atggattgtagtaacgagttggatatgcaagaaccgagcattgagacggataagcttagttacgaaatcttctccattctcgaaagcaagtttctcttcggctacgacgatccaaagctctggttccccaagcaaatacctcccaagccggaatctcagactccggcagctaccgccgccgtggactgcgtctccgcagtcaagaaccagcgcggcaagatatgcattctcgccatcgacggcggcggcatgcgcgggattctcgccggaaaagccctcgcctacctggaagccgcgctgaagaagaaatccggcgaccagaacgccaccatcgcagactacttcgacgtggccgctggcgccggagtcggcggcatcttcacggcgatgctcttctccaccaaagaccaccgccgcccgattttctccgccgacgacacgtggcggtttctggcagagaaaggaaacaaattctaccgcgcgggaggcagcgcaagcaaccgggggttgctgaagaggttactttccagtggaggttccggctcggtgtcgtcggcgacggcgggtttggagaaagcggtgaaggaagcgttcacggcggagaatggtggtgggagtttgactctaaaggacactctaaaaccggttctgattccgtgctacgacttatcgagtacggcgccgtttttgttctcacgtgcggacgcgttggaaacggatagcttcgacttccggttgtgggaggtatgtcgtgccacctcggccgaaccgggtttgttcgaaccggttcagatgcgttccgtggatggtcaaacaaagtgcgtggccgtggacggaggtttagcgatgagtaacccaacgggggcggcaatcacgcacgtgctgcacaacaagcaagagtttccgttcgtgcgaggcgtggaggaccttcttgttctgtccctcggaacgggtcaactattggaggtgagttacgactttgaccgagtcaaacgctggaaggccaaggattgggccaggcccatggcccgcatttccgccgacggctcctctgacctcgtcgaccaggccatcgccatggcctttggtcagtgccgcagcaccaattatgtccgcattcagctagcaagttggatgagtatgtatgggggtagcaatagcatagctggatttggacttgttagagggatatctattgatgaacgggcaaatgggtcaagtatggggcgatgtggacccaatgtggatacagattcaagtcccggcaatgtgaagatgctagtaggaatagcagaagagatgttgaagcaggagaatgtagagtcagtactgtttggaggaaagagaattggggagcagagtaacttcgagaaacttgactggtttgctggagaacttgttcaggagcatcagaggaggagctgcagaatagctcccactgttgctttcaagcaagcaaccccaaaagcgacttag

SEQ ID NO: 85258 - DNA, 201 bp, Glycine max
  Peptide Sequence Number=SeqID_202036
atgtcgtgggtcccacaacaggaattgtgttttgagcaatggagcatcatcgccaatgagccaccgacacttgtacaccgtcaatcttggttcttcccatccatggctcagattgcaccagcactattttcctccgtgatcaacgggaagaattgtggtggtggttacgtgtgggagcagggtttaatttatataggttga

SEQ ID NO: 85259 - DNA, 306 bp, Glycine max
  Peptide Sequence Number=SeqID_202037
atgaagcgtgcacagattaacagaacgcatgtggaaaatgcaattgaagctaaagacagaaacgtaaatgaaactggaaatagaaacaagaatgaaattgaagctaaagacagaaacataaatgaaactagaaatagaaacgagaatgaaattaaggcaggaacggaaatgaaactaaaggcagaagaagaaataaaaatgaaattgcaattagaagtagagaatggaaaagtgcattacgagaacaataacaataagctccaaaaatgtaaaaccctaaaccctatgctccgaataatagcttaa

SEQ ID NO: 85260 - DNA, 477 bp, Glycine max
  Peptide Sequence Number=SeqID_202038
atgaccctttcatcatgtcagaacaagctaaacaataaatggcgagaccatccagctctcctcctcctccttctcctcctggtgcagcatcatacttcgacaaccgttcaccatatccatttgtgccatgatcaagtcaaggttggtgttgaggaagttagagatgcagattctcccattcttgtacccactgaagaggttcagttaatgagacagacacttgacaccttcgttgcttggccgacacatcttgtgaagcgtttatcagaacaaggggatgtgggactagcgaaacctccaaataggctggatcatgatgtcgatgatcccctatatttgatgacattgaccatcccacagctttttcttaagccgttgcaggttatgtggggtgctatcgtgtttggggtgtttaatgataacttccccttgtacataaagcatgaagatctgtctgaaatagaacacggtggttaa

SEQ ID NO: 85261 - DNA, 480 bp, Glycine max
  Peptide Sequence Number=SeqID_202039
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcgggtggtggatcatcatgtcataacatggcaagacacaaggtcacacgcacacacacacacacacactcacgcaggcacaagggggaggaggggcttggtcgtccgtccgcccgggcacacacctaggtttgttggtgatttggaggggagggacgaatcaaagcgacaagggctgaatctcagtggatcgtggcagcaaggccactctgccacttacaataccccgtcgcgtatttaa

SEQ ID NO: 85262 - DNA, 1050 bp, Glycine max
  Peptide Sequence Number=SeqID_202040
atggcaagcccaaaattcagtttctgtttcctagttcttttcgtaagcagctatggcataacttgctgcctaggggatatatggcatccaaaagaacatgctgccttatttgtatttggagattcattatttgatgttggaaataataattacatcaatactactgctgataatcaggcaaattactctccatatggggaaaccttcttcaattatccaagtggtagattttctgatggtcgcgtgattccagatttaatagataccttgatggagtcaattttgcatcagcaggagctggggctttggttgaaacccatcaaggactggtctgctgtgatagatctgaaaactcaactaagttatttcaagaaagtcagcaagatattgagtcaggaactaggagatgcggaaaccacaactctgctggccaaggcagtgtacttgattaacattggaagcaatgattatttagtctctctgacagaaaattcgagtgtctttactgctgagaaatatgtcgacatggtagttggtaaccttacaactgtgatcaaggggattcacaagacaggagggaggaaatttggggttcttaaccagtcagctttgggttgtattccattggtcaaggcactattaaatggatctaaaggttcctgcgtggaagaagcttcagcgctagccaaactacataacggtgtgctttctgtggaacttgagaagttaaagaaacaactagaaggatttaaatattcatacgttgatttttttaacttatcatttgatcttatgaacaacccctcaaaatatgggttaaaagaaggcggcatggcatgctgtggcagtggcccttacaggagatattatagttgcggaggtaaaagagcagtgaaagattacgagttatgtgagaatcctagcgattatgttttctttgactccattcatcctactgaaaggtttaatcagattatttcccagcttatgtggagtggaaaccaaagtattgctggcccatacaatctcaaaacactatttgaagaataa

SEQ ID NO: 85263 - DNA, 261 bp, Glycine max
  Peptide Sequence Number=SeqID_202041
agttttgtgtctgggcttagagttgtggatcctatttctaggtcattaaagttgtatggtgacaactctgtcgcgatattcatggctaagaacaacaaaaatagaagtcgaaataagcacattaacatcaagtacttagctataagagaacatgttaaagaaaagaaagtgaactttgaacatattagcattgagttgatgattgccgatcatttgactaaagacatgccaccaaagtattttaaggatcatgtaatgtga

SEQ ID NO: 85264 - DNA, 249 bp, Glycine max
  Peptide Sequence Number=SeqID_202042
atgtcaagtgatgcaatcctcccaaggaagggacccatcaccagagctatggctacgagactccaggaagattgggttaggggtgcaggagaaggtcctagagttctcacaagccttaagtcgcatctccaatcacctttcctccttttccatttcgctatcattgttcttcaagaggcaaaggacttcattgatgaagaagatccaaggcctacaagctctacatggagctacattatcaaggcttga

SEQ ID NO: 85265 - DNA, 807 bp, Glycine max
  Peptide Sequence Number=SeqID_202043
atggatgtggttttgaccatgggaggtgaagacattaattctgttgatgagacaaaaccgacagaagagaccatcacgactggaaacaccatcaagactgaagaagccctggagaaacatggaggcactggctttggttctagaattcgtagaaaaagtaaatacatgtgtcacccatacataaatatcgaaccgaagaaaaaacatttgtcaattgaaagggaagacttgaggacccacggatcttcatcatattctaaattgtgtagaaaaaggttccgaaagaactggaacagaaaattcatccacaatagtaatatcttcactagtcctgaattgattaatgcgtctgcagctagacttctttcaggacttcgttctgcagctgttgattgcacgtttccaatggggaataagagcttcaacttagttgagcagttctttggcaggtatagaatatcaatctatcatgatgaggctgaacttgctagttccctagttaatgcaaaagaagaagaaatggggaaagctgctgatagtgatgactctgtaagtcctgagatggtgaaaaaattgaaactaaaggaaaaggtggaagaagtaacttcagtgcatcagccacaaagtgttgacacaaatttgaatgaaggcctagaagaacatcatcaaagtgctcaaattactatagaattacctgatttgaatgccactgtcacggaatgcaattcaaatagcataggttttcatactcccaactctaatatggaattagagataccagatttgaatgctccttatgctgaatga

SEQ ID NO: 85266 - DNA, 1053 bp, Glycine max
  Peptide Sequence Number=SeqID_202044
aacagtccttcttcttcggacattcaaacaacctctattatgaagaggacgcggaagccgaatagaaggtattatcataactcttcttcatcctcttcttcttcttcctcgacgacgtcgtttaagctgcaccggcgtgggaacagaacgaaaacgcggaagcccaagttcgtgagcctgaagcttcagttatccgagcctaagaagaagatggcatccaccaagcccaagcccaagcccaaggctgaacaactacaacaacagcagcagttacagcaacaacaacaacaacaacagccgcagctcaatctcttccctctccatccggaccaccacgacatgcacgaggagcagaacatggcgcttctcttcagctccgacggcggggcaaccctcaacgggctactggaggagggttcgacgacgacgacaacgacgtcggtgctgacgtgtccggcggaggataccgggaactggctggttcggaaggcgatgcggcggagggagagcgaggaggggagtgaagaacggtgggtgtgctactcggaggtggtggaggagaagaaggaggcgatggaggaggtcacgagttattccgtcaagggggaaacgaaaacgacgtcgttcggatttgggttgttgtcgttgaagctggatcaccaggggatattgaatgcttggtctgataaaggctctctctacgtcgcgggggaggaggagggggccctacagactgtccctgacatattcaatggtttcctctttcataatgccgtcgccccccatgttgcatgggacggttgggggagtggtggtgttgttgggaacgcatggagtgttcatgaagagtgtggggctaacaaggcgaatgtgaaagaagaaacgagttggaagttggcgcagagagaggcaagtgtgcagaggtacaaggagaagaggcaaagcaggctcttctctaagaggatccgttatgaagttcgcaagctgaatgctgagaaacggcccaggatgaaggtactactccctactttcgttaagggtgccatagtttga

SEQ ID NO: 85267 - DNA, 192 bp, Glycine max
  Peptide Sequence Number=SeqID_202045
atgagtggacgaattcttatagatgtaaggttttgcaaatcttacaaagggagtaggacaatggtaggggatgaggcctatggggaccacccaaaagttatagaaatcttcatggagtcgagtcatgttgacattgcatatgagattgaagtactacaaattgacattgatctattgtctggtgttatttaa

SEQ ID NO: 85268 - DNA, 246 bp, Glycine max
  Peptide Sequence Number=SeqID_202046
atgaggaatccctttgtggcggtggggaaggtgtgcggtcatcgggaattgaagggggaaggtcttgtttccgcacctagtggtcatcctcatcctttcgaagaaaatagagttaaggattgtggggaggaaagggaaggattaggtggtgctggtgggtcaccggaagtgctgtggcggtattgtcttgtagcggtggttgtggaggttgagccttttctcttcttagatggttctatcatttga

SEQ ID NO: 85269 - DNA, 390 bp, Glycine max
  Peptide Sequence Number=SeqID_202047
atggaccttgaaagaagtgattttgcatctatctcaggaactctatatgtgcagcatggtgctcatcaatccatgcatcctaagcagcaaaacactcatcaaagtgagcctgcatgccatccaactgccttaaaagtgtttgcatgtcaaatgcagatggtcttcattatggttgttgtcgagctttctaatatgggcccctctgctcctcctgtggctattgctactatgcctcaaactaccgcttttcaaccggttccccctcagttggctccaccaaagcatactgactctgcacttggtaatggttgtggtaatcaacacgaccatggtcagatgataacaaccctcccagatgatggttgtggtcaaccaagagggttgtggtaa

SEQ ID NO: 85270 - DNA, 693 bp, Glycine max
  Peptide Sequence Number=SeqID_202048
atggaacaaaaatatggtctctgcaaagaaattagcatgggtccaaatcacaacttggaggtagaggaggaagcactatggaaggggggcaacgtcaaagacgacaagtttagggcgggacagaggagaaagggttgcaatagagatgtatttgtactagcaccatcagacaaagatgtcaaagggagtgtcgcaacctacccttcggcaggagagcgacgcggggctcacgggtgcgtcttccaagaaaggaaaatgcgcggagtcgccaccaacgcttatttgaggaaaacgtcggaaaaaccggaaaaggagaaaaaagggaggtggttgccgcctagcttgcccaagcgagctcagctgacccaggcgagcagggttgcttccaccagaaggtatcgccttctgttggaacccccggaaggcccaaattacctaatgatgggtgttaagtaccttgaggcggtcaagcgaaggttgcatgccaccaaacaatggtccccggacgaaattaagcgaagtaaagataagacactaattttgttcgagcggaacatcattcggccggtcaatatcctaaccagcgaaacctatcattcggaaggaaagaaatggcatcagaagcgtcaacaaaactttagtgtcttgaaagcgataaagtgggacaaccacgacatttccccacgccattga

SEQ ID NO: 85271 - DNA, 738 bp, Glycine max
  Peptide Sequence Number=SeqID_202049
atgccgatttctagaattgccatcggaaatccttcagaatttggccaagctgatgcactgaaggctgctcttgctgagttcatctcaatgctaatatttgtcttcgcaggagaaggctcaggcatggcatataataaactcacagacaatggttcagcaacaccagctggggtggtggcagcatcactgtctcatgcatttgctctttttgttgcggtttcagttggtgctaacatctcaggtggacatgttaaccctgctgtcacatttggtgcctttattggtggccacatatccctcctcagaggcattttgttctggattgctcagttgcttggctctgtagtggcttgcttgctccttaaatttgccactgttggattgtctcctggggtgggagctgcaaatgcacttgtttttgagattgtgatgacttttggtttggtttacacagtgtatgccactgcagtggacccaaagaagggtaaacttgggataattgctccaattgcaattggtttcattgtgggtgctaacatcttggcaggtggtacctttagtggtgcatccatgaacccagcagtttcttttggacctgctgttgttagcgggacatgggctaaccactgggtctactgggccggcccattaattggctcggctattgctgctgttgtgtacgagactttcttcatcacccctaactcttatgaacagctacccgtcacagattattag

SEQ ID NO: 85272 - DNA, 202 bp, Glycine max
  Peptide Sequence Number=SeqID_202050
agactgggggggtgtgagaagaagaggctgggggcaggcgcctggctgccctgcgctagccgtagcgcctgcagcaggggcgccaccagtagtgcctgacccctgggcactaccaaaggcgcctgcgtcaggggcgctacctccctgtgccacgtgtcacgtgcacagtggaggcgcccgggtggggggcgctttgcaataa

SEQ ID NO: 85273 - DNA, 267 bp, Glycine max
  Peptide Sequence Number=SeqID_202051
atgagtagggtagtaaataactccatgacttggagtcctccccaggaacatttcattaaagttaacattgatgcgacagtggttcctaagagcttcttcgccagacttgatttttgctcgatcattactcaagccgagcttcttggcattttcaatggtcttgccagaggggcttccaacaaatcattctcgaatctgactccctcattgcggtcagacttaataaccaaggctgtagttcgaatcatccctgttatcccattgtga

SEQ ID NO: 85274 - DNA, 343 bp, Glycine max
  Peptide Sequence Number=SeqID_202052
atgcctattttcgcaacctaccctacgacgggaatgcaggcgaaaagccaaaagagcgtctttcaaaaaggaaaacgcgtgggagtcgccaccaatgtttattcgaggaaaactatagaaaaaccaaaaaggaaaggtctgcgaatattgaaaagaggggtgttggccttgctcccaggtatcctcaggtgcgatgaggaattcagacctacaaagttctttaagtctgaatctcgcccaggcgagctaaaacttaaccttgcagcagtgagctcgcccaagcgagctggtttcttcaccaagaagctatttggtggcccaggcgagccaaaggctagcctgg

SEQ ID NO: 85275 - DNA, 318 bp, Glycine max
  Peptide Sequence Number=SeqID_202053
atgactaaagcacgtcaaaagggggtacggaaagtaaatgaaacaaaaataaaagtacgcgaaacaaatggggaccaccaagggaaaataggggaggacttgccacatagctcgcccaggcgagccaggttgcttcctccagaagcaaccgccttttggaggaacatcctggaaggcccaaattctgtaacaatgcttccttttgatctccggcttgtcacggaacttcacatattgtgcaacaaagggtgccaagcacctcgaagtggtcaaacaaaggttacatgccatgaaacaatggtccccggacgaaattag

SEQ ID NO: 85276 - DNA, 1351 bp, Glycine max
  Peptide Sequence Number=SeqID_202054
gggaagaataacgacggagcttcaagtccccaagaaatggacagagagagaaacaagtcctgagagaaccaaggtttgggccgagcccaagcccaagcccaaaacgcccagaaaagtttccgtcgtttactacctctcccgaaacggccaactcgagcaccctcacttcatggaggttcctctctcttcgcctcacggactctacctcaaagacgttatcaaccgcttgaacgctctccgagggaagggcatggccaccttgtactcctggtccgctaaacggagctacaaaaacggcttcgtttggcatgacttgtcggagaacgatttcatctacccgacgacgcaagggcaagactacattctcaaaggatcggaaattgtggagcacaatgttaccggcgccggcgcgagggttaacaaatcggaggaagaatccgattcgccggtggtgatcacgaggcggcggaaccagtcgtggagctcaatcgatatgaacgagtaccgagtttacaagtccgaatcgttcggtgactcggctgggagaatcggcgccgacgcggcgactcagacggaggagaagcggaagcggaggagagcggggagggagggagaagcggtggagattcaagagaagaacgatggaattgaagcgggaatggagggagagagggtcgcgcacgtgacttgtgatgatgataataataaccacactacggagctgagtagggaggagatctcgcctccaccgtcggattcgagccccgagacgctggagacgctgatgagggcggatggacggctcggattacgatcttcggaatccgagaaggagaatctgacggtggagagctgtcctagtgggaggacgagagcttcgtctgttttgttgcaattgttatcgtgcggtgcggtgtcgtttaaggagtgtggggccaacgcggtgaaggatcaagggttctcgttggttgggcactacaagtccaggatgccccgcggagcagggaatcattcgggaaacgaaacggggacatcgatggaaattccagatttgagcagggtgaggttggaagacaaagaatattttagtgggagcttgatagaaaccaagaaagtggaaacccctgctttgaagaggtcatcttcttacaatgcagatagtttgggtttgtctattgtctcttctccttgcagtggttcccggttgcaaatagtggagcatgaaggagaagctgtgcgggcaaagtgcatacctcggaagtctaagacactaccaacaaaaaaagaagagggtgtttccatgcatattgttgctgatagtggagaagagggcaaaagcttagagatgtga

SEQ ID NO: 85277 - DNA, 411 bp, Glycine max
  Peptide Sequence Number=SeqID_202055
atggagaagaaggtgaagggcaatggttttatatatttggaaggaacatgggctggtgatgttggaaaagtgactatagtcaatatatattcaccatgtgatacaactttcaaaagaatcctatgggatcaagccaggcagcttagagctgcaaacaatggggaaagagttggagtgtgtcaaaggttacagggtgggggtagccagaaggaatttaatgattggatcactgacttgaaggttgaggatgtgcctagtgtggggagaaaatttacctggaaccgaccaaatgggacagctaaaagaaaaattgataggatccttgtctcagcagagtggttttccaaatggcaagacaacattcagctaatcttggaccgcaatttttatgatcactgcccaatcttgtga

SEQ ID NO: 85278 - DNA, 1017 bp, Glycine max
  Peptide Sequence Number=SeqID_202056
atgacgaatgtcctaattcatccaacaacttgtccatcgtgggcatcggaaagcggagtatcggagatgagaaaggattgtggcttagttggatacgatcggcgtcgagcatcgtcgccacctatttctctagctctaccttctggtaataagggtatttgtatggtgtcaagaatagagaggatgactggtggtgtattcaaaagtgttgagggtggtggggtggaagaaggtttggttgggtcaggaatgggtgttaagtggtacaaggcggatatgctttgtgtttgcgcaaaacgtttaagttgttgggctgagacatgtgacaatatcagcaccactgagaggcagacgataaaggtcaaggacgaaggtgtggccctacaacttaagaggtacgctgagggaggtggtatcgcaccccaggttgtgggtgctcccactgtcaatcaagataaccattcgatgatgggcgatggagttgtagagacgaaatgggagcctgggtctaggtcaataagggggagaggctcgggaggaggactggctagtaacgggtctagggttgaaggatccgcgttcggcttgacaataatgagggccatgtctttagaagataatctcttaaagggtagttacggtgccgaaggatccgctggtaatggcggcggaaccggagagtttcaaggtggtcttaaggatgcaaaaaaggctgcaaagcctggaccttgcgatgcaattttgagaggagactggacacgaagcaggcgccctgtggatcatcgtagaaagacagggcaaaacgagactccaatgcctagagcatcaccgaccatgaggtgtggtggtgaaggtcgcaaagtgtacaaggatggaatcaattttagaattgagggtggattgggcttgggaaagggtggcttgtgtctaggcgaggcggtcaatggtggtttgacgcgtgctatgctcaggcatggtcgacaacaggtcggactagttgtgaggactatcgactaa

SEQ ID NO: 85279 - DNA, 471 bp, Glycine max
  Peptide Sequence Number=SeqID_202057
atgaagagaggcagagataaggagagtgaggtgggcatggctaattgtttgatgttactgaccaaagttggtgaaactgaaaccccatcaagagagagggttctaagttgtggtgattttaggtgcaagacacgtaacaggaaattccattcgtttcaagcacttgggggccaccgagccagccacaagaagctaaaactcatggcttcaaacctttcgtgttcgatggcacaaaaaaagcaccagtgccccatttgtgggcttgagtttgggattggacaagccctcggagggcacatgagaaaacatagatcagcttccttaaatgaaggtttgataactcacgatcatgctgtgccaacatctaatggtgctgaaaggcttcgtttgtgcttggactcgaacttgggaccgtacgagaatgatctcaacctcattttaaggacacctgttttaaatttgttcatttga

SEQ ID NO: 85280 - DNA, 908 bp, Glycine max
  Peptide Sequence Number=SeqID_202058
atgatcgtgatgctggaattgagaatccagcgtttgaagtttgggagcaacaagaccaagtgctcctcacatggcttcaatcgaaactctctacgtcgattttatctcgtgtgctgggatgcgcacactcctacgagattcaagcgacctctaattcgcttgcgttagttggaagtctgattatgcttcaagagcatgtcgattccattcttgaaggccttttgtccgattatcatccaattattgtgattatcgaaagcaattttgaacctcagcctattgagcaagttggagtgcttctcttggctcacgaagctcgtttgaacaagatcctgaaagcttctctaactttcgtggtggatctagtcacggcggcggtttcaatggtggtttcaactacggcggtggtcggcgctagcggtggtggtggctgtggtcatggtggtggtcgtggtggtggtcgcttctccaactttcaatgtcaaaactatggtcctcagaatcagtacaatgctacctctggtcagagtaaccctaactctaattctaggcagcaatatggtgattatcacccttcaaatgaaattctcagaacattcagcagtttgaaccctttgaaggacctgaccaaatcttcattgggtaatggtcaaggtttgcccatctcttcctctggtcttgctaaaggcaatgttggtcctgatgatctatacaacttctccaacatccagcttcagcatcccttgtctacttctgttcttgcttgtgtttctaatcctgaaaagtgtttaggaaagtctcacagacttccttcttcttcttcttcttcttcttcttcttcttcttctgaatctgtttatacctttcctcttgaattggttcacagtgatctatgggggccatctcat

SEQ ID NO: 85281 - DNA, 555 bp, Glycine max
  Peptide Sequence Number=SeqID_202059
atgactgttgaagtgtctaatcatcctctttctagacttatgctgcaagtggctgagtttcatgctaatgctgtagtttctgtgaaacctaaaaagccttcctttaaagaaaggaaacagaagttgcttacctttctacaagagaagtatgaaccagtttgtgctaagtggactacagaacgatgtgctgtatgtagatgggttgaagattgggattacaacaaaattatcatttgcaacagatgtcaaatagccgttcatcaagaatgttatggagcaagaaatgttcaagattttacgtcatgggtttgtaaagcttgtgaaacacctgacatcaagcaggaatgttgtctttgtcctgtaaaaggtggtgctctaaagccaaccgatgttgacacattatgggttcatgttacttgtgcttggtttcgacctgaagtatcttttgctagtgatgaaaagatggagcctgcattgggtattctgagtattccattgaattcttttgtgaaggtgggggttttggttaccaccttttcttgtctgtttcaataa

SEQ ID NO: 85282 - DNA, 150 bp, Glycine max
  Peptide Sequence Number=SeqID_202060
atggggcgcttaggaatacataacaagtcataccacataatgagtatgtcagtcatggtaactccattttgcgataatactccaaccatatgggatcaacataggcttaaaggggcactcaaactgagtgtctttacccccaaggcctaa

SEQ ID NO: 85283 - DNA, 261 bp, Glycine max
  Peptide Sequence Number=SeqID_202061
gaaaataggggaggagcttgccactcagctcgcccaggcgagccaggttgcttcttccagaagcaaccgccttctggaggaacatcctggaaggcccacgtgggcccgaaactcacggattgtgtaacaatgcttccttttgatctccgacatgttatggaatttcacggattgtgtaacaatggatgcaaaatacctcgaagtggcatacgaaagttgcacgtcaccaaacaatggtccccggacgaaattagggtatga

SEQ ID NO: 85284 - DNA, 438 bp, Glycine max
  Peptide Sequence Number=SeqID_202062
atggatgcattaatatggtatagttggctaggaggagtaatcattgggacaatgataggtgctaacatggtgttggaggaacattgtcgtgccggcccacgtaatgttgtcataacggggagtacaaggggattgggtaaagccttagctcgggagtttcttctttctggagatcctttcatctatgcgttactaacaacatgtcgttgtcgtgcacctgctctctcattttgtgaagacagccccgagtctgtgcaagcaactatcaaagagcttgaggaaaatctaaaggaaggcattgccaatgcagttggctcttctctgacaaagctttcacatgcaaaagttgtaggcattgcttgtgatgtttgtgaacctcatgatgtgcagagactggctaacttcgctgtcaaagaacttggtcatattgacatttgg

SEQ ID NO: 85285 - DNA, 669 bp, Glycine max
  Peptide Sequence Number=SeqID_202063
atggtcattgaccaatccctcttctatgatttgactcaattgtctagcgaaggtgtaccatttgaaggtactttagatgatgattggaaatttgatttttccatgcatgatgcccgccggttggtttgcaccaaccaagcggatatgaccggaaggcttcttgccggtttattggctcttgaaaacagatccaagacgagttctatgaatttgtcgaaagagtcaaaaaaggatatagattacccttggaaacaagacatcataggtgatccaacaacaaatgtgataacaaattggcaaactaaggatggtgagttaatccaatcggagttacctcccacaacccaataccaactaccaaggattaaagacaataatgataaacatgtcatggccagtccgttcaaagcaaaagatgtcaacgaggaagtaacctctaaggacattaaaagcctaatggaacaggaaaattataccaacaaatatttacaagttttaggagagtccatcaagactaaagtagttcccaaacataaatcagtcgaggaagcttcatcaagtattcccattgaaaaacctttgttcaaaccttccaaaattagcgataaagctaaacgtaaaattagggaacttagaaaaaaacaagtccttaatcgaaggagtaggtga

SEQ ID NO: 85286 - DNA, 234 bp, Glycine max
  Peptide Sequence Number=SeqID_202064
atggttccccgcatgtcatcgggctcgccacctctggatgacaaaggtgcagatgaccataatttgtctttatgtgtcaacgggctcacttgcctctggtgtgggaccataaggtttccccgcatgtcatcgggcccaccgcctctggatgacaaaggtgcagatgaccataatttgtctctgcctgtcaacgagctcgcttgcctctggttgacaaaaggtgcgggaccataa

SEQ ID NO: 85287 - DNA, 1707 bp, Glycine max
  Peptide Sequence Number=SeqID_202065
atgacattgggcacatcagacgaaaaatggaccctcacgttaggaaagtcaaattcatattgtgaagtatatgacagccttcatacttggtgtcagtccatgagatgtccagcaaattgcaatatacctggttgtgtaacacaatctcttgaatttgagttggacttaactcaattccaaaagttagctcatgagatgagaattgtccaagccttttctttgcaaaacaagggattttggatggtaaagggttctggacaaattaatgacagagagacaatatttgataatcctaccaaaattgaaccaaaacgacctcatcaatggtttgttgacgctgctgaagtagatttttttccaaacaagaaacaagctgtagaagatgcagatgaaaaatctagtcctggattttcaaatgtaaatattcctccctgggagaacaatcccaattttcattcggtcccaaaccaatttattggccgattatttgggtctgaaaccaggcctgtcaatttcactgagaagaatacttcatatgttttggctgatgattctaatgtgagatcaaagatgatcaccaatcaatatggagatgatgcatcttttggtttgtctatatctcattctattgaagattctgaagcatgtgtaaattttggtggaataaaaaaagtcaaagtaaatcaggtaaaggaagatgatatacaggctctggagggacataattttggtaggccaaataatggtaatctacatcaggcctataacagggaagttgagacaaggtctgcatcaatagggcaagcctttgacagggatggtgatgcttctttaatgggacttacctacagcaaaggggatgcacatgtcagatcatttagtgccccctttgtcaaaggtgatgactcaattgtatcaattagtgagtcctataataaagaggacacaaatataatttcttttggtgggttcccagatgaaagggatattatctctgtgggtaggcctgctgcagagtatgatcaattatataatcaatcttcagttcatgggtcaacaacagcccacgagaaagagttggatgtgtcaagttctgatgcagttgcaagtacacttcaggtagcaaaagttaagtctgaaactgtatccaagaataaacaagagctcaaaacagcaaagaatgaagctccaaacagcttcccttctaatgtcagaagcttgatatctactggtattcttgatggagttcctgtaaagtatatctcagtgtcacgagaggaacttcgtggaattataaaaggctctggctatctttgtgggtgccaatcatgcaactatacaaaggttctgaatgcttacgagtttgagagacatgctggctgcaaaacaaaacatccaaacaatcatatttattttgagaatgggaagactatttatcaaatagtacaggaattgaggagtacccccgaaagtttgttgtttgatacaattcaaacagtttttggtgcaccaattcatcaaaaagcatttcgcaactggaaaggtaatggaaaccttctgtccactgtacacgcaaacacatttacgtttgtttggtatgtcacttatccaaatttttttatctcctgtcaactttatccagaatcatttcaagcagcaacacgggagcttcaacgcatttatggaaaggaagaacttaacctataa

SEQ ID NO: 85288 - DNA, 354 bp, Glycine max
  Peptide Sequence Number=SeqID_202066
atggagattcctttaggagagttgggttttggagcttactaccgtggtgctatgggcatattgctagtctatgatgttacagatgaagcatcatttaacaatatcaggaattggattcgcaatattgagcaacatgcttcagacaatgttaacaaaatactggtggggaacaaagctgatatggatgaaagcaaaagggccgtgcctacgtccaagggccaagcactggctgatgagtatgggatcaaattctttgaaactagtgcaaagacaaatctaaacgtggaggaagttttcttctcaatagcaagagatataaaacaaaggctggctgacactgacaccaaggcagag

SEQ ID NO: 85289 - DNA, 108 bp, Glycine max
  Peptide Sequence Number=SeqID_202067
atggggaactcaaatcaaaatcctaagcaggaatgtgtggccaattacttaaacttcatctgtgcattcaatatgcaaatcaacagattcttccaaattgacttaaaa

SEQ ID NO: 85290 - DNA, 1275 bp, Glycine max
  Peptide Sequence Number=SeqID_202068
atgataattaagcggaacctgaaatcgcaaatgccgagtctgaaacggcggcgtctcggcgacgcggcaggggaggacgacggcgacgagtgcacggcggaaaggaagaagaggaggaagacgagcgggtactgctaccctctgaatctcctcgtcggcgtaataccggccagttttagcgggcttttaggcgcgcccgagaaaggatgccaggtggcggcgagctcggagggcggcaagaagaacggttcgcggccgccggctctggtgcggacgtcgcgggggcgggtgcaggcgctgccgtcgcggttcaacgattcggtgattgaggattggaggaaggacagcagcaaggttgaggttgaatgtgaattagacgaagaattcgagagtgtgaagaagtcgagaaaaggaaagatcaataataaaggtagagggtattctacactgtgtgaagaggtgctgcttaagaattttgatgatgccagcaaggaggagaagaagaagaaagaggggttgtatgaaccagaagacttttatgctggggatatagtgtgggccaaggcagagatgaaggaacctttttggcctgccattgtcattgatcctatttgtcaggcaccggagctagttttgaagtcgtgtattcctgatgctgcttgtgtcatgtttcttggctccgctgggagtggaaatgaaagggactatgcatgggtcaagtacgggatgatttttccgtttatggatcatgtagacaggtttcaggggcagtctgatttgggttgctataactataatccctctgaatttcaaatatcaatagaggaggcatttttggcagatcagggttttacagagaagttgatagcagatataaatacagcagctggtagaactggttgtggtgattctgtactgaaaggctttcagaaggtcactgcttcgaaccagaatgcagcatgtcactttctgaaccaggatttatttgataagaagaaagacatgcgatcttgtgaagtgcgttgtgatggatgtaaagtatgggtgcatgcagaatgtgacaaaatttccagcaaccttttcaagaatcttggaggatctgattatttctgtcctacatgcaaaataaagtttgattttgagttaactgattcagaaaaatcacagccaatagtcaaatggaaaaaaaacagtgggcagctagtgcttcctaacaaggtcactgttctctgcaatggcatggaagggacatattttccaagccttcacttgtaa

SEQ ID NO: 85291 - DNA, 207 bp, Glycine max
  Peptide Sequence Number=SeqID_202069
atgattagcattctgagccaggaacggcttctgggagcttcgttgggagtggtattaacgggggtggttgtgtttgagcaacgcagatacatctacgcttctatttccgattcccaatctcagtttggtgaatgcaaaaatacaagttttggtgcagagttaagcaacaaaaaaatggatggaaaaggtggcgaattcaaccattga

SEQ ID NO: 85292 - DNA, 645 bp, Glycine max
  Peptide Sequence Number=SeqID_202070
atggagggagatgatataaagaagacccacgtcatcgatctgcgccaaccccccccagccaataagaaacgaaaacgtttctctatattaatcatcgctgcaatccattctcattcacaactccaatccctcttcgctttagcaaattccaattcccaatccaaaaccctaatttcgttcaaagaaccaattgtgatggcaccaaaggcagagaagaagccagcggagaagaagcccgcggaggagaagaagtcgacggtgggagacaaggctccggcggagaagaagccgaaggccggaaagaagcttcctaaggagggaggagccggcggagaaggggggaagaagaagaagaggaacaagaagagcgtggagacatacaagatatacatattcaaggtgctgaagcaggtccaccctgacattggtatctcaagcaaggccatgggaatcatgaacagcttcatcaacgacatcttcgagaagcttgctcaggaatcttccagacttgcccgctacaacaagaagcccaccatcacttcaagggaaatccagaccgcggtcaggcttgtgctgcccggtgaattggccaagcacgccgtttctgagggtaccaaggccgtcaccaagttcaccagctcttga

SEQ ID NO: 85293 - DNA, 315 bp, Glycine max
  Peptide Sequence Number=SeqID_202071
atggtacctggcggtgggtgggaggtggcggacgaggacggcggagttgtcgtggaggagagcggagattggggaaagaaaggcggcggaagagtggttacagttccagacgctgacgtaggtgtcgtcgatcctcttcaaggcggcgagggcgtcggctacggtgtcgcggacggagagggacctgagcggcggtttcccaagacacagatcggacaattcatgccccgacaatctagctgctgccataaactgtccaagtttgaagagagagaaagaaagagaatcacaagagagagagagggagaggtttga

SEQ ID NO: 85294 - DNA, 582 bp, Glycine max
  Peptide Sequence Number=SeqID_202072
atgtacaggattgacattcaaacaaatacaaggcgattccagtctttattccgggctcagcgggatacatatcttatgctctcaaggttcattctattttacaacaaagctgacaaaatagatggcttcttgaagcaatgtcctgctttcccaactgctttcttagttggcggtccagcagatatacttgttactgaactcactgatcagcttcaaaagctaaaggtggaaccagtgctgcttcattacctttccgaaattaagatccttcagggcttggaattgagaatgactactagtacgagattgaaaacttgtttgtatagctttacttctcctggtggtccaatgtatcccactagagccgttcgacatgcagccagggaatcattagatttactttttccggtgggacgttacccgcggcatcttattagtttgttcttcaggttgctttatccgtggtattggccttcctcttgttggaacttcgtggtttcttgcattcaggctattttttactccgtgctggggtttatattttctacgcggaataagattgccaagccaaaatcacaatag

SEQ ID NO: 85295 - DNA, 186 bp, Glycine max
  Peptide Sequence Number=SeqID_202073
atgaagtgtgtagaaagaaacgtggaaaagaagaaggaatcgtggatgcggcggtgcggtgtgtttttggataatgaaaacaatctgaggtggtggcgtggaaatgtggaattcgtctcatttttactgactctattattattgttgaattgtcgattcagcactgacatggtgaatcgttactag

SEQ ID NO: 85296 - DNA, 861 bp, Glycine max
  Peptide Sequence Number=SeqID_202074
atgtttccgttgtgtgctggtgttggaactgtgtcggacaccctgacacctcttcaactgccatgtttgagcttcataaactacctgactcataccagaaaacatttgtggcaccttgaaccagagcagatgaataccggagaagcacttctggattatcaagatgaacttcaaataactgcaaaaagttatgaatcccttaatttcaaagcaccgggggtgttatgtgatgcaaaggtaccgatcaagctaaagggaaagttttatcggactacggtaagaccggtgattttgtacagaacagaatgttgggcggtcaagagccaacatgagaataaagtaggtgtagcggagatgaggatgttgcggtggatgtgtggtaagactcgacaggataaaattagaaacgaagctattagagagagggttggagtagcgcctattgtagagaagatggtggaaaatagacttaggtggtttgggcatgtagagagaagaccggtagactctgtagtgaggagagtagaccagatggagagaagacaaacaattcgaggcagaggaagacccaaaaagactataagagaggttataaaaaaggatctcgaaattaatggtttggatagaagtatgaacctcgggggttgtggaactgttgacgttaggagtgaagaacctaggactactgcagaggtgttcttgaactggaacaccttttgcaattttctggaaccttggactgtcaacatacaaggagcgaaaaacaaaaagtgtctaggagagagaatcgacaaacaggaaagacaaaggaggaaaagggaggaacaaggaatggagatgaataatgaagaacatgagtga

SEQ ID NO: 85297 - DNA, 471 bp, Glycine max
  Peptide Sequence Number=SeqID_202075
atggcccgtattgctgacaaaataaaaaccatcaacggatctaaagaaactctgaaactttctggtgatcagatccacgtggtctgtaagcaagaccagttaaaggcatggaaaatggatttgaatgaaggttgtagttatgtgatgcacaattttaaagtcaccaagaatgatggacagtacagagtttgtgatcatccatataaattgacatttattggagttacggttgtcagacagtgtggcttagatggccttcctttaaaaaagtatagatttgtagattttttagatatcattgctggccaattacagtttgccctattagtagacatcattggtgttgttgacgaggttgtctttcatcatatttcacccagaagtaaaagagttgtttttaagcttatgaatttgaggcttttagaattaggcattgagatccggtcagttttgacacgtcgttcccagtag

SEQ ID NO: 85298 - DNA, 549 bp, Glycine max
  Peptide Sequence Number=SeqID_202076
atggtgtcctttggaaggttgccttttcttcctctcatgctaaccttctggcttatatttaccgcttcatattgcaaatggatgtgtagggcgtcagattttccaagggaatatgatgggacctgccttcagatgagaatgtcatacagtccagcagcacacctgtttctcttttttgtgcaatggacagactgcaatcttgctggagcccttggactgttaagaatcctaatatacaaagtgtatgtggatgggacaactaccatgtctacccttgaaagaaaagcaagtattagggaattctatgcaatcatatatccctctttagtgcaactgcaagaaagtgtggcagatacagaggataaaaaacagaaggctgtatgcatggagaggtatcgcaaaagagatgatgaggagcacagacagccttcagacatagacattgaaagagaagaagaatgtggaatatgcatggagatgaatagtaagattgtgttgcctgactgcaaccatgtcatgtgcctgacatgttaccatgaatgtgattag

SEQ ID NO: 85299 - DNA, 367 bp, Glycine max
  Peptide Sequence Number=SeqID_202077
atggaaaaccatagatttataggcaagtctgattcagcaaaagccaggagcaagagaaagcgtgttagacaacaaaaagtccatcttgatgttcagcatagtgtccatgcaagtttcaatccaacttcatcccatactgaagatgattataaccaaccaaagacaccacctcatagtgttcatgcaactgccaatcgagctccacacgatgctaaagatcattgtgcgttatcaaagttaacatttttatatctttacattcagctcatatcagtaaataatgttgatacaatatccatatatagtttgttgttaaaagttaatatctgcgattcatctgagaatgagacttctggatcagcagaag

SEQ ID NO: 85300 - DNA, 539 bp, Glycine max
  Peptide Sequence Number=SeqID_202078
atgggtggagccgtggaggtggttgcgacgcatgatagtggttttgatgttgttttgttcggatctggtgacgggcagtccagtgccaagaacacaaaaaccttgcatgcccatttgcttataactcgtgatttgcagtctaatatcttcttgatgaactctttgctcgatttgtactgcaaatccactgatatggttgtttctcgcaagttgtttgatacaactgctcttccaaatcttgtttcttggaacatcatgatatctggttttgaccataatcaaatgtttgaaaagtcattgaagatgttttgtaggatgcatttgcttggtgttgagcctatgagtttagttataggagtgttctttcggcctcttgtgctttgtgagctgcaatattttgcaaacaaggtggaccaggggttcggcggcggggaccatggtgaagaggagttctgggaggatcacgacagtgtactccaccatgccattcctaacagcgagaaagggagaagagagtcaacagagaaaggcttatcaag

SEQ ID NO: 85301 - DNA, 327 bp, Glycine max
  Peptide Sequence Number=SeqID_202079
atgatgttccaagaaacaagatttggaagagcagttgtatcaaacaacttgcgagaaacaaccatatcagtggatttgcagtacaaatcgagcaaagagttcatcaagaagatattagactgcaaatcacgagttataagcaaatgggcatgcaaggtttttgtgttcttggcactggactgccttgaaaacttgcttggaaagagggaagagataaacaaaggagaaaccgaggtgtggcagcggtctcgttttgctccagtagagaaacataggagtggtgatggaagcttgcttatgaagcttctatgtaggctggatctttga

SEQ ID NO: 85302 - DNA, 817 bp, Glycine max
  misc_feature (761)..(761): n is a, c, g, or t
  Peptide Sequence Number=SeqID_202080
atggatcagtttttgtggagggtgttgcctttgcttacaatccttgtttcctttggagtgttcttctacttgcaggattcttacacagcacagttatttcctctcataaagttaccgcgggataagtgcagccttcttccccatcgccacttctggatatccagcaaacgtattgtgaccccacaagggatcatttctggttcagtggagataaatgatgggaaaataatatctgtcgttgagggacatgctattcaggggaagcctaagcaagaagaagtaattgattatggagatgctgttatcatgcctggcttgattgatgtgcacgtacatcttaatgagcctggaagaactgagtgggaaggatttgatactggtaccagagctgctgctgctgtttggtttatatgcacattaaatagatctgttccaacactttcaacaggtggtgtaaccacagtggttgacatgcctctaaactgttaccctacaactgtgtctaaggaaaaactgaaacttaagcttgatgctgcagaggataaaatctatgttgatgttggattttggggaggcctaatccctgaaaatgcacttaatacaagtattcttgatggtctcttaagtgctggtgttcttggtgtgaagtcttttatgtgtccttcaggaatagatgacttccccatggctactattgaccatatcaaggcaggattgtctgtgttggcaaaatatagaaggcctatagttgtgcatgctgnagattcacaagattttgaaaatcatttggagcttaatgaggataaccttgatccac

SEQ ID NO: 85303 - DNA, 1464 bp, Glycine max
  Peptide Sequence Number=SeqID_202081
atggtggagatagtgagaaatggagcagtttgtatggagggtgttgcctttactcacaatcctcatgtctttagtagtattcttctacttgcaggattcttacagggcccatttacatcctctcgtaaagtggagataaatgaagggaaaataatatctgtcatcaagggatatagtaagcaggggaagtctaagcaagaaaaaataattgattatggaggtgctgttgtcatgcctggcttgattgatgtgcacgtacatcttgatgagccaggaagaactgcgtgggaaggatttgatactggtaccagagctgctgctgctggtggtgtaacaacagtggttgacatgcctctgaacaatcaccctacaactgtgtctagggaaacactgaaacttaagcttgaagctgcagagaataaaatctatgtcgatgttggattttggggaggcctaatccctgaaaatgcacataatacaagtattcttgaaggtctcctaagtgctggtgttcttggtttgaagtcttttatgtgtccttcaggaattagtgactttcctttgactactattcaccatatcaaggagggattgtctgtgttagcaaaatatagaaggcctttacttgtgcattctgagattcaacaacattctaaaaaacatttggagcttaatgataaaggtggtccacgtgcttacttgacctatctccacactaggccaccttcatgggaggaagcagccattaaagaacttgtaggtgttacgaaggacacaagaaaaggtggtcctttagaaggagcacatgttcacgtggttcacttgtctgattcaagtgcttccttagatctgattaaggaagcaaaacgtcgtggtgacagcataagtgttgagacttgtccccattacttagctttctcgtctgaagagataccaaatggagatactcgttttaagtgttccccgcccattcgtgatgcatacaacagagaaaaattatgggaggctgtattagagggacacattgacctattaagttctgatcattcaccaactgtgcctcaactcaagcttctagaggagggtgacttcttgaaggcttggggaggagtaacatctttgcagtttgatcttccagtgacgtggtcttatgggaagaaacatggactaactctggaacagttgtcgttattgtggagcaagaaacctgcaacatttgcggggttagaatcaaagggggccattgcagttggaaaccatgcagatattgtagtttggaaaccagaggtggagtttgacctgaatgaagattatcctgttttccttaaacatcctagcctctctgcttatatgggaagaaggctatccggaaaagttttggagacttttgtcagaggaaaccttgtgtttaagaaaggaaagcatgctccttcagcctgtggtgttccaattctagccaaatga

SEQ ID NO: 85304 - DNA, 738 bp, Glycine max
  Peptide Sequence Number=SeqID_202082
atgactctcaagatgttttggaatattttaagagaacctagccgtatgaaaaatcagtccactctttacttttccagggaggaggcagccattaaacaacttgtaagtgttacgaaggacacaagaaaaggtggccctttagaaggagcacatgttcacatcgtccacttgtctgattcaagtgcttccttagatctgattaaggaagcaaaaagtcatggtgacagcataagtgttgagacttgtcctcattacttagctttcacgtctgaagagataccaaatggggatactcgttttaagtgttccccacccattcgtgatgcatacaacaaagacaaattatgggaggctgtattagagggacacattgacctattaagtactgatcattcaccaactgtgcctgaactcaagcttatggaggagggtgacttcttaaaagcttgggggggcatatcatctttgcagtttaatcttccagtgacgtggtcatatgggaagaaatatggacttactctggaacaattgtctttattgtggagcaagaaacctgcaacactggcggggttagaatcaaaggggaccattgcagttggaaaccatgcagatattgtagtttggcaaccagagctggagtttgacctggatgatgattatcctgttttcatcaaacattctttgatcagaaaaatagatgctagaggaaccaaattgttcctcccactacttctataa

SEQ ID NO: 85305 - DNA, 705 bp, Glycine max
  Peptide Sequence Number=SeqID_202083
atggcttatacggatttccaacaaccaaacatcaccaacaacgccacaaatcgactgagagggaaggggcacttacaatggagacgtagaagacgaagacaattgagttgcggttactggcggcacgagcagccacaacggcacagtgacgaaaacaaacgaagatcaaagaagaagaagcgtgtatggaagtgtaccagcatttctggtagtgtccaaagcaattgtgcctttgatggtttgcctatgttacattcctccacccgctctagctttacagtaccaaaccattcagaatttgtttccctttttgatcgatcttcatcagagtttagcatgggaagatgcaaaggttcccatataggtccttctactcttcaaagattaggagaagtgatcatattgctcgaattggttgttccatcaatcacaatgatggtggaactggtgaggatccaatacaaattggtgaaggatttcatgagatttaaaacatctggatttgaagattgtgaatcaaattttcatgaggttgatcttgaatcgatctttggccgatgcttcttaactactcgtttgcgctgtattggtagattttatcaactaaatgacctactgtcataccctaatttcgtccggggacctttgcttgatgacatgcgacctttctttggtccttgtgaggtgcttggcacccatcattaa

SEQ ID NO: 85306 - DNA, 132 bp, Glycine max
  Peptide Sequence Number=SeqID_202084
atgacggaggaaaggtctatgttgctcaacctaaagccaaatgaaggaggagtatttgtctttggaggcatgtgtaaagagaagatcacaagtatagagaagatgagagatggatttggcaaaaaaacttag

SEQ ID NO: 85307 - DNA, 138 bp, Glycine max
  Peptide Sequence Number=SeqID_202085
atggtggtggacacggtctcaatggcggcaatggaagcggaggatggtgacggcacggcgcaaaacggagaacaaaggaagaagaggaagaacggcgcacaagcaatggtgctagatgcacctagcaacgcccattag

SEQ ID NO: 85308 - DNA, 204 bp, Glycine max
  Peptide Sequence Number=SeqID_202086
atgggtcaagtgaaagcatggaagggggtgggggtaggaggtgttcgacgcgtcatggaaggcgcgtgggtcaaagaaggcgtggtgatgttggtggtggttcatctggttatggtggtggggttgcgggttgaagtggctgtgggtgaaatctacggtggttgtcgcgacagtggtggcggtggagtgcattggcgcgtgtag

SEQ ID NO: 85309 - DNA, 537 bp, Glycine max
  Peptide Sequence Number=SeqID_202087
atgcaattgtcccttttggtaaaagtacagctggttgagaacgatagattgagaaatgggaatagagaagcacttactgcattaaggaaaagggctcgaacaacaaagagcagtgttccatctccttttgaatcaataatgaagggagttgcagggtccagctcaagacctttggtgcaagaggtttgcaccacctgtggcaaacatgactcttctgagcagacgtggatgatgtttccaggaactgatctgtttgccagaattccatttcatgcggctcatactatattggaaacagatcaaacgcagcttgactttgagtcaaagagactacagagcattgtgaaggaaaaatcttacattatatcagaggcaggtgttcttgcagacaagataagtcctggagtgctcaaatcacttgtatccttaaacgacaagccaaatatcaactgggtggaaaatggcaagtgttttctggaagtctttcttgaggcatttaggctgaggcttatctattctgttgctgtgattgtgtaa

SEQ ID NO: 85310 - DNA, 486 bp, Glycine max
  Peptide Sequence Number=SeqID_202088
atgacttcttacctttatctactattttcacagaatcaagaaattattgcaatcaaggctccaaaagctagttgcatcgaggtccctgatcctgatgaggaattaggttttcggcaaaggcagtacaaaatgattgttcgaagtgccattggaccaataaatttgtatctcttgagcaaggacgaccgcaagtttgaggatgatagtgccaaccggatgaaattaatggatccatcatggaatagtgattccatcagaaagaggggtgtgggattattagaaagccaacatgatgaaaaaaaaaatccttctgagcgtttcagtttgcagggttcacaagcatttggaattcaagaaattactcccacggattttgaaatggaagatgactattggtttcaatcagatcctggagtgatccgtaagcattttcctcttatggatcaagttgatctggaaaatgcttacagatcacctgatccgtaa

SEQ ID NO: 85311 - DNA, 126 bp, Glycine max
  Peptide Sequence Number=SeqID_202089
atggatgagaacatgaaacagttccaaaagaaattaacagaactggaagtggaagctgagcatattcttttagcccgacatcagaggagttattctgcacatacctttttaaagttcagtgactga

SEQ ID NO: 85312 - DNA, 636 bp, Glycine max
  Peptide Sequence Number=SeqID_202090
atgaagtatcccagaggaaagcttcctcttcccatcattgtcatcacaacatgtgttcttgtttttgtggctatcttgtatgtagagaggctcagtttcctctcttccaagtccattttcaagttcaaaccatgtcctagaaaaaccaccaaaacaaagtctagtgacaaaaaagcagatgaggaggttggggttgtgaatgcatcaacatggattgatgacaggtttgattttgaccctgaggagtgcaatgttgcaaatgggaaatgggtgtttaaccattcaataaagcctctctactctgacataagctgtccatacatagatagacaattttcttgtgtcaagaatgggaggaatgattctgactatcaccattgggagtggcagccagaagattgcaccttgccacgtttcaacccagagctaaccctcagaaagcttcaagggaaaaggctgctatttgtgggggattcactgcaaagaaaccaatgggaatcttttgtctgcttggtagaatgggtcatacctcataagcataaatctatgcaactaggaagagttcattcagtcttcacagccaagcatattggtggcgaatgtttgggtcacaaactccaaatttgcaaaagctag

SEQ ID NO: 85313 - DNA, 654 bp, Glycine max
  Peptide Sequence Number=SeqID_202091
atggaaaagcctacacaccgaacatggatgtataataggcttcttcctggtcaaaagggttatacaacagaatttttgaaaggtgtcaaggattttattgattttgcttgtcagcaaccaaagtatttgaatgaaggtgtaataagatgtccttgtaagttatgtaaaaatgcaaagcatttaaccccagaagaagtaaatgttcacattattaaaaaagggtttacacccagatattggttttggacatcccatggagagaaacttcctcatattaataatgatgttgaagtgcattcagtgtcaccaaggcttgcttcaatgaccaacctcgaacccgatctcaaactcgacctcgaactcaattcactcaatcccaacctcctcctcaactcactcaatctcaacctcaaacccgccctcgaacccgatctcgaagtcaacctcgacctactcaactttcacctcaatctcaatctcataccacccaatctactcaatctcaacctcaacctcctcctctacctcaatcacaatctcataccacccaatctcaacatatccccactcaagtcctacgtattgaagaatatccaatggccaataaagccccatcttcttcatctagtcaagttagtgaaggcaataacatga

SEQ ID NO: 85314 - DNA, 399 bp, Glycine max
  Peptide Sequence Number=SeqID_202092
atggtgcggcacaactttgaggaaaggggttcagctaaaatgactcaattaatgcaagatgttcgaaaaaatttaaatgaaaaaccaacttggatggaagatgatgtgtgggcacaaatgaaggcacattgggaatcctcaagtttcaaaaataaatctgaaataaataaaagaaatcgtaagtctatggacggtgcgtctcttcacactggtggatcaattcctcatcgtttgcattggaagagaatgaaggaggaaaaagggacagatccatcattggctgagttttattttcgtactcatcgaagaaaaaaggatcaaagttgggtgggtcctcgtgcagaatcttcatataaattaaatgtttgcccgagtaaggtgcaccaaccaaaagattaa

SEQ ID NO: 85315 - DNA, 1008 bp, Glycine max
  Peptide Sequence Number=SeqID_202093
atggcaacgaattcttctaatggagcaacaaagcaacctcccatgccatctcccttgcggttttccaagttctttcagttattcaacaagtacaataaaacattggaacaatatgtgatagtacgcttgtctaatcaggtcattgttgctgacaacttcttcactggatctaaagacaaccttaaaaaatggattggccatccaagattcgagctaattcgtcatgatgtcacagagcaattgttgattgaggttgatcaaatctatcatcttgcatgcccagcttctccaattttctacaaatacaaccctgtaaaggtggggacaataaagacaaatgtgattggaacactgaacatgcttggtcttgctaagcgtgtgggagcaaggattttgcttacatctacttcagaagtatatggggaccctcttgagcatccacaaccagaaagctattggggcaatgttaatcctattggagttcggagttgttatgatgagggcaagcgtgttgcagaaactttgatgtttgattatcataggcagcacggaatcgaaatacgcattgcgagaatctttaacacatatggaccacgcatgaatattgatgatgggcgtgttgtcagtaacttcatcgctcaagcaattcgtggtgaacccttaactgtccaagttccaggaactcaaactcgcagtttttgctatgtctctgacatggttgatggacttatacgtctaatggaaggggaaaacactggtccaatcaacattgggaacccaggcgaatttactatgattgaacttgctgagaatgtgaaagagcttattaatccaaaagtggagataaatatggttgagaacactcctgacgatcctcgtcagagaaaaccagacattacaaaagcaaaggaattgctgggatgggaaccaaaggtcaagttgcgtgatggccttcctcttatggaagaggatttccgtcagaggcttggggttcccaagagcaactaa

SEQ ID NO: 85316 - DNA, 720 bp, Glycine max
  Peptide Sequence Number=SeqID_202094
ttaacagtctcttctcttctcttcgctcctccacttgtttgcccttcatggcggcatctcaggcaagccttctccttcaaaagcagctcaaaggggggatttttcaatgctattatgagtttcccatccaattacccaaatagtccaccttcagttaagttcacttcagagatatggcatcccaatgtatatcccgatggccgggtttgcatatcaattcttcatcctcctggtgaggatccaaatggttacgagcttgcgagtgagcgctggacacctgttcatacgggacgattggaatctttagtgataagtgtcaagtcatggaggtgtagagagcttcaagaagcctcgctcaagaagatcaaggagttcatcctcaaggcattagaaaatgaggaccatgggagaaggtcaatggggagatcgtcaaatgaacatcaggagggagcattggagattcctttattctatgagaatgatgcctatggggaaatacttgagttgatttcaatggtgggagtattacatgccaaagccatcttgggagagcaaattactatagtggaagatttaagggtgaaatttgagttgtatgcgggaccattgaggggtactgatccagagtacctcaagggcattttcttaaatgggttaagggaggaactgaaggcagtaaagttgcatcctgtaaggacattaggaacaatgcctaaatga

SEQ ID NO: 85317 - DNA, 690 bp, Glycine max
  Peptide Sequence Number=SeqID_202095
atgtattgggcttctcctaaattccctcttctgagttctcttcttacagtcacaccagcccagcaccgcccccccagattaattgagatggaagtctctgggcagaatattgtgaaatgtgatgaagagaaagcattgaagtgcttgcttgatgcctttggctcagttttttctcttgaagagattgcttctgcctattgcaaggcgagccgcaatgcggacttggctggggaaatgttgtatgaaatgaagggaagttcctcaggatcatctacaacccttgattcatctaatgcagatgttatgactgaagggtcttctgagtcatcagatgcatattcccttgagaattctttccaagaaaggaaaacttcaaggcccaaaggtcgcccgatttcaatgggtactgtttctagcgttattgggaaggattatggtagacctgcccgatcagcaaatgggtcttttgcttcagtaaaaccaactaagttggatgcaaaatcactacccatgactggaatctggcgtgagaagggcaaggcagatgtttccatttcgaagcatgatcagcttcaccaggacatggaagatttcttatttaaaatgcttggagagggctttcagcttgacagaaatatgatacgccaagttcttgcctgtggtcgctttgccgccatagcagtgctataa

SEQ ID NO: 85318 - DNA, 803 bp, Glycine max
  Peptide Sequence Number=SeqID_202096
gagtgaagcgtgttgtagatttatgtgctgccccaggtagctggagtcaggttttgagtcgtaaattgtatctaccagccaagcttgcacctgatgcaaaggatgaaaatcttcctcttattgtagctattgatttgcaaccaatggctccaattgaaggtgtcatccaggtgcagggtgatataactaatgctcggacagctgaagtggtcattagacattttgatggttgcaaggctgacctggttgtgtgtgatggtgctcctgatgttactggccttcatgacatggatgagtttgtacaatcccaactcatacttccagggttgacaattgttactcatgtacttaaggaaggagggaagttgatattcagaggaaaggacacaagccttctatattgtcaggcggttaatgctatttgtgctaattctaggcgtttcacccttgcagaggcatttgcggtttgtgaaaactattcccctcctgaagggttcaatccgaaagatcttcatcgccttcttgagaaggttggaagtccctcgggggtagatgatacagattgttgtagtggttggttggaaggccctaataaggtgtatatcccatttctagcttgtggtgacctcagtgggtatgattctgatcgctcatatccactacctaaagttgctgggggaacatatcagagcttggatcctgtgcagccccctattgccccaccttacaagagagctttggagttaaaaaaagcttccagtcaaggattccgtgaacttgaaaagctctcattggattcttga

SEQ ID NO: 85319 - DNA, 699 bp, Glycine max
  Peptide Sequence Number=SeqID_202097
atggacgccgaacaacaaccccaactaatggaagagcaagagctccagtacgtagctgcaattggcgagcatccaagccctagtgcaatgcgccgtcctctactcatacgtgaaggaacgcacgtggaagagagaagagaggagcaagaacttaagtacctggaatttgtgcaattcgcgaccatccaggccctgatgcgctgcgccatcctctactcctacgccaaggagcgcgcgggtcctctgaagcccggcgtcaacaccgtcgaggaggccgtgaagaccgtcgtggctccggtctacgacaggttccacctcgtccccggcgaggtcctcaaatacgccgatcgcaaggtcgccgaattggaccgccacgttccctccaacgtgaagaaggtctcctcccaggcccgctccgtcgtctccgaagtccgccgtgatggtgtctccgcctacgccaaaatcgtttactcgaagtatgagcccacggcggagcagtgtgccgtctccgcatggaggaagctcaaccagcttccgctcttccctcaggttgccaatgtcgtgttgcccaaggctgcctactgcactgagaagtacaatgaggcggttgtttcctctgctgagaaaggttatagggtttctgcttatcttcctttggtgcctactgagaagatcgccaaagtcttcggtggaaactga

SEQ ID NO: 85320 - DNA, 414 bp, Glycine max
  Peptide Sequence Number=SeqID_202098
atgagtcccattggcttgtccttcctcttcctcatttctttagcacttctctctattgccagaggccaagaaagggcacctcacgggcttgtttacgagagccctgtagcttttccaccagcagcatatgacttctttcatcccaatgctcaaaagcctgagaacaaagacccgtgtgttgcatccaaatgttcaccactgcctctagcagctcaagtggatgccactcaaatatatgaaaacaaagcttcaacaacgcagaaaggtgggaaacaaataggaggtgggggtgtagctggcattatcactgctgttgcttttgctgtgcttttagctatgggaatctactatgtaaaagtcactcgccaagccaacatgagtcgagccagtaacagtgttcaatctcatgcttga

SEQ ID NO: 85321 - DNA, 267 bp, Glycine max
  Peptide Sequence Number=SeqID_202099
atggttgcaccgttcaagtcagagactagtttagtgactggcctggaggggttgggagaacctaccgcgtttgcgaaggtcacgaatgatgcgttgaagttctgcgagacgaagctaattccccttgaacacccaatcgtcgagcacaggtaccacactagtgttgggatttccaagggggctgattttcgaatgcaggttaggtttcttcggcctgctcgcaactgcaatgattctgcgaagaagaatatctcttctctgcgctag

SEQ ID NO: 85322 - DNA, 1656 bp, Glycine max
  Peptide Sequence Number=SeqID_202100
atgaaggctccgaatctgaatcaaatagtaattcgtgctcaacaacaactcctcacaaaccctaacccccaattcttgaaccccttactgtcacaactcacgaattctcgaaatgctttctttgatctttataaccagatgctctcacagcctttctcccacaaccactacaccttcacccacgccctcaaagcctgctccttccacaacgcgcgctccaaagccctcgaaatccacgcgcacctcgtcaaatcggggcgctacctcgacctcttcctccagaactcgctcctccacttctacctcgcccacaacgacgtcgtctccgcctcaaacctcttccgatccattccctcccccgacgtcgtttcatggacctcactcatctcgggcctcgccaagtccggcttcgaggcccaagcccttcaccattttatcaacatgtacgcgaagcccaaaatcgtcaggcccaatgccgccaccctcgttgccgcgttgtgcgcctgttcctctctcgggtctctgagactcgccaagtctgttcatgcttatggactgcggttgttaatcttcgacgggaatgttatctttggcaatgctgtgttggatttgtacgccaagtgtggagcgttgaagaatgcacagaacgtgttcgataaaatgtttgtgagagacgtggtttcttggaccacgttgttgatgggttacgcgcgtggtggctattgtgaagaggcttttgctgtgtttaaacgaatggtgcttagtgaggaagctcagcctaatgatgcaactatagtaactgttttatcagcttgtgcctctattggaaccttgagtttggggcagtgggtgcattcgtatattgactcaagacacgaccttgtggttgatggaaatattgggaatgctttgcttaacatgtatgtgaagtgtggagacatgcaaatggggtttagggtttttgatatgatagtgcacaaggatgttatctcgtggggcacctttatttgtggactagccatgaacggttacgagagaaacacattggagttgttttcacgcatgttggttgaaggggttgaacctgacaatgttacgtttattggggtgttgtctgcatgcagccatgcagggttgctgaatgaaggggttatgtttttcaaagcaatgagggatttttatggcattgtgccgcagatgaggcattatggttgcatggtggacatgtatggacgtgctggtttgtttgaggaggctgaggctttccttagaagtatgcctgttgaagctgaagggcccatttggggggctcttcttcaggcttgcaaaattcataggaatgagaagatgtctgaatggattaggggacacctcaaggggaaaagtgttggtgttggtacccttgctttgctgtctaatatgtatgcgagttctgaacggtgggatgatgctaaaaaggttcggaagagtatgagagggactggattgaagaaagtggcaggatgtagctgggttgagctagagatgtccaacaacagattgggttcaaatttgtgtactgcctacggtgatcgttggactgttcaagtcagaaaggtgcatggttttcttttcaatgttaggattgtgaaattctgtggcttggtgcagttttga

SEQ ID NO: 85323 - DNA, 675 bp, Glycine max
  Peptide Sequence Number=SeqID_202101
atggctccaattgaaggtgtcatccaggtgcagggtgatataactaatgctcggacagctgaagtggtcattagacattttgatggttgcaaggctgacctggttgtgtgtgatggtgctcctgatgttactggccttcatgacatggatgagtttgtacaatcccaactcatacttgcagggttgacaattgttactcatgtacttaaggaaggagggaagtttattgcaaagatattcagaggaaaggacacaagccttctatattgtcagatatttgaagttttagaaagtgaagacttgctcatgcgtttcacccttgcagaggcatttgcggtttgtgaaaactattcccctcctgaagggttcaatccgaaagatcttcatcgccttcttgagaaggttggaagtccctcgggggtagatgatacagattgttgtagtggttggttggaaggccctaataaggtgtatatcccatttctaggttgtggtgacctcagtgggtatgattctgatcgctcatatccactacctaaagttgctgggggaacatatcagagcttggatcctgtgcagccccctattgccccaccttacaagagagctttggagttaaaaaaagcttccagtcaaggattccgtgaacttgaaaagctctcattggattcttga

SEQ ID NO: 85324 - DNA, 360 bp, Glycine max
  Peptide Sequence Number=SeqID_202102
atgttgagaaaaagtaagagagtaagcttcagtcctgatgtcaatgaaaaaacaaccatgtttctcaaaaatggtgtgttaggaaacaggaagagggtcattggaagttggagtttctcaagattacccaaagaccctttgttgtcacctgtaagattcatactacggcttggagcaaaggtagcaagttccattagagttatttctatgggaaggagatcctccaggaaggtttcttcatccactttggtaaggtcacattcattgtcagaccctaatgactcatcgtatcgtgctaaggctgtagaagattgcattgagttcttgcattcatcatcctctagggagagacccagttga

SEQ ID NO: 85325 - DNA, 228 bp, Glycine max
  Peptide Sequence Number=SeqID_202103
atggaacgggatcaagttcaacatcaaccaatgcaaaagaaaattggaagaaatcttatcaaccttgccaacaaattggcatctccattcagatgttggaaaagacttgatactaagtgcagccttaagtcccaaattagttcaactaaagaaaaatttgcggctactgcacaagagcatgcaaacaacaagatacacttgagggaaaaagataaaagaattgagtag

SEQ ID NO: 85326 - DNA, 285 bp, Glycine max
  Peptide Sequence Number=SeqID_202104
atgtctgaatggattaggggacacctcaaggggaaaagtgttggtgttggtactcttgctttgctgtctaatatgtatgcgagttctgaacggtgggatgatgctaaaaaggttcggaagagtatgagagggactggattgaagaaagtggcaggatgtagctgggttgagctagagatgtccaacaacagattgggttcaaatttctctctctattacaaaaaccaggtggcaaaatgggttatctgccccgtcctaatgcaagtggcagttatagcaggctaa

SEQ ID NO: 85327 - DNA, 843 bp, Glycine max
  Peptide Sequence Number=SeqID_202105
atggcacgccgtgaatctctttccatgacaagggccctgaatgccatagcttatgtggcacttatattccttgcatttgcaatgagctgcagcacttcaactcgaatcctggatgaagtagaaagaccagaagcagaagaagctaacaatgctgcagaatcccatgttgctgaccaacaccacacgctctcgtttttcatgcacgacattctgggaggctccaaccccacagcccgagcggtgaccggcgtggtcaccaatccggctctgaacgctcaagtggcattcgccaagcccaacggagcaaaccttcctctgaacaacggcgtcccacagaacaacaacaacggcggaattctcaacaacaacaaccttcctttcctcaccggcctcggcggcaccacggccaacgtcttcaacaacggcggcaccggtttccctgtcaccaacaccaaccagctcccggcgggaatgacgctgcagaaggtcatgtttgggacaatgactgtgttcgacgatgagctcactcacgggcatgagtttggttccggtttggtggggaaggcgcagggattttacatagccagtgccgtcgacggaaccagccaggttatggctttcaccgctaagtttgaagaaaacggttacgttgacagtctaagcttctttggtgtgcatcgagcgcaagtttccgagtcccaaattgccatcattggaggcaccggaaagtatgtcaacgctgagggctatgcgattattaagacttttccgctgagccctcagcaacataacactgatggtgtccagactctgttgcagctcactgcctatcttgcctattag

SEQ ID NO: 85328 - DNA, 1536 bp, Glycine max
  Peptide Sequence Number=SeqID_202106
atggagatgaagtcctttggcgttgaaggtgaagctaaaatgctaaagggtgtttttcttccatatatatcaaccagccacgtgcttcccttggtagacatagcgaggatcttcaccatgcagggtggtgtagatgcgatcataatgaccacaccagcacacgctgccaccattcaaagctgctccactattggaacccatgttgtcaagttcccacaagttcccggtttgccggaaggaatggacacggagaacatcgacttgcgaagaattatcataccaactccaaagttccgcaagcgcattcccttcgtcaccgaagtcaaaacagtggaagacccggaagaagcattgtccctctttcaccgttacaaagaacagggtttccggcactattacccttcctatgccgcattactctacaaactagctcgttctagaatgttcgatgccgttgaaacgattctcgctcacatgaaagacaccgaaatgcaatgcagagagagcgttttcattgccctctttcaacattacggtcccgaaaaagccgttgaactcttcaacagaatgcctcagttcaattgcacccgcacgatacagtccttcaacgcgcttctcaatgttctaattgacaatgacaggtttgacgaggccaatgatatttttggtaaatcctatgaaatgggttttcgtccaaacacggtcacgttcaatataatggtgaaggggcggttggcaaagggcgagtgggggaaagcatgtgaggtgtttgatgaaatgcttcagaagagagtgcaaccgagtgttgtcacttataatagtctcattgggtttttgtgtaggaagggtgatttggataaagcaatggccttgctcgaggacatgggccagaaaggaaagcatgcaaatgaagtaacatatgcgctgttgatggagggtttgtgctctgtggagaagactgaggaagctaagaagcttatgtttgatatggcatatcgcgggtgtaaagctcagccggtgaattttggtgttttgatgaatgatcttggtaagagaggaaaggttgaagaggccaaatctttgctccatgagatgaagaaaaggcggcttaagccagatgttgtaacttacaacatattgataaattatctttgcaaggaaggtaaggcaatggaagcttacaaagtcttacttgagatgcagattgggggatgtgtgccgaatgcagctacatacaggatggtggttgatggtttgtgccaaattggggattttgaggttgctttgagtgttttgaatgcaatgcttactagtagacattgtccacgttcggaaacatttaattgtatggttgttggcttgttgaaatctggaaatattgatggttcttgctttgttttggaagagatggagaagagaaagctagaatttgatttggagagctgggaaactataataaagtctgcctgtagtgagaataagggtgcaagacgagcgttgatggtatttgatggcaaagatgaaagtagagcttag

SEQ ID NO: 85329 - DNA, 432 bp, Glycine max
  Peptide Sequence Number=SeqID_202107
atgaaccacttcttccggaaagttcccggaagaggttttccgggagtcttccggaagaagtgttcttccggaagacgtttcggttacttccagaagaacacttcttccggaaactttccggaaaatgttcttccggaacttccggaagaacccctaacgggtcttccggaaggctccgccgtgaacctcctttccccatttttttcggcgtcctctcctctcgtcttctaccctaaggttactatcctaaggttccactgctacaacaatgttgtatcatacaagcaaaggggagttagggagactaacctcgttcgcggagaagaagaagacgaggttcgcgcttgccttgcggagaagaagaagcagttcgcggagaagggagaagaagcagttcgcggagagggagaagaagcttcgcggaaggaatga

SEQ ID NO: 85330 - DNA, 340 bp, Glycine max
  Peptide Sequence Number=SeqID_202108
atgacttccatagagcaacaacttaatcttgtggtggtcgcacaaccaattaatgctattaaggatgctgatatcctcgaaagactttggaaaggcttcgaagaccaactatggaaagccaagacgatagcatcagaacgtctccgacttggtggagattcatcagttgcgcctacattcccaatgctagagacaaacgcatcagataacgctgatgaaacctctagaaaaactctacgcaaaaggggaagaaagacagcttccaaggttctcttccaagtgcctttttcttttcaacctcctgaattttgtttgaaggaaaaccatcaacctggacata

SEQ ID NO: 85331 - DNA, 210 bp, Glycine max
  Peptide Sequence Number=SeqID_202109
atggagaattcgtccctaacagtcaaccacttaatccaaccctatttcaatttactaagcgaaaatcaacttagggttttcaggagaactgccaggaaaccacattacaagcgaaacctcaaagagagttgggcttcgtcctcaaaaggaaacaacaccagaaaatctagccttccatggattcaaacagaaaacgcaattgaaacatga

SEQ ID NO: 85332 - DNA, 117 bp, Glycine max
  Peptide Sequence Number=SeqID_202110
atgacgcagaaacaaagttatcaattgagggtaagggagaggtgcattggccagttaatgccttatgcattcagtaccaaaccaagtgagcccagtcgatctgacgaccggaactaa

SEQ ID NO: 85333 - DNA, 2649 bp, Glycine max
  Peptide Sequence Number=SeqID_202111
atgaatttaagacagcgacccgtcgccgcgcgcggcggcgccaccaacctgccgcggccgcctccgctgaactccgtcttcaacattatccccgtgcatgacctcttcacggaccatccgtcgctccggtacccggaggtgcgcgccgccgcggcggctcttcgcaccgtcggcgacctcccgaagcaccagttcatgcggtgggaaccggagatggaccttctggactggctccggttactcttcggcttccaactggacaacgcgcggaaccagagggagcacctggttctccacctcgcgaactcgcagatgcgcctcgagccgccgccggtgatcgtcgacgcgctcgacgccggcgtgctgcggcggttccggcgaaagctcctccacaactactccgcgtggtgctcgttcctcggcctgaagtcgaacgtgcttctctcgcgccgccgcgacccaacggatcttcggcgcgagttgctgtacgtgtcgctttatcttctggtttggggagaggccggtaaccttcgtttcactcccgagtgtctttgttatatttatcatttcatggcgaaggagcttaatcatgttatagatgaacacggtgatcctgatactggtcgtccttatatgcctacggtttctggtgaattagggtttttgaagtctgtgattatgcctatttataatactattaaggttgaggttgatagtagcagaaatggaaaggctccgcactctgcgtggagaaattatgatgacattaatgagtatttctggagtaggaggtgtttgaagagactcgggtggcctttgaattttgaatgtaattttttcggtaccacgccgaaggagaagagggtggggaagacggggtttgtggagcagaggtcgttttggaatgtttataagagttttgataggctctgggtgatgctgattttgttctttcaggctgccattattgttgcttgggagggtaccacttatccatgggaggcgttggagaaaagggatgtgcaggtcaagatgttgactgtgtttatcacttggagtgctctgaggtttcttcaatcggtgcttgatgccgggactcagtatagcttggttactagagagaccaggtggcttggagtgaggatggcgctgaagagcatggctgccataatgtggactgttttgttttcggtcttttatggaatgatttggattgagaagggttctaggccaatctggtctgatgcggccaatcagaggatttatacatttcttaaagttgtccttttctttcttatcccggagctgttggcgttggtgctgttcgtggtgccatggttgcggaatgtcattgaggaatcagactggaaaatagtatacttgttgacatggtggtttcatacccggatttttgtgggtcggggtgtgagacaagcgctaatagataatgtaaagtatactgttttctgggtagcagtattagcttcgaagttttcattcagttatttatttcagatcgagcctctagttgctccaacaaaggctcttttgaatcttaagaacattcgttataaatggcacgagtttttcaacaacaccaacagggtagcagttgtcttgctatggatatggtattcaattttctctgccttttatggcgcggcaattggtttgttctcgcatttgggtgaaattcggaatgtgacacaactcagacttagatttcagttctttgccagtgcaatgcagttcaatctgatgccagaggagaagctgctaagtcagcaagctacactgttaaagaagcttcgtgatgccatccacaggttgaaactgcgatatggacttggtcagcccttcaataagattgaatcaagccaagtggatgctaccaggtttgccttaatatggaatgagattatgataactttcagggaggaagatatcatcagcgatcgagaacttgagctcttgaaactgccgccaaattgctggaatattagggttattcgatggccgtgttcccttctctgtaatgagctgctgcttgctgtcagtcaggccaaagagctggaaaatgagtctgactggtcactttggttgaaaatatgcaagaatgagtatcgccggtgtgctgtcattgaagcttatgatagtgttaaatatttgtttcccaaggttcttaaagctgaaaaagaagagtattccattatgactaatatattcggggtcatagacagctacattcagacggggaagttaacagaagcatacaagatgtctcggctaccacagatacatggtaaggtgagtgaatttgttcagcttttgatacaaccagagagagatatgaataaggctgtaaatttgttgcaagctttgtatgaactttttgttcgagagttcccaaaagtgaagaggaccatcatccagctacgtgaagaaggtctggcacgacgaagttcaacagctgatgaaggactcatctttgagaatgctgtgaagtttcctgatgctggagatgcagtctttactgagcagctcagacgattgcacacaattcttacttcaagagactcaatgcacaatgtcccattgatctcgaggcacgacgacgaattgctttctttaccaattctttgtttatga

SEQ ID NO: 85334 - DNA, 2373 bp, Glycine max
  Peptide Sequence Number=SeqID_202112
atgaggaggacttctggactacagaaaaggcccgggatctccgcctttggggcccttaagatgcttgcattccttgattcagcatctgagatggatgtaagacagggatcagaacatggttcaatgaaccaaaacagcagcttaaatggcctaccctcaaacggaccttcatctttacagacaaatctcaggccggcagatagcagtgtgtccatgttattcaagggacatgaatatgggagtgcactgatgaagttcacgtatgtggtggcatgtcaaatgtatgggcgccacaaggcagacaagaatccccgtgcggacgagatattgtatttgatgcaaaacaacgaggcacttcgagtggcgtatgttgatgaggtttctttagggagggaggggactgaatattactccgttcttgtgaagtatgatcagcagttgcagagtgaggttgagatttatcggatcaggttgcctggtcctttaaaacttggagaagggaaaccggaaaatcagaatcatgccataatctttacacggggtgatgcagtccagaccattgatatgaatcaagacaattattttgaggaggctctcaaaatgcggaatctgttggaggagttcaatgcatactatggtattaagaaaccaaccattttgggggtccgagaaaatatcttcacaggatctgtttcctcacttgcatggttcatgtcagctcaagacacaagttttgtgacactgggtcagcgtgttctggcaaaccctttgaaagtacgaatgcactatggtcatccggacgtgtttgacagattctggttcttgggtcggggtggagtcagcaaggcctccagagtgatcaatatcagcgaagatatttttgccggtttcaattgtaccctgcgaggtggcaatgtgacacatcacgaatatatacaggtaggcaaaggaagagatgttggtttgaatcagatatccatgtttgaggccaaggttgctagtgggaatggtgagcaggtcctgagcagagatgtgtaccggctaggccatagattagacttctttcgcatgctttcagtgttctacacaaccataggattttactttaactccatggttattgtactgatggtttatgccttcctttggggccgcctttatatggctctcagtggtattgaacatgcagccttgaaaaatgctaccaacaataaagcccttggtgcagtcctaaatcagcagtttgctatccaggttggtatcttcactgcgctcccaatgattttcgaaaactctcttgagcatgggttccttccagctctttgggacttcttgacaatgcagttgcagcttgcatcactattttacacattctctttgggaactcgcacacatttctttggtcggactatacttcatggtggtgccaagtaccgagcaacaggtcgtggtttcgttgtggcacacaagagttttgctgagaactatcgactatatgctcgaagccattttgcgaagggtattgaacttgggattattttaattgtgtatgctgctcatagtcctttggctagggatacttttgtgtacatagctatgacaatctcaagttggtttcttgtagtttcatggataatgtctccttttgtcttcaatccctctgggtttgattggttgaagactgtatatgactttgaagattttataaattggatatggtatcctggtggtcccttcaaaaaggcagaacatagctgggaaacatggtggtatgaggagcaagaccatttaaaaacaaccggtatatgggggaagctgttggaaatcattttaaaccttcgattcttcttctttcagtatggcattgtttatcagctgggtattgcaggtggaaataatagtatagctgtttacttgctgtcttggatagtcatggttgtgattgttgccatttatatcatcatggcatatgcccgggataaatttgctacaaaggagcacttatattatcgattagttcagcttcttgtgattgtaatcacagttcttgtacttttcctcctactggagttcgcccatttaaaatttattgatcttctgtcaagcttcttggcattcgttccaacaggatggggaatgatttcaatcgccctggtgcttaggccttttctgcagacaactaaagtgtgggaaactgttgtttccttggctcgtctatatgatttgctgtttggggttattgttatggctccaatggcaattgtatcatggttacctggatttcaatcaatgcaaactaggattctctttaatgaagctttcagcaggggtctccagatatctcgaatagttagtggcaagaagtctgtttaa

SEQ ID NO: 85335 - DNA, 531 bp, Glycine max
  Peptide Sequence Number=SeqID_202113
atggtggcgtacatcactacatctacttttcccagacaccagcaagtggaagccagtgttaagttctattatctggacttgcactgtatctcagaagatcttgattggtttcttactgacaggtgggcgggtcaggctttgtttggaactcttacaccagatataattgttctcacactcctatacagcatagctggattgggaattgctattgtcaatgacttcaaaagtgttgaaggggatagggctctagggcttcagtctcttccagttgcttttggtgctgaaactgcaaagtggatatgtgttggcgctattgacattacacaattatctgtagctggatatctacttggggctgataaaccgttttatgcgttagctttacttggcctaataattccacaagtcttttttcagttcaagtatttccgcaaggaccctgtgaaatatgatgttaaatatcaggctagtgcacagccatttttggtgcttggtttgttggttactgctctagcaactagccactga

SEQ ID NO: 85336 - DNA, 231 bp, Glycine max
  Peptide Sequence Number=SeqID_202114
atggaatctcagcaagcaaaccgtgaagaacttcatgagagggcaaggaatcagatacaggcgaatacaggaaggaaccgtggagggcagacgaggaaggagcagatggggagagaagggtaccaagagatgggacgcaaaggaggcctcagcaccatggacaagtctggtgtagagcgtgctgaagaggaaggcatagacatcgatgagtctaagtttaagaataaataa

SEQ ID NO: 85337 - DNA, 1500 bp, Glycine max
  Peptide Sequence Number=SeqID_202115
atgaaagagagggcttcaacaaccaaccaaacactaggagaggtaaaaaaaaagacattggataaacaggagcacctctgggagctcagccgtgcattagccgttttagcatcagcatcttcagtgagcagggaacgtgaagagtttttgaggcttgttagaaaggagatctcttttggtgctaaggatgttgatgtgacagaatggaaaggggacattctggcagtgggtgttacagagaaagatttggctagagatgcaaactcgaagtttgagaatgtgattttgagcaagattgactcaaagttgggtggcttattagctgaagcctcttctgaagaggatttctctggcaaagttggtcagtcaactgttcttagaattacaggacttggatcaaagagggttggattgattggtcttggtcagtcaccttccactccttcaccttttaagggtcttggcgatgccgttgtggaggctgccaagtcttctcaagaaagcagtgctgctgtcgttcttgcctcttctgaaggactgtctgctcaatcaaagcttagcagtgcttatgcaattgcttctggggctgtgctgggattatttgaagataatagatacaagtcagaagcaaagaaatcaacacttaggtccattgatattattggtcttgggatgggacctgaactggagaagaaactgaagtacgcaggagatgtttcttccggaattatctttggaagggagcttgtaaattctcctgctaatgtgctcacaccaggggtgttggcagaagaggcagctaagattgcttctacctacagtgatgttttcactgctaaaatattaaatgccgagcaatgtgctgaattaaaaatgggatcctatctgggtgttgctgcagcctcggaaaatcctcctcattttatccatctatgttacaaacctctgagtggacctgtcaatgtcaagttggctttagttggcaaaggtttgacttttgacagtggtggctacaacatcaagactggacctggctgttcaattgaactcgtgaaatttgatatgggtggttcaacaacagttttaggaacaacgaaagctcttggtcaaatcaaacctctaggggtggaggttcattttattgttgcaacctgtgagaatatgataagtggaacaagtatgaggcctggagatattgtcacaacttcaaatggaaagactatagaggttaacaacactgatgctgaaggtagacttaccctggcagatgctctggtatatgcttgtaatcaaggtgttgaaaagattattgacttggcaaccttgactggggcctgcgttgttgcccttggaccctcaattgctggtgtgtttacacccagtgatgacctagcaaaggaagtttttgaagcttctgatgtgagtggggagaaactatggaggttgccattaggggaaagttactgggaaacaatgaaatcaggagttgctgacatgtga

SEQ ID NO: 85338 - DNA, 465 bp, Glycine max
  Peptide Sequence Number=SeqID_202116
atgactcttagcttggctacgaaagtcatgcaatgtgacttcctaagtattggaggaatcaaatcagctgatacaacaacagatatcaagaaggcataccacaaggcagctctccgacatcatgcagacaagttgttggctagaagtgaagttggagatgaaggccaactttggaaggaaatttcacaggaggtgtacaaggatgctgataagcttttcaaaatgattggagaagcatatactgtgctttcagacccagcccaagatccaaacatgaaagcacaattggattgggaaagtcattacaaaggattatacttgtcaccggattatcccacttgtaaatcatataattgtcagttgtcactgacaaaggatttttatatatggcgaggattaaatatgagatttctaactaaaaagacagcggcattcatcatggggagaatgttgaggatctactaa

SEQ ID NO: 85339 - DNA, 231 bp, Glycine max
  Peptide Sequence Number=SeqID_202117
atggcttctctactcaacatggtttcggttccaccaagaatatcaccaacctcacacaccagaatcacttcgcttcaagctcgacccgttttgccagccttttctgtctcattttccagtagtggatttgaaattcttgttgtttttatggacattccagggaggagacaatcaattagagcaacagaaactgataccaatgaaggtgtttgttacgagaagcaaccctga

SEQ ID NO: 85340 - DNA, 1824 bp, Glycine max
  Peptide Sequence Number=SeqID_202118
atggccgaagctacatgctccaagactagtgttgatcgttgggaagatgccttcgcgaaactctcagcgtcaatgacttcgaagttcgatgaactccttaatcgcatgaatcagttagaaacttcacataccaacccccacgctcctccgtcgtttgctggtgcttccacggcggccacaacaaacgtagcctataggttgaagttggaggttccgcgatttgatggatcagatcctgaaggatggatattcaaggttacgcaagtctttgagtaccatgcgacaccggatcatgatcgcttgacgacggcatcattctatatggaagggcctggcgttagcgtggtttcaatggatagatccacggtatcagcgtacctttcggagttcgaagctctcgctaacagagttatcggccttccggtgccgtttgttcttagttgctttgtatccggccttagccctgcgattcaaagggagggaggtagacctccttccactgcaccacctgtagtgaacaacacgcgaccttcactttcctcgaatggaccttcgccagaatcatccctactgccatctgtgaccaaaccacgttcagcaaccatccctttcaagcggttaacgccatctgaattagccctccaccgtgaacaaggtttatgtttcaactgcggcgagaaatattcgcgaggccataaatgcacatcttctttgttcttatttgtcacagaagaatacgagtacactcaggaaattgatcccggacctccttcgttaactcttcctccctcgcaggaaacgtcaccagtgcagattagtctgcatgccctctccggtcaaggagcaccgaaaaccttgcgcctcacaggcttaatccaggatcatcgagtccaaatcctcatagatggcgaaagtacgcacaacttcctacaacaggagttagtatcttctctacaattaagcccacgagatacttccacgctgcgagtgacggtaggtaacgacgaagaattacagtgcaaccaggtatgcacaaatatctcagtgaagatccagaagcatgatttccaggtggacttccacgttctaccaattcgaggggctgatgtagtattgggggttcagtggctcaaatccttggggccagtcctaacggattacactgcgcttactatgaagtttatctacaatggacccacaaaccacactatcacacttcttccacactcagccccggttaacgtgaaaccctatcgttaccctcattttcaaaagaaagaaatagaaacccaagtcgcagccatgctcaggcaaggtcatatacaacacagttctagcccattcttatctctgggcactcacgcgatcacggtgcaagatcgtttccccataccgatggtggatgaactcctggatgagctaggaggcgcggtctggttctctaagttggacttgatgcaagggtatcaccaaatcctgatgcgagaatccgatataagcaaaacaacgtttcgcacccatcatgggcattacgaatttcgcgtaatgcccttcgggctttgtaatgcgccttcgtcattccaagcaacgatgaacaggttgttccagccacacttacgaaagtatatcatcgtcttcttcgatgatatactgatctacagtcacagcttggatgagcacgtgcaccatttagaaattgcgtttcaagtgttgaaggatggcaagtttaccctcaaattcgcaaagtgttcctttgcacagaagcaaatagactacttgggtcacattgtttccggcgacggtgttcggcctatacctgagaag

SEQ ID NO: 85341 - DNA, 618 bp, Glycine max
  Peptide Sequence Number=SeqID_202119
atggggaaacaaaagaagggccaaaacggtattcagaacacacaagacgaagtgattctggtgtgtgaggttggtgatattcttggtggaaccgaaaccatgttgagtagagaagccattgcagatttagagcttgaagatgccttggatacacagaaaaagacacgggttatcgatcctttaagtggtagtgataaactactgtcttctccttctcctcttcacaatgatccaagagctggaaggaaggggaggatttctagccgtgctaatgaaatttcaggaactggtgtagatgattttgagttgaggagtcttgatgctgatgatttaaagatagaactacaggctaggaaacaacgagaggcagctctggaagttgcattagccgagaaggaatttgtggaaaagcagtaccggaaaaaaactgaagaggccaagagaagagaagaagccttggataatgatttagcaaatatgtgggagcatattttggatgcaccgaaactagatgaggaaatgcccaaagaagatcccttggttgttcgcctcaagggtttaggtagggaagaaggaaaagagagaatcaagaccgtgaataatgggatatttatttga

SEQ ID NO: 85342 - DNA, 468 bp, Glycine max
  Peptide Sequence Number=SeqID_202120
atggcagctatacaaatgaccagccttgtctctatgacgtgttgggcctgtttaagtttgcctctagtcatgggcccttcaaggatacgtactaatacggaggctgttaagcagggaccttctacaggaaaagctgcaattgggggtccatttcgcgttatcaaccatcacggaaaacatgtaactgaaaaggatttcatgggaaagtggactttgttatattttggctttactcactgcccgaatatctgtccagaggaactacagaagttagcagctgctgttgataaaataaaggagaaagctggaattgaaactgttccggtttttatctctattgatcctgagagggatattgttgaacaagtcggtgaatatgtcaaagaatttcatccgaagttaattggattaactggtagccccgatgaggtcaagaatgttgctcgtgcatatcgcgtttattgttaa

SEQ ID NO: 85343 - DNA, 177 bp, Glycine max
  Peptide Sequence Number=SeqID_202121
atggctagattaggttttgaccgcacaaacaacatagctgagtacgacaagagcgccttcgggatccaagcggcaattgacttcaaggtcaagttgctcaaggccaaagaagagaaggttaaagttgctaatgactcgctcagcgaggcagatccgttcaacgagatgcatctgtag

SEQ ID NO: 85344 - DNA, 1641 bp, Glycine max
  Peptide Sequence Number=SeqID_202122
atgacgccacttccggtgaaggaagataagtcaggaggccttgaagctagttatttcagaatgcaaactggaaatgtgtacaagaatgtgaagaggaagattgagagaggtgttgctttccctacatgtttgtctgtaaacaacgttgtctgccatttctctccactagccagtgacgaggcagtgttggaagaaggtgatatattgaaaattgatatggcatgtcatatagatggattcattgctgccgtagctcacacccatgttcttcaggaaggtcctgttacaggaagggcagctgatgtcattgctgccgcaaatactgctgctgaggtggccttgaggcttgtcaggccaggaaagaaaggaggatctaagtcattctccttttccgttggtggtggctcaggtgattccaatccttttggatttggcttggatgatctttttggcagttttttcggtggtggaggtggtgggagtcagtttggtggttttggcagttcagccaagtctcaatctgggtccaagagttcttccaaaagtcttagagctgtaaattcacagatttacaagaaagaaatagagaatgcagggatgacttggcttttgttatcttatatgccctcttcgatggagatccaatactttgaatccactatagaggaggttgcaagttcgttgcatggagctttgaaggttggaagcataaactgtgaaaaggaagtctcattctgtaaggagcttagcatatatccacgcagagctccaaggcttattgttttttcttacaaggagaatgaaaaaggttatttggtcgagtataggggagacttggctgctaagaatttgaaggctttctgtcaagaatatttgccaaggttttcaaaacgaactgacttgaatcatcttgatcaattcagcactactggaaagttgcctatggtgctgcttctctccaccaagaaggacactcctgtaatttggcgtgtccttagtggcttgtatcacaaacgcattactttcattgatgcagaggttcatgatgtttctgatccaagagtgaaaacgctaggagttgatgcacttccagctattgtaggttggctaccaaatggagaaaagcgtgttctaaaaactgggatatctgtgaaagatttaaaatctgcagttcttgatcttagtaacatacttgatagttttgaaaaagtaagtaaaaaggaatcatcaggtcaggccaaggaggcacaaactgactcagacgagggacgcgtaccattactttctaaatcaaacattgaggctctatgtggtgagaaaactccagtctgcataattggtgccttcagatcttctaaagctagagaaaagcttgaatcaatcctctctttggtttctccaaaatctttgtcaagacgaccaaatcagggatccagcagctctagggactccatttcctatgctctcttagatgctgcaaagcaaaaatcatttctaaaggcatttgacaaaacagggaagtatagtatatttatgggtgaaatgacaatagaggagatagagaatttcattagctccgttctcagtggagatgtacccttcagagaagcaacacgggggaagcctgtactagagtattag

SEQ ID NO: 85345 - DNA, 432 bp, Glycine max
  Peptide Sequence Number=SeqID_202123
atgaagttgcctgggaataacaagaacttggaggatcaagtgcttgtgttgaccatcgaggcaaacaggttggagaagctcaatgttaatgcggaggccttggtgatgcacttgtgtgaagtctctgacccaagtgtgtttgacatcaacaaagatgtctacaatggggatttgatgatgattgacaacattctagaggatgttgcccctaagccagagaggctgacgacctcgacgaaggacttacatactaaaggtgtcggggtcgaggatgaagaccataaaatggaatggataaggagaaagaaagtagcgagtttatggagggctgattggaagggatttggttcaaagtctgaatgtgtttggatggagaatgaagatgataacaatgatgttcaagtgggattaaagaatgaaggtttagaatga

SEQ ID NO: 85346 - DNA, 378 bp, Glycine max
  Peptide Sequence Number=SeqID_202124
atggctaagagggtactcgacttcatagggtatattgcatcaggtttctctcgtcttgatcgaatacttatccggtatactggccctctaagcccttttttatcctcgaccaaaaagaaggcctttactctctgtgctagagcagttaagatcttcttctccgatggttcattgtcaggggagtcggtcgataatgagtctaaggttcatgggtacaataacgaagtttttgaggtgagtgagaatattgtagctccagtgctggtgcctgctgtcgagaaggggacttccatgaaagttgcaccttggcctaagaagcaccctatgttgaaggataagtgttcacctccccctattatgcttctcaagtacaattag

SEQ ID NO: 85347 - DNA, 999 bp, Glycine max
  Peptide Sequence Number=SeqID_202125
atgtctggtccatttgtgacaagaacattttggcacacactgtggggtcgagtaagatatatcttgatcccaagatattatggcgataacgagaactggaacaaacacaatagcaatgaagagattcatgttgaggaccataccaacttgtttttgatagtgcgttacaagctcaagtctcgaaaatgcacaggcatcacgcccaagttgttgcctttcggtgtgagaatgcccatctacgtgaagttcaggacgatcaaagaatgctatatggtcagcctaaggttacaccttcatgcaaggatggaagccccaaaagtcattcactatgtggtggttaaaatgagaaccaaagaggtgaaggaactagaactcgatctgagaactaacgatgacaaccagatggacccaagggacgaggagaagatgacatttatcaccaaattcgtaaacttttgctacaaatttatgccatccagacttaaaaacgctggagcaacgtatcaacatttgatggacaaggagttcaagggtcagcttggacgaaatctagaagtttatgcagatgacatgatgactgatggccctatagccaaagtactacgcaaacctaagctggtaggacggatgatggcatggtctattgaactctcagagtatgaaattgtttacgagacaagagggacagtctgggcccaggccacatgcaatcaggccgagtatgagactctcttgataggactaagatttgccaaagaggtcggtgcccaaagagtctggagcgaaagtgattctaagatcgccgccaaacagataaacaaagtggaggaaggcccttcgagatggaaaaaagagatagtcgagtacttaaaacatgagacactcacaatagacaagggaaaggccagaaaactaagaacgcaagatggagagaacaatggccataagagttctgagagtcgagtactattggcctactttgaggacggattgttcaag

SEQ ID NO: 85348 - DNA, 837 bp, Glycine max
  Peptide Sequence Number=SeqID_202126
atggacacaaagaaccaacaaatccaaagtgttgcattaaagctattacttgttctttggtctgagtcaactcctgcttcatctctagtttctcttaaagcttcattggttgacttgaggatgcaatgcttgtggatccttgatttttggtttgagtcaactcttgtctcgtctttagttgctcttgttcttgtctttgtagcttacaatgcaactatagaattctattgggttccatatcttgtggagtccaacagtgacattgacatcatagatataaagaaaaggataataaaagtggatgccatagctgaaagagccaaaaattggatgggcgtggacatccttgttttcaacacctatgtatggtggatgagtggtattaggatcaaaacaatatggggttcatttgccaatggacaagaagggtatgaagagtttgacaccccagttgcttacaataaaatgtctcatgattgtaacaagtcaaatgtgttgcttctcagaagccaagattggggcaacatggaaggtgtgaagtgcttcaatgagacaaagctagtgaggaaaaagaagcactgggggactggttctgacaagagaataatgagtgtggtggcaaaagtgacgaagaaaatgaaagttccagtgacattcatcaacataacacagatatcagagtacagaattgatggacattgttcagtttacactgaaaccgaagggaaattgttgactgaagaggaaagggctaatccacaaaatgcagattacatacagtggtgtttgcctggagttcctaatacgtggaatcaaatacttttggctatgttgtaa

SEQ ID NO: 85349 - DNA, 213 bp, Glycine max
  Peptide Sequence Number=SeqID_202127
atggccggtggtgcgaatttcgtgcagagggttctctcttacgtggtgaatgaagtggttgtcaatgggcttgccaacagccctgcatttcagaggtttgcagtgaggacatcaaaaagaattgaagatatttctaacaaagctgttcagaagaggcaggagctagctgagcagatcaaggacatctcaaaaaatatggaggttgtatgctga

SEQ ID NO: 85350 - DNA, 504 bp, Glycine max
  Peptide Sequence Number=SeqID_202128
atgggtgtcaagcagcaaaaacaaaacaaaaaaaaagctttgcccaccagtataagtggcggttctgcgtgtgggttggggtcgtcttctccgtgctcgttgccgtcgttcacgccgtgctcgtcgccgccgttcgcgccgtgggtcgtcgctgccgtgctcgtcgccgccgttcacgccgtgggtcgtcgctgctggctgctgtgtgcagcgggtaacgcgtggctgctgtcgtggctggttgcaggggtcgtggctgggttccgaggtcgcgctgtgtgttggagcttcgaggggttgcagctgcgttctaaagccaacaacaactcagcttttgcttctgcttttttcagtttcattattagtgcaagatgcctcgttctaaagccaacaagaactcaaagaaacagaagggcattgacttcaagctttttaacatgggtcacttgttcaaaattttcagaaaataaggcgaaaggttgggaggaaactgccaccacctaa

SEQ ID NO: 85351 - DNA, 1311 bp, Glycine max
  Peptide Sequence Number=SeqID_202129
aattatgaggatattctagtgaggaaccagtactatttacaggacaaaggaaaactaaaggatgctcttgctgggctggttcgctgcttgtcactcctgccatggaataaagaagaaactgatttgcacaataaggatgctactggacaaagggtattgcatgcctttgaagttgatgtgtctatgagctctaatgggaagtcttttggttgtatgatatccattcttcatagcatatatcttatagtcaggtctattgcttatgggactgataaggattcagaatccccaagttctcaaggtggacctgatgcagctgtatgggatgttaacatctcttctacattcttgaagaaattatttcctcgtttccccctcaacccggttgatcatctttctgaaaaggattgtgataggttgtttgacttgaacatgatcgttgccaaaatattttttgaattaaatgaatggacgagtcttcctcctaatttgttggagacatttctagaattttttgaaaatgctttgcttgggaagttctgcagggctacacagtctggtaaggctgtctgggaagagtgtttagttcagctcctttcatttattcctaaatttctttcacgtggggcaagctcttggacatcacgtcttcttcaggcttttacccagacatttagggaaagcaagccaggttccttgatgaaattggcatgtgtttctgctattgaagatatgctaactcctattgaaagcatgctttccatagagacaagcaatccagaaaatttagaacttcaagatgccttactcgcatggattagagagctccctctgttgcttatccagcttggagataaacacccaacctgctcccaggttctccattcagcctatagagatggacatataaaaattgcagattacttgagtgttttcatcaccttggtcttgcgtttcaaagtttcccctgctagaaaagctactgaattgaggaaagttgtgttcatccctggccaagaaaaagttaatttagttatctatgaaatcggttctgctggttttaagagtgatccactctgccaaactttgaagtcaatgacaactgttctttgctcatacatggcacagatgggtgacaattctcttgttctgcagatagtagagaaagtgccacaaatgccttctttggataatagttgctctctcctgagaatgcttgttacagtggattccaagcccacaagactttctgaacaaagcattatcattctaggccagcatctttctgaatatctgatggatgctgtgcag

SEQ ID NO: 85352 - DNA, 519 bp, Glycine max
  Peptide Sequence Number=SeqID_202130
atgtcttcaacagcaattgttcttccggaacagagtcttgcggcagagaaggcaggtttggctgtaaacaagaaaggtttgactttaaaagaacttctccagcaaacatctcatcacaatccaaaagttcgtagagatgcattgattggtattaaggatttattcaccagatatccagctgaacagaagttgcacaaatatgctgctgtagaaaaacttcgtgagcgcattggtgatgatgataaagtggttcgaaaatcattatatgatctttttaaagtagtgattttaccttgctgtaaagagcccagtacatactggaagcccagaactagaagaacctttaaaatcttatcagcaaaagcccaaaatgcccaggaatggtggggtagaagaaatttatggttaaaggttatggaatcatgctcccaccaaattaacctcactccagctaaaaagcgcaatattttcatcctactccctaaaccactgatccacccaaatgttgagccattctaa

SEQ ID NO: 85353 - DNA, 641 bp, Glycine max
  Peptide Sequence Number=SeqID_202131
atggcagaggttgagccgcactgggatcggctggagctgcgcgcgtggatcaaagtcaacggcgactgggtgacttatcagcagggcacgctggcatctctgctcacgccgatggatctgctggcgcgctactttggcgatcgcccggtcagtgaaggctttgcgatgtcatgcggcacgttgagcgcgattggcggcatccgtccggccagcgagttccgcatggcgctgcacgatccgctgttgaatcgcacgctggaacaccactatgtcaccggcacgctgccggcgagccagcaactgcgcgccggagacctcaccgcaagcgccgcgacgcaacaggcactacgcgccgctgagcagccatcgggcgaaggcgcacgcgtgtttacgcggacctacgccaacagcgccgttcagcaggcgcagcaggctgatgcgcgctggcaacagcagcagccgcgcagcccgattgacggactgccaatcagcatcaaagacctgtttgatgtggcgggcgaacccacctgcgctggctcgcgcgtgctggcggatgcgccgcccgccgcgcgcgacgcgcatatcgtgcagcaactgaaacaggccggtgccgctatcatcggcaaaaccaacatgaccga

SEQ ID NO: 85354 - DNA, 1579 bp, Glycine max
  Peptide Sequence Number=SeqID_202132
atgggaactccatcatcgaaccctctcttcatcttcttccttttctattcctctgtatcacttaatccttcagatttgactttcgaatcgacctacgctcgcctctgcaaccaccatgtccctgcaccgccctctcgttccgccgaaggaaccttccccggcgtcgccgacgagctccggttccaatttggctactttgccggcggccaccgattcttcaaccgatccgtctcgatgaagaaccgcgcgtcgagcgacgccggcgccgggaaggtcgctccggcaggtttatccgggccggagagtgacgcattggggagttttgcagtggatgcgcgtttctctgagtggattttggtcgcgctcttctgttcgaattacaggtttacaatagctgggaatgaaaaggataatggttgtggaagtggatctgatggggagggtttgtcccttagaaacttaagccaaggtgcttgcactacttttcttggacacacggataagtttgaattggaatatgggagtcactgtggtaatggtagttgcaatcctgttggtggtagtggtggagaattgcctgatttaatgctgcttcatgccactcaatgtgcggagaggcagaaggttcagatgctattgggttttcccgaatccagctaccaggatgctgtgtttccgtttcatccaaatacgacattggtttctgaggggatgtgggatgagaaggagaatcaactatgtgcggttgcatgctggatcttgaacttcactgaatcttcggttaatccttatgttggagattgcaagattaggctcagtttcaggtttcctgcagttttatctttgaggaacaggagtacggttttggggcagatttggagtgacaaagtggttggtgaatctgggtactttaggaaggttggatttcagggttcatcaagggtatcaaaaagcctccaaggtttccaatacaagtatgctgatactgagaggcatgttagtgacaaacagcagaaggcaagaaatccgaaagcacgtggtattcaaacagataatttgttgaatgtcagctatacaataagctttaattcccctgctgatttcaagtttggcagaggagtctcatcaaccaaagtcaaaattggggctgaaggaatttacaataggaatactggagttttgtgtatgataggatgtcagcatttgaggtcaacagacaaaatactgataaagaatgagactctggactgtgaattcatggttaatgttcagtttcctccattgaatgcaaaaggaggattgcaacttctccatgagaaaaagcacccggatgtccttccttacatttctgttgtgatgctcactgttattactctaggacacatgattcccctgatattgaactttgaagctttattcatggggaacgacagcgtgcagaatacttttcttggtagtggaggctggcttgaagtgaatgaggtagtcctgaggatggtgacaatggtagcctttcttcttgagttgtgccttgtacaattgatctggtcctcaagacagggtgagggaagccatcctg

SEQ ID NO: 85355 - DNA, 347 bp, Glycine max
  Peptide Sequence Number=SeqID_202133
gtcctcatgtgcctctccaagaatacattgaaaatttgaggaagatcgttgaccatctcaagatgaatatcgaggccatggatttgtggtctgctattcagaaaagagataactggcaagatgtttgcttcattgatggaattcacctgtcatctgagggaagcaagatagtgttgaaagagatactgaatgtcctcaaaggtgcagaatgggaacctagtctatattggaaatcaatgccaagtgagtttgatgaagattcaccatatgatccaattgcatctgatggaaagtcaactgttaatctttccaactgggtcttccctgacaatgacaaatgggactag

SEQ ID NO: 85356 - DNA, 441 bp, Glycine max
  Peptide Sequence Number=SeqID_202134
atgtcctttcctcatgtaaactcgcctccaccttccttggttgccttgtgtactaaaggctcagggctggttggtaaggtggactttactattaggcatctctcttcatccacaacttcatttcctagcacatggacattcagtagtggtcaaccttgtattggaagtgatgcccatcagatatttggtggtgttggtattgcctgtcttccattaggacttatattttcatttattcggcgtccaaaggctgttataactcgctcgcagtatatcaaggaagccactgaactgggtaaaaaagcaagagaactaaaaaaagcagctgaggcactacatcaggaagaaagaactggttcaaagggtagaaagtttcgtaaaaatgtgaagggagttgagaagtttgtggtagaaagtatacagttgctgaagtattcatag

SEQ ID NO: 85357 - DNA, 720 bp, Glycine max
  Peptide Sequence Number=SeqID_202135
atgtgggagtggcggatcttattcgggtttttggtcaactccaacgtattgggtagaaatatcccgaggagttttggaggacaagggagtggtaatgggcctggcctaaacgcaccagctggcactggagaaaaaaatagaaactggcccaaagatagaggaaataagcatttagcttatcaggaccttatggaatgttgccgtaaaggactttgctttaagtgtggagagtcctatggcccattccaccaatgtcttgtgaaacaattacgcgtcatattggtaggagacaagatccaggtggcgtgtgatgaggaagaacgcgtgtcaggacaggaggaagaagacgtggaagctgaatttgatggggaatgcagtgttctaaggttattaagctctcaggtggaacaaattggcaattcacggacaatgaagatgcgaggtagggttttcgacgttcccctctttatacttgtcgacaacaacgcttcccataactttatttctcagaagttagtgaaggctatgggatggaagtgggaggaaacgaggagcatgcaaatcttgctgggtgatggtcacaaaactatgacctatgatgacagaggagatgacaaaaagctcaaagatcaatcaaagaacaactcaagtgaatcaagaacaattcaagagttcaagataagaatcaagaagaattcaagacttaagaagaaagtttag

SEQ ID NO: 85358 - DNA, 1971 bp, Glycine max
  Peptide Sequence Number=SeqID_202136
atgtgtgtggatttaagggcactaaatagggttacaatacctgacaaattcccaattcctgttattgaagaattactggacgagttacagggagctaagtatttttctaaactggatttgagctcaggatatcaccaggttctggaagttttgaggcacaacaagctgtttgtgagacgtgagaaatgcacttttggccaagaacaagttgaatacttgggtcatatcatctctgtgcggggagtggcggtcaatcctgccaaagtgaaaagtgttcttgagtggcctagaccaaagaatgtgaagggggtcagaggcttcctaggcctcacgggctattataggaagtttataggggattatggtaagattgcacgagcactgactgctctaactaaaaaaaacggatttaaatggggtgctttggctcaacaagcattcgatgctttgaagaagtgtgtgacggaggcaccagtgttgagattgccaaattttgaagagcagtttgagttagaatgcgatgctttgggaacaggaattgaagcaatcctgatgcaaaatcgccaaccaattgcatatttcagtaagacattgggtgagaagaatttatctaaatctgcctatgagaaagagttgatggcagtcgtccttgctatccaacattggcggccacacctgttaggaaggaaatttgttgtgttttcatatcagaggagtttaaaacaattgctaagtcaaagggttttaacaggtaatcaacaaaattggttggccaagttgatggggtataattttgagataatttataagcctgggaacgagaataaaggagctgatgccctgtcaaggagtttggaggatgccaaattgactaatatgatctattatcctgagtggttagattggcagcagttgactcatgaggtgcagcaagatacccactggaaaaaggttatttctgatttgcaacaggataaagaggcccatactggtttctcttataatcagggagtgctgccttataaaggaaggctggtgatgcatgagaaatctccttggattcagaagttactagaggaatttcattctactcctcaggctagtcattcggatttttataggacatatcggaggctgaccaaatatagccattttgttccattgaaacacccttatactgccaagggaattgctgagattttcgtaagggaagtagtgaggctacatggagttccaaaatctctcgtagaattttggatcaataccacgcaccacgagtttatagggactactccttttgcagtggtgtacggtcgtgaacctcccaagattataccgtgcattccaggggaagtgagagtagaatcagctcagagggagttaattgatcgtgacgaggcattgagacagttaaaaacacatttactaagggcccaagatcgcatgaaaacccaggcggataagcatagaaaggaaagggagtttgaagtaagagatatggtgtttttaaagcttaaacaacacatgcgacattcagtcatggctagaattagtcctaaacttagtgcaaggtattatgggccgtttaaaatactagaaaagattgggaaagtggcttacaaactgcaacttcctcccacttcaagaattcatcccgtgtttcatgtgtccttactcaagaaggcagtgggaaattatgaggcagaagcagacttacctactgggctagaagatgatagagctgacatcaacgaacctgaagctgttttagcttctaggaaagtgatcaagcatggagaaatattgaaacagtggttgattcaatggaaagggaagtcagtggatgaagtaacatgggaggatgaaatctcaatccggagccaatttcctactctttgtcttgaggacaagacaattgctcaaaggggaggtattgatcaaccattggtgaagaattacgtgagcctttag

SEQ ID NO: 85359 - DNA, 432 bp, Glycine max
  Peptide Sequence Number=SeqID_202137
atgaagagagttgttgaagaagaacccgtcgttgagaagaaggcgccgttgaagatggcttgcaaaaccatcaatgaggaagaagaaccatgtcgatgtagaacaggatcactttgcagctttgttttcagttgtcacatagtgtggagaagaaaagaaaatgggtttgagcttcccgtatctgagccgtattggagtcatattgaagtcgtgtctagccttaggaagcctatcggtatcggatacgggtgcgacaccgacacttttccttttttcacgtatccgagcttcacaggtttccgagattttgtgaatgaagcagtattggttgtgcagtttcttaaaatggaaaggaaagatgggtgtcgtgtgattagtgcttgtttccgagattttgtgaatgaagcagtattgggtgttgtggttcttgat

SEQ ID NO: 85360 - DNA, 403 bp, Glycine max
  Peptide Sequence Number=SeqID_202138
atggagaaaagatttgtagtgtcaggaaaatatattgccttgcaaatttgtgatgatgaagatgttgaaacgatgctcgaaagttttaaacaacaagaacaaatgttagttctggaattgtacatagaaaaggatgtggcgggtggctctatgtttcattctgcaaattcgcttacatcatgtggaaataatttatcttataatgagacacaaccgccaacaaatatgagcaatttacatgttgacgaagataatgatgatgatgatgatgatgattatcttgtgtctaactcatacgttgaagagtctttagatgaagatgacaatgttgacggtatatctgatacagacgatgaagtcaccgacatgattcaaccagtaagaattgttcacccagcagaag

SEQ ID NO: 85361 - DNA, 2004 bp, Glycine max
  Peptide Sequence Number=SeqID_202139
atgtttgcatctttggaatatcaagatgaccatgctccactgtggtcatttgttacaataaagggaaagataggagatgggggaagtaatagactatggagttgtaatttttgtgaaaaagttgtcaaaagttcatactctagggttaaagcacatttgctcagaatttgtggtagtgtaattgatacttgtccgaaagttactgatgcatatttggttgatttgaggagggtttgtgaagaggttgaaaacagattaaagtctaagaatgttcctttacctactgacaaaaggactccaacaccaccaacattaccaccaaaaagaagaaaatcaagcaatatagagagtgcatttaatattgaggataggaatcatcttagagcagagatagcaaggatttataatgcattgagaactagtcttttacagcaagagaggtctcatattgaaaggttgcttcaacctatcaaatctttgtggagtttaaaaggagttacattggttgcagatggttggacagatgctcaaagaagacctttgataaacttcatggctatatctgaagaaggacctatgtttttaaaggccattgatgggtccaaggagtacaaggacaaacattacatgtttgacttattaaaggatgtaatcaaggaggtagggccacaaaatgtagtccaagtcataattgataatgctcttgtttgtaaggcagctgggttattgatagaagctgaatttcctcatattttttggaccccttctgtggttcatactttgaatcttggagtgaaaaacatttgtgctgcaaagaatgttgatggtaatgagaatgtcttcaatgaatgtgggtggattgctgaagtaattggcgatgcttcttttatcaaggttttcatcatgactcattcaatgagattagcaatttttaatgagttttcttgtcttaaattgctttcaattgctgaaactcgttttgcctctatgatagtcatgttaaaaagattaaaattgttgaaacgttgtttgcaaaatatggtcattagtgatcaatggaatagttatagagaagatgatgtcagaaaagctgcacatgtaaaagagttgattttgaatgatatatggtgggataaagttgattacatcctttctttcatggatcctatgtatagcatgattagaatatgtgacactgatgcttctaatcttcacttagtgtatgaaatgtgggattctatgatagaaaaggtgaagacaaccatctataggcatgatgaagtgctagaaaatgaagtttctagtttctttgaagttattcatgaaatacttaattctaggtggagtaagagttgtaatccacttcattgcttagctcattctctaaatccaaggtactatagtgataattggcttaatgaggttccaaatagggttcctcctcatagagatgatgaactttctagccaaaggaataaatgtcttaagagatattttccacatgttaatgttaggacaaaagtttatgaagaattctctaaattctcatcttgtgcgggtgactttggttcatttgattcaattgaggatagatgggcattagatccaaaaacttggtgggtgatgcatggatcctgtacacctatactccaaaaggttgctttaaagcttctagtgcagccatgttcttcctcatgctgtgagaggaattggagtacatactcctttattcattctttgaagagaaacaaaatggatccaaagagggctgaagatttggtttttgtgcactctaatcttaggcttttgtctagaaaagaggaatggtataaagaaggagagacaagattgtgggacattaatggagatgtacatgatccacttgatgatagtgctagagttcttgaaatggcaaatttatctcttgatgagccagatttagaagctatgcttttcttagatgatggcaatggaggagaagaaaatgaaacaattagagtttga

SEQ ID NO: 85362 - DNA, 457 bp, Glycine max
  Peptide Sequence Number=SeqID_202140
cacaaccaatgtattccttaacagaggaattgaagtccaaagctgaggtgtattatggggacaaagtttgcagggagaagttctctttgttgctggcagaaataggtctacctgatggattattaaccattcaagacattgaggaatgtggttatgtcaaggaaataggctttgtttggctgaagctcaagaagaagagggagcacaggattgataacattcttgtttgctatgatacagtggtaactgcttatgtggagcaaaacaagatcaagaatctcactggggtgaaggccagggacttcttgctttggttcactttgaacgagatttgtgttaagggcaatccagaagaacctgtcatcactttcaagtctttggttggtttgtctatgtcttttccattgtcattgtttgaagcagggaaagaagccaaggaagaagcaaaggaagagaa

SEQ ID NO: 85363 - DNA, 306 bp, Glycine max
  Peptide Sequence Number=SeqID_202141
atgaggatccaagacagtcatagtatccaagatgaggctactacgtcaccttcctctagtgaaagtgaagaagcaaaatgggaagaatctagtgaagaaatctacccccaagaagaaggacaacctttaatggttaaggatgagtttaaagaggtaagtgtctcctccaagaggtgctcatatgtgatgcaatcttaccccccaagggcattagatagaagactccaagaagattgggccagagatgcaagagaaggccctaggattctcatgagccttagggtagatttcgggcccatgggctaa

SEQ ID NO: 85364 - DNA, 546 bp, Glycine max
  Peptide Sequence Number=SeqID_202142
atgtcctttttaggagaaactgacagtcagacgattgtcaactcaaggttgggtttcatttttccaaatggatcgattatccacaatgatactggggtttacttccaaacttcgactccggtgctcattcgagtaccaaacaactatgattttgcaagcctaaaaatcagaatacacaatacccttcagctatccgacaaacaatttttggatgaaattcactaccggaagccattcacccatacaggtaaccaaattcgctttcagtgtatgaaattgataaatgatgacgatgtcaacacaatgttaatgtgtaatgataaattttcgtgtgttggtccgattgagttattatgcaccgttggaagaacaccagatggagtaataaacttacttcaacgcactatgccccgcactcatgacgcgatcctatattacaacgggaaatggaacatgtcaccgcagaacaaatttgttggatgcgtgttcacaggaaaaaatcctaagaaatttcaaattccttcaacatgtacatcgatgaactga

SEQ ID NO: 85365 - DNA, 250 bp, Glycine max
  Peptide Sequence Number=SeqID_202143
atggcaaaggggggggagctggacactgctgaaccggaagagattgctcaggatgagtgtctgggtaacaaagccgagaagggtgtagtcaaggatctggaagagagggttgatactgggtcaactatggcagtgactgagggggacttgttctgtgataaacaaatgactccaaacaagaacctcagggcagccaatcctaagaaaagaggtgaacctgaaagcagtaagagtaagcgttcaggtgctg

SEQ ID NO: 85366 - DNA, 429 bp, Glycine max
  Peptide Sequence Number=SeqID_202144
atgggggaggcacataatgtaccccgaggtcacgctctagccaacttcaagcctcacctcggacatgccactgaggggcaggcattttgtggtgaacccctgccaaacactttggggggccctcaatatcgcccacaatcacaacccttgcattttgcggtgggaagagtccctcctggtatggtgaaaagggagagatttgatcatataaaggagaggctgagggctattgaaggaggcggagattatgcctttgctgacatggtagaactatgcctagtgcctgacatcgctatccatccaaagttcaaggtgccagattttgataaatacaaggggactacttgccccaagaatcacctgaagatatacaatagaaaaatgggggcatactcgaaaaatgaaaaattgttgatgcatttcttctag

SEQ ID NO: 85367 - DNA, 570 bp, Glycine max
  Peptide Sequence Number=SeqID_202145
atgaccgtgcctctcaatgagtcaatctcttgctttctcataagggtgaacccttgggtactagtatctattgcctttagagggctacactccctcgccttcagagggttgcacacccctgccttcagagggctggatgccctcgactttagaggacaacacatcctcgactttagagggctatacgccctcgccttcagagggctacaggttctcaccttcagagggctacatgtcctcgccttcagaggactacacgtcctcgtctttagagggctacacgccctcgcctttagaggactacacgtccttaccttcagaggactacacgtcctcaccttcagagggctacacgcccttgcctttaaaggactacacgtcctccccttcaaaggactacatgtcctcgccttcagtggactacacgtccttgcctttagagggctacacgccctcgccttcagaggactacacgtcctcgccttcagaggactacacgtcctcgccttcagagggctgcacgccctctacttcagaggactacacgccctcaccgtcaaaggactacac

SEQ ID NO: 85368 - DNA, 207 bp, Glycine max
  Peptide Sequence Number=SeqID_202146
atggatgcttcaagatggtgtagattctttgtatacccttttaagatctcagtgtatcgctcaaccggggttaatgactttgctacatatgacattgaagaaaaagcacagatgagttatgacaagactgactttgtaaggaaagatgtctcatatctccatggccaaaagttattgcatcaagacgtgacaatcataagactttaa

SEQ ID NO: 85369 - DNA, 552 bp, Glycine max
  Peptide Sequence Number=SeqID_202147
atgcattatccaccatcgagtctggagcccccacgtattgattgccctagcgctgatcgtctatccggcaccctcaaatcttatcaagagccccatgaattgcttgtcattcatgcatcctccgccatcgagtctggaaccccacgagttgatggcctagcgctttttgtctatcctccaccctcaaatcatatccggagccccatgaaatgcttatccgctgttcgtctatccggcaccctcaaatcttatccggagccccatgaattgcttgtcattcatgcatcctccgccatcgagtctggagccccacgagttgattgcctagcgctcgctgttcgtctatccggtaccctcaaatcttatccggagccccatgaattgcttgtcattcatgcatcctccgccatcgagtctggaaccccacgagttgatggcctagcgcgtttcatctatcctccaccctcaatccttatccgaagctccatgaaatgcttatcattcatgcatcctccaccatcgagtctggagcgccacgaattgatttcctag

SEQ ID NO: 85370 - DNA, 330 bp, Glycine max
  Peptide Sequence Number=SeqID_202148
atgatgatgaaggacaattaccagttgaaggggactcttctctccttcaaagtattttggacaggttcgatggactccaaacatatgttcatgaaagattgtcatcatcaaaaagggggagattatggaagcaatgccttacaaggttattttgatgatgccaaagaatcaagagtcaagcaaaatccaaagattcaagaatcaagcttcaagtttcaagattcaagactcaagaatcaagatttaagaataatcaagatcaagattcaagaatcaagagaagactcaatcaagataagtactaaaaaagttttccaaaacattgagtag

SEQ ID NO: 85371 - DNA, 447 bp, Glycine max
  Peptide Sequence Number=SeqID_202149
atgaagagccagagagctaagaatttggtggaccttatgagggagataagaaaggaaactttcaaccggatttcgtaccgatgtgcattgagatgcaatgttagtcctgctattagggagtacgtggcattggagtctaaaacattgatgttgaatgaaattatgcaagtactggaggatggcaggatggacattgttcaactttatgggatggttggcctagggaggacgacgttggtgaaggaattgttcgatcagttgacaaagcttggacgggcgagtaggtgtggaagcaatgtctgccaagattattttgatgatgccaaagaatcaagagtcaaacaagtttcaagaatgaagatcaagattcaagattcaagaataatcaagatcaagattcaagtaaagaatcaagactcaagattcaagaatcaagagaatacttaa

SEQ ID NO: 85372 - DNA, 411 bp, Glycine max
  Peptide Sequence Number=SeqID_202150
atgactgcaatcgattttacattgttcttcgttcttcgtccggggtcctctttattgttttgtgcatcttcatctccttctcctatcattggtgatcgcttttcttttgtaaagactaaccgcctgagaattctttgtcccaacacattggagggtacatcctttgtggtacaagtagatggtacatctacttgggggtcagttcaagtggagggtacatccgcttggttattcaaagagaacaagggagggtacatcccttgtggatctttggcttgtaaaggattttacaaggttgaaagaaatctcaagaaccggttggttgcttggggattgaacgtaggcatggattgtggccgaaccagtataaatcttgtgtttgtcttcttcttccctactgtcataccctaa

SEQ ID NO: 85373 - DNA, 342 bp, Glycine max
  Peptide Sequence Number=SeqID_202151
atggatgaagatcaatggatgtatgacaatataatgttcgaagaagttgatatggatgatgaaaatgaacacgaatctggtgtgaataaagaacaacatgttgattgttcagatgcgtttgatacttctcaggtgttcgctacccgagatgatgttttgcagtcagacacaaacactggtatgagaggaaggacttcatttgtgttaattggttgtgagaggagtgaccagtataggtctaggaagaaagattttgttagaagagatactggagtaggaagtgtgggtgttccttcaagcttcgtgggaaaccagtggttggagggcaaggttggatggtga

SEQ ID NO: 85374 - DNA, 384 bp, Glycine max
  Peptide Sequence Number=SeqID_202152
atgggctccagtgccgcctcagagtttgatagtcactgttttcggtgtgtcgagcaccagcagcgcttcgaggccatcaagggatggtctttccacagggagaggcgtgtccagctcagggaagacaactatcctgacttccagggagatatctctcgcagacattgggcacgactagtgacccctttggctaaatttaacccggagatagtaatagaattttatgctaatgcctggcctactgaggagggggttcgggacatgcgctcacgggtgaggggtcactgggtccagtttgatgcaaatgtcagcagccagttcttgggcgacccactgattttgaaggaagaccagcagtgtgaattcagccagaggaggagctag

SEQ ID NO: 85375 - DNA, 387 bp, Glycine max
  Peptide Sequence Number=SeqID_202153
atggagaccgcaaggggcacttttgcacgtaaagtgcatgcatggcccaagcaaaccgccagtgggactggcgagttcgctgtcgtgaaggaatcgccactgggaatggcgatatgcgcatgcaaggggaaccgccagtttgactggcgagttccaccacgtaggctcagggctaggagtcaggccatgcaggtgcagcaggccatgcaagtgcaggtgcagagggcaacagcaggtgtaggagggactcgccattcgcattggcgggttgggctttgcgggaatcgccaacgtggctggcgctttgtggcagaaaggactcgccagttgcactggcgagttgctttaattcaaatttcgtgcattataaaagaagaagttggatga

SEQ ID NO: 85376 - DNA, 1551 bp, Glycine max
  Peptide Sequence Number=SeqID_202154
gacacgttaggatggacgtggcaaaagtgggctctcggacttcgcacgtcgactttgagatgtgcccttatcaagaggacaggaggggagacttgcaaagtaaaggactttgacgctcaatgtgtgttagctcgagatgtgagcgaatgtgtagaaggtttgatggaacttgggtcgagtgttggtgctcctattgtagggctgacgtggagggttgacacgcgaaagagattgtccagtgtcaaaggagagggtgatgagtttgtcgagcccccaagtgtggacgaatgttttccaatgttgggtatggtaacttcgacaagcatgatagaattacaggtcgatgtggcttgtcaagcccccgagcctggacaagtattatccggttttagggcaccacttcaactctcgccggttactgaagagtctgtcttcattttaaatggagtagacgatactcgttgtggtgcctccaacaacgagtcctcctttttggagaggatgagggttgcgcgtcgtattggtggggcacttctcgccctcgtgggagggcgtgaccttttgctgctatcggagagcctgccccaccatagcgttggattgccgttgtccacacctgctgtcgttggctatgagtgggtgagggacgatgttttgaaatacaagtcctctctcacctcggcgaaaagtgtcgttgttcttcaatgccatgtgaagctggtgagccctaaggactcttgcaagttggccgttcaagcttgcaggagtgatgacttccctttcttgagggtggcgcctagcagtctgcctttcttttttatgtatagatgtctgtttaaggtcttgggtctcattctccccttgatctctttccaatgtgttctgcttgagcaattgaatgtatccccttctcaacttcacccaaacagttgggcaatggtcctggctactgatgtcgtggctgatggtttaccactgatgttcaacagggaaagggattgttgcttctcgttctactggcagtctaaccctactagggttgacaaggctattttggagcagttgtcggtctcaatggacgcgtgggccattctgtctcttccttcggtgagtgatcccctcgttgccttggatggtattatgggtgacttcgcttggaggccactcgtgaagcaggttagacttgtgggtggaactgtgccaccgtttgttgctgttcttgttgtcggagaaaggggtcaacctactggtgaggttggtcctattgttgttattgctgaggtcacccatagtgctccttcctctattttggcaaagaggaaacatgatgatggtgttgggccatctggccgtaagaagtcaaaggcccctatgagtcttcatgccttgaggcagtctgccacttttgctgttgttgaagttagtgtgccagctactttggcgggtttcgttgtggcgtcgttgtccaccattgctacacctttgcttagtgtcagtgtagcaaccattaatgctcctgcggtgttgcctccttcctcttcggctccaatg

SEQ ID NO: 85377 - DNA, 377 bp, Glycine max
  Peptide Sequence Number=SeqID_202155
gggaggtggttgccgcccagctcgcccaggcgagccaggttgcttcctccagaagcaacagtcttctggaggaatattctggagggcccaagtgggcctggcacttggttcaccagcaggcggccaaccatcgtgggcaggtccagatacacgagtgtgtctaccggttcagtcttagtcagcgcgggcagggttccgctccttttgcgtgccctactccaaagcagtttggagctgaggtcgcatggcccagagactggcccgaggcccagccaggggaggagcctgcaggatcccccagtgaggtagaggaggcccgtatggatgaagagatgactaacttgctcgtgttcttgggaggaagcggagccacgtga

SEQ ID NO: 85378 - DNA, 159 bp, Glycine max
  Peptide Sequence Number=SeqID_202156
atggaggagttggatgagggttgcatggtaggacatgattggttgaggaaccctaagcgcatgcccaactcattctcattttgcataaggtttaagaagagtgtgcttgaaactatgacttcccttaagccttttaatgaaggagtacgaagaggatga

SEQ ID NO: 85379 - DNA, 222 bp, Glycine max
  Peptide Sequence Number=SeqID_202157
atgcaaggtgttaagtgtttgcaggtggtgtttggtgcttgcagtattgggtgtttgtgggtggttttgggtggaggtggagcttacttgggagaggcagggattacatgttctggaatgaaaaaaataatgaaagtctattacgaattacctaatttgaaagattggaatttaccatcaactccaaatcagctaattcagaagattggaatttaccattaa

SEQ ID NO: 85380 - DNA, 153 bp, Glycine max
  Peptide Sequence Number=SeqID_202158
atggtggaaggtcttgggtttatgcctgatttctttttgcagtcatataggcatctgaaaacaccaatgataaaggaagcaagaacggtggaatgcaaagagagagagctagagcaccaacagagtagccacaggaagaagaatcatcgctga

SEQ ID NO: 85381 - DNA, 237 bp, Glycine max
  Peptide Sequence Number=SeqID_202159
acttatattcagtgtcggtctttggaggagattaagaattacaagaaatatggaagtcgtcctcggcgtcacaaggtgaaaacacaagacaaagaagaaagcaatgacaaaaccaaaaatgaaatagatgaaatgcttgttgctcaaggaaaagcaaaagcagaagttatgagaacttttgttgaagagtttctttcggaagcttattacaatcagcttcacatgttcaacccataa

SEQ ID NO: 85382 - DNA, 336 bp, Glycine max
  Peptide Sequence Number=SeqID_202160
atgggaaagacgaaacctattggacttcctaagtctcatcatgaagatagatgcagagacaatggttctaaaatattgagaaagttatcgcattggccaaaacaaaatgtcctcacttggaagggatatgatataaacaagtactccttctacatgaagtcacatgatgacaagagtaaaatgcaaaatggtgggattagtcttgacactaattttgaacacttttgtagtgcatttgataacatccccattttgacgtccatgccttattttggagtcattgaaaacatttgggagcttgattatagtttgttcatagtgcttgtttttaagtga

SEQ ID NO: 85383 - DNA, 273 bp, Glycine max
  Peptide Sequence Number=SeqID_202161
atgacgctagttgaggaggaaagtgtcgtggtaggggagggtgcgggtggcgaggatgtcaaggagggtggattttctagcgccactggggcccaccacgaccaagatttgggaggagagggcagtgagggagatgtctttgaggatgcaggttggggtgtttgtggtgatggtggtggtgggggtggtgggaatctgaggggtcttccatggagggttggagtgagagtgaagagcaatggagggagggaggcccgaaaaagcgagaagtga

SEQ ID NO: 85384 - DNA, 234 bp, Glycine max
  Peptide Sequence Number=SeqID_202162
atggctagggaatctttgatcttctcccataagaagatgtggtccaagaccaataaccagttgctttttataagtgaatttgtcactgtcattatcccttttcaaagagggagctcacctggtcacgctattgctagagctttttttgctgacatttttgcggttattaatgctcttgaaatggctaaggagaagggtggaatcacatttggcttgagtgtgactctaccttga

SEQ ID NO: 85385 - DNA, 474 bp, Glycine max
  Peptide Sequence Number=SeqID_202163
atgattcgtgatcttggacaagagtctcttcaacaagcacatgcccctatgtatgatacattgcaaactgattcaaagaagcctttgcatctaaggtgcaacaattccttgacgctgttgtcagcggtgttaagtctagttaatgtgaaggccaaatatgggtggagtggcaaaagcattagttcactacttctagtagtgcatgctatgcttccaaaggaaaacacgttgccaaaaagttactatcaggccaagagaatactgtgtctgatgggtatggagtatcagaagattcatgcttgccctaatgattgcatactgtacaaacatcattttgaagaaattcataaatgccctaggtgtgaggtatcacgatacaatgtgaaggatgatgacgagtgtagtattgacgaaaactcaaagaaggcccccagcgaaggtgttgtggtatcttccaatcattccaaggtttaa

SEQ ID NO: 85386 - DNA, 177 bp, Glycine max
  Peptide Sequence Number=SeqID_202164
gtgaaaatgaggctaagtcatgaagtgctaaaagtgacagttgagcttagctcatcagcgcagcagttgtcttcagccaggcttagcgcacgactggcgctaagctcaaatccacttacttgcactgagcgcgagggtggcgctaagcgcaacatcgtgaattcagagcctatttaa

SEQ ID NO: 85387 - DNA, 405 bp, Glycine max
  Peptide Sequence Number=SeqID_202165
atgcagtttgatgaggagaaaacacacaggccaggaaggcagcgagaggcaagtggttttgtgtttctacggcacttgggaggaggcactatcacagaagtcttgggaggaggcactagcattggcaacaacagcaagtccatcgagatcagaaatttccttgacgagaagaaggtgaggaaagtcaaaatgcttgatggcgtttcagttgttagatttgaaaaggtgaaagatgaattaattttggatggaaatgacattgaacttgtttctagttcatgcgctcttattaaccagaaatgtcatgttaagaacaaggatatccggaagtttcttgatggtatttatgtcagtgaggatgaaagcatttgtgttggtttttggtttggagacccttttttttaa

SEQ ID NO: 85388 - DNA, 243 bp, Glycine max
  Peptide Sequence Number=SeqID_202166
atggggtggctattaccattggcaatgtctatattcctttcggcaatggacaaaaaagaagagtgtggggggagcttaggaggagaaataagacaagaggggaaagggacaaatttaacaacatctttgtacaagaatgaagcttgtagatattcctatggtgatatgaaccttcattgcacaaacgttgacttaggatcgtctaggattaaaccttcatggaaaatgcggaaaattgattaa

SEQ ID NO: 85389 - DNA, 336 bp, Glycine max
  Peptide Sequence Number=SeqID_202167
ggatcgcgcccgcaagacacccaatggacccgaagaagtccaacagggtcttggagttgccaagctctaattacgggcctctgtcagttctacggagtgcctgtcgcccccagcaaggtcatcaggccccctactaatcgagctttcatcaagaagtactgcgtccccaggcaggcacagggcgaaacaccacagcagcctagggatggccggcagcgggcaacagacgcaccgccatcacctctagagttcacctcagcttatccacaaaaggttagagcgttgcttatgacccatggccgaccaataggcgaccaagtccaaagccaaaggtaa

SEQ ID NO: 85390 - DNA, 363 bp, Glycine max
  Peptide Sequence Number=SeqID_202168
atggcggtggtgacccccaagtggattttccaatccccgtttcctcgatggtacaacctcaacatgacctgcgtttatcatgggggtgtcccggggcactcgatagaacaatgtgtggccttcaaacataagcactacgcgaggcgggcatcatttgcattgacgggggcgaggtgtcgcaacctactcttcggcgggagggcgacgcgagactcacgggtacatcttccaaggaaggaaaacgtgtggagtcgccaccaacgtttattcgaggaaaacgtcggaaaaacaaaaaaaaggcgtggtctacgaactttaagtgaaaggttcgggagttgtatttacacacggggaaggtattag

SEQ ID NO: 85391 - DNA, 831 bp, Glycine max
  Peptide Sequence Number=SeqID_202169
atgccgctgctggaaacgctgaccgtcaccggctccggccgctatgacgccttcaagatcggcagcaacaccgtggacaaggccacctacagcgtcggcatcgagttccgcccgatcgaaagcctgttgttccgtggcaagtacggcacggcgttccgcgcaccgaccctgtccgatgccttccagggtcgcagcggttactacgccaacggctccaccgactactaccgctgcggccagctgggctacgacccggccaacaccaccggctgcccgtacgacagcgtctcggtgttcggcacccgctcgggcaaccccgacctggagccgatcaccgccgacgtctggaatgcaggcgtcgtgtgggcaccgatcaacaacctgtcgctgtcggtcgactactacaactggaagatcaagaacgaggtcgatacgctcagctccgaccagctgctgctggccgagtactactgccgcaacggccagtccaacaacacttcggccagctgccagaacgtcgatgactggatcacccgtgatgcatcgggcgtgctcgacgagatctacacgccgaagatgaatgtcgcccgccagaacctggaagcactgaccgccagcttcaagtacgtgcaggacatcggccgcttcggttcgctgcagttctcggccaactacaccgacatgctcaagcgcaagctgcagccgcagccgggtgacgagttcctggacctgctgcacgacccgtatgcgatgtgggtgtatgactcgtacgccaaggtacgcgcggacggttcgatcggctgggccaaggacaactgggaccaccaccct

SEQ ID NO: 85392 - DNA, 733 bp, Glycine max
  Peptide Sequence Number=SeqID_202170
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaacacaggtctccgcaaagtcgggagccgacgaccgaagcccccggtgaacggcggccgtaactataacggtcctaagggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaagttactctagggataacaggctga

SEQ ID NO: 85393 - DNA, 243 bp, Glycine max
  Peptide Sequence Number=SeqID_202171
atgtatataaatctcccaatttatggttctttttggcttagcacgagattggcgctaagctcaaattcacttactcgcgctaagcacgagaatggcgctaagcacgacgtcaagatcaagaagccctttttaatcctgatttgcatagaattaaaggaggtgctgaatagccgtcagaggtttgaagagtatgaatttcagagagcacagagcagagcaaggggccaagttttcatcttttag

SEQ ID NO: 85394 - DNA, 393 bp, Glycine max
  Peptide Sequence Number=SeqID_202172
atgtttttaaagttaccttatacaagagactacttggcatggtatcaagaaaaggtcaacaccaaaggtgctcaaaagaaactgatgaccaaacatcaaagatcaacaaagcttgatccgtcttacttggagtatgtggatgctttacattctgtgcaaaatagtaattcttcaatcaaacatagcgcatcatcatctgaccaagcaattccaagaaggactatgccgatgttggatcaatttcatctgtgcattcatgattccattgaaaatattgtcgatgtcaaagttgacgataattatggatatcgtgcaattgatgtcttattaggtattagtgaagattcatggtctttggtgtgcaaccattttcttaaagaacttgccaaatga

SEQ ID NO: 85395 - DNA, 437 bp, Glycine max
  Peptide Sequence Number=SeqID_202173
gttggaggaatcatccaaatctgaaatggacaagtcctccacaacaagaacaacctgtccctcctttccagaatgttactggtccaagcaagccatatgttcctcctccaatgcagcaacaacagcagcagtcacaacaaagacaaccagcaactgaggctcctcctcaaccttccttagaagagttacaagagacaagagcttccattcagagtctgacaaatcagatggggcagatggctactcagatgaatcaagctcagtcccaaaattctgacaaattgccttcacaaactgtgcaaaatccgaaaaatgtgagtgccatcaccttgagatctggcaaccaaattcaagtgcctccaccagtagcagcacctgcacctgaacctgtcaagcttcattctacacctgaaaaagaggatgagatagttgcataa

SEQ ID NO: 85396 - DNA, 273 bp, Glycine max
  Peptide Sequence Number=SeqID_202174
atgccaatctccccctgcagatgtaccgggatcgcgcccacaagacgcccagtgggcccgaagaagtccaacagggccctggggtttctagctctggttacgggcctctgtcagtcctatagggtgcttgttcccccagaatcgcacccacaaagacacccagtagacccggagaagtctaacagggccctggggtttccagctctggttacgggcctctgtagtcctatagggtgctcgttccccccggcaaggtcacattatcataggtaa

SEQ ID NO: 85397 - DNA, 411 bp, Glycine max
  Peptide Sequence Number=SeqID_202175
atggcaacaccactaggcatagccaaagaagaagagtggtacatcataatcgtgaagaagaagtgcgcagctgctattcgtatattggcttatggatcacctgctgatagtgtggatgaatatgttcgagttggtgaaacaactacagtggaatgcttgcagcgatttgtattaggcatctgcaccatatttgggaatgagtacttgaggagaccaaataacgaagacaccgaatgcctactacaaatgggagcagcacgtggatttccagttttgtcaggacgtgcacctgcagtgcaattcacagtgaataaaacccaatataatatgagatactatttagcagatgacatttatccagactttgccacatttgtgaagaccatctcaatgccacaaggagaaaagtga

SEQ ID NO: 85398 - DNA, 108 bp, Glycine max
  Peptide Sequence Number=SeqID_202176
atggtgggcgaggagccaacactccatcttgaggatgaatgcacttcaggaaggtggatacccgacatgactacaggcgtggatcacttccttgggcctaggctttag

SEQ ID NO: 85399 - DNA, 462 bp, Glycine max
  Peptide Sequence Number=SeqID_202177
atgtcaagaaagtatgtgggggaagtaggaatgggtgataaaactagattttggattgatgcttgggtaaaggggaattgtttggcaaatttttttctaagacttttccttattttggaacaaaaagagaatttggttgggggagatggggtgtggaaggaggatagttggtcttgggagtttaagtggaggagggaaatgttcgaatgggagaggaagttgactttacgactaacaaatttgttacaaaatgtgcagatccctaagaaagtggcgttattcttaatttggagagcaatgagggatggactccctaccaaagataatttgagaaagcgtggaatcattttggaagaatccgaagcggaaggtcgattgaggagactcacacttagagagttatatggagtgcggttatttttaccatttggaagaagagaaataacattgtcttcaatatga

SEQ ID NO: 85400 - DNA, 126 bp, Glycine max
  Peptide Sequence Number=SeqID_202178
atgcaaatcgccattggcaatgacgagttcgttgcggattggacatgtggaacgcaaaccgccaacggtgttggcgacttcactgaacgtggcatctcgccacttccattggcgacacagctagtg

SEQ ID NO: 85401 - DNA, 414 bp, Glycine max
  Peptide Sequence Number=SeqID_202179
atgggccaatttgctaaggagtttgtagatcttaagagtggagccttctcagccaataccaaaaccatccccaaagagcaatgcaaggtagttaccactaggagtggtgctattgggaggaatgcaaatggagagaaaactaagaaaaagggatttttggaagttgttagtgaggaagatgagatatggttgatggaaaaacctatgagtggtaaggataaggagttaccttatgagacaagtagacaaaagagtgtagctgagggtgttgagctaaagaaaaccaaaaatgaaacagtgagaaaagagaaaaaagtttccaaacctatactccctgaaggattaccttaccctcatgtgccaactaggaaagaaaaagatagacaatttgcatatttcttgaacattttctag

SEQ ID NO: 85402 - DNA, 225 bp, Glycine max
  Peptide Sequence Number=SeqID_202180
atgtgtcggatgtccttgaaatggccccaaggaagcttgcttcaaagagatccaggaaggataaagcggcagaaggaaccagttccgctcccgaatatgatagtcattgttttaggagcgctgagcaccagcagcgcttcgaggccatcaagggatggtcatttcaccgggagcgacgcgtctagctcagggacgacgagtatatcaacttccaggaggagatag

SEQ ID NO: 85403 - DNA, 531 bp, Glycine max
  Peptide Sequence Number=SeqID_202181
atgggtctacggggaagtggggagggatttaacgaatgcaaatcgccaacactgctggcggtttcctcaccaagtcacagttcccgttggcgactccctgctctgcagctgcagctccgtgcagagcctcggaaatggcttctgtgcctttctctctgcaccctactcgtagcccttggaaatcgccagtcaatgctgcgatttcagcacagccttgaaatcgccagcaccgctggcgggatgcgccttcccctgatatcgctagcaccagtagcggcttgctatatccacgtgtccggtgctcacgaaatcgccattgaagcttgcggtttccatgcacaatccatgcaaaccacgtacaaaacaacaccatggcggaataagtttcaaaacaaccccaaatggggaataagtttgcaaaaggaccccaaatggggaaatttgccgcaaacactcgacctcatattccgtgaactggctcaattgcatcaaccttatttcaatgttgtaaaacgcccccctctacgatag

SEQ ID NO: 85404 - DNA, 297 bp, Glycine max
  Peptide Sequence Number=SeqID_202182
atgtcttcatgtaggtgcaaaattagtagattcagaaatggcactttgcagagcgcaatcaagtatgatgaggagaaatcggggagtgagtacagtttaagcgtccaaatgtgggaactcttaataacatgcgatgatgatgaagacggatcaagtctgaaagcaagcaggggctgctctcgttcttcaacttgccaagattgctcaacttgttattgtgaagggtgcatcaagtgccgctttgaggattgcaattgccaagaatgcagagactttatgctatatgctaaaccttaa

SEQ ID NO: 85405 - DNA, 195 bp, Glycine max
  Peptide Sequence Number=SeqID_202183
atggacattgaggaagatgaagatattcccttaattttgggacgtccatttatttctactgcaagctgtgtagtggacatagggaagaaaaagttagaaatagaaagaaaattgctggaccagaatttttgtttacaggtgaaggagtttgatgagaaggttctgaaggagagaaccaagattgatccaagataa

SEQ ID NO: 85406 - DNA, 393 bp, Glycine max
  Peptide Sequence Number=SeqID_202184
atgcctgaagagagtgaagaggtgcaagctttgaaagctgagctcgaaaagacaagagtggtgaatgagaagctgaaggtggcagtcattagggttaggaaagaatgtgatgagctgaaagatatcaacatgagcgcggctgaagcgctagagcgggaaatgaagaaggccagaaaggaagagtggagtagaaacaagtttcgaggggctttgctaggaagtagtaatgagctcaaacttagaaagatcgagagggataaatcaaggatggaaagcctgatgttagaggataagttaaagagttgtcagaggtcgaagagaagtttgaaagaacagttgagaaaaatggaagaaaatatgttgataatcattgaccaatataaaaagaggtga

SEQ ID NO: 85407 - DNA, 159 bp, Glycine max
  Peptide Sequence Number=SeqID_202185
atggaagagttggaagtcggggatgacacgaagaaggagtattacttttgtttcattgttcttcattttttatttctctatttctcgcacagggaccatgctttcagtgtggggaggacatttattcaaaccattatactgcctatttgttttgcgtga

SEQ ID NO: 85408 - DNA, 648 bp, Glycine max
  Peptide Sequence Number=SeqID_202186
atgctgtcccccgcgttgagagaagtgcttggtgttcaggttgacacgcgggcgaggattgtttccgcaatctggcattatgtgaaggcgaggaaattgcagatcccgaatgatccttcgttctttcactgcgatcaggctctgcagagggtgtttggggaggataaggtgaagttcacgatggtttcacagaagatttcgcagcatttgtttcctccacaggttatacttttggagcatatgatcaagctctccgggaatagtccggttgggtctgcttgttatgatgtgatggttgatgttccttttcccattcagagggaattgaatgctctggtggccaatgtggagaggaccaaagagatcgatgcatgtgatgagtccatatgtggaatcattagaaaaatacacgagcaccgaaggaggcgagcattctttgttggttttagtcagtctcctctggaatttattaaggccttggttgaatctcaaaacaaggatctgaaagttttacttggagaatctcgtcacaatgctgaaaaggaccgcaagtcagatttctttaagcaaccctgggttgaggatgctattgtgcgctatttgaatcgcaaaccagctgcaggaagcgatgctccagggagcacataa

SEQ ID NO: 85409 - DNA, 461 bp, Glycine max
  Peptide Sequence Number=SeqID_202187
atgtctatgaacaacaacaacccttccaatccctatggaccctcttccaccgccaacccacattcccaaattacccctggccagggccagtatccccggtcccaggcccacgccatcatccaagcccagttccaggcccagctccaagcccacgggctcaccctcaaccccaacgccaagcgtttccctccaaaaccccctattcacaccgccaccacgccgtttaaacaaacggaacccgctcccaccgtaccggctcgaaggaagaagcataaaccaaacgagaaacatcttcctgagaaagccttagcaattctcccagaatcggagatttacacgcagcttctcgacatagaagcgcgtgtggacgctgcactcgtgagaaagaaggttgacatacaggaggcactgaaaaacccaccctgcattcagaaaacgctgagaatcttcgtgttcaacac

SEQ ID NO: 85410 - DNA, 283 bp, Glycine max
  Peptide Sequence Number=SeqID_202188
cacctccagcaagggcatcaggccccctactaatcgagctttcatcaagaagtactgcgtccccagacaggcgcagggcaaaacaccacagcagcctggggatggccggcagcgggcaacagacgcactgccatcacctctagagttcacctcagctcatccacgaaaaggacatcccctttatccccaaaccgctggccaaaccctgacatatatcatgaccagccgttctacaagccttgagccaaaatcccaacttatcataaaccttgacccagggtga

SEQ ID NO: 85411 - DNA, 255 bp, Glycine max
  Peptide Sequence Number=SeqID_202189
atgaaaaacaatgcgactaccggggaaggggagtatgctgatgaaataaccacaaatgagattttggatgtttgcatttcatttctaaatgaccatttagaggaaacattgggttcaacaaaaatagaagaaaatcactcaaagtttattaatctcacacagggcaaggtttatggcaagttgggactttggctcaaggcttgtagaacggatggacatgatatatgtcagggtgttggtctggttcagggataa

SEQ ID NO: 85412 - DNA, 230 bp, Glycine max
  Peptide Sequence Number=SeqID_202190
atggaagaaatgaaaagagaaaaacatgcctcctataggggtcatgactcttgcaagagtttaggtgatgaacttagtgactattatagagggcaccataggtcatatactaaacatcactctcaaataaaagaagagaaaaggatagaaggcctcaagagggaaaaaaggattcatggggatcctccagttgagtattggaatgatcttatgagtgcccttaggaaaag

SEQ ID NO: 85413 - DNA, 237 bp, Glycine max
  Peptide Sequence Number=SeqID_202191
atgaaggagatggtgattgcggtggtgacaatgatgactacaatggcagaagtggtggttgtggtgacaataatgatgacgagttgtgacaataatggtgatagtggtggtggtggtgacgatgatgatggtggagacaatagtgagagtagtgaaagcaatgatggcggtggttgttatggtgacaatgggggactgatgacaaataaaacatttttagaagaacaaaaaaagtag

SEQ ID NO: 85414 - DNA, 318 bp, Glycine max
  Peptide Sequence Number=SeqID_202192
ttcctcatcacaatttgaggatacgtaggagcaaaagccctgcttttgtcaaccaccccaccttttgttatcgtgacccaagagtccggtggcatgcggagacacccgacggtaacccgcacacaccctttgctatccagcaacccgagagtccgatagcatgcggagacaccttacggttatctgcaccttgtcatttggagaccccaagtctgattgacaagcagagaccaatgtggtcatctgcaccctttccgaagatgtcagcatcttccggtagagactattttagtctcacaccgctttcgcaagaactac

SEQ ID NO: 85415 - DNA, 1056 bp, Glycine max
  Peptide Sequence Number=SeqID_202193
tgccacaaagcgcacgccatagtgcagcggcgtttgactcagcgcctgcgccagcgcgagcgagtcacgcccagcccggaagcgttatcgtccacgccctgcaaacgcaggccgccgagattattgtctgcctcgtgctggctgagcggtgtccaggtatccagatgggtgacgatcaaaatctcctgcggcacgctgccggcgcgtgcggcgatcaccgaggtcgccgtcactttatggcggcgcgtgatgccctgtttctccagccagttgtagctggtattaaactgtcgggtattgctctgataaccaagctgggtgaactgctgctgcagatgatctgccgtcatcagctcggcggggctgccgctcatgcggccggggaaataggtggcaatgtggcgcagctgctgttcggcaaagtggccaggtgcgatcgttgcagcctgcgccagcagaggcaaaccgccggcaatcagtgctgccagcacgctgcggcggagagtggcaaacatagtggttgtccttttctgacatcccgtcaggtcgcgttaacttattgtaaaactaacaaggttaacgtggattacttgcctctctttgccgatctcaacaaccgtccggtgctggtggtcggcggtggcgaaatagctgcgcgtaaaattgagctgctgcggcgtgccggtgcgcacgtgcgggtagccgcgcgcgagctcggccatgaactgcaggcgctgcgcgacattaacgccattgagtggattgctcagcacttcgacgcggcgcagctggacgatgttttcctcgtgattgccgccaccgacgacaatgctctcaacgcgcaggtatttgatgccgccaatgcgcgccacaagctggtaaatgtggtcgacgaccacccgaaatgcagctttatcttcccgtcgattgttgaccgctcaccgctggtggtggcgatctcctccagcggcaccgcgccggtgctggcgcgtctgctgcgtgaaaaaattgaagcgctgctgcccgccaatctcgggcagatggccgaagtggccg

SEQ ID NO: 85416 - DNA, 327 bp, Glycine max
  Peptide Sequence Number=SeqID_202194
atggaaaaaagtctaacagagggtttgaacgcggctttatcgtgtttgtgtggcggtcgcggaagtgatcgccaccaccatgttgaaagcttccgagggctttacccgcctgtggccgtcgctgctggtggtgctgggctacggcgtggcattttgggggctgtcgatggtggtcaagagtatgccgctgggcatcgtgtatgcgatttggtcaggcatggggatcgtgctggtgtcggtcgccgcggtatttgtttatcagcaaaaattggattggccggcgatcgtcggcatgggattaattattgccggcgtgctggtgattaa

SEQ ID NO: 85417 - DNA, 492 bp, Glycine max
  Peptide Sequence Number=SeqID_202195
atgagtaacggcagcagcccgcccgcgccggcgttaatcggcagaaacagtacccctgcgccaatcgcggtgccgtacaggcccagcatccacaccgtatcactcttgcgccagccggttgctgccgcctccaccgtaccaagggtaccggtttgtgagttatccatctgtctctccaaaattgtctcaaatgcagccggaacgacggctaaaaattcgcggcggcctgcagcgtgcggtcgcttcacaaaacgcgcctatgctacccgtttttgcccggcgtggattgccgcaacgcaagacatgcatcacaaaggcggagtgcaagacgcagcgcgaagtggacgtgagcgggagaatgaagtgcgggggtgttgcctgcagcaaggcgctgaggaggaaactcccccggcagctagcctcgggcaacgcagcacgtcgccagaggataacgccgggagaattgaaaatcagaacgcccgcattctgtag

SEQ ID NO: 85418 - DNA, 402 bp, Glycine max
  Peptide Sequence Number=SeqID_202196
atgagtgaagaaggtgagttgcaagagcagataaaggccgacataaaggccctgaaagagaaaatgaccacaatgatggaggccatgatgagcatgaaaaagataatggaagtcaatgcggctgcagttgctgctaccagcgctattgctgaggtgaacccgactccctcatctgaccttaaccaaataaaatcgtccaatctcggatatgttcaaaacaagcatgccttcccgccatatggcttgcctcccaattatacaccacccaatgtggcgcacactcctaatgagaatgacactaactccactcccatactcattgagatccaacaacctcaatctgatcatgcacccatccctcaacccatgggggaacataagaaataccccaccataatctag

SEQ ID NO: 85419 - DNA, 1491 bp, Glycine max
  Peptide Sequence Number=SeqID_202197
gctgcttcattatttcacacatctgtgacttcaattgggattgtactaatggaatcttggagttatgtccccgaagagaaaggctatttgttttctgatgaaatggatttttcacttgatgctttcatgagaagtagaaaagcattggttgaatgggacaacaaatccaactttgttgagaaagatggatttaattcagacagagaggtagttagaagcatggaatttgtggatttgggattccctgacttgttgcaaaagtcttttcatggaagccagcctctagagacatctagctatgaactagatagtaataattctagtaaaagagggaattcctccccacatgtcattgccttggattcttctatgggggaagaggaatccgattcaaagcatttgagttctctagttgaatccaagactcatgattcttcactgattgatctgaagctagggagattagcagattgtaaaggtgcaagtagtgataaagttgcaaaagaagggttcactttaacatctatacatccgaccacactttggaagagagctcgcacttccagcttgcctgcacaggctcctgtatgtcaagtttatggttgtaacatggatcttagctcctcaaaagattaccacaaaaggcataaagtttgtgatgctcactccaaaacagctaaagttattgtaaatggaattgaacagaggttttgtcagcagtgcagcaggtttcatttgctagctgagttcgatgatggtaagcgcagttgtcgcaggcgtctagcaggacacaatgaacgccgaaggaaaccccaatttgattacgtgactggtaaacagcacaagattcttcagtcatatcaaggtactaagtatctggggtcttcattacagaataaaccccagtttccctttcaagacatatttcaaagcagcatccttttccccggaaagcatgctcaattctctcagagtggacgtgtcaaactggaagaggactcgatttacggttcccaacttgctgcaccggtcacacttgatcaggaatcatcaagctgtgctctctctcttctgtcagatcagtcacagtatccgtcatgccacgcagcaggcaatccattagccagtccccaagtctttagtggcatccgcatacccgacagagacagccgagtttccaaaaagcctttgaggataagccctgcagataaacttgcaccaaatgagtcctttccatgtgatacaatctccaaggaagttatcaagaatagatccgccgcaacattttccagtgttggtcatgctcttgaagtccataatggagatgatatctgccaaccatcagagttgttcagcattaaacacagtctttcctcggaacatgcagccacggttgatttgttccaattgtcttcacatcttcagagggtggagcagcaaagaaattctgttttggtgaagtgggaaaatgaggactactgtttcccaact

SEQ ID NO: 85420 - DNA, 363 bp, Glycine max
  Peptide Sequence Number=SeqID_202198
atgattcactctgaggtgcatggtatttctatgatcattgatcaatctctattctttttattaactaaattacccagtcaaggtgcaccttttgagggcaccattgttgatgactggaagtttgattattctagtcatgatgctcgttgtatggacttaccacatgagcatactccgtcacctccgccacagagagatgcttcctctgctcttataaatgaagtcctttctaaacttcgtgagcttcgaacatttgtcgatgctattgatgctcgttttgacggcatggacactcgtattactcagcttgaagatgacatgggtttcattcgctattgctttgatccaccagccgacccatag

SEQ ID NO: 85421 - DNA, 228 bp, Glycine max
  Peptide Sequence Number=SeqID_202199
atgaccacaagcctttggattatggaccgggccgagtattttagtcaaatccacttcaatctccgtgtaaaccctgccactccgttttttctcttattctcgtgcttcggcggaaatcggcttagctcttcgaccggtggtgagggtgaaggttttatgttttatctggaggatgatttgaatcttgtgatttgtgaagcacgtagtcaattgctgaattcgatgtga

SEQ ID NO: 85422 - DNA, 3037 bp, Glycine max
  Peptide Sequence Number=SeqID_202200
atggtgagagattcgagtgattgggagcaggagcacgaggaatggcgcacacgattggagttagcagaggcacgcgccaaacatacggaggatcaattggctgcattcgctgccaagattgtttcaaatggaagcggtaatgttcgcggggaagaagaggagaccagcaggtgtgatggtagaatcctgggtgaccacgctgagcgcgaccggtggaggaagcttgagctcccaattttctccggcaacgatgcgtacggttggatgcaccatttggaacgatacttcgagttgcgaaacgttcatgagaaagagaaattgcgtgccactgtggtggccatggagggtagagcactgagctggtatcaatggtgggctaggtgcaatcctgaaccgacttgggatgggttcaagctggcggttgttcgcaggtttcaaccttcaatggcgcaaaatccctttgagttgttgttggcactaaaacaaacagggacggtggtggagttcgtggaggagtttgagaaatatgttggagctttgaaggccattgatcaagaatttgcacgaggcatcttcatgaatggcttgaaagaggaaattcaagtcaagggaaccaacactttcactaagccaaccactattcctaaggctagttcttacactaaatctatgactgtggataccaagccttggttagataagaaaactgagagtggtacctctgctactaatcttgttagtgttcaagctggggaaatgaataaaaccaggggtggtgatttcaaatgtttgtccggggctgagatgagagacaaaagggagaagggactctgtttcagatgtgatgagccctaccatagagaacacaaatgcaagaataagcagttttgtatgatcatttttgaagaagataaggaggaggacaaggatattgagtttcatgaaggagaaactttcaattctctacaattgtccctttgttcaatggttgggctgacttccacaaattattggaagatacaaggggtagttcagaataattctgttttggtactcgtagattgtggagcttctcatagcttcatttctcaggaggtagttcagaaactgtgcttgatggtggaagataccccttcttatattgtggaattgggggatggtcatagggtcaaaaccaactttggcaagttggagcttaccttgtctagagatggcaagttgattactttggttggtgatccttccttaactaggactgaattgtcttatggagctttcgtgcaaattttgaaggaggaagggaaaggcttgttaattcagtatgattctgcagagcagaaatcagtagaggtttcagttgtacctgaagttatttcagaggctcttcagcagtattctgaggtttttgaggatcctcaaggtcttccaccccaaaggaggttagatcatacaattcatttgaaggagggggttgagatacctaatctacgaccttataagtatccacactatcaaaaaactgagatagaaaggttggtttcagaaatgcttgaggctgggattataagaccaagcattagtccttactctagtcccatcatcttagttaagaagaaagatagtggttggcgtttttgcatggattatagggctctcaacaaaattactatccctaacaaatttcccatccctatcattgaagagttgcttgatgaactggatggagcaacaatattcactaagcttgatttaaaatcaggctatcatcaaattcggatgaaggaagatgatatagagaagacaactttccgaactcatgaggggcattatgagttcttggtgatgcctttcagtcttaccaatgctccttccacattccaagccctcaagaatgaggtcttgaagcctttcctccgaagatttgtcctagtcttttttgatgacatcttggtgtatagcagggatttggatgctcatcttgttcatatccaccaagtcttggcaatactaatgcagaatgggttaaagcacttgggacatgtgatttctggaggaggggtggcggcttgccctattcctattgatatgaagggtcttaggggtttcttgggactaacggggtattatagacgttttgtccaaatttatggtaagttagccaaacccttaattgagcttttgaagaaagataagttttgttggacagaggaagctacatctgcatttcaggccttgaaaacagccatggttgatcttcccttgctggttgtacctgatttcactaaggtctttgtagttgaaaccgatgcttctagtaaggggttgggggctgttctgatgcaggacggtaaacctcttgccttttggagtaaaggcttatctttgagagctcaacaaagatctgtttatgagagggagcttatggctttggttcaggctcaatttaagtgggctgttaagctcattggtttggattttgaaatccaatacaaaccgggtaaggagaatactgcaacaaatagtttgtctaggagagatatgtatgctgccatatcaatcctacatgtggaagatgatgactcttgggatggggaattacaacaagatcctaaattgcagcagttggtgcaggacttaattgtctctcctacttctcatgctgggtatgagttcaagaagggaaggcttttgtataaaggtatgaagggagatatcaagaagtttattgaagaatgtgatgtgtgtcaaaggaacaagtactccactttatctccagctgggctacttcaaaccttgcctattccttgccaagtgtggcaggacatctctatggattttgttgctggccttccacgagttagaggcaaggatacaatctttgtagtcattgatagacttacaaagtatgctcacttctttcctcttgggcatccttacaatgctaaggaggtagcagctttgtttgtgaagaaagttgtgaagcttcatggatttccttctacaattatatcggataaggatgcaatttttctcagca

SEQ ID NO: 85423 - DNA, 915 bp, Glycine max
  Peptide Sequence Number=SeqID_202201
atgggtgtcaaggtcggttgggtttccttaaatgcattcaagtttggaaaaatgttccagtgggccaaggattcatccaaatctgaccttgcaaagaaactgacaaagctcatggaggagcatgttgagggtgatggtgcgaggtggagaaaggaaaagaaggtggacacagtcaagaagtcagccgtgtttgagaaagaaaaggtggtagatgttgctcagaagtctacctcaattgagtctgaggacaatccgagcatgagggtaccttggatgaataatgccatccatcattatcacaagggtaccttggatcatgttttggtggcccccaacatcatttccttgtggaatgctaacttgactaatcccaaattcgtccagtcttttcctttcatgacccaaaccaaccgtggtatgatggattatgttgggccagaggctatgaaggtcaagcttagtaaaacaaaggagacttcttcgactaggtcaaattctattgctaatgattttgagttcttggccaagttgaacatgcttctatggagcaaaggttcgtcgatctccaccggtatcatgttctcaatgtttgaattgccttccattgtcagtcacgatggcttaagggtttctactttaatccaccacaacaaggaggaatctaatttagcttttggtcatgggaaatggaagtcagctaggccttgccctttgatgggcactcatactttgaatcatgggccaaactcaaagagttcaactgaccatgcaaccaatttttcggtaaggaggataggtgaagtggtgaggaagttcttcaacttggaaagcattgcttcgcactattggtcccatcgaaagtttgctggctacttcaatagtttgaagaatggcttcgccctttcgtccattttg

SEQ ID NO: 85424 - DNA, 435 bp, Glycine max
  Peptide Sequence Number=SeqID_202202
atgggtctcccgttttggggtaggtcccttgtggctagggaagtgagaggtatagaggagtttgggagtgaggatgagttttatgcttcatccctttcatctatatttgattcgaatagaatggaagattacttgggggctaaaaagcgtacggggagcaagtttgcccttatcgccatttatgggtacaagtgggttttcatggaaggcaactcataccttgctcagttccaaacccttgagtccatagaggagttaaaaaggaaaatcgacatgatgaacctggatgatgccaagctgttgattgttgaaccttgtggcgccgaggagcatgtgttcatgaaggcatcgaagggtgaggctgactttgtgtacttgtatgaagatgtctttaaggagttgaatattcaatttccatttctgaatcttgaatga

SEQ ID NO: 85425 - DNA, 489 bp, Glycine max
  Peptide Sequence Number=SeqID_202203
atggatcatgggggaagacacttgtaccatgttagtgttgatcctttgagggaagtgagaaagaccttgcacatcaccgtattgtcattggagtacaagtttacttgcatggtgaatgcatctaactgcttgtttggatctgaggtgccatcatatcattcaatgttcatgggtttccaggtgatgggtaggagaatatccatgatgttgtcctggaaaggatgtcagggaatgatgttattgatgaaagttgagtgcgaatttcctgagcatgagtgggtggtggggatgggaagcgaggtggagatgtttatggaagaggttccgtccatttctctctctctctctctctctcgtctaagaagacgtcattggtttggaggaggagtaatggcgccacctccaaaggctccacgtgaagggagtgctttggaagccaccaccgaaggtggaggacttgtcatcgccattatcatcctccacccttag

SEQ ID NO: 85426 - DNA, 312 bp, Glycine max
  Peptide Sequence Number=SeqID_202204
atgtgtgtcgtttataccgatcttaacaaagcttatccaaaggttgcatacccactccctagcatcgaccgactcgtcggggccacgtatcagaagctcatggacaaggtctttaaagacatactcggcaaaaacattgtagtatacatcaatggtatggtcgcaaagtcctccgactccagcgatcatccaacggacttgacaaaaatattcaccgaactccgaaggtaccatatgagactaaactcagagaaatgcatctttagggttagaagagagaagagatttcagaaaagctttgaaaagacatga

SEQ ID NO: 85427 - DNA, 654 bp, Glycine max
  Peptide Sequence Number=SeqID_202205
atggatgacaacaatcccatggtggcagaatcgaccaaacaaaagcaaagccaaatcaagtcggcacctcaccaattggcgaagaaggaagacacagggttatcaacaccatcgcaggtggcttcatcagcgaaggtaccgctaagtcaggaggcaagtccacacccattgtgtagtagagctagagaccaccttcggatgaggagaaatgtcaagaacgttactggtccagtacatccttatcgacaccaacacctcctacaatgtcttgatcagaagaatgacattgaacactctaggcacgccatttcaatgccctatctctcaatgaagttgcccaaccaacatggtgacatagtcacgataaaggcagaccaagtggaagcccgagagtgctacgccaaaagcctactcgacaagccttacacactcacctcctctaagcacaccgatgcagcagatgtcaaccatgtagcaggcgcaacaccaagcttagcttaccttgacccaaggaaagatgaggaaaacatgaggttagccccaatcaaggagttgcatttgctccaactaggcaagacaccacaccaatgcacaaagattggagagaaactcgacgaccacctcaagaagaggattgaggacgtgatgacatag

SEQ ID NO: 85428 - DNA, 369 bp, Glycine max
  Peptide Sequence Number=SeqID_202206
atggttgtcagcatcattaagcaccttagggattttgattctatcgttagggacatcagcatcaacatggttgctcttcttgcctccaaattgggtcgagaagcagactcgaaggagaaagtgtttgttctactggttaaagcagttaggtatgttgttttacaagcgctcaagtattggataattcttcccgctccccctgatactcccaacccttctgaaactggatcctccttaaaaggtgctttatcttatgttgttgagtatcgtggtgtgcacgtaaggcctagtgttgatgagcggaatgaattaaaagttccttgcctttgcaaagcctctaattataggagatttatgaattgggcttaa

SEQ ID NO: 85429 - DNA, 213 bp, Glycine max
  Peptide Sequence Number=SeqID_202207
atgaatgaccaaaccggtttcacatgcttggatgtacgctctccctcagcttcctcctcttcggagagcctggacccaattgctaacttatttgaacaagactcgagtcaagagtttgatgcaactggctgtccagtgtgtgtccacgtcccattccaccgcatgcctaatgcctgggtggctgggtttgcttccgtgtatcttaactcttaa

SEQ ID NO: 85430 - DNA, 138 bp, Glycine max
  Peptide Sequence Number=SeqID_202208
atggttttaacaaaaatcgatgttgaaataagatactcagcattggttttaacaaaaattgagggcgataaccacggagatggcgagcacgaccgcgagagcgaggacgagagggagcagagcttgcaagaggtggag

SEQ ID NO: 85431 - DNA, 498 bp, Glycine max
  Peptide Sequence Number=SeqID_202209
atgtcaccagaagtaccattgtttacaatagacatagtttcagcacccacacttggcttacagtttcaccccatttctggacatgtcaaagaatatgcaatccttgcatattcgaatgggccagatgaatgtgagctaaattcactggaatcatgtgcccttaatctttggcataaagtggacatacgttattatttgattaactgctttgagtatctggtaattggggggaaaagcatggaatgggtgaactgtttaagccagttgggtttgcctaaggagcctattatgaagtgcttcaacatgggaaatggggcacagcttggaaaaacatatattaatcaaaccgcacaactttacccacctccttcatttttgccatgggtggtggtgaacaatcaacctgttggaaaagactatgcaaattttgcacattatgtttgtaaggcttacaaaggtgctgcagttccagaggtctgcaatcctccttcgaaatga

SEQ ID NO: 85432 - DNA, 537 bp, Glycine max
  Peptide Sequence Number=SeqID_202210
atggtgggttatcctttcacttggtcgagtagcaagggtattgttaatggtgtggaagagagactcgatcgtgccatggtcaccagtgtttggtttgaatattatcctaatgtagaattgagaaattcaatatcatctatattagatcgtagtctcattattctggctacccaagaagcattgaaccattaccatatgaggaggagatttatattaaaaaatgcttggttgttggaggaagatgttgaggagatggtaaaaggtagttggaacaattctagtaaggttgattttagcgatgcaaaaaagaaaggtgatgtgcatgaggttaaactttgtatggatgctcctattgtttcccacttattgcttatagatgatagctttttcttttttagagctgatgagagagaagttgtggttagaagatttttggatgactatgttgcaacatctgggaaatatatcaatctacagaaatctgaagtcactattagtaggaatgttgatcaaggtttaaagaatgatgtgatataa

SEQ ID NO: 85433 - DNA, 372 bp, Glycine max
  Peptide Sequence Number=SeqID_202211
atgtggggatcgcacccacaaagacacccagtggacccggaaaagtcaaacggggccctgaggtttccagctctggttacgggcctctatcagtcctacagggtgcccgtacccccccccccccggcaaggtcacgtcatcatagggatcgtgcccgcaagacacctaggggacccgaagaaggccaacagggtcttggagttgtcaagctctaattacgggtctctgtcagttctacggagtgtctatcgcccccagcaaagtcatcagacccccctaccaatcgagctttcatcaagaagtactgcgcccccaggcaggcgcagggcgaaacaccacagcagcattgggatggccggtagcgggcaatag

SEQ ID NO: 85434 - DNA, 212 bp, Glycine max
  Peptide Sequence Number=SeqID_202212
caaggagcagaatcgtctcaggccacggtcagaagtcaagacaagtcaatggcagaaatcaaccaaggtacatagggacggatgcaagtggggctagggtcacaaccgaccgatcattgccccttcccggcgctaaacaagcagagaacgtcgctgcagggcagcccagtatcctttgcgttcgcagtttcttttactattgtttgttttaa

SEQ ID NO: 85435 - DNA, 825 bp, Glycine max
  Peptide Sequence Number=SeqID_202213
atgtcgatgcttctgtgcaaaggtcatatttcatgctcaaaatgttatttcgcaaatcctaacgaccaaaacgtgaaaacgtgggttgtgagcctacaatccaaatttgatggtgatccaatggtaaatgaatttgagattgtggttttaccaaaacagattgaagatctactcaagaaagaaattatcagaccgagtgtttccgtatggggagatgttattggtcaagaagaagaatggtggctcactatcaagaacaagtacactttgccaaggaaggatggtttcatggatctgttgcatgggacgaagattttctcaaagattgatttgaagtccagataccatcaagtaagggtgaaaaaaggagatataaccaagatgacatttcgaacttggtatgaacattacaagtacatggttatgccttttggagtgatgaatgctcttgctatattcatggattacatgaataacgtctttcatccctttgcagatgagtttgttgttgtgtttatcgatgacattctaatatattctcgtactcgtgaagtgcatgaagagcacttgagagttatgttggagattttgagggaaacacaattgtatggtagactttctaagtgtgagattttgctagaagaagtcaaatttttgggtcatgtgatctcagctgaagagattgcaatgaatccctccaaggtggtcaaaatttcaagacccactactatcagtaatatgttttctaaaaacttccaaaatggtcaaaatcccaactttgttactctgttgccaagatcaactagaggttgtgatgcaatatag

SEQ ID NO: 85436 - DNA, 291 bp, Glycine max
  Peptide Sequence Number=SeqID_202214
atggggatgtataacaaggttttaaaatatacaagtgatagcggagcctctgaccttacctttttgcctctgactgtaacagtggcttcaatttgtagtgaagaacaagggaaatttgaagacactgacagtgaaaggaatggaaagatgttagatagagagaagaagctgaaaagaaggagaagaagaagaagaaaatattggatggagttgttgtggatagcttcgacttttaatcggagcgagtggttctcgtcttgtgctcctatcgaggaatcaccggcggtttga

SEQ ID NO: 85437 - DNA, 339 bp, Glycine max
  Peptide Sequence Number=SeqID_202215
atgtcaatgatccgacaagtagtctgtcggtcatatccgcttggtcattacagacatgcggtgggcatcatgactggagtaatcaaacttccagtcgtcaacaatggtgccctgaaaaggtcgagatatttaggatcaagaatttgtcgaaatgaaaagagagaggagtaccaaagacgttgttcgtcagatgagaacagtgttgaaaatgacaaggagggtggaattggtgccaggggtgcttcggtggctccgtggcatcgagttcctgtcgtcgtagcggaggtggatgatccctttcgtttcttagatgattctaccattctgttgtgtttttga

SEQ ID NO: 85438 - DNA, 159 bp, Glycine max
  Peptide Sequence Number=SeqID_202216
atggtgccctcaaaagaaaatagagtagatgatcatggagatgacaaggaagggggaagtggtgctgtgggagcttcagatgatccatggtgtcgatgggcaacagcggcggaggaagtggatgagcccttttgctttttcgatgattcagccatttga

SEQ ID NO: 85439 - DNA, 390 bp, Glycine max
  Peptide Sequence Number=SeqID_202217
atggcacatcaccgagggtttcttaaagttgtaaggttatctgaacacaagggaaaggttgttcctgaaattggtctgtgtattgagaaattttgtgattttggactattggagtatgtcgcaacctaccctttggcgggagggcgacgcgagagctcacgggtgcgtcttgtagaagcaaagcttcatggtgaatcaaagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgaatag

SEQ ID NO: 85440 - DNA, 345 bp, Glycine max
  Peptide Sequence Number=SeqID_202218
atgcttgccgcccagctcgcccaggcgagccaggttgcttcctccagaagcaacagccttctggaggaatcttctggagggcccaaggagcttgcactgctgttggaagcgccacttagggccaaatttagggtgcagcgggggcttgccgtcaacaaggaaaaaggagtggaagatggtgttggcggggttcttggagcaggttgggttgtagaagttgcgattcttgggtactgtgactggagtggtagtggagagaggccttggaagaattcagttgctagacttatgcttgaagatggttcaatttggagagcaaaatcatttggtgcttcagggacataa

SEQ ID NO: 85441 - DNA, 285 bp, Glycine max
  Peptide Sequence Number=SeqID_202219
atgacactggaaagtgaggagaagaggtggttgttcatatttgcggtggtgcgacttgacaatgtgggtgttattggcgctcaccatgttagcgaggacgaatgcataacttgtggtcgcaatggtcaacactatagatctagaggcaccgttgaattggtgaatgctgacgccattaaatttgagcttgaggagagtgatggtggtgcagggcagggagaggttgaggatgggtttctaggcaagggtgttgatgcaatcctaccccctaagggcattggatag

SEQ ID NO: 85442 - DNA, 363 bp, Glycine max
  Peptide Sequence Number=SeqID_202220
atgaccactcttgcacagatatgtatgacgttgctacttagcaacattccacccggcgaccataatgtcgatctccccttgcggaaggatcgtgcccgcagacaccctgtggatccggagaagtccaacagggtcctagggtttccagctatggttacgggcctctggatcgcgcctgcaagacacccagtggacccggagaagtccaaccgggtcctagggtttccagctctgattacgggcctatgtcaattctacggagtgcccgtcgcccccagcaagttcatcaggccccctattaattgggctttcatcaagaagtactgcgcccccaggcaggcgcagggcgagacaccacaatag

SEQ ID NO: 85443 - DNA, 1209 bp, Glycine max
  Peptide Sequence Number=SeqID_202221
atgtctaagaaacaattgaatggacaggctgttgttacaatgtacaacttccaacaatatcgtcatatctcagtgcctgggtggtcactaggatggacatgggcaaagaaggaggtaatatggagcatgataggagggcagaccactgaacaaggggattgttcaaaatataaggcaaacatcccacattgctgtaaaaagaaccctatagttgttgatttacttcccggaacaccttacaaccaacaaatttcaaactgctgcaaaggtggtgtactcagctcgtgggcacaggaccaatccaaggcggttgcagcatttcaagtcagtgtaggtagtgccagtaccactaacaaaactgtcaaagtgccaaaagatttcacactgaaagcgcccggacccggttacacgtgtgggccggcaacaattgtgaaaccaactcaatttttacaaccagacaaaaggagagtgacccaagcacttatgacatggaatgtgacatgcacatattcacaatttcttgctcagagaacacccagttgctgtgtctcgctctcatctttctatgacaatacagttgtaccctgcactacatgtgcatgtggctgccagggcaactcatctcaatcaggagaatgtgtagatccagattcaccacatttgcaatcagttgtttccaacgctggacctggaaagagtagtatcacacctttggttcgatgcactcgtcatatgtgcccaatccgagttcactggcatgttaagcttaactacaaggagtactggcgtgtgaaggtcactgttactaatttcaattacgggatgaattattctgattggaacttggttgttcaacatccaaactttgacaatctgacccaacttttcagtttcaactacaaagcaataactccctacgggtcaataacaatgctttggggacttaagttctacaatgattttctcatgcaagctggccctcttggtaatgtacaatcagagctactattcagaaaggataaatcaaccttcacttttgacaagggctgggccttccctcggagagtctatttcaatggcgacgtttgtgtgatgccgccacctgatgcttatccatggttacctaatgcgggttccaggcaaatagtttccctgcttgctttggtgatgtcctctttggtagccttggtattatatgcagatacttaa

SEQ ID NO: 85444 - DNA, 360 bp, Glycine max
  Peptide Sequence Number=SeqID_202222
atggaaggggaccacggaggcaaaaataaaagccaccccgggtgggctttgaaacctcagcattcacctcaaactttgccaccaatgttgactgaggagcttgaattagttgtacagccagaagatatactgcagttgaggactgatgctggaggcaatatggaggttttggtgaaatgggctcatttgccatcttgtaataactcttgggagcgagcttccaagatgttggaggtttttccttcctttccccttgaggacaaggtagttcttttagggggggtattgataggattgctactcgaacaaggcttcctattaggaaggtgtatgagagaaggaaccaagcgtagtttctag

SEQ ID NO: 85445 - DNA, 2913 bp, Glycine max
  Peptide Sequence Number=SeqID_202223
atgggggacacagactcaatgcttttatccagtcaagatagcaccgtttctgctaaaccaacatcacaatctccatctaccaatcatgttccctttaccactgcacgcatgtcacgttcccaattcaactactccttccccgttaccccaggccccaaattccttcgtctcttcttctacccagcttcttatccttcctttccccacaccgattcctccttcaaagttcaatgcaaccaatttcttctcctcgacagttttaatgcctctttaaacgtcgatgctgtaaaaaaggaaaccatcttcagagaatacatcgtctatgtgggcgacaatcagatgcttatcctcagcttcactccgttccaaccaaactcctatgctttcatcaatggaatcgaggtcttttccatgccaagctacctgtattacacgtcagctaccgacacaggattcacgtttgtgggaagtggcacactattcagcatccaaagcagtgctgtattggagacatattatagaatcaaagtgggaggccaaggaatctcgcctggaaacgatactggtttgttcaggaactggattggtcacgatgaagattatttaattacacataatctaaagaataatctaccaggcgacacggatgctaagatgaacataattgtgaatcctgattacgtggcacccaaagaactttatagtatagcacgtgacatgggatcaaatgccactctgaacaaaatcagcaacctgatttgggagttccctgttgattctggctgcacctacatgataaggctccacttttgcgagcttgatccgcatgtttatgacatcggtgatagggtgttcttcatttacatagcaagccagttggccgagagtggcgctgatgttatgagctggagccagaaacagaaaggtctggctgtgtacaaagactatgccattttgattcccaagaatgatactgagaaaaaggttaatctgtcgctccagatgcatccttatcaaagtagttgggataccgaatactccggccctttcttgaatggtctcgagatattcaaaatcagcgactttcacttgcccgtccaagaaggacatgacagcatgcttcctgtcaccttgtgggtggtatctggtgttttctttgttttgtttctcttcatatcggcaacctacgagcgccgtcaactcttgctttccacgaacaagtcaatcaacacggaggattcttctttgccatcagatgactcccatctctgtcgtcgcttctccatcgttgagattaaagttgcaaccaaaaactttgatgacgtcttaattgtcggcgtcgggggatttggccatgtctacaagggctacattgacggtagttccaaccctgtggccatcaagcgcctcaaaccgggttcgcaacagggggctcgtgagtttctgaatgaaattgagatgctttcagagctccgccatcgccatctcgtctctctcatcggctactgcagtgatgacaatgagatgatactagtctacgatttcatgacacgtggcaatctccgtgatcatctctatgacaccgataatccccctctctcatggaagcaaagattgcagatttgcattggtgctgcgcgcgggctgcgttatcttcacagtggcgcgaagcacatgatcatccaccgtgatgtgaaaacaaccaacatcttgttggatgagaagtgggtggccaaggtttcagacttcggcctatccagaattgggcccacggacatgtccaaatcccatgtcagcactgctgtgaaaggaagttttggatatttagacccagagtattataatcggcaacgtttgacggagaagtctgacgtatactcttttggggttgtgctgtttgagatactgtgtgctcgtccacctctaatccacactgcagagcctgaagaattatcgctagctaattgggctaggtactgttaccaaagtgggaccctggtgcaaattgtggaccccatgttgaagggaagcatcgtgcctgagtgctttaccaagttttgcgagatcggggtgagttgtttgttacaagatgggatgcatagaccgtcgatgaatgatgtcgtttcaatgctggagtctgcactgcagctgcaagagggagtggagcaattaaaaaatgttggtattgttactgtccaagttcatgaagaaagaaagggaaatggtgacaatgtctttaatagcaatgagcatgactaccatttcaaggatagtgatacattgctccggtttctccgagataatcgacccaaagacatgcaccatttagatgaagcagacgaacgtgccaaaggaagagaaggagaaaagtacatcccgcgaaaatcagggacaactactgtccttacctattacgtgaaatctccgatcttcgatgttgaactagggggaggtacctacaaaagggactccaacaaacaagtcaatagttctcttagccacgttcgtgaactgttcctctatgtgttatgggcaagttcatgggcagcagttgaggatcgccactatccaatgtcgtgggggccccttgagctgagtgcgtgtcgagctttatgggtcgtactgtacataagcctcaaagctatgaattcatgtgtggatgataaagctgagtacactatggtcatgcttggatgttcatatgccaaggttgacacaatgagcataaccgatgtggtcgatcatgatgacccttgggtgtcttgtcattttgagaaatgcaatggagcacgtgtaacgacacgacccccaaggggttttgtcatttcaagatacgcagtaggcatgtgtaaagactccccctttcatggagtgttagaactggaagtgaaatttgaagaaactcagaaatag

SEQ ID NO: 85446 - DNA, 144 bp, Glycine max
  Peptide Sequence Number=SeqID_202224
atgaggattaaaattactaaccgcacgaatatggtgtcgggtacaatcttggatggacttcacgatggactacacgacagtgaggtttgggggcatgacggagacgatgtggtcaccgtggatctaaaaagggttccaagataa

SEQ ID NO: 85447 - DNA, 721 bp, Glycine max
  Peptide Sequence Number=SeqID_202225
atgattgaatccgaaagactctcctatgttagaaacaaccaaaagaaactcagagttgataagttctatagcttgcagcagtcatccgaagctggaaatacagaaggtttaggccaaggcaagaggattatcttaccttcaacctttgttggcagcccacgttacatggatcaactttattttgatggcatagctatatgcagtcacgtaggcttcccaaatctttttattacttttacctgcaatccaaattggcttgaaattcataggctgctgacacctttgaatttgacaccaatagataggccagaaataatctcccgcattttcaagcttaaatatgagcagatgttattagaccttacaaagaatcacctgctaggcaaagtcgtcgcattggaattccaaaaacgagggcttcctcatgtccatttattgttatttttacacgccaacaacaaatatccatctccaaatgatattgataatattatatcagcagaaataccttcacagaaagatgatccagaactctataaattagtccaaaatcacatgattcatggtccatgcgaaattttgaggcctgcatctccatgcaggaaggaaggcaaatgcagtcgattttatccaaaaaagtttcagcccacaactcttatagatggagatggttatcctgtatatcgtagaagaaatactggtcagacaataaccaagaatg

SEQ ID NO: 85448 - DNA, 1173 bp, Glycine max
  Peptide Sequence Number=SeqID_202226
atggattcagaaaactggaaacactctctcctctaccttatcttcctcctcgcaattctccacctcacgcagaactatttctcgcacaaactcttcctcgacaatgaaacggtgcgcatcaagaagaaccccgacctccccctccggttccgttccgacggtaccttcaagatcctccaggtggctgatatgcactacgacagtggaactattgtgacccggtgcaaggacgtgttggcctccgagttcgagttttgttctgatcttaacacaactcagtttttgaagcatatcattcgggccgagaatcctgattttgttgcctttaccgaatctctgtttagagcctttggccctgctatggaatcaggacttccttgggcagcagtgttgggaaaccatgaccaagaatcaactatgagtcgtgaagaattaatgtccttaatctcccttatggattattcggtctcacaaatcaatccattagatgatgatctcactaattcttctaaaggtggtatgatgactaaaattgatggctttgggaattataacctaagagtatatggtgcaccagggtccatggtggcaaacagcactgttttgaatcttttctttcttgatagtggagacagggctgtttatcagggaatccgaacttatggatggatcagggagtctcaacttaattggcttcgtcgtgtttctcaaaaattccagggacaaaagcaggatcctcttcatcctaccgatgctatttccacaacgaaacccccagcacttgcattttttcacatcccaatcccagaaattccacagctattctacaatgagatcatagggcagtttcaagaggctgtggcttgttcgcgagtaaactcgggggtcttccagacctttgtctccatgggagatgtgaaggctgtgttcataggccacgaccacaccaacgacttttgtggaaacttggatggtatatggttttgttatggtggtggctttggataccatggctatgggaaagcagagtggccaagaagagcaaggattatacttgctgaacagaatggaaagaagtcctggatgaacgtgcagagaatcatgacttggaaacgccttgatgatgagaagatgagtaagattgatgaacaaatcctatggcagtctagatga

SEQ ID NO: 85449 - DNA, 582 bp, Glycine max
  Peptide Sequence Number=SeqID_202227
atgaagagagagaaagagagagagagagacctggaggatcttgaaggtaccgtcggaacggaaccggagggggaggtcggggttcttcttgatgcgcaccgtttcattgtcgaggaagagtttgtgcgagaaatagttctgcgtgaggtggagaattgcgaggaggaagataaggtgagcttcgatcaaggtgaaggggctggtgttcattgttgcggtagttggttcgacatcgacgacaaacaagatcaatggatgtatgacactataatgtctgaagaagttgatatggatgatcaaaatgaacaagaatgtggtgttaatgaaccacaagttgattgttcggatgcgttcaatacttctcagataataatccgagatgatgttttgctgtggactcgatccattgttcatgaaaacggatttgtggcggtcattataaggtctgacacaaacactagtagtagaggaagaagtgtaggaagaaataatttgttagaagagatactgggactaggaaatgtgggtgtcccttcaagcttcatggcaaaccagtggttggagggcaaggttggatggtga

SEQ ID NO: 85450 - DNA, 354 bp, Glycine max
  Peptide Sequence Number=SeqID_202228
atggcgtttgaatttgtgaagaaaacaacaaaaatggcggcaaccagtgtcactactttccgcgttggatcagatcttcgagggcttattattcgaattcaaagcaaacacgatacgaagagtggcatttcggagatgcagttgctgcaatccaactacaacgcagagctcaagatgcgcgaatcgctcccaatctctagcaacgccctgaaaagaggttcgttacactacaatgcacaggtctgcaaaactgtactcggagtccttgaagaatctggcggatcaggagctttgattgcgaactttcgcgaccttaattgtgactgcaattttaatttaaatatagttctttag

SEQ ID NO: 85451 - DNA, 168 bp, Glycine max
  Peptide Sequence Number=SeqID_202229
atggcttgttcaccttggccaatatttgttggctatgtcaacgaaacatggataatctcatacaaggaaaaatttgttactgcctggataaataaggtgatgcacttaggaaacacaacaaataggataatctgttcaccgggctttaaaaagagtgttacagaatag

SEQ ID NO: 85452 - DNA, 351 bp, Glycine max
  Peptide Sequence Number=SeqID_202230
atgatgcatgcacctgactcaacactcagaagcaatgtggtacgtaccaacaacaaccaaatcttaggaaatagcctaagcatgtccacacgacactctcacttagggaactgtgctgagtttgtcgagaccacccggttgtgcattgccaaagaccctggaaggtcagtgcacagtgccccccacgatcatacacaacatccaacgtatgaacgtggccaaaagctagtgccaaagaccctgaaaggtcagtgcatagtgccccccacgaacatacacaacatgcaacatgtcgatgacgttatcaacaacaacaacaacctcatttcatattcacatattcatcaataa

SEQ ID NO: 85453 - DNA, 1929 bp, Glycine max
  Peptide Sequence Number=SeqID_202231
gctcagcatgagagagctgataattgtgcactccgggcagagaatgacaagatacgttgtgagaacatagccataagggaagccttgaaaaatgttatctgcccctcttgtggtggtcctcctatgaatgatgattgttattttgatgaacagaagttgagattggagaatgcccaactcaaagaggagcttgatagagtatctagcattgcagctaagtacattggaaggccaatttctcaactcccacctgttcagcctattcacatatcttctctggacctgtcaatggggacttttgcaagccaagggttgggtggcccttcacttgatcttgatcttctccctgggagttcttcatcacccatgctgaatgtgcctcctttccaaccagcatgtctctcggacatggataagtccctcatgtcagacattgcctcaaatgccatggaggaaatgatcaggctattgcaaacgaatgagcccttgtggatgaaaggtgctgatgggagggatgtccttgatcttgattcctatgagagaatgttccccaaggctaatagtcacttgaagaaccccaatgttcatgttgaagcttctagagattcaggagttgtaattatgaacggcttaactttggttgacatgtttatggacccgaacaagtggatggagctatttcccaccattgtcacaatggctagaacaattgaggttatatcttctggaatgatgggtagccatagtggttctttgcaattgatgtatgaagagttgcaagtactttctccacttgtttctactagagagttctactttctgcgttactgtcagcaaattgaacaaggcttatgggcaatagtagatgtttcatatgatttccctcaagataatcaatttgctcctcaatatcgatcccatcgtcttccttctggtgtctttatccaagatatgcctaatggatattccaaggttacttggattgaacatgtagagattgaagacaaaactccagttcataggctctatagaaaccttatttatagtggcattgcatttggagcacaaagatggctaactacacttcagaggatgtgtgaaaggattgcttgtctaatggtgacaggcaattcaacccgtgatcttggaggagtgattccctctcctgagggcaagaggagcatgatgaaacttgcacaaagaatggtcaccaatttttgtgcaagcattagtgcatcagctggtcatagatggaccacactctctgggagtggcatgaatgagattggagtcagagtcactgtgcataagagctcagaccctggccaacctaatggtgtggtgctaagtgcagccaccaccatttggctccccatccctccacaaactgtgttcaatttctttaaggatgaaaagaaaaggcctcagtgggatgttctttccaatggcaatgctgtgcaagaggttgctcatatagcaaatggtccacaccctggtaactgcatatctgtgcttcgagcattcaactcaagtcaaaacaacatgctgatcctccaggagagctgtgtggactcctcaggttccctagtggtgtactgtccagttgatctgccagccatcaacatagcaatgagtggtgaggacccttcctacatccccctcctcccctcaggcttcaccatttccccggacggccaagctgaccaagacggcggaggagcctcgaccagcacaagcacaggcagcagggtcatggggggtggttctggtcctggttctggtggctcactcatcactgttgcattccaaatcctagtgagtagcttgccatctgccaaactcaacatggagtcggtgaccactgttaatagcctcatcggcaacactgtccaacacattaaggctgctttgaattgtcctagttcctga

SEQ ID NO: 85454 - DNA, 159 bp, Glycine max
  Peptide Sequence Number=SeqID_202232
atgacaaaaccaatcttaaagtccattttgtggatagaccaatcagttgctgtgtggaaggatttacatgataggttctcacagagagatctgttgtgcatctctgatctacaagaggatttctacaaactccaccaagttgtggagcagttagcatga

SEQ ID NO: 85455 - DNA, 498 bp, Glycine max
  Peptide Sequence Number=SeqID_202233
gatcccgatttgacccaattgtctagtgacggtgtaccatttgaaggtgcactagatgatgattggaagtttgatttttctgtgcattatgcccgccggttggtttgcaccaatcaagcggatatgaccggaaggctgcttgtcgattcattggctcttgaaagccgcatcctccattatctaattgttctcatcttactccccagatcttcaaaccttgcacaggtttctgacgaagatctgatagtcatatctttcttgatcggtgctgctgtggttgcctcctttggttattgcaaagagtgtggtggctcttgggtaaaaaagggtgctcaacaaaatgatgataaaggacacttaccggttgaaggagactcttctctccttcagagtattttggacaggtttgatggacttcaaacctatgttggtgagaggtttgactccttggaacgtcaaagtggacacacgattcaaggagatgaactcaaggattga

SEQ ID NO: 85456 - DNA, 241 bp, Glycine max
  Peptide Sequence Number=SeqID_202234
catctctggaaggggatggcttagaatcttcaattatccacggaggaatacttgtacttgggggcatgtcactcggtttggaactcctttgagactcaggttgatcaccatgtggggagtttcctgtgcacgacagggtgacctcgacacttactacctagttttcctaagtgagagtgtcgtatggacacacttaggctatttccttaaggatggtaccacattgcatttgagagttgag

SEQ ID NO: 85457 - DNA, 213 bp, Glycine max
  Peptide Sequence Number=SeqID_202235
atggcatttgctaatgctttgacagttatgagtgaaagttctaaaaaagttgatattttggaaagtattagctcaagccaggttgtctggtcatcctgtaatgctacagtggggcatgcagttggacaacacagtgaggataataacaaattgatgtcttgtttaagcatccttgaaaaacttgaaggaatttatgttgctccttttacaaag

SEQ ID NO: 85458 - DNA, 270 bp, Glycine max
  Peptide Sequence Number=SeqID_202236
atggaagcagaaatgcaaacaacacaacaaaaaggagaagagacttacctcgacgtcaatggagcaacacaatgcacatcctcaatgcccgaagagaagaacctccaaagcaccacaaacacatcgaaaataatgctgaagaagaatgggctaaaaaagaagactcacaatcgcggaaggaagaagaaaaggctaaagacgcagttgcggaaggaagaagaacgtgctgggtgcacaaatgtttttaaaaaaagggcaggagtattttag

SEQ ID NO: 85459 - DNA, 183 bp, Glycine max
  Peptide Sequence Number=SeqID_202237
atggcaactgctagcggttacattaatgcacgcgattgttgctacagagataggggacaggggctggccatttgcgtgattgacttgcaagccggcaacatcacgattcacatatctatagggacaagaagcctcaccagacggttacgtagtaattttgttcttcaaggaaacaaagaatga

SEQ ID NO: 85460 - DNA, 378 bp, Glycine max
  Peptide Sequence Number=SeqID_202238
atggcgcagaagacgacgttagtctctgcgtgctatcaggcttttcgtattacagatagcaaaaaggtttatacggataaccactcgggtatttccgcccgtcagcgtgactcaaaagtcagtatgacatatcttgtgagcgcggaagatgacgtaaatctccgcgtgtcaacgggcttgtcggccgcgattgacgaagggcgcaggagacgacatagcaaaaaggtttatacggataaccactcgggaatctccgcccgtcagcgtgactcaaaagtcagtatgacagatcttgtgagcgcggaagatgacgtaaatctccgcgtgtcaacgggcttgtcggccgcgattgacgaagggcgcaggagacgacgttag

SEQ ID NO: 85461 - DNA, 300 bp, Glycine max
  Peptide Sequence Number=SeqID_202239
atgcttatgcatggctggttgtggaaagggttgtacatattgggttctggacgttttctagcagatcccaatgttcatgatgtttggatgttgtggaagcttggaggaattgatggggacccggtgttgagaggaacgaggataagggctacgtgggagtacgtgagctcagttgaaggtgggcaactggggatggtggatttatgtgtgatttgtggatgtggagagtcgacttgcaccatcgcccaatcgctacctagtaccacatatgacgggtaccccataatcctacaagcttga

SEQ ID NO: 85462 - DNA, 351 bp, Glycine max
  Peptide Sequence Number=SeqID_202240
ttcattgagaaggtagcctggccaggaactcggccttctcttgtgagggaaggtggaggtcccagttctcaggaggctactactccagaaaggtcaccacatattacaccagatccaccctcgccagtggtggatcattgttctcctcagcaactagcagaccatccttcaccagtgcatgagatgccagcagacccttctactccattactgaagattccagaggaccctgccacactagtcctgggactaactaccactcctccagccactcctgtgctacattttacagatgaggagggcacccaggatcaggatacccagcaggatgaccagtcgcaggagttttaa

SEQ ID NO: 85463 - DNA, 1047 bp, Glycine max
  Peptide Sequence Number=SeqID_202241
ctttttcctttattggtgctgatgaaacagaaggaacctctttccaaggcctgactgtagaaggtaaaaagccagagaagaatgaagtatcttttgctacttggaagagcgcacagaaagtggtgcaggaaggaacaggtgtaggatggggaaaagttgtgcagttgatagagagtaaaaaccgcgaaggactgggatttgcttcttctgcaggatccgcaacgaacagtgttggatcaagctccattactagcaccttttgtagcgccgggttcatcaacaactcgccagaagccaatgctgtcttggaagatgttcctgaagagatagtgcttgcatttgtcacacctggaaaacttgttcgcaactgggacgcggttgacatccctgcagtggttcatgcatcaaaactaggcatttatgagccctttgaacataataaccatgcattctctcccaacttcgaatctcctgtctacgaggctgaggaggaggaggatgacgaaattccggaggaacttgctcggttattggaatatgaaaagaaagccattcggcctcatgaggaggtagtagaggtgattaacttgggaaccgaggaagataagaaggaagtcaagattggggcatcgcttgaggcaactgtcaaacgaagggtgattgaattactcaaagaatacgtcgatgtgttcgcatggtcgtaccaagacatgcctggcttggatccccgtatcgtggagcaccgtttgcctttgaagcccgaatgcccaccggtcaaacagaaactgagaagaactcgccctgacatggctctcaagatcaaagaggaagtacagaagcagatcgatgcaggttttcttatcacatcagagtatcctcaatggctagccaacatagtgcctgttccaaagagggacggcaaagtcaggatgtgcgttgactaccgtgatttgaacaaggctagtccgaaagatgactttcccctacctcacatcgatgtattggttgacagcgctgcaaagtccaaggttttctccttcatggacg

SEQ ID NO: 85464 - DNA, 308 bp, Glycine max
  Peptide Sequence Number=SeqID_202242
ttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcactgctcgtgcgtcgaaaagggaaagggagtcaagaacttccccgattgctagccaaggccaaagcagtggcggacacctactccgcccccgaggagatccacggacttctcagctattgtcagcatatgatagacttaatggaccatatgattag

SEQ ID NO: 85465 - DNA, 309 bp, Glycine max
  Peptide Sequence Number=SeqID_202243
atgactgctcagaatgccgatgtactggcacaaagcctgaaaccccgccacgtgcgcatgctgtcgattgccggagtgattggcgccgggctgttcgtcggttccggccatgcgattgccgaagccggaccggcggtgctgctggcctatatcgccgccggcgcgctggtggttctgattatgcgcatgctggcggagatggcggtcgcctcaccggactccggttccttctccacttacgccgacaagtctcttggccgctgggccggctttaccatcggctggctttactggtggttctgggtactg

SEQ ID NO: 85466 - DNA, 261 bp, Glycine max
  Peptide Sequence Number=SeqID_202244
atggtggcaatgagaacaatcatgttggtggtgacggtggttgatgatcatgatggcagttgtgatggtagtcatgacagttgtgacgaaaacgatcaagatgatggtggtaatcatggttatgataggagctctccaatggataagagccccaatccttatgggcttactgtggacacagacaacaacaaaaaccgtactgtactcctcatgtttttgcaagacaatactctatggcctaaatggcctcacaaaggatga

SEQ ID NO: 85467 - DNA, 174 bp, Glycine max
  Peptide Sequence Number=SeqID_202245
atgtactttttcgagaaaagaaagattgcatgtggaggagagttggcgagtagttttgcatccttatgcaaagaacaacttccaatgaccaaagtactcaacatgctacaagttgaaaacagctcagcacattcattgtgtgaaagtgaaatgctcaagatgcaagctttttaa

SEQ ID NO: 85468 - DNA, 276 bp, Glycine max
  Peptide Sequence Number=SeqID_202246
atggttaacacaaatttatatctttgttttcatcaaaaccttaagagttgtatggatcatccagtgtctaacatgagtgttatgaatatgaagcaagaaacaaaggcaacccacagtgtggatgaaaagggaggtgcatattgtgatagggaggaggaagatgctcttggagtagtggccattgaggtgaaggagggcgtcgaggtaggggaggttgtcgaagggagggaaatttacttggtgggcaaaaggattgcacgttgggtaatggggtag

SEQ ID NO: 85469 - DNA, 147 bp, Glycine max
  Peptide Sequence Number=SeqID_202247
atgtcgaagcaggaaaaggcaaatgacgaaaaagctaggttcacatgcactgaaattttttttatgcagactagggaggagaatagggcactgtattggatagggaaatcagaaatcacatgcatgcatgacagcttaatgagttag

SEQ ID NO: 85470 - DNA, 348 bp, Glycine max
  Peptide Sequence Number=SeqID_202248
atgttaggagtgcctctgacccagtttggcggtggtgatggctttgacgaggaggcattgtttttgatatacccggaactgcaagtgttggagtgggaagaaaccctcgttcacctttctcccctgttttcccctaggattcttcctcagaaaccctcgatcaccttcccccctgtcactgtcaaagaacacttccccaaagcttcttcccctaccgactccgatattgttgcaagagttgttggagtgggaagacaccctcaaacatcttcctcccctgtcagagaacaccgccccaagccttcttccccagtcgactccgactccgactccaactccatttattag

SEQ ID NO: 85471 - DNA, 621 bp, Glycine max
  Peptide Sequence Number=SeqID_202249
atgaagtatgggaaggtgtggcaagtttacatcgccaggaaaagggataagtgggggaatcattatggttttgtgagatatttggaggtgggagatgtcaagagcttgaaaacaaaattggatgaaatcaaaattgagaatgttaagatgaatgctaatgttcctcattttgaaaataattctaacattggagtaaggaggggtgtgatgactaagaatggtagggcacaatctgacatgaaacctaaaggtccacaactagggacatatcgtgttgcaagggaacaaacctacaatgtccctaacaacaaaggaaaaggggtagtagatactctttatgcaaatgtagtaagatgtccaccgacagatgtcgggcaaaaatggagagtacataaaaggaaggaaaacattgacaatcacattaaggagtggaccacaaaaatgaaggttgatggagagacaaaggggtggctagtggatagatgggccaggagattgaaggatctgaccctctttgaaaggctcaacgacatctacttgtcagaagaaggagatagagttaaacttagatacctcaacagcgatgcaattttatctttggtgcctcccaagagatgttga

SEQ ID NO: 85472 - DNA, 351 bp, Glycine max
  Peptide Sequence Number=SeqID_202250
atgattatgaggggccaagacatttatagtagccaagatgaggctactacttcaccttcctctagtgaaagtgaagaagcaaaaggggaagcatctagtgaagaaatctacccccaagaagatggacaaccattagtggttaaagagaagtgtaaggaggtaagtgtctcctccaagagtgatcaaggggttcccacagaccctaagagaataaaggtcattcctgattggccccctccaccaagtgtcgagggaaggagcctagagtatgaagaacctcgggatttgaggtcaaatcctttccaaggtggaggggaaaatgcaatcctaccccccaagggtattggatag

SEQ ID NO: 85473 - DNA, 309 bp, Glycine max
  Peptide Sequence Number=SeqID_202251
atgcatgtgcgtcaagatttgccgattatggttagaactagagggttaggtcatgccttaggtaggattataggcaaagccctggggagagaggatcatcatgatttagatgatgttccccaggggcaaaggcctacagcattcgtacgtaggcaacgggaagttgcccctattgctgaggatgatcctgtgttgcatgaagacgtatatgcacatgctgcagaagctattcatgatgttgagggatttccaagtgggccgcgtgacccatcagtgctaactaactatggtgaccatgttgcagtcatc

SEQ ID NO: 85474 - DNA, 564 bp, Glycine max
  Peptide Sequence Number=SeqID_202252
atggcaacaaggcgaggcggggatgggtattacctccccagtccccgacctcgactccctaacatatacccgtacccgtccccgatactcgatgggttaaaatttgttaccccatccccgtgcccgtcgggtatcggtatccccgtcctcggcttgtcaaacccaagatccacccttggtgagtcacttttctccaaaggcttgtcaaacccaaggtccacccttggtgagcctcaccacaacctaaggcaaacaggtcctctattgctaagtttgctctccataggagctcaagtcaacccatggtacaacaacccaaggtccacccttggtacacactcttacaaaacccaaggcacccccttggttaggtcactccttaagaactatgacgaccacagtcaaaggtccaagttccacaagacgatctaccaccagactggttggcaagaccttcaactagcggaatggagaaagaagaaagatgattggagatgcctcttcaaggagaagatgagtcaagaagaagttcaccaccataagaagccatggataagagcttga

SEQ ID NO: 85475 - DNA, 153 bp, Glycine max
  Peptide Sequence Number=SeqID_202253
atggattacatcaaaatcttaagaaaaactagccgactgttgcatagggaaaaggccatttggtgtaggggaagctcatctaggcaagctggttgcttcaacttgaaggtattagcttgcccaggcaagctggagctcacccaagcgagctag

SEQ ID NO: 85476 - DNA, 189 bp, Glycine max
  Peptide Sequence Number=SeqID_202254
atgaagatgaatctaagagggagacaagtagagataagtgacccaatgttcccgttatgcaacaattcggaggaggttgcagcacaccttttcttcaattgcacacagcagaaggaatgctacacgaacaaaagatataagatggagctattggtggatagccctcacaaggaccatatggcaacatag

SEQ ID NO: 85477 - DNA, 1065 bp, Glycine max
  Peptide Sequence Number=SeqID_202255
atggaaaagctaagccataaggcgcgcacgcggcagcgcattctggaagaagcggcggtagtgatgcgcgaatgcggcaccgaaggcattggcgtggcagcgctgatgaagcgcgtcggcctgacgcacggcgggttttatgcgcactttgcctcgcgtgaagcgctggtcgaagcggtgattagcgagatgtttgccgactcggcgcagcgttttgccgccgtgctggcgatggaggatccggctgaacggctgaaccagtggatcgaccgctacctgtcggcgcagcactgtggcgcgccgggcgagggctgtccgataccggcgctggtcagcgaagtggcgcatttaccgccggatgcgcgggcgctgttttcagcgaagcgcgaagcagtgcggcgccagctggtgcaggcgctgcagcagctggggcatgcgcaggcggagagcatcgccagtagtatgcaggccgaaatggtcggcggaagcgcgccagatgctggaggtgacgcgtcaggcggtcaaactgcgcgccgggctggtgacggcatgagcgatcacgacatccgtgacatcatcgcgcccgatttacaggtgctgttctgtggcatcaatccgggtaaatcctcggcgcataccggttttcactttgcgcatcccggcaaccgcttctggaaggtgattcatcaggccggattcacccgcgaacagctgctgccggagcaggaacagcggttgctggagaccggctgcggcatcaccatgctggtagagcgccctaccattcaggccagcgagctggcgggcgcggagctgcgtgacggcggtgcgcgtctgcaggaaaaggtgctgcgctatcagccgcgcgcgctggcggtgctgggtaaggatgcgtttcagaaggcgtttcgtcagcgcaacgtggcgtggggcgagcagccgcagttgctgggcgaaacccgcttatgggtgctgcccaatcccagcggattaaaccgcgcttcgctggaggagatggtcgccgcttatcgccagcttcatgattggttacagaataaggcgtga

SEQ ID NO: 85478 - DNA, 382 bp, Glycine max
  Peptide Sequence Number=SeqID_202256
atgatcagtcaatggaacaatagagctgagtttagggttgaggtttatcctcggcaggagggcctattgagttttaactccgattacatgggtgaagttccggagacattacagtatatggtgtcaccacaagggaggaacacatggacagttgatgatctcgtgccttatgtggagaagataacgattttatctgaaaagcaagagaggatcactgagcatacgaaaggaggtcatgacactgatatgtctacaagcgaacattcgtttggtggtgttgtggaaacacatcctcatttttcatggccgactatgaccccttcgcagcaacatgatgccccaatggcaacacctagcgcccccattagctccgcaatggaat

SEQ ID NO: 85479 - DNA, 408 bp, Glycine max
  Peptide Sequence Number=SeqID_202257
atggatgctaggatgttctcaccgctgctattggacgtccagagcaccttggacataattgcagcagctgacccagcaaatcagggaccagctagaggagtcgatcacaaaaaaagtgactcagcagctcatggcaacgttcagctagatgcagtcccagtttcactcctagatgcaatctcagggacttgcattgcctcaggagcctctggttggtccctcaggtcctcgagtgaggcttgtacatcgaagcaaatcttgcccgcctggttgccttgggaagacttttatgagggatccactgttgttcataacactcctttgttgcctggccaagtaaaggtgggtgtggaggaggttaaagatccagatgttcccgttcctgtacccactgatgagtttccttag

SEQ ID NO: 85480 - DNA, 258 bp, Glycine max
  Peptide Sequence Number=SeqID_202258
atgtctcctccacctctaagacctcacaatcactcacaaactcatttcaagctctcaggacggcttcctcttcaagctctgcacgggcttttcatgctcagcgaatggattgaagcggtgcgcttagcgggacggccatttgctcagcaaaaatgcacagctcatccttcttccagattcttcctcgcgctcagccgaggagtgttgcgctcagtggatggctcgctaagccgacaggttggcttagtgagagggtga

SEQ ID NO: 85481 - DNA, 696 bp, Glycine max
  Peptide Sequence Number=SeqID_202259
atgtattccctttgtcatctctataagatacagaggttttccactctatgtcgattgtatggtattggttataggcttctttgtaaacttaaccacactaagtcgtctacagtcttacggctgaaggcgatttggttaaaggctaagctacctttcgagttgtggcttggccagtgctgtcctgtcgacccttatttaaaaggtcgattgatctggaagcttcaacaagctttcagacctaaggatcttgtggtgcctccaacgagtacttataagtctgagacttttgagtacttagaggatatgacacttctaagatcttggactgaagcctggctcaagtacgtcaggtggtattacgctactgctttatccccagatgtttccatcgaggattttatccaagctcctgttgttactactcgctctttccagcgaggagtgagaacctctttgatgctgaggttgcggctcatcgagaactgttgcggggagaccatagctgaggctgggcttgatcctaaacctctaactatcctaggttctaggttaggtggaagtgaaaagactaagggagatgcagattacagcattgctgattcagaggagattactgatattgtggggacaaatttaattttcatgacaggccctgttattgatctccttctggtcatgcagcatagggttccatga

SEQ ID NO: 85482 - DNA, 153 bp, Glycine max
  Peptide Sequence Number=SeqID_202260
atggtactagtagacgatgctggtggagcttatccacgcattgatcactccccgtggaatggatgtacattggctgatttcgttatgcccttctttcttttcattgttggggttgcaatagccctggcactaaagtatagcaaagcactttag

SEQ ID NO: 85483 - DNA, 258 bp, Glycine max
  Peptide Sequence Number=SeqID_202261
atggaagaactcctagcatctgggacacctttgcctacgctggttggtggatatgcccatggagaaaatggagatgtagcctgtgatgggtaccacaagtacaaggaagatgtgcagctaatgctggaaacagggcttgatgcctatagattttcgatttcatggtcaagattgttaccaaatggcagaggacccgtcaatcccaaaggattacagtactacaacaatctcatcaacgaacttatcagcaatggttaa

SEQ ID NO: 85484 - DNA, 1115 bp, Glycine max
  Peptide Sequence Number=SeqID_202262
atgaactcgctaagcacgcctaccgtgctaagcgagttcatcttttggggaagaatattcatcttcttgaggagatacctttggctaagcggggtaagcccaggaagcataagattattggggcaaggccaactgctcaatatgatactagacggttccattcgcttgatgcttggaaccattatatagataacgttttggggaggagtatcttgccagagagaaaggttgagttataccacacagagtttgatgacttcgagacagactttgaggatccttcaccaaagcaagccagagttagaggccacttggtgaagatagacgctgacaacctcaacacatttctagagactcttgtagtcctagaggagagggagacattacccacctactctaggtactgcaggttacccacggaccatagagagattgaggctgctctttgcataccagggagggggttcattttgaatgttgagggccatccggggagaattctcaagaaggatttgactaccttagcccaggtgtggagtgttctctcttactccaacctgacccctacatctcatacatcatatcttactgtggatagagccagacttgggtttcctactttgatcatcgccttatgccaagcccgaggggttgtctctgacagcctcacatttgagtgcctaagctcggccattaacttggcctacatcaggaagaactgttggaacattgatgatttaatagttgctttccggggggctaggagggcgagggtgaggccaactgatattccatctacttctgcagttctaacatctactccagcatctacttctgcaactccttcagttctagctcatgttgactcgcagcattttgaagccatgcttcaaagtatccatcaaggtcagattctattgctgcagagtctacaggtggtagctcctccaggatccatcttatcagtggagcagttcttagagagggtagcctggcctggggcccaaccttcgcttgatagggaaggtgaaggtaccacagcccaagtaccccaacaggtacaggatgcttcctccgagaccaccattccaaagccattcactcttcatcttgag

SEQ ID NO: 85485 - DNA, 906 bp, Glycine max
  Peptide Sequence Number=SeqID_202263
atggcgactggtaaatatttgaccgctcttggggcttttggcaacggtcccagtatgtttattctccacatggggaaggggctatggggagctcaagctatggagattgtcaagaggggtgtgtggaatgtctatgaattcttggcatcatttgcacttctttgtgaagtcgagggtgtcttctctgagtgtaggctaataccactttggttgcaagggagcgccccttggtatgaagtctggttcctcccctcctctagccataacctcctcaacgtctatggtgggagtttggaacatctcctagatgatagtcttgaggtctgctctggtattgctctccctgtgccaaatggcatgacctttgtagcagaagttgacatcttcgatgttagtgcacatctgccatttgccgttggcctttttgaccatgactatgttggtgagccacgtagagtacctgacttctctaataaaattggctttgaggacatcaactatgcgtttgtgttcatggatagtgaggtctcgactgagctgtgtacactgctcggacccttcgtccatgcccataacttgagtgccaccacccactgtgaggtgaggcttggtaggctccctggtgtagaagcaaagcctcatgatgaatcaagattgattcaaagatgttttcatgataacaaagatgatgacaaaggtgttgacaaaaagctcaaaggtcaatcaaagaatgagttcaagatgttcaagatagaatcaagaacacttcaagattcaagaggaaagttgaagaacacttcaagattcaaaaggaaagttgatttcaagaatcaagaatcaagatcaagattcaagactcaaggttcaataatcaagagaaggcttaatcaagataagtatgaaaag

SEQ ID NO: 85486 - DNA, 405 bp, Glycine max
  Peptide Sequence Number=SeqID_202264
atggttactccacttgcctcgcttcctcctcctcctcctccttctccttttccagtagcatcagagtctccgtctaccttgaagcggacatgtaaagccatatggctacaatccttggccactagaccacctggggcaaaaagaccagtggtccacatcgatcctgccaccgggaaggctaacggtccccacaagaagaaattaagaacatatttggggattgtcgctcatgataaggtcgacgtcacatatgaaacttggaagctgaatttgatatccctgaagcatctgacggcacttgcggccgacaatgacagtgtggatgacactgtttgcaaaaaatacggcattagcaaggagaaatggacccaattttgtcagacccgcagagacccctcgtgggag

SEQ ID NO: 85487 - DNA, 549 bp, Glycine max
  Peptide Sequence Number=SeqID_202265
atggaaaattatcagtgggagcaagagttacaaccctacaaccaatatgaagaagaaagaaattctaatctggataatttgttgatgcaatacaaggaagttactgaatctactcaacgggcatttaaaagtctagaaattcaagttggtaagctagcagatgaagtgactaaatttgtggccagaagagaaaaaaactttgtagaggttgaagctcataaggaaagcctcgtagaagagcatgattcaaaagaaaaagatgaagaaaaaagtgaggagaaaacacaacaatgggagaagcactcacaagtagaaattcaacaagaaagtattctccaagtcaatacccctcctcatcaactgattgtcaaggaagaaaggcatggaaaacatgagaaagccttaagtgtcattctttccttgatcgttaccacttctcttgcaataatgtggaaggtgcttccagaatacacaagtttcaaggtgcttccaaaatgtgttctttgtgaccttcatgccaccttgaagacatttgacctgtcaagctaa

SEQ ID NO: 85488 - DNA, 297 bp, Glycine max
  Peptide Sequence Number=SeqID_202266
atggaaccaccacaaacgaggttgatgatcaacgttttcatagtgagtttcttagcactacttgtgaacttggtggtgggagtgctcggcgctgataactatagcagagatgattttcctcttgactttgttttcggttcaggaacctctgcttatcaggtggaaggagctgctaacaaagatggaagaactcctagcatctgggacacctttgcctacgctggttggtggttaccaattataggctttgataattttggaaaatttcttaatttcctcaaagaaatagatatttaa

SEQ ID NO: 85489 - DNA, 556 bp, Glycine max
  Peptide Sequence Number=SeqID_202267
atggataaattacttggatataaatgcagaaaagacttcacatactacgcagaagtatgttttagagagtttggtgacagagtgttgtattggaccactgtaaatgagcccaatgttttcgccttaggtggttatgatcagggaaacagcccacctcgacgatgttctcccccattttgtgctacaaacgacacaatgggcaactcaacatatgaaccctacttggctgttcatcatattttgttatcacattcttcggctgctagattgtactggagaaaatatagggacaaacaacatggatttgttggtatctctatttacacgtttgggatttttcctcaaacaaatacagaaaaagacagggtagcatctcaacgagcccgtgatttttttgttggttggattatggaacccctgcaatatggagactatcccatttccatgaagacaaatgcaggcgtaattcactacaccaatctcaatgtctcagacaattctgacgcccttaagaaccaactgagagatttcactgcagacatggcggcaaatatct

SEQ ID NO: 85490 - DNA, 630 bp, Glycine max
  Peptide Sequence Number=SeqID_202268
atggccacaatgataaaggccatgatgagcatgaagaagataatggaggtcaatgcggctatagttgcctctagcagtgctgttgctaaggtggacccgactcccccatctggcctcaaccaaataaatcatcccatctcggatatggtagggcagagaggcaaagaattgggaagtacaagtgaccctcattttgtgcaagttcaaaacaagcatgccttcccgccatatggcttgcctcccaattatacaccacccaatgtggtgcacattcccaatgagaatttcaatgactccactcccatactcattgagagccaacaacctcaatctgatcatgcacctatccctcaacccattggggtgacacatgaaagaccccatcacaatctagccaacttcgagccttgcctcgaatacgccactgaagggcaagcaattggtggtgtacccctgtcaaacactttggagagccctcagtctcgctcacaaccacaacccttgcattttgcggtgggaagaacccctcctgctatgggtgaaaagggaaagttggatcagatagaggaaagattaagggtcgttgaaggaggcgaagattatgcccttgctaacatggaagatttgtga

SEQ ID NO: 85491 - DNA, 411 bp, Glycine max
  Peptide Sequence Number=SeqID_202269
atggaggccataaaagagcaaatggccacaatgatgaaggccatgatgagcgtgaagaagataatggaagccaatgtggttgcaattgccgctaccagcgctgttgctaaagtgaacccgatgctcccatctggcctcaagcaaatgaatcatccaacctcaaatatggtaggcaaagatttgggaaagactcatgaaattccctatcacaatctagccgacttcgagccttggctcggatataccactgaagggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattga

SEQ ID NO: 85492 - DNA, 222 bp, Glycine max
  Peptide Sequence Number=SeqID_202270
atgccgtataacatgtcaactggattatccaagccatatcatgccaatttaagccatactagaggagacaatgatattgcttctactgtcatcaatgaaagtgttgtggaaggagaagaagcacagaagttcctagaagatgttaatgttttgcgtgttgagaagaagggatattggaagagaaagagatgctacaactctagcggtaactcgatggtatga

SEQ ID NO: 85493 - DNA, 237 bp, Glycine max
  Peptide Sequence Number=SeqID_202271
atggccggagaaggtggtggcacgtggcagctccgatggcatcggagaaaggtgggcttgactgacgcgaaatatggctcaccggataagaacactcaccggaaaagttgctggaaaacagaaacagttcgccagaaaaagggcaacgagttgaatggtacaccaaaaattggaaaaagaatgatagaagaaaggcaggagcaaaagggctcaccgaggaccgttggtccccaatga

SEQ ID NO: 85494 - DNA, 354 bp, Glycine max
  Peptide Sequence Number=SeqID_202272
atgaacgaaaacgcaattcatgggggtgcgaaacagggtagagaatggagaattgcactaagcaatcaacacgcatggctccaaactggtgggtggaggatgcatgaacgaaaacgcaattcatgggacaccgaaaaaaggggtagagaatggagaattgcactaagcaatcactacgcatggctccaaactcgtgggtggaggacgcatgaacgaaaacactattcatggggctccgaaaaaagcggtagagaatggagaattgcaataagcaatcactacgcatggctccaaactcgtgggtggaggatgcatgaacgaaaacgcaattcatggggctccgaaaaaaagtag

SEQ ID NO: 85495 - DNA, 129 bp, Glycine max
  Peptide Sequence Number=SeqID_202273
atgagtgagatagaaagatttggaggtttgggaatggaggaacgtcgcaaggaggaaggggctgcgcatggattgctggaaaatgtgatatttatagagcaggacgcgtggccatttgttctagtgtaa

SEQ ID NO: 85496 - DNA, 618 bp, Glycine max
  Peptide Sequence Number=SeqID_202274
gttatcactggcatcgcacttcctgttggatccgacaaactttattctggcagcactgatgggacagttaggatatgggactgccatactggtcaatgtgctaaagtcatcaatcttggtgctgaggttacctctttgatcagtgaggggtcatggatttttgttggtctgcaaaatgctgtcaaggcttggaatatccaggccatgtcagagtttactcttgatggacccaaaggccgagtccgtgccatgactgttggcaacaatacactctttgctgttgcagaggatggtgtcatttttgcttggagaggaagctctaaagccgattctccttttgaactggttgcgtctctcactggccacactaaagcagtggtttgtctggcggttggatgcaagatgctgtactccgggtccatggaccaaagcataaaggtctgggacatggatacattacagtgtacaatgacactaaatgatcatactgatgcagtcacatcccttatctgttgggatcaatatctgttgtcaagttcatctgaccacacaattaaagtctgggcttgcattgaagcaggatctttggaagtaatatatacacacaccgaagaaaat

SEQ ID NO: 85497 - DNA, 603 bp, Glycine max
  Peptide Sequence Number=SeqID_202275
atgctgtatgctgagcatcggggagttcggggctatgacttgatctcctcgtacacggggcaagtcagatggggtccgatcatcgtctaccttcgaccagagagggtggttcgtcagatagggtacattcagaccgttcctccgccatcggttcgtgattcgttgacaggtactgatatagacgatcggtgggtacacttttcagaccatgtggcgcctacaggggagctctgtgtagttcctgggcaggtggccccagactacatggagtggttttttcagatttcgcacccctttgtgacgccgacggaggacactgttgagctgagacctacgcctccccctcccactaatgatgacttcgtcgagccacctgtcgccgaggttccaatcgcgtcagattcccctacgcattctgtggttgattgcacaacatgtgtcaggatgggaaggattgctgagcatttggagcgcgtcatcaacctcaggatggtgactgcagggactaacttatatgatatcatggatctttgcctgaggatagctagagatgacgacccaaatgacaatcttaggccgcgacagagaccctgcataaattag

SEQ ID NO: 85498 - DNA, 171 bp, Glycine max
  Peptide Sequence Number=SeqID_202276
atgtgttttcgtgaagaaaatccaagccaaggtgcttctgtaacgctttcgagacgtttccgtaagcaattatgtggaaattcttcattgctcttcatcgttcttcaccgttcttcgttcattcttcgtcattcttcaactgcaaaatctaaccgatcgttcacgctgtaa

SEQ ID NO: 85499 - DNA, 2187 bp, Glycine max
  Peptide Sequence Number=SeqID_202277
atggcttccaccccacaaagcctcaaacatgggacaccccaatgttgtgctgtttcaccctgtaatcagaacaacactgttcttcttaatgactggcctcagttccttcaattctcaattgggtcacatgattatatgctggccaaggcaattcatgggtctcttatcaaatctggttgtgaaggtgacatgtttgtggacaacaatcttatgaacctttactcaaaattcagtaacatgggtgatgcacagaggatattcgatgaaatgcctgtgaggagcatagtcacttggactaccctcatgaaggggtatttgaagaatggggatgttgggtctgttttctgtgttgcacgtgatatgtgcatggctggtgagaagttcaatgagcatacttgttcagtggttctacaggcatgtaggtccccggaggatcgtgtttttggggagcaggttcatgcttttgtcgtgaaaaatgggcttcaggagaatgttgttgtggccacttcattggtttctatgtattgtagaagtggtcagttgggttgtggtgaaaaagtgtttggcggcataagtgttaaagatgctcagtgcataaattatatgattttggaatatggcaaggaaggcttgggggataaggcgctttggatttttgtggatatgctacaatctggattgaaaccaagtgattacacgtttacgaatttgatcagtgtgtgtgattcaagtgtaggattatatgtagggaagcaactacatgggcttgcagttaagtatggttttatgtgtaaaacatctcttggaaatgcagttattacaatgtatgggcaacatggaaaggtcaaagaggctgagagagtgtttggtgaactggatgagaggtctttgatttcctggtctgctcttctttcagtgtttgttaagaacggccattctaacaaagcctttgaaattttcctaaatatgcttcaagttggtgtgcctcttgattctggttgcttcagcactgttttagatgggtgttcagagtggaataatttgaaatttgggattcaaattcatggacttgcaataaagcttggtcatgtctctgatgtaaatagtggtacttctttagtagatttgtatgctaactgtggaagtttgcagtctgcaagagtgatttttgacaggcttccaaataaaacaattgcttcatttaatgctattctagttggataccagaattcaaaaataagagatgatgaagaggaccctatgggttttttcagcaaagtaagattcaatggtgtgaaaccagattgtgtaacgttttcacgactcctttgtttatctgctaatcaagcatgcttggtaactgggaaaagtcttcatgcttacactataaaggtgggccttgaagatgatactgctgtaggcaatgctgtaattactatgtatgctaaatgtggcactgttcaggatgcttatcaaatatttagtagcatgaaccgtgattttgttacctggaatgccataatttctgcatatgcccttcatgctgaaggaaacaatgtacttttgctctttgaggagatgaaggaacagggttttgctcctgatgagattacaatgttggctgttctccaagcatgtagttactcaggtttgtgggaaactgggttgcacttattcaatgagattgaatcgaagtatgggatcaggcctgtgattgagcacttctcttgcatcattgatcttttaggtcgagccggaaacctatccaaagccattgatatcatcagcaaatgcccgtaccctgagtcacctttgctttggaggacttttgtgaatgtctgtaagctttgtagtgatttacaatgtggaatgtgggcatccagaaaattgcttgatttagcccccaatgaggcctcctcttacatacttgtatcaaatatgtatgctgaaggaggcatgctggaagaggctgcaaagatcagaacagctatgaatgacttgaaattatttaaagaaacaggttccagctggattgagatagacaacgaggttcactattttatagcaagtgacaaaaaccaccctcaaagcagagaaatttatgcacatttggatctgttaaaatatgaaatatgttggagctgtgggaacagaaataatcttgaactgatttcaaattccctgtga

SEQ ID NO: 85500 - DNA, 228 bp, Glycine max
  Peptide Sequence Number=SeqID_202278
ggtggtgctcttaatgaggtgacagtgcagagagtgaggaaggaggaggttgaggcaaagatatcggcgtggcataacgccaatgttgctaagatcaacaacaggttcaagagggaagatgctgttatcaatgggtgggagaatgagcaggttcagaaagcatcttcatggatgaagaaagttgagcatgcaattcaagggcttgatcttggtcatatgcaagcttaa

SEQ ID NO: 85501 - DNA, 288 bp, Glycine max
  Peptide Sequence Number=SeqID_202279
atgaaggatgaagacaaaggaaacgataaaaaagcgtcatgtgagactgagaaagcaataaggacttcaaatggcagtgtgagaaggataacaaaaaccgcgagaatcacagtgaggttgcagcacgtcacgaatgaaggcaacagtgatgttgcaataccgcgagtggttctaatgccgccagtgaccgagttacaatgtcgtgagaggttgcaaatcagagtgccaaagtgttcgagtgaaagtgatcagaatgagagtgagagtgagaggtttcaaagttattga

SEQ ID NO: 85502 - DNA, 174 bp, Glycine max
  Peptide Sequence Number=SeqID_202280
atggagttggcttcggagaataagcctaatgatttaagtgttcaagattgggaatatctcataaattacttttcaacttctaagttcaaggactttcaatatcagttattaacctatgttgacactaccgatgttaaaagtgtcaacgttaaccctttacaaaaccgattttaa

SEQ ID NO: 85503 - DNA, 243 bp, Glycine max
  Peptide Sequence Number=SeqID_202281
atgaataggtgttgtgggtgcttcggatgtgaaagaggagtgaaaaagaggaagattgggctttacgggatgtgttttggtgaagatttgagtaggatacgaaggtttgaagatttagggatggaggaggcacgaggagaagccttggctgcgcagcaagactggtttcgcaggagtgataagccttatggtaatcgattacaggatgttgtaatcgattacaggctacctgttcttgtgtaa

SEQ ID NO: 85504 - DNA, 345 bp, Glycine max
  Peptide Sequence Number=SeqID_202282
atggctgaagaagatggcataattgtttcaatcatttttcacgtcaatgttgtggccaatgtgagcaaatgggtggtagactctgaggctactagacacatatgtgctgataggaatgtgcttacctcctacactgctgtgggcaatggagaagaacaagtttatctcggtgattccaagactactcctgttttaggaaaaggaaaggttcttcttaagatcacatctaggaagacacgggctttcacattgttggggaagcttggggtgaaagtgtcatttgaatcgaaaaaaattgttatgactaagaataatgtgtttgttggaaaaggatatcgtgattag

SEQ ID NO: 85505 - DNA, 342 bp, Glycine max
  Peptide Sequence Number=SeqID_202283
atgatgatgatttgggaaggttcacaatcaaaagctcataaacaaattcatcagggtattgttgtgttttatgcctttaggtcttccagtagcttgtgctctttggccaatgctgtagagtttagcttctcagaaataagggtgaatgctactcgatgcatgtcaagtagtgtgtcaacacgttattgccaacaccggaaatgttggccgacaaaaatctcgatcttggacacgtttaggagtggcttgccaaaggcagcattcgacactggaggagtctacaccggggtgactgtatcaacgtccatgtcttcagccataataaatcctttagattgttag

SEQ ID NO: 85506 - DNA, 834 bp, Glycine max
  Peptide Sequence Number=SeqID_202284
atggcccaacgtctccatgggtcttcaattggcgacgccttgaaggaccaactactgaaggtcaatgactctttgaactctgcacttcaagccaacatgaagctggccagggacaacgagaacctggaggatcgagttcatgcgctaacaatcgaggccaaggggttggagatgcatgctgtaaatgtcgaggctttggttaggtctcaggatagggagattgccagacttcaattggccttggccattgcgaacaaggagaaggaggaggccattgtggacaagaaggaggaggaggtgttgcatctttgcgaagtctccgacccaagtgtccttgacatcaacaaagatgtgtatgatggagagttgatgctgattgatggcatccctaaagaggtggctcctacactagagaagccaatgaccccagcgaaggattgtaatgctgacaatgtcaaagtcaaggatgaaggcaatccgtataacttgaataaaccttcaagttcaacctcatctgaggagagtactcgggaggtaactgatgacgactcattgaagttgaacccttatctgaggagagtactcaggagggaattgttaatgattttgttgaagttcatccttagccgaaggaattcaacattagctgaggagggtactcaggaggaaactaatgatgagtcattgaagttcaaccttggccaaggggagatggtactcgggagggaattgttgatgattttgttgaagttcaatcttagccgaggggatactcgggaaggaactggcccttccaagttggctgccaaattctcatttgacgggaccttctag

SEQ ID NO: 85507 - DNA, 261 bp, Glycine max
  Peptide Sequence Number=SeqID_202285
atggatcccagggacaaaaagaagatgacattcatcaccaaatcctcaaacttttgttacaaagttatgcgatttagactgaaaatgccagagcaacagggggaagcttttgggtttcatgctcacccaccagggaatacatgccaacttggacaagtgttaggccatcctggacatgaggagtccctagaatgtgaaagaaactcaaaggctaaccaacatgatagccttcttgtcgagatttttgccaagaatcgttga

SEQ ID NO: 85508 - DNA, 195 bp, Glycine max
  Peptide Sequence Number=SeqID_202286
atggagacgttgggccatggccaaatccctagcaaggaaggcctaaaatttggccagcaattgccgagggagcatttcgaggaactcgaggtctcaacgttcatcgacactcagaagctccttaaggtacttgtcataccggcgagggaattgttgccaataaagggaaaaagaaggtttctcgtcgagttgtag

SEQ ID NO: 85509 - DNA, 453 bp, Glycine max
  Peptide Sequence Number=SeqID_202287
atgaaattgtcaatgagccgagagaaactattcgggctcaagtgctggccgacttcatcaacgagctccaccccccaccatcacaatttgagcaggaatgctataaaatgcatgtggacggctcttccaaccggcatggaagtggagctaggtcgctatacttcggcttcaaagccacaagtcgagtatgaggctctcctcgcaaaactaagactcgccaaaaaggacgacgagctggctcggctggcaacttcccttaaacctaggcagttgaaagcattcattctccattcgattcctgaacctagtgtctcaggtaaagaatgtttgcaggtggaagaaggccctccaggatggaaaaaggagatactcaagtacttgaaacatgagacactcccaacaaacaagggaaaagctagaaagttaagagtgcaagctaccaagtacagctga

SEQ ID NO: 85510 - DNA, 786 bp, Glycine max
  Peptide Sequence Number=SeqID_202288
atggttgaggaagaagaaatagacaaacagattaagggcttggccttgaagaccaccattctgttaagcgatgatagtaaagatgacaatgcaaaagggttagatgctaagaatctaaattttcttgtaaaatggtcattcaagaagaaggaatatatcgcttgggatgaaaaagagtcaagctcatcaagtgatagtagtgaagaagaagaagccaatttgtgtctaatggccaacaatgaagttgacagtgaagataagctcttagaagcatttaatgaaatgcaccaagaagcacaaaagttatttatggccaataatttcctgtttgggaacttaaggtggcatgtggacaaattagtagaaattcaaaaggagttatcggaacttaaagtgaaaaatgaggctttacaaaaagaaaaggataactcttctagtaattgtgctaatactacaagtgtcacttccacttgtgaaaattgtaaagctttgcaagaaaaggttgagtattttctaaaaaaattatcgaaatttataatgggaagagataacttagaggcacttcttgcccaacaaaagtgcgttattgaaaaggctgggttgggatacaataacaataagaaacagaaagctgacaaaatctttttcaacgttacaaaagcttccagctcacccatcatatttggaattccaagtgggaaatacaaatgggttcctatgggaactaaaaaggttgctaaccaaaaaggacccgacataatttgggtgtgcatagcagtggaatga

SEQ ID NO: 85511 - DNA, 300 bp, Glycine max
  Peptide Sequence Number=SeqID_202289
atggccatggttgaaagtgacgctgaagccctatgccattatggattgactatgaccctcttggttgtctatgatgctcatgaattaaccacaaccgtgctatcaaacttggctacagacactttgacactgcatcagtctatatatggatctgaagaggctttgggagaagccatagctgaggatcttcaacttggcctcgtcaagtctatagaggagctcttcatcacctctaagctctggcctacaaacaatttcccccatcttgttcttcctgctctgcagaaatcacttcagtaa

SEQ ID NO: 85512 - DNA, 402 bp, Glycine max
  Peptide Sequence Number=SeqID_202290
atggtggcaggggagggaggggagggactgggtgaaactagtggcggtaaggacaaaaccagtgagagaggtgacaaagagacaaaactgggagaagcacctacattcatacctcaagacctgcagaatggaacatgcaatgggtttgaattaaaaagtgggacttttgaaactgatactattgttggcaataaaaagtatgtcattggtggaacctatggtgaaaccttttcggttaaagatcaaattcttgacaacaatggtctaggggaatgggttgatctcattcagctaggtaccaaacccatttcatgcaatggccactcagccgtgcttttgaaagaccgaatactaattcttaagaaaaatgccaagccagatgattgtatatggtttctggag

SEQ ID NO: 85513 - DNA, 465 bp, Glycine max
  Peptide Sequence Number=SeqID_202291
atggaagaatgccagaaactaggcctcgcaaaatcaataggtgtcagcaacttcacttgcaagaaacttgaagatctactctcatttgctaccattcccccttctgtcaatcaagtggagatgaatcctgcttggcatcagaagaagctaaaggaaatctatgatgcaaagggtataatcataactgcattttctcctctgggagccaagggggctagttggggttccaatgtagtcatgggcagtgaaatactcaaggaaattgcagaggcacatggcagaactattgctcagcaaggtgtgactatcgctgcaaagagctataataaggacaaaatgaaacaaaacttagaaatatttgattggtcacttacaagagatgaccatgaaaagattaaccaaatccctcatattcgcatcaacaatgggccagttgtgttcgttgctaacctttgggacgggtag

SEQ ID NO: 85514 - DNA, 885 bp, Glycine max
  Peptide Sequence Number=SeqID_202292
gtggacactccatatgtcaggcagcagaaaaaaattttggggattgatgttgttgcatggagtaacggtgtgataggaaatgctgagaaacctgttgttatcagtggtccttctggagtaggtaaaggaacattgatatctatgctgatgacggaattcccctctatgtttggtttctctgtgagccacacaacccgtgccgcaagaggcatggagaaagatggggtccattaccattttacagagaagaatgttatggagaaagaaattaaagatggaaagtttctggagtttgcttctgtccatggtaatttatacgggaccagtgttgaggctgtggagatggtatcagatgcagggaaaagatgtattcttgatattgatgttcaaggagcaagatctgtgagggctagttctctagaagccatgttcatctttatctgccccccatcaatggaagagctggagaaacgacttcgtgaccgagggacagagacagaagaacaggtcctaaagcggttacgaaatgctcaggctgagattgagcaagggaagtcatcaggcatatttgatcacatcttatataatggcaaacttgaagagtgttacgagaatctgaagaaattattgggacttgatggatatgtcactcctcccaagtcagcaccaaaaaagatgaatctcccaagggatcattcagtgtcaaaaattgatgacaaaatcatcataggctgcatctcttcaggactagaaaaggaatcaaagaacttgatcatgttagatgtctcctcacttaaagggggcgcgcctggacggacaagagggctagattttcaagtcattgactcgttttcagatggcttcaatggcaatgaaccattttga

SEQ ID NO: 85515 - DNA, 378 bp, Glycine max
  Peptide Sequence Number=SeqID_202293
atggcaccagtttctacaagaactcgaatgaagtgcaagaaacttgagggaaaaaagcagcagaagaaaaaatcatcaatggtttatgacgctactacacctacttcttcagccaccaaagaaataaagggtgaggatcttaatgaggaagatatatgttcaagtgtctgttctacaccaaagggtaaaaggttcagaataccagaagtgctaacatgtccaccagctcctaagaagagaagagtaacatcatgctcatcatccaagaacaagagatccccgatagcattttttgcttcaccagatatagagctctttttcttttctgcaattaaaagtagtgtacctgcttcaagttttaccccaagtggagtttga

SEQ ID NO: 85516 - DNA, 612 bp, Glycine max
  Peptide Sequence Number=SeqID_202294
atggcacgtgcatctgacaagatcattggaccctcatttagattgcggccagagatgaagctggtcagccacgatggtcaggtcttaccactcctcactgagccgatagtgagggcttatgtgttgcagtcaaggttatcagccctaattacggtgtggtaccctttcgaaaacagaggcttcgtgaatgccctagttgagaggcctactgatcgtgtcccttccaccttcactagagaggtcgtgaaggttctactcatgactcaccttgacagaggaagaggctatagcaacgaccaccataggtgccaagcaacctggatgactgccaccggtacgcttggggagccactgcataggcgtacctatacgattatctctcttatgcaagccaatacaccagtaagcaggttggagtcttgggcatttgcacatcttcccactattggctatttcgagcctaagattggtgctctagatgacctggtgtgggacaaacgtgtggccttatcttccaaagagggtgctaaggcagcttctaatatggcatgggcagagtggcaacaacatatcattccgttgggcaatgttgtgccacccaagggtccttag

SEQ ID NO: 85517 - DNA, 2075 bp, Glycine max
  Peptide Sequence Number=SeqID_202295
atcaacctaaccagtttagtgttggcattagattcaattccaagtctataccatataaccaacaaactgtggtttgggttgctggtggtgatgtcaaagtaggtaacaagtcctactttgaactcactcaggaaggggaactggtcctgtttgattccttaggcgaggtttctgtttggaccgtcaaaacgggaaaccgatctgtagcttcagcttcacttcttgacaatggaaatcttgttctaatggacaaggagcaaagaatcatttggcaaagttttgatactccatctgatacacttctcccaggacaaagtttatttgctaatgaaatgcttcgggctgctaccgcaagcaagaatagcaaggccagttactatactctccacatgaatgcttcaggtcatttggagctacattgggaaagtggtgttatctactggacaagtgaaaacccttctgcttcaaatctcagtgctttccttacagccggtggagctctagagcttcgagaccgaagcttgaaacctgtttggtctgcatttggggatgatcacaatgattctgtgaagtacagatatcttcgactcgatgtggatggcaatcttaggttatattcatgggttgaaagtttggaatcatggagatcggtctggcaagctgttgagaatcagtgcaaggtctttgcaacttgtggtcaaattggtgtatgtgtgttcaacgcctcaggttctgctgaatgcaaatgcccgtttgaggtaactgggggtaacaaatgtttggtaccatatgaaggggagtgtgaatctgggtccaatatgatagcatataagaacacatatctatatgcattctaccctcctgataattcttttaccacaactagtatgcagcattgtgaacagttgtgcctgaatgacactcaatgtacagttgcaaccttttccaatgatggaactccacaatgctcaataaagaaaactgggtatgtcactggttattcagatccatctgtaagctccatatcatttgttaagagatgttcaggtccatttgctgtaaatccaggtatcaccaagtctcctcctccttctgaaccgcctcctcggctctgtgttccttgcgtaataggagcttcgactggcacatttttcacccttgttatactccagttgggaatagggctcttcatctacagaagaaaaaacactaccaggaaaaagtccactttagctttcacaggcacaaactcgaagggtttaattgtgttgtccttctcagaaatcaagagcctcacaggggatttcaagaatcaaattgggccaaaggtgttcaagggtttgctacccaacaatcatctgattgcagttaaagacctgaatgcgtccatagaggaaaggaagttccgaagtgctgttatgaagatgggttgcatccaccacaagaaccttgtgaaactggagggttattgttgtgagtttgatcacaggtgtttggtgtatgaatattgcaaaaagggttcagtggacaagtacatagatgatgatgctcttggcaggatgctgacatggagaaagagagttgagatatgctcaagtgttgcaaaggccatatgctatttgcactccgggtgcagggagttcataagccatggaaacttgaaatgcaaaaatgttatgttggatgaaaacttagtggccaaggtgactgaatttgggtttgctattgcagatggcaaggcaacatattgtggcttttcagctgagaaggatatagaggactttggcaagttagttctaaccttgttaacggggtgttgcgatcacgatcatgttaagctttgtaagtgggcgtataaagaatggatggaagagagggtagccaatgtggttgataaaagaatggaagggggttacaattcagaggaactggagcgcacattaagaattgcattttggtgccttcaaatggacgaacgtcggagaccttccatgggtgaggtagtaagagtacttgatggttcattgagtgtcgatccaccgccatctccttttgtctttcagaggcccttgcag

SEQ ID NO: 85518 - DNA, 297 bp, Glycine max
  Peptide Sequence Number=SeqID_202296
atgaagaacacgatttttcactcttctcctctccaaacgaccacccaaaccctaacaccttcttctccaccacccatgaccactggttgccaccacgagccaccgttgcttgcctctgaaccaccacatggagaggaacgctttaatcatagtagaatcctcatgattcatctcaaggatttggtggagaacaagcccccaatcctttcttttgtagcttctctgaggttaattaggcaagctttggaaagtgttgtttttcaccttctcgctaagccaatttgctggcttagctag

SEQ ID NO: 85519 - DNA, 576 bp, Glycine max
  Peptide Sequence Number=SeqID_202297
atgaagggaaacttctacccgaaattggtaaaggtattcaacttccccaacttgcttgaagctcaggttctttcaacactagtgtatatgaagggaaacttctacccgaaattggtaaaggtattctacacttgtgttaaggatgatatggaaggtaatttttattctattgtcaatggaatggatatggaatatgttgctcaatcccacaaggaatatggtggcttaactgctgaagaccggatgttgatgtatatcattacgtacaagctaactccaagatcaagtaatcatgctcaagtcacgaacgacgacttgaaaatcataaatggactaaaatcagactatgaatttctatatgttgtccttgcctcaagattcattgattacttcaaaattgatgtgcctaatgagattgtggactttaccaaagcctctaatgagataactgaaaggcatctcaaaaagcttggtatgacatatttggaacatgaatgggtcatggcaggagaacaaccagttatagctaatgatgatttgatggaagaaaaagctcatgaggagccagccccataa

SEQ ID NO: 85520 - DNA, 262 bp, Glycine max
  Peptide Sequence Number=SeqID_202298
gatgttctactctacagcagttggaggattaagatgctatgagaatccaaagaataagattactgcagtacctgccgaggaagagcaaatttggggtgcattcttcaagaacagagaatcagtgattagtcccaacagtaatataaggttaatgtcagttgagactgcattaggtacaaagggaaaatgtgaggtaatcttagagcttaagaagttagagttgaatatcccttacgtaactaggattgccagttgcaactag

SEQ ID NO: 85521 - DNA, 243 bp, Glycine max
  Peptide Sequence Number=SeqID_202299
atggcagtagaatggagaaggaggaaaggttattggagatgctattcgacggccgacaaggtcttcacaccagaagttctctccgccactcagccactcagaggaatgcttccaagaatagagaaaacgccaaaaattgagaactgcggtgcgctttgcgagttgattcttgctgagcgcatcatgacaactcatctgcttctaggatcttctgcacacttagccatgaactactgcacttag

SEQ ID NO: 85522 - DNA, 396 bp, Glycine max
  Peptide Sequence Number=SeqID_202300
atggaagatctaaaaaagagtggttgcggtggtgtcgctatcattggctgggaaatgagagtcgtaaccaccattgtcatcattgcagtggttgcaatttgcaaatgcgttgctattgttggcttggaagggagagtcgttgcagtggtttcactaatgttattgttgtcaaccaagttggcttctttagatgtcgccgctatggtggttttagtggtgtcgtcatcattggcttttggtggcaacaatgagactaggcctacgacaagccttgagattggtggaatgagaggtggtggagaaaccaacaaacttggccaaaatattacattgaatcaaccaaagaagaagaaagaacaagagtttgttggatttgaccaacttgtgagaatttag

SEQ ID NO: 85523 - DNA, 219 bp, Glycine max
  Peptide Sequence Number=SeqID_202301
atggaatatagagagagggttgtggtgaatgctgaaagggtgtgtaagagtggtgtctttatagccaaaccacccattgtgagagtgcgtgtggtgcaagacagaacagtaggattccgcaaagaaggcaatttggtgggccactgtagattggtgggagaggcaccttcaattcacaggaatacaaggacatgtttggattacagtttccaaatttaa

SEQ ID NO: 85524 - DNA, 339 bp, Glycine max
  Peptide Sequence Number=SeqID_202302
atggatgcaggactacctaagcttgttgcagatgatgttcttttctcggctcaaaaagttagtgctgcaatgggatacttagctcctgaatacatcaccacaggacactttactgagaaaagtgacatatatgcatttggagtaatcattcttcaagttctatctagcaatacgacaataggcagttcaatacggacaacagttgagtctttcagatttgatgaatctgttgactcaaatcttaagggaagatattctaaatctgaagcagcaacactttcaaagcttgcaatacagcatactcttgaacttccagaccatagactaaccatgctggat

SEQ ID NO: 85525 - DNA, 333 bp, Glycine max
  Peptide Sequence Number=SeqID_202303
atgggtttgaagatatgcataaatgcctcaggtgtggggaatcatgggccaagacaaccaggaaatgacatcgatgtttatctaaatcccttaattgaagacttgagaaagttgtgggacgagggggttgacgtgtttgatgggaatcaaaatgagacattcaagttgtgtgcaatggtattttgtatcattaataactttccaacatatggaaatttgagtggaaacaatgttaaggaccatcatgcattccctatctatgaagaagacataagctacgtacaactgaaacatggaaaaaaacagtgtacactcaacatcgatgttttctga

SEQ ID NO: 85526 - DNA, 195 bp, Glycine max
  Peptide Sequence Number=SeqID_202304
atgggatttactttagtagaccttcaaaaggttggttacaatgatgacccattcatcacagtagcacaagctaaacagcgagatatcgactttctcttaacaaatgccttcataaatggtgaaaatcaagaggattatgtacatgaaaatcgtaatgatcatgatgaaggcttatgggagaatattcctatgtaa

SEQ ID NO: 85527 - DNA, 264 bp, Glycine max
  Peptide Sequence Number=SeqID_202305
atgggcagcgagggcgtgccgtcgatggtggtggaggtcatgttggtggccgccgtcgagctcactgacgcctccagctggtggcacgaaatcgatgactctctagcgtggcaggattgtatttcctacactctcgtcgtactctacggttcaactggcttggatacaattgagagtggtctttcaccttatcaatattttggtgagggtttttatcttctatcagaacgtgcagaggttaaagctagaggtatcggagtatag

SEQ ID NO: 85528 - DNA, 550 bp, Glycine max
  Peptide Sequence Number=SeqID_202306
atggctatttgcttccactgggatgttttgcagttttcttattttttcttggatctccttgatttggatgaggaggctggcatgatccagaagtcaactaaccaaactgatcaaaatgagaatgctgaggaacaagctaatgatgagtcaactaaccaaactcttatgccagatttcatgaagccagctcacgatcagtacgcttaccgccacgccaatggcttgtgtgtaattgggttggctccttcccacattgctttcaaggatgaaggtggaatcacagccattgatttcaatgttggaaagtctgatcgcaacaggataaaagtcactggaaagcagaagaagataaaagtcatttttcttgtagcgcctgtagatttatcacaacctaactttgactttgatgggtcacataactttgcagtttttctacaacctaactctaatgtggacttgactgaaattgcatcattccctacctttgatgggttacttaactctgcagttttatcacaacctaactccgcaatggcacatcttcctccac

SEQ ID NO: 85529 - DNA, 570 bp, Glycine max
  Peptide Sequence Number=SeqID_202307
atgttggtaagctgcccctccttgacaccatatgtagaggcagcggaggaatcattggaaacagctctccaatccttcgaggtggtaagctgcgcctctgtggaaacaagtccattgctaccttgtttctctaatgcggccctgatggtggcgcgggtaatgctcaagcacggttatgagcccagaatgggtgtgggcaaggacagccacgggaatgctgatgtggttgacattaggggtaacccgcacaaatatgggttggggtatgagtccgggaaacttggaaaaaggaatgcaccattaagactccgggcagatagggcatggcccggtcatgttagccagtgtttcactagtgtcgggataatgttcgaggaagaggtggtggcaataggaggagaagctccacaagatccatcgagtttcgtgcgaccgtgccttcccaatttccaactggggaattggcacgtgacgagccagtcggaagtctataccggtgattcaatatgtgaggatcgatcctttgaggattctaacaacgagggcttgataatcgattttgaccgagaa

SEQ ID NO: 85530 - DNA, 282 bp, Glycine max
  Peptide Sequence Number=SeqID_202308
atgggctatgaagcagagatgcacaacatgacgattgccatatctgccaaaaattgcaccattaacattgtgatggattctctccgcgacttctccttacatgtcaccatcggagttgtcggaccctatcattgcccatcccaagaggagtatgtagcctatgtggcatcgcttggctttggggacaatgccaaagctgaccaaggaggtggccaggctatacaagaagaagctatggaggaacatgccgcgcatgatggccgtggagatgagggccattga

SEQ ID NO: 85531 - DNA, 627 bp, Glycine max
  Peptide Sequence Number=SeqID_202309
atgaagaactctgcttcggaaagcggtttgtacataattgagagcgatgaagatgttgagaaggatctgcagaaagacgaaaacgatggaaacgaatccgattattcgaatgattccaatgaaaaccagtcaatgaggaaacccagcaattacagcatcgcatggcctcaaagttacaggcacactcttgaagtgttacaaccagaaaaaaaaccactcttgaaacccacagaagaggagcaaccgcgacataccttgcttcctccccagatatctaggaagtcttccattagaatttccaaggtttctcatgaacctcacattcctggccaatgcacttttgggcaagctgtgcttaatggtataaatgccctttgtggtataggaatcctttcaaccccttacgcagccaaagagggtggatgggttggtctttctatattgttattgtatgcagttttttccttttataccggcttgctcttgcgttactgcttggatagtgcacctggtcttgagacataccctgacatcggccaagcagcttttggtactactggacgtgtcatcatctctcatggtaaacacggagaaattgccgctaaatggacaatttctagcaattag

SEQ ID NO: 85532 - DNA, 405 bp, Glycine max
  Peptide Sequence Number=SeqID_202310
atgttgatccaggtgattatgcttggaagactgcatcatcgaaatcttgtaaatttgttaggatattgcatagataaagggcagtttatgctggtttacgagttcatgagtaatggaagtttacaaaaccttttatatggtgaagaaaaggaactgggttgggatgaaaggctagaaattgccgttcatattacacacggaatagaataccttcatgaacgggtagtcccacccgttgttcatcgtgatttgaaatatgcaaatatattgcttgatcactcaataagagctaagaatttccttaataacatgaatggacactattccgtaattataccaaatatctcaatgatatttccttcactatgtcaacactcattcaaaatgaaggtcgaagcttattaa

SEQ ID NO: 85533 - DNA, 286 bp, Glycine max
  Peptide Sequence Number=SeqID_202311
ctcgaagaaaactaggaaaggaaagagtcccggaaagggtgggaatcgattttggaagttcattgtggttggctttaagactcacagggaagccatcgaaggtgatttcttcgtcttctttagtctctgtcaaggtttgttgttgattgtgttctgtgtgctggactgtgtgtttgaaaggatgattgctgatttggttttcacctataaccactattttaggaaggaaaactgtgtcccacttcacccaagggatcttgttggcctcaaggtgacctccccatag

SEQ ID NO: 85534 - DNA, 484 bp, Glycine max
  Peptide Sequence Number=SeqID_202312
ggttatgaaaatccccgagaagcaaccggtcgtattgtctgtgccaattgccatttagctaataagcccgtggatattgaggttccacaagcggtacttcctgatactgtatttgaagcagttgttcgaattccttatgatatgcaagtgaaacaagttcttgctaatggtaaaaagggagctttgaatgtgggggctgttcttattttaccggaaggttttgaatgggcaccccccgatcgtatttcgcctgagattaaagagaagataggcaatctgtcttttcaaaactatcgtcctacaaaaaaaaatattcttgtggtaggccctgttcctggtgggaacaggggaaggggtcagatttatcttgacgggagcaagagtaataataatgtgtataatggtacagcagcggtggatgcattggatgggcgtgaagtgattgatattatccctccaggaccagaacttcttgtttcagaag

SEQ ID NO: 85535 - DNA, 441 bp, Glycine max
  Peptide Sequence Number=SeqID_202313
gaacaacaagctgagtgggtaaacgcgcagagacagattctgcgccctttatcattcaggaacgacaaagacatattctgcgcccttatcattcgagaacaacaagctgagtgggaacgagaagttgagtgggtaaacgcgcagagacagtttctgtgccctttatcattcaggagcagcgagtcgggtggaacaacaagttgggtggaacaacaagctgagtgggtaaacgcgcagagacagattctgcgccctttatcattcaggagcagcgaggcgggtgataaacgcgcagaggcaaattctgcgcccgttgtcattcagatttcgcaagttccgctagcagggaggttcactggccgaatggggcaactgtcataccctaatttcgtctggggaccatccgttgttgggatgagaccctcgtgtgacaacttcgag

SEQ ID NO: 85536 - DNA, 168 bp, Glycine max
  Peptide Sequence Number=SeqID_202314
atgtcgcggaacttcatggattgcttaacgatgggtgtcaggttcctcgaaacggtcaagcaaaggttgcatgccatcaaacaatggtccccagacgaaattaggccaaccttcagtggggtgttgactctcttgggcatggtcaaaatgttgactgctaaggcctga

SEQ ID NO: 85537 - DNA, 300 bp, Glycine max
  Peptide Sequence Number=SeqID_202315
atgtacatggtgactgataacttggttgtgactccaatgtcatacatttatgctgtttcatatctaaatagtctgaaagtaccattctctgacttagaggaaagggtcatcacaattggtgtaaaggagggtcttggaatattgaaagctttattgacctcagcatttgctttgataaacgacctgaaacacttgattaaaaccactaagggggagaatgaatcaatcacttccgtctggtctaaatttataaataaggatatcaaagattgcaacaacaagaccggaaccaaaatttaa

SEQ ID NO: 85538 - DNA, 309 bp, Glycine max
  Peptide Sequence Number=SeqID_202316
atgggagatcgcttagaggacatgattcgtgaccttggacaagaattttttcaactagcacgcgcccctgtgcatgaaggattgcagagtgattcaaaaaagcctttgtatacggggtgcaagaattccttaactctgttttttgtggtgttaagtccggttaatgtgaaggccaagtatgggtggagtgacaaaagttttacctcactgcttgaggtagtgcacaatctgcttccagaggacaacacactgcctaaaaattactataaggcgaaaaagatattgtgtccaatgggtatggagtgttag

SEQ ID NO: 85539 - DNA, 291 bp, Glycine max
  Peptide Sequence Number=SeqID_202317
atggagggaatagaaaaaatgatgagagagagaagagaattccctaaggaagagttctcaagctttagattttcccccggtgatactaacatggtgttaagggagtttgaaaaatgcggtgaaattttgaaacatgttcctggtcctagagatgctaactgggtgcacattttgtatcagaatcgatctgatgcccataaagctctcaacaagaatggaatgcaaattaatggagtactaattgttggtgtgaaactgttggatcccatgcaacgccaagcttttaaatga

SEQ ID NO: 85540 - DNA, 1680 bp, Glycine max
  Peptide Sequence Number=SeqID_202318
atggcttcacattgcttccttcgttttcctccttccttaaaccctaaatacaaaagacttcccaaaccccgttattacccttccatttcctcgcgaattcaaaccccaaaacctgacaatgacgacgacaatgacaaaaccccaaacgacaaccgcttcgacttcctcaaactctccgtaaccctcactgtcatctctgcctccctccctcaacccgctgccgctgccgccgccgccaccaggaaggtaaagaaacggtcaccgaaaaaacaatcagccaaaaaagccgaaggtctttcgccggaggagctaaaaacatggacaagtggccttcccgtggtctccgatcgccttccctacagcgaaattatcgaactgaagaagagcgggaagctgaagcacataattaaacctaattccgcgaaattgaggcaacgtggcgaagcagttcttgtagttttggacgattcgagagtgttgaggacagtgttgccctcgcttgagagccatagcaagttttgggattcatgggatgagttgaagattgattcagtgtgtgtgaatgcgtacacgccacccatcaagagtccagagttgcctacctctctgttggcaaacatttgggtgcccccttttgtgcagaaattcattacttacgtttttgaagagaggcaaacaaagcccaagaaggagtccaagaaagcggcggagtatagggaaatgaggatgcagttgcagagggagaaggaagaggagctaaggaagtcgagggaagagagggagaccatggagaggaacacgagggctcggaagaaggaggaggagaggaggaagaagagggagatcaggaagaggaagtataaggaatccttgcgccaggcgagtgaccgaaacgagagaatggcgtatttctggtctgatttggcaaataatagcaatgtggccaatgcacttggggtgcttttcttctacattttttacaggactgtggtgcttagttataggaagcagaagaaggactacgaggacaggctcaagattgagagggccgaggctgaggagaggaggaagatgagggagttggagagggagatggagggaattgaaggtgatgatgaggagggtgagcaggggaaaggggaggagaatgcttatttgaaaatggccaagcagtttatgaaatcgggagcgcgtgtgaggagagcacagaacaagaggcttcctcagtatctagagagaggtgtggatgtgaagtttagtgatgttgctgggctgggtaaaattcggcttgaacttgaggagattgtcaagttctttactcacggagagatgtaccgaaggaggggagtgaaaataccaggtggcatacttctttgtggccctcctggagtgggaaagacattgctggcaaaggcagtggctggtgaggcaggggttaatttcttctctatttccgcttcacagtttgtggaaatatatgtcggtgtaggggcttctcgtgtccgagcactttaccaagaagccagggaaaatgccccatctgttgtcttcattgacgagctggatgctgttggaagggagcgtggcttgattaaaggttcaggtggacaggaacgtgatgctactcttaatcaggttaagctggcagtgctgaacttcccaactgcttttcataagtaa

SEQ ID NO: 85541 - DNA, 573 bp, Glycine max
  Peptide Sequence Number=SeqID_202319
atggcatcccgtttgttcgtcctttctacttgtgtgatcattttcatggctgccaccaatacttgtgttgaagcttccgtgcaattcaaagttggtggtagcttcggttggcatgaacctgcaggcaccaacaatactgatcaactttatattcaatgggctgaaaggaacagatttcaagttggtgatgctcttgtttttgagtaccagaatgactcggttcttagtgtggagaaatttgattacatgaattgcgatgcaagtaatcctatcactgccttcgacaatgggaagagcacgtttaatcttgacaggccagggaacttctacttcatcagtggaaccgatgatcactgcaagaatggccaaaaactacttgtggatgtgatgcacccacatactgtccttaaatctccaccacccatttcccttccaccagaagggtttccaccaatggctcctccaccttctgatgatcaaagcctagaggcttcatcagcctcagtgcttcttacttttatgtttatgtctcttttcgtcacatctgttagtgtcatgctgttggcattctga

SEQ ID NO: 85542 - DNA, 1191 bp, Glycine max
  Peptide Sequence Number=SeqID_202320
atgttctcctcaaccagatgcgctttcctgagcaactcggggttaggtgggtgcagcagcttgtgtgatgctgcgcagaaaaagcgttcaactcgtttgagggtggtgagtatgaccccaagcagcagcagcagcagcaggtccggtgatagaaacggcagcgttgtgatggagacgccgttgaaagaattgaaaaaggaatccacggtggctgacgtggacgataacgccatctccgccggcggccctcaagatgtctacggcgaggatagggctacggaggatcactttgttaccccttggagtgtttctgttgccagtggttatacactattgcgagatccccatttcaacaaagggttggccttcactgaagatgagagggatgcccactacttgcgtggtcttcttcccccatcagttattcctcaagaaactcaggtgaagaaaatgatccagcacgtacgccagtatcaagttcctttgcagaagtacatggcaatgatggatcttcaggagagaaatgaacggttattttacaaacttcttattgatcatgttgaagagttacttccagttgtatatactccaactgttggtgaagcttgccagaaatatggcagcatctttatgcatcctcagggtctttatataagtttgaaagagaagggaaagatccgtgaagtactaaggaattggcctgagaagaacattcaagtcatagttgtaactgatggagaacggatcctgggtcttggggatcttggttgtcaggggatgggaataccagtgggaaaactttctttatatacagcacttggaggagtccgcccttcagcttgtttacccattacaattgatgtgggcacaaacaatgagaagctgctgaatgatgaattatatattgggctaaagcaaagacgagcaactgggcaggaatatgctgaacttatgcacgaatttatgacagcagtcaagcaaacttatggggaaaaggtcctaattcagtttgaagactttgcaaaccacaatgcttttaatctgcttgagaaatatagatctacacatctggtctttaatgatgatattcagggaacagcatccgtggttcttgctggactagttgcatctctgaagttggttgggggtaacttagctgatcacagattcttattccttggtgctggagag

SEQ ID NO: 85543 - DNA, 336 bp, Glycine max
  Peptide Sequence Number=SeqID_202321
atgacgcatagatctttgtcgatgtcgcacttatgtggtgaggcttggcgtttcgacgatgcgcaaatgaaaaagggggaaggaggtgttaggattggggaagggaggtatcaagacttggtgtgtcgtagttttacatcaatgggttcgatgtcgcgtttttactcggaatcggatttggatagcaaattggaagttagtttccagcgatcggagattgggacttgccggaggaggttggagacttttcacgaaaacaattatgcatttccggatagtagtaaaacaaaaaatgagtacttttggattgttcatttcggaatcatgcatacataa

SEQ ID NO: 85544 - DNA, 2820 bp, Glycine max
  Peptide Sequence Number=SeqID_202322
atgttaattcaaattgggttactttactgtactcatccagttacttcaaggaaagatcaagaacaatattgggcaaatagaagcttatcataccgttatgtcacagtgagcgagtttgcaaatagattcaagcaatttcatgttggaataaagcttgagaatgagctttctgtgccatttgataaatcaaggggacatagagcggctcttgttttcaagaaatatacagtgcccacaatgggacttcttaaagcatgttgggacaaggaatggctactaataaagaggaatgcttttgtctatgtatttaagacaggtcaaatagtcattattggtatcatagctgcaactgtgttctttagggccaatatgcatcaaaggaatgaggctgatgccgcagtttacataggctcaattttgtttaccatgatcatgaacatgttcaatggttttgctgagttaccactcacgattgcaagacttcctatattctacaagcacagagaccaccttttccatcctccttggacttacactctccctaatttcatcctacggatccccattactatgtttgaggctattgtttgggtacttatcacatactacacaataggattagcacctgaagctagcaggttcttcaagcacttgttgctagtttttcttgtccagcaaatggcagctgggatgtttaggttcatatctggagtttctaggacaatgattattgctaacactggtggatccctcatgctcctccttgtttttttacttggaggtttcatccttcctaaaagttccattccaaattggtggatatggggctactggatatcaccactaacatatggattcaatgcttttactgtgaatgaattatttgctccaaggtggagcaatttgtcttcagatggtagaaccccgatcggtatagctacattaaataacttcgatgtttttactgagaaacgatggtactggattggtgcagctactcttttgggtttcattatcttgtacaatgttctcttcacctttgcacttatgtaccttaatcctattggaaaaaaacaagcaattgtatctgaagaagaagcaagtgaaatggaagctgaaggagactttagaaaagatcctagacttttaaagccagagcccaacagagagatagcccttcaatcattatcttctactgatgggaacaacacacgagaagtggcaatgcaacaaatgagtaaccgaggtaatcctagtggaataagaagtgttgattcaatgcatgaatcagccactggagttgcccctaagagaggaatggttctaccttttcaaccacttgcaatgtcttttgatagtgttaattattatgtggacatgcctgctgaaatgaaagggcaaggagtgacagatgataggctacaattacttagggaagttactggtgcctttaggcctggagttttaactgctttaatgggagttagtggagctggaaagacaactttgatggatgttttagcagggagaaagacaggtggctacattgaaggagatgttagaatatctggcttccccaagaaccaagaaacatttgcacgaatttctggttattgtgagcaaactgatatccattcaccccaagttactgttcgagaatctttgatctattctgctttccttcgattgcctatagaggtcaataatgaggaaaaaatgaaatttgttgacgaagtaatggagttggttgagctaaataatctcaaggatgctatagttgggcttccaggtgttacagggttgtcaaccgaacaaagaaaaaggctaacaattgctgttgaactcgtcgctaatccgtcaatcattttcatggatgaaccaacttcaggtctcgatgcaagagcagcagccattgtaatgaggactgtgagaaatactgttgacactggaagaacagttgtatgcacaattcaccaacctagtatcgatatctttgaagcctttgacgagagaggaggacaagtgatctactcaggaccattaggaaggaattcacttaggattatagaatattttgaggcaatcccaggggtcccaaaaattaaggataagtacaacccagctacatggatgttagaggttagctctatagcagctgaagttcgacttcgaatggattttgctgagcactacaaatcatcatctttgtatcagcgaaacaaagctctaataagggagttaagtactagtcctccaggagtaaaagatttgtacttccccactcaatattctcaatccacttgggaacagttcaaatcttgtttatggaaacaacggttgacttactggaggagtccagattataaccttgtcaggggtaactcaggcgatctgactactattataggagcattgtatggttcagttttttttgtaggtgttaacaattgccaaactgttcaaccagtagtagccgttgaaagaacggtattttatcgagaaagagctgctgggatgtattctgctttgccttatgccattgcacaggttatttctgaaataccatatctatttgttcaaactatatgtttctcattcatagtgtatgctatggtgagctttgaatggaaagtagccaaggtcctttggtttttctttgtaagtttcttttccttcatgtacttcacatactatgggatgatgactgtttccattacaccaaaccaccaagttgcatcaatccttggagcagcattctacggaatcttcaatctattttctggtttttttatcccaagaccaattgatatcattagttaa

SEQ ID NO: 85545 - DNA, 1089 bp, Glycine max
  Peptide Sequence Number=SeqID_202323
atggagagtgggaatttaaccagaagcataagtaggagcttaagcaggtcaagttggagaatggagggtgtgtttgcaagtgggagatattctcgaaggacttcaaatgttgatgaggatgaagaggctctcaagtgggctgccatagagagattgccaacctatgacaggctaagaacaagtatcctccaaacatttgtggaggctggtcatgatcatgctgatgctcgtccaagcacattgcaacacagggaagttgatgttcgaaagttggatgtcaatgaaaggcaagagtttattgacagaatcttcaaggtagctgaagaagacaatgaaaagtacttgcgcaaattcagaaacagacttgataaggttggtatccgactcccaacagtagaagtgaggtatcaaaatttgactgtagaggctgattgctacattggcagcagagctctgccaaccttaccaaacgttgcattgaacattgctgaatcagctcttggattatgtgggattagtaccgcaaagaggacaaagctcacaattcttaaaaatgtctccggcattattaagccttcaaggatggcccttttgcttggtcccccttcttcagggaaaacaacccttttgctggccttggctggaaaattggacaatgatttgagggttaatggagaaatctcctacaacgggcacaagcctaacgagtttgtccctagaaagacttcagcctacattagccaaaatgatgtgcatataggagaaatgaccgtaaaagaaacccttgatttctcagctagatgccaaggagttggaacgagatatgacctattagccgagctagctcgaagggaaaaggaagctggaatatttccagaggcagaacttgaccttttcatgaaggctactgcaatggaaggaacagaaagcagtctcattactgcctatacactcaaaatattggggcttgatatttgcaaagataccattgtgggtgatgaaatgcagagaggtgtatctggtggccaaaagaagcgtgtaaccacaggtgacagagacttgcctatgcaatcaaatcttcctagataa

SEQ ID NO: 85546 - DNA, 663 bp, Glycine max
  Peptide Sequence Number=SeqID_202324
atgtcacgttttagagttagtgatatcatagtgatgagaagggtcgttacacattgcctccaaaggccaaggatccgagaaatattacttttccatgtaccattgacaatctcaccattgataactgtgtttctggtggactttgtggtgatggatatcatggaagatgttgaattttctctcattttcggaaggctattcatgttaacatctaaaaccatagttaatatgggggaaggcaagctcactaccaaaaaattccacctaattaaagaagtattagaagaatcaaaggtggaaggtgaaaagaaggaagagaagcccaagatagagctgaaaatgcttccctctcatttgaaatatgtttttctagaagagggaggaggaaaatcggtcattattagtaggtctcttttcaaattggaggaagaaaagctagtgaaagtcttgaaagagaataaggaatcaattggcttgactatttctaatctaaaaggtatttgtccatcattttttatgcataagattatgcttaaggaaaacttcaaaccaatagctcaacctgaaaagagacttagtcctgctatgaaggacgtggtgaggaaaaagatgctaaatcttcttgaagcctatatgatataccttatctctaatagtgcatag

SEQ ID NO: 85547 - DNA, 240 bp, Glycine max
  Peptide Sequence Number=SeqID_202325
atggaggaaaagttgagagctctattctctactgaatccttgaggtggattctgaagattccatttcgattaaagcattcctctctgtatggtggtcggacggcaagcaacgactgctcatggcggccaccggtggtcgtggatggtggaagagaagggttgaggatttggcatgcttatctcactaagcgaattttgctctcgggttgggaattgcgcttagcgcgcttgtctcgctaa

SEQ ID NO: 85548 - DNA, 378 bp, Glycine max
  Peptide Sequence Number=SeqID_202326
atgagtgaagtagaggaggtgcaagagcagatgaaggccgacatggaagccatgaaagagcaaatggccacaatgatggaggtcatgatgagcatgaagaatataatggaagccaaggcggttgtagttgccgctaccggcgttgttgtcaaggtgaaccagatgcccccatctggcctcaaccaaatgaatcatccaacctcagatatggtaggcaaaagatttgggaagtacggatggccccatgatgtgcaaattcaaaatgagcacaccttcctgccatatggcttgcctcccaactatacaccacctaatgtggcttacactcccaatgaggatgtcaataactccgtttcgatactcattgagagccaataa

SEQ ID NO: 85549 - DNA, 528 bp, Glycine max
  Peptide Sequence Number=SeqID_202327
atgaaagataagagggatgcggaagaaaaactagaaaaccaaaagaaaaagaaggatagtatggccttgtcttcaaaggccaaggggaaggaaaaagaggaaaaggattcctccaagaagattgttaagaaggaaaatcattgcgacaaaatggaaatatcccttagcaccgccatacctcttgagcttgaggttattcctcaagtaaaggagttattagatgagggtttggtttcaccactcattcaattggtgaggaaccatgttacctcatgggaagatgcccaggaaatgggttttcagaccttaccttactccaacataccaaacaccactaatatatatgtttttattctttttacatgtgttgtgggaagaagccctgagtttcaagaacctttggatttgaggtcaaatccttttcaaggggtagggaatgatgcaatcctaccgcccccaaaggcattggatagaagactccaagaagattgggccagagatgcagagaaggccctagggttctcataa

SEQ ID NO: 85550 - DNA, 623 bp, Glycine max
  Peptide Sequence Number=SeqID_202328
accaccccctcttcccctcttcacctctctctcaaatcgcaatagaaatggaaagtaacgcaccagtactagcagagaaagtgtggagcatggtacgtgtgctgttgttcatgcttcgaaaaggcatatcaaaggggaagctaatgatggatctcaacatgatgctcaaacgccgcggcaagctcgccggcaaagccattgccaatctaatgtcccacaaccacaaccaccgtgggtcccacaagtcgcaacttcggttctctgctccaagggagtacgagttcagctgcagcaacactccccacaacttgttccccacagcagggaagcgccaccgccacttcttcgcctgcgtccacgcgcctcccacgcaggacgacgacgtcgtgacggtgaacgcaatgaaggcagtgttggagatgctcaacaacaacgacgtcgttaaggttgaggcgtcccctgcgctgccagggtttggacggagccctattgtgaggcagcttagggttacggactccccattccctctgcgagactccgaccatgacaacgaccaccaggtcgataaggcggcggaagagttcataaagaggttttacaaggacttgaagaagcaggattaa

SEQ ID NO: 85551 - DNA, 562 bp, Glycine max
  Peptide Sequence Number=SeqID_202329
atggcaccaccccatggaaagtctttgcctagctcattctctaagtgcaacaacaacaacagcgttagcatgtcgaaacctccaaggctctcatctgatcatcacattcaaagaacaatctcagacatgtcgtttgagctaaccaaggaagggattgatttgacgcttccaccaataactgaggttgtggatgccaagtgtgagtgctgtgggatgagtgaggagtgcacgcccgaatacatagagcgtgtgcgtgacaagttcttggggaagtgggtgtgtgggttgtgtgctgaggcagtgaaggaagagttggagaaaaatggtgggaagaaggaagaggcattgagttcacacatgagtgcatgtgttaggttcaacaaatatggaagggctttcccagttctgttccaagctgaggccatgaaagagatgctcaaaaagaacaaaatggaagggagaagggccaagtccttcaacccaagggacaaaggaggatactacaaaggagggattgcaaggagttcaagctgcattccagcaattacaagagagatgaatg

SEQ ID NO: 85552 - DNA, 612 bp, Glycine max
  Peptide Sequence Number=SeqID_202330
atggtcgcacgtcatcgagcaaaggttccccggacgaaattagggtatgacaatacggatgaccactcgggtatctccgcccgtcagcgtgactcaaaagtcagtatgacagatcttgtgagcgcggaagatgacgcttttcatcttaccgataacaaaaaggtttatacagatgaccactcgggtatctccgcccgtcagcgtgactcaaaagtcagtatgacagatcttgtgagtgcggaagatgacatagcaaaaagaatgtatacggataaccactcgggtatttccgcccgtcggcgtgactcaaaagtcagtatgacagattttgtgagcacggaagatgacgcttttcgtcttacagatagcaaaaaggtttatacggatgaccactcgggtatctccgcccgtcagcgtgactcaaaagtcagtatgacagatcttgtgagcgcggaagatgacggcgccgaagacgacattagtctctgcgtgctatcaggcttatcatcttacagacagcaaaaagtttatacggataactactcgggtatttccgcccgtcagcgtgactcaaaagtcagtatgacagatcttgtgagcgcggaagatgac

SEQ ID NO: 85553 - DNA, 585 bp, Glycine max
  Peptide Sequence Number=SeqID_202331
atgacattgctacttagcaacattctgcccagcgaccgcaatgccaatctccccctgcaaaagtatcagttggtctgtgtcgtcccgacatggggatcgcacccacaaagacacccagtggacctgaagaagtccaacagggacctggggtttccatctctggttacgggcctctgtcggccctacagggcgcccgttccccccagcaagttcatgtcgtcgtggcatagggattgtgcccgcaagacacctagtggacccgaagaaggccaacagggtcttggagttgccagctctaaatacgggtctctgtcagttctagggagtgcctgtcgcccccagcaaggtcatcaggtcccccctaccaatcgagctttcatcaagaagttctgcgtctccaggcaggcgcagggcaaaacaccacagcagcctggggatggccagcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 85554 - DNA, 228 bp, Glycine max
  Peptide Sequence Number=SeqID_202332
atgaaagaaaatgcgaaaaatgaaaccaaaagtgcacaaaggaagcttgggggctgctgccaatggtggctcccgtgttatcgtgttcaattttacttaaccgcttatggcaccccgtttatcgagccgaatggctttgtatttagtgagcaagatcgagagtgtatgttcttaaagacaataaaaagtaaaggacacaacactggaagtagagatgcaaatcattaa

SEQ ID NO: 85555 - DNA, 606 bp, Glycine max
  Peptide Sequence Number=SeqID_202333
aggcggcgggcccgatgacatgtggagacagattatggtcattccgcacaccttttcgtcatttagacacagtcgtgtccgatggcacgcagagactaacgtcgtcttatacacctttttgtcatccagaggcggcgggcccgatgacatgcagagacaaattatggtcattctgcacaccttttcgccattcagacacagtcgtgttcgatggcacgcagagactaacgtcatcttctacacccttttgtcatccagaggcggcgggcccgatgacatgcggagacaaattatggtcatttcgcacacctttttgccattcagacacagtcgtgtccgatggcacgcagagactaacgtcgtcttctgcacctttttgtcatccagaggcggtgtgcccgatgacatgctgagacaaattatgaattcaaaaggaagtgctaatgtgcaatccgtaaagttccgtaacattccggaagccaaagaagggatgattacgggggtgcaaatagcaaccaggcccacttgggccttccaggaagttctccaaaaggcggtgccttctagaggaagcaacctagctcgctgggcgagctgggttgcaag

SEQ ID NO: 85556 - DNA, 797 bp, Glycine max
  Peptide Sequence Number=SeqID_202334
atggcaagagtagcaagagtggttaagatctcagcacaagagttagaccgagtgaagcaaaacaggaatggggtggagagtggacttcatccaaatgtagacgggctagtggatttagcagcgatcgatgcttttcttgcttatcaccacagcaaggaaagcccggagcgcttgttagttggttcccccgatggaaggaaggaggggccggagttttgtgctcgtgtgaaggactctcaaacgtcccctcgatggaaacaaggggctcgaatgcaagggataacttggctcccaaagaaaaaaagtccaagtggggaagaagctgaagtccccgaggaaagcgaaaaagtgcaagccttgaaagcagagcttgaaagaatgagagtggtcaaggaaaagctaaagacatcagtcaccacgattaggaaagagtgtgacaagctaggggatgtcaacatgactacggccgaagccaacaacgagctcaagcttcaaagggctgaaagggacaagtcaagggtggaaagtatgatattaaaggataaattgaaggcttgtcaaagattggaggatgagcatgcgaaggtatcaactctgcaagtggaaaaggaagcaagagaaagggtgatagaatcattgcatgaggaagctacgaaatggatggatagattcgctttcactctaaatgggagtcaagagcttccaaggctgttagccagagccaaggcaatggcagacgtatactcagctcccgaggaagttcatgggcttttcgattattgccaacacatggtcga

SEQ ID NO: 85557 - DNA, 255 bp, Glycine max
  Peptide Sequence Number=SeqID_202335
atggcagctacctatgcccaaggaatttccaaaagggaactcaaagaattgtgctcaaatgccattgagacatttcaccgagcacttggcgggcacgcttttaggcatgaatatcaagagaatggggacaatgtggcatgccccattattccagaatgcaacctaggcctaaatccatcctctacaactccctatttcaacaaaacaagcacgaattcaaggataaaattgcttctcggatttttgcaagtatga

SEQ ID NO: 85558 - DNA, 843 bp, Glycine max
  Peptide Sequence Number=SeqID_202336
atgactccgaaaaatctttccacgaagaggtctagaaaggacgccacgggagaaggctccagtgccgccttagagtttgatagtcaccgggaagatgagtactcagacttccaggaggagatagctcgcaggcgttgggcacctttagtgactcctatggccaagttcgaccttgagatagtcctagagttctacgctaatgcttggcccacggaggagggagttcgggaaatgcgctcgtggaggaggagccaggcagacggtttcgatgaggaagccatcgcccagctgctgtgcataccggggcaggattttgcccggaccgctgcagggaggcgggtgcggatcatgcgcaccagcatgactactttgacccagatatggatgacactgctactcagcaatgtcttgcctagcgaccacaactccgacctccctctgcctaagtgccagttggtgtatgccatcctgacacagatgagcgttcacgtggcccagaagtccaatagggccctggggttttcggctttgatcacgggcctctgccagtcctatggagttcctgtcacccccagcaaggtaatccaaccgccgatcacccgagccttcatcgagaagcacactgccaccacctcagtaagccgatccgattgggccactaggcgtggagcgttatctatagcatttggttcgccagcaggcggccaaccaccatggacagactggcccgatgcccaagcaggggaggagcctgcaggatcccccggtgaggcggatgaatctcatatggatgaagatataactgacctgctcggtttcttgggagggagtggagccacatga

SEQ ID NO: 85559 - DNA, 294 bp, Glycine max
  Peptide Sequence Number=SeqID_202337
atgggctttattgggcttgtaacatggttaggcgtaagagagctatgcaagaaaaaatcaaagaggctcaaagagtgtttgagggttatattgagtaagaaccttcagagtcttgcttgttgtcgcaacatgccctctttgcgggcgtgcgaggcgagactcacgggtgcgctttccaaaggaggaaagatgcgcggagtcaccaccaacgtttatttgtggaaaacgtcggaaaatccaaaggaaaccggtcaaaacgaaaattctaagttcgggagttgtatttacgtttga

SEQ ID NO: 85560 - DNA, 794 bp, Glycine max
  misc_feature (758)..(758): n is a, c, g, or t
  Peptide Sequence Number=SeqID_202338
atggcctcctctggacctgttttttcgttttccgggactccaactatcactactgcaaagctgaactggaaaaactatccttcgtggtctgcttccgtggagttgtggttccttggtcaaggacaccatgaccacttggagaaaacctcggattctgtttcagttgataaaagacctgaatgggagaagcttgactatcaactatgtgccgtgttatggcaatcagttgagccggatatcttggagatcctccgatcatttaaatcgtgtcgctccttttggaagaaagcccaggaaatctttgccaatgatatccaaagcttgtttgatgctaccatgaaggttacagccctcaagcaaaccagtcatgacatgattgctcatgtgggtaaggctcgggctgccgtggaagaactgagaaagttccttgtagctgattcattggaagaagtgaataggaagcttgacaagttctacatggttcttattttgaggagcttacattcagactttgatcatgtgcgtgatcaagtacttgctggggaccagattccatcaatggattccctcatcactagacttctccgcgtgcctcatttattgaaggatgagaatcctactgatggagtggagacgtcagccatggttgcgtctcgagggagaggaagcggccgcaacagtagaggaggtcgcagtggaaggggcggacgtcctcattgcacctattgcaagaggataggtcacacccaagagacttngctattcattacatggtttcatgacaagtcgcacaa

SEQ ID NO: 85561 - DNA, 273 bp, Glycine max
  Peptide Sequence Number=SeqID_202339
atggcttcaataaattttactcgtgcaggttttccacccactctcttattttcagatctcctttccttcttctcatcattcaaaacttgccacaataaccaaaacgaaatgcataagcaaagagaaaaagaaattggaactctacgagagagagagtgtgtgagagagaaaaggaagttacagggtcttgcaagatctcgcaacacggtgcaagctcagcacgagcacatcatcacagtggatctggtctgggaggtgttgacggtgaggtaa

SEQ ID NO: 85562 - DNA, 312 bp, Glycine max
  Peptide Sequence Number=SeqID_202340
atgcatgagacaattaataaattgtatgctgagcttttggaaaaggcaaataaggagaagacacttgaggaaaagatgttgcaaatgatgaagaatcatgaccaccaaagtcaggagatgcgacaacagatgcaagaacaaaatgagaaaattcctcaacaaaataagcaaatgcagcgtatactacaacacttgcatattcagtctatcatgctaactcctagtctatcgcctaccatagcagatggaactgagcaccatattaatgatgctcaaattgatcatcctcatgacatgggaaatgatcattga

SEQ ID NO: 85563 - DNA, 120 bp, Glycine max
  Peptide Sequence Number=SeqID_202341
atgcctgcgtgtctagtccaggaaaaacatagttggctgctagcacggatcagagctcataggtcgactattgaatatgaagggattgtggaggggcaaaaattagatgcaattagttaa

SEQ ID NO: 85564 - DNA, 282 bp, Glycine max
  Peptide Sequence Number=SeqID_202342
atggaacctattaaggaagagttagataacaaaagacaactctcccaaaagaaactccaacgttatcacgtcagcttggcggctctaacaaaagaccttcctccaaagacacctactgctgctcatctggcagcaattgtcaaggtcacccagttgtgcaaatgccactacccctccccctccatgttgatcagcatgagtctcaaggaagttccaaatcaagtgaaatatcacccaagtacaaggatttttcctcatgaagaaccacaggggaaattctaa

SEQ ID NO: 85565 - DNA, 342 bp, Glycine max
  Peptide Sequence Number=SeqID_202343
atggttgttcaagagaacaagggaagatacatcccttgtagatctttgcttgtaaaggattttacaaggccacttgatccaacacaagtccctttagcttgtgcctctagcagtaaggtgattgctcctttagtttttgttacaaacaataatgaaaaagcacaacacaataatgaacccatggtacataatgaacctattgtggaagaaccacaagaagtagcattaaggagctctcaaagagaaaggagaccagttatttccaatgactatgtggtatacctacatgaaattgaaacagacttaagcattaatgataatgatccagtttcattttcataa

SEQ ID NO: 85566 - DNA, 185 bp, Glycine max
  Peptide Sequence Number=SeqID_202344
atcattgtcttgaattaaacttgagaagcgcattttcatcaaatcatcatgatcatcatcaaaacatcaaagacaaaggctttgcttctacagcaacgacggctcatggcagccaccagtggtcatgggtggtggagaaggaggtgttagggtttaggtggcgttttggagagaggagagagtga

SEQ ID NO: 85567 - DNA, 273 bp, Glycine max
  Peptide Sequence Number=SeqID_202345
atggcaaccaggcccacttgggccttccagggggttccaatagaaggcggtgccttctggtggaagcaacccagctcgcctgggggaaagagggtagagcaaaaatgttcagcccttctgattgcttcaacaaacaaagccttgtttcaagattcactaaagaccaagccttgccttaaaacaaagtgctttcaagacatgcaaggctctggtaatcgattaccaggaagtgtaatcgattaccagaagacagggttgagaaatagctgttga

SEQ ID NO: 85568 - DNA, 387 bp, Glycine max
  Peptide Sequence Number=SeqID_202346
atggataaagatgctaattcaaaaatccaactccctcctggatttagattccacctttcttatgaggagctaattgttcactatctgagaaacaaagtgacatcatcaccccttcctgcttcattcatagcagaaatagatctttacaactataatccatgggagctcccaactttgtttggggaggatgagtggtatttctttactcctagagataggaagtatcccaatggagtgaggcctaatagagcaactacttctggttattggaagcctaccgggactgacaaacccattttcacttcctgtgggatgaagagcattactgtcaagaaggcactcgtgttctacaagggtcgtccaccaaagggatcgaaaaccgactag

SEQ ID NO: 85569 - DNA, 381 bp, Glycine max
  Peptide Sequence Number=SeqID_202347
atgtcgagcgtttcgatatattacgggactcaatcaaacatccgagtaaaaacttgttgtcgtttgaatgtggtcagagcttcaacattcaatttcgagcgtttcgatacattacgggactcaatcagacatccgagtaaaaagttattgtcgtttgaatttgctcagagcttcaacattcaatttcgagcttttcgatatattacgggactcaatcagacatccgaagcttctgcattcaatttcgagcttttcgatatattacgggactcaatcagacatccgagtaaaaagttattgtcgtttgaatttgctcagagcttcaacattcaatttcgagcgtctcgatatattacgggactcaatcagacatccgagtaa

SEQ ID NO: 85570 - DNA, 252 bp, Glycine max
  Peptide Sequence Number=SeqID_202348
atgaccacaactctgatctccccctgccaaagtggatcgcgcccacaagacacccagtgcactcggagaagtccaataggttctacggagtgcccatcacccctagcaaggtcatcaggccccctattagcagggctttcatcaagaagtactgtgcccctaggcaagcgtagggttaggcaccacaacagcctagggactgccagcaacgggcaacagatgcaccgcccccacctccagagtccaccttaa

SEQ ID NO: 85571 - DNA, 210 bp, Glycine max
  Peptide Sequence Number=SeqID_202349
atggaggattgccttgagggtcctcacttatgcaatcatgaaacacagctcctaactcgaaagtggaggacacatgaacagccctatgcaatgacgttcatggggctccgaaaaagggtgagaatggaggattgccttgagggtcctcacttacgcgatcatgaaacacaactgctaaatcgaaagtgcaggacacatgaacagccctag

SEQ ID NO: 85572 - DNA, 480 bp, Glycine max
  Peptide Sequence Number=SeqID_202350
atggaagatcaacaatggagttgggaggagccaataagcaagcagctgctagaaaccccacaattctttgatgatgatgtagatgacattcttgtcaaaagcacaagacctttatttgagatctatcaaaggtgtaatgtggttgtcttagaacctgcagaatttgaggaagctgagaaggatgacaagtggataaatgctccaagggcctggtacaacaagataaattataatcttcaaaatcttggatttgtcaaaagtccaagtgaagcaacattttatatgaagtatgtttatgcaaatttagtcattgttgttgtctatgttgatgattggcttatgacacgaagtgatgaatggcatcatcaccggcgagcaagggttttatggttcttaaaaattggggaaaatgtagttaacaaagaagaagacaaggtttcaatcggagctaagagcggtgacaaagatggacaacggtga

SEQ ID NO: 85573 - DNA, 789 bp, Glycine max
  Peptide Sequence Number=SeqID_202351
atgatgagacatgaggaggctatacaaagtgcttttcatgcaaaaacacaaaattcaaaaggtggaaaagacaagaaaagcaacaaatggaagaacaaaaatctagaaggctccaacaagcaacaaggtgaggtttttcccccttgtccacattgtaaaaagacaaaccatcctcagagaaaatgttggtggaggccagatatcaagtgcaaaaaatgtggcaatttgggacatgtaaagcgaatctgcaagtctaaattggaggaggcaaaggtgaaattggaggaacaaggagataaacaactctttgttgcaacatgtttagctacaagcaacaattctagtgattcatggttgatagatagcggatgcacaaaccacatgaccaatgaccaaaagctcttcaaagagttgggcaaaaccattgtttccaaaaaacatgccttggtgaaaggtgtctcgatgctcaaagacaagttggttgattgtgtggcttaccaatatgctttaaacttgagattggatagtttacaatctccattccgatctagaatttgtagacaatcaacttcgaaagaagaagatgaggagtattcagatgcaagaagtcatggaagaaggcgaagaggcgaacaaagaaggaataatcaattgaggagcattaagatgataatccctacgtttcaaggaaaaaatgatcctaaattgtatttggagtgggagagaaaagttgaacgtgtgtttgataattcttctgaggaaaaaaatgttaaattagatgttgtttaa

SEQ ID NO: 85574 - DNA, 270 bp, Glycine max
  Peptide Sequence Number=SeqID_202352
atggcctatacctacctaaggatgctaatgagattcgaggacaaatccgtcaaagagggagggagtgatggaggtgcaaccagcccgtctaatgatcctttacaggggattggaggtcctatgacaaggtccaaggctaaaaggaagaagcaaacattgcaaggcctaattctaaagatcaaagagaaagaagaccactatgaactaactgttgcacctaattgggtcactcccctaccagttgatgaagatgttttcaggccaacttga

SEQ ID NO: 85575 - DNA, 207 bp, Glycine max
  Peptide Sequence Number=SeqID_202353
atgtcattgcctagcgctgttcatgtgttctccattatcaagtgcgaagcttctggtgactgggaagcacgttattctgttgttttccagatcggttccttcgccaaatactcggcgccccgggctgcccaatatgtgaagtcccgtgaagtgctgagaatcaaaaggaagcaggcttacgcgattagtgaaaattccgtaatgtga

SEQ ID NO: 85576 - DNA, 1002 bp, Glycine max
  Peptide Sequence Number=SeqID_202354
gcagatcatgtgtggtcaccggaggcggagaacacgtttcagacactcaagaatgcagtcacgacagtgccggtgcttgctcttcccgacttcactaagccctttacagttgaaacagatgcttcgagctcgggaataggcgttgtgctctcacaagaaggacacccaatcgccttcttcagcaagcaattctgtccaacgctacttaggtcctttacctacgtccgtgaactggccgccatcaccgccgcagttaagaaattgcggcagtatttactaggacatcatttcgtaatcctaacagatcatagaagcctaaaagaactgatgagtcaagccattcaaactcctgaacaacacaagtacctagcacgattactgggcttcgattatgtcattcaatatagaacaggcaaaagcaatgtggttgcaaacgcgttatctcggtcaggggaaacaacacctgcttcacttctcattatctcagtgcctcactttactttccttgaagacttgcgaaaggagttgcagacaaaccaagaattcatcactttgagggagaagatacgcgcaaagacacaagcataccctgatcattcattaactcagcacttcatcttatatcaaggtcgaatatggttacctccgaactgctcatttataaagaccctgctctctgaatttcatcagtctccaacaaggggacacatgggtttccgtaaaaccctagatcgtgtagctgagaacttcacttgggatgctatggcgagtgacacgcgcaacttcgttgccaactgcttggattgtcaactcgtgaagtacgagccagcgaaacccaggggcctgctatgtccgttacctgtgccgttgcggccatgggagaacctttcaatggacttcatcatgggactccctgcttatcgcggcaacacgtgcatcctggttatcgtagaccgcttctccaaaggggtgcaccttgtgatggatcgagtggcctcataa

SEQ ID NO: 85577 - DNA, 876 bp, Glycine max
  Peptide Sequence Number=SeqID_202355
atgagttctacgtatcatcctcaaacggatgggcagaccgaggttgcgaataggatcattgagcaatatttacgagcgttcgtgcatcgccggccaagcgcatggggccattttctgatgtgggcagagtggttgtataatacgtccacacattcagccacagggctgacgccgttcgagatcacttttggccgcaaaccaccaagttttccacagtacttgacgggcacttctacggtggcggcagtggatgaattgctcagtcagagggaggacatgtttgccctacttcgacaaaaacttcagaaggctcaggctcgcatgaaggaaatcgcggatgggcatcgtagagatcatgagttccaagtgaatgaatgggtcctagtcaagttgagaccgtatcgaatcatcgcgaggatgggcccagttgcatacaagcttgaactcccagagcactctcgcatccatcccgtgtttcattgctcccttcagaaacctttcatgggatcgcccaacacagtggaagttgagaaactaccctcaggggccatggataatcaacctatttccacacccttagctattctgggccagaaaacaattccgacggaccaggggccaaagcagatggttttggtgcagtggcagggcctgcaccccgacgaaacctcttgggaagattgggcaagtcttcaggagcttcatcaccttgaggacaaggtgttgtttgaagatcgtgggaatgttacgagaagcaaccttgaaccgcaagcaaccaggcccaatgaagatggcaacctgagattagctgcaggaaggcccaagagaggaagtaacacccctagctacttaaaagactacatactcgaagtttaa

SEQ ID NO: 85578 - DNA, 237 bp, Glycine max
  Peptide Sequence Number=SeqID_202356
atggaggcgccatttgaaaacagacgagcttgcaacgggtttgatctcgatgcaatcgaagtgacgcgtgaggtttcggtgagcacacatacaacggcatccagaattgtgcgacatgtgagacatggttttttgggtggagggagtagcaacgtgcttcagctgaggaagaaagaggggcacaaggtttattgcatgaactacaatggaggtttattgcgtgaactacaaaggtga

SEQ ID NO: 85579 - DNA, 180 bp, Glycine max
  Peptide Sequence Number=SeqID_202357
atgataattgagggtgcatcagcaacaaggggattaggtaatggcgcaatgccattggacgatgcaagtgggtggggtcttggcatccatcaaggctgggaatgtggactgttctatgtgtcgacatctatttcactttcaatctctctctgttttggtgtgctactgctaactgtttga

SEQ ID NO: 85580 - DNA, 426 bp, Glycine max
  Peptide Sequence Number=SeqID_202358
atggctactccacctgcctcgcctcctcctcctccttctgtagtagcattagtgtctccgtctaccttgaagtggaaatgcaaagtcacacgactacgatccttggccactagactacctggggtagaaagaccagtggtccacgtcgatcctgcaattgggaaggccaacggtccccacaagaagaaattaagaacatatttggggattattgctcgtgataaggtcgacgtgacatacgagacttggaaggaagtccctgctgctcagaaggatttgatatgggaggatattcaggacaaagaagaaagtacttcaacttttgccgacaaggacagtgtggacgacactgtttctgaaaaatacgacattagcaaggagaaatgggcccagttttgtcagacccacagagacccctcgtgggag

SEQ ID NO: 85581 - DNA, 345 bp, Glycine max
  Peptide Sequence Number=SeqID_202359
atggtgctggggtttgtgtcaaggttggggtggtcacgcgatggtcgtgcgccgctggtcgtggttaggtcgcgcactgccgatggtcgtgattctgactctgctgtggtctgtcatcctttggtggtggtgatgtcgcatcacgttctatgggggtctactattaacacttgtttgattttttatatgctggttgaaggtttatatgggtgtgatgatgatttggttcgtgctcgtccccactcacggttcacttcttcttcttttcttttcttttcgaaacacggaagtgggattgcgtgtgttaccggcaagcgcaccggatcgtcaagtattttaaattaa

SEQ ID NO: 85582 - DNA, 591 bp, Glycine max
  Peptide Sequence Number=SeqID_202360
atggctaaagttggatctgattggacctcaaccttgaagaaacgcctagatttcagggctgcattttcagaatttgatgcagaaaccgtggccaacttgactgataagcaaatgatgtctattagttctgaatatggcattgacataagcagagtccgaggagctgttgataatgctaaccaaattttagagattaagaaagactttggctcatttgacaagtacatttgggggtttgtgaatcataaaccactctccactcaatacaagtttggccacaagatttcagtgaagacatcaaaatcagagagcataagcaaagacatggtgaggaggggctttagtgcaccctattggcagctcgatcctttgtaccatagagccctctcaatagacccaaatttcaactactactatccaggaacaaggaccaacaagagattattgaccctggagaagaagagctcaagacataaaaatttaagagtgatgctcgcgagatgcagagtttttatcagcattactacaacaaatatatccaagctttacaaaatgctgctgataaagctgcccgatagactctccagataa

SEQ ID NO: 85583 - DNA, 584 bp, Glycine max
  Peptide Sequence Number=SeqID_202361
atgaagtttatctacaatgggaaactgattgagctcgtgggagatcgcgatacatctctgcaattagtctcaccctctcagttacggcgcctggttgacataggtaataccagcacctattttcatattaaaatggaaccccccccccccccccccaccaagacaccactgccaattgcgcacccgataccggcaatccaaaagctcctcactaaacactcctcccttttccaaccattatccactttacctccatcgagacccacagaccacactatcacacttcttccacactcagccccggttaacgtgaaaccctatcgttacccacattttcaaaagaaagaaatagaaacccaagttgcagctatgctcaagcaaggccatatacaacacagttctagcccattctcatccccggtattattagttaagaaatgcgatggaacttggcatttatgcgttgattacagggcgctcaacgcaatcacggtgcaagatcgtttccccataccgacggtggatgaactcctggatgagctaggaggcgtggtctggatcttaaagttggacttaatgcaagg

SEQ ID NO: 85584 - DNA, 243 bp, Glycine max
  Peptide Sequence Number=SeqID_202362
atgaggtggcacaaagataagcgatttcaagatggacaattgagacatccaattgactcaattgaatggaagagtgttgactctaaatttccttcctttgcggcatatccacgaaatggtcaactcaaggactccccgaatggtcatagaactggaccatgcatggtaggcgatgaggcctatggagaccgcccaaaatttgtaaaaatatcgataaaatcatgtcaacattttattacataa

SEQ ID NO: 85585 - DNA, 213 bp, Glycine max
  Peptide Sequence Number=SeqID_202363
atgaagcatattgaagtgaaagttaaccttctaccgacaaggaagatatggactaatccttcttgcatcaacaccacaactagatcagcacttgcaccaagatctgcaaaatcggaatggagaagaagaagagttgagtggagacgccacttcaaggagaagatgagtcaaaaagaagctcaccaccataggaagccttggataagagcttga

SEQ ID NO: 85586 - DNA, 330 bp, Glycine max
  Peptide Sequence Number=SeqID_202364
atggatcaagctggtgaggaaagaaagttgcaactgagtgagttagatgagatccacctagaaacgtatgagaatgccaagttctacaaagaaaagaccaagaagttccatgatagcatgataattaagaaggactccatggttgggcaaaaagtgttattgtataattctaatcttggactcatgagtgttgagatcaaaagcgactccacgaacaagagcttcaaggtcaatggacaccgacttaagccattcctcacaaacccttctttagtggacgtagtggtggaagagacttccttactccaccatactcttcctccaccataa

SEQ ID NO: 85587 - DNA, 1173 bp, Glycine max
  Peptide Sequence Number=SeqID_202365
atgatgttcgctttgttgcaaacatcggcgactattgccggaagtgatgctgaaaagcagctgaaaaaattcttatctgagttgtccggtgtgccacaggaacgtattgatgttctgggaggtagccgtgtcattcctgacctggcgccgtgcaagcatctttctctatccctggatgagcttgagcatattcctgattctgatggggaggggattagccttgagcgctacaccgcgctgacccactctccgcaagcgcgtcatctccgcgaaatgattgtgagtcaacccagaccgatgaagcttgatacgctcacccggcgtttgaacgagctaacaaaacatcaatacactcagcaggaaattttgcgctggctcgatctctgtaccggtacgcttcccagtgcgcaggaaccggcattcctgaaagtcagagcgcatatttttcaacgtaatactcaggggatatgggcctgcgtagataaacattgctccgctaaacacaatactgcgctggagaaggggtggccttttggcaatgtgtatgtaaatcagcggcaaagctgcgagtgtggcagccctgtttatgaactcgcgttctgcaatgagtgtaatgaaccgcatttacttgcccgggacaaaaaaggaaaacttgtacagtgggataataaaggtggggatgagttttcgctgcaggatgaagctcctgatgattttgactcctccagtgaaaaagttcaaaaagaacagcgcctcgatcgtcaaactcgaagtattggcgtagtcaacccggatagtattccgttggcgatgaatgatattgagcaggtctgtagtgccagcaactgcggttatagagggggtaaaggtaaacaacccttccggcgggcactgttaggcgggcctttttatgtgacgaatatcgtgcctaccgtgctggaatattgtcaggactttatcagtgatgaaggtaaagagggggttggcccgctttctttgcctggacgagggcggcgactgatcaccttcactgatagccgtcagggaacggcacggatggcggtgcggatgcagcaggaagcggagcgcagccgtttgcgtggtagcgtggtggatattctcggatggtaccaacggaaacagtcaacatatgcgccaaatgctcaggctgac

SEQ ID NO: 85588 - DNA, 327 bp, Glycine max
  Peptide Sequence Number=SeqID_202366
gttagtatcattgtagaggcagatccagaggtattgggtgataagcgagtacaatcagctgttgaaggaaggttttgtgattctgcaatatctgttcgagaagcagcattggaacttgttggtaggcatatagcttcacatccaggtgtgggttttaagtattttgagaagattgctgagagaatcaaagatactggagtaagtgttcggaaacgagctataaaaatcattcgagatatgtgcacttcaaatgccaacttctctggatttacaagagcttgcacagagataatttcacgtgttagtgatgatgaagcaagcatccag

SEQ ID NO: 85589 - DNA, 258 bp, Glycine max
  Peptide Sequence Number=SeqID_202367
atgggaacaaagaggagcttcaattctccggttaatgttttgattgaaaggttgaggaaggttccaatgaaagtgaagattttttgtggggtattgtttgctgtttttgctttggtggccttaaagctcaccataacaaatcactactatttcttcatagcttctgaaacggtccatgttgctgggataattgccctcatatacaagctttttgccctgaagacctgcactggatttgtgaatgtgtttgtattctaa

SEQ ID NO: 85590 - DNA, 129 bp, Glycine max
  Peptide Sequence Number=SeqID_202368
atgactgctcttttacaagcaccatcagagggaataggcacagcacctgcaatcccttgtttaagggatgagggtggaggtcagtttgtgactgccaaagttgtggctggtttacagaagaaagaatag

SEQ ID NO: 85591 - DNA, 393 bp, Glycine max
  Peptide Sequence Number=SeqID_202369
atgcccaaggctactagcccggagtgtggcaaatgcaagtggcctaacaatgaattttggatagctcaatcccataatccagctttaaaaaactgccttgtatacatatattctagtggcagtagattggctcaaaggctaatatttggacatacaaaccatggggacctaagaaaatatttatctggcttttttgacaccacagtagggaacaaaagagagacacgcagttacgttgaaatttctgagtctcttggtgttgataagccatcagatattttatttgtcactgatgtttatcaagaagctacagctgctaaggcagcagctcttcttcctaatcatcttggtgcttttggaagcctgaaacccaatttggcattgcttgagtag

SEQ ID NO: 85592 - DNA, 735 bp, Glycine max
  Peptide Sequence Number=SeqID_202370
atgaaaatcaacttaaggctccaagaaacagaaaccccaccttccatgaacaactccccaagaagcaatctgagcaacaacaactgcaccaataataatagcattggcatccaaatccccaccacaccaaaaaccattcccagatctgactccaccaccaatccttaccccaccacctttgttcaagctgacacttccactttcaaacatgttgttcagatgctcactggctcatcagaaaccacaaatcctcaacagcaactacaagatccagttcaaccacaatcatcatcatccaagaacttcaacatccctccaatgaaaacaacgccaaagaagcagcaagggttcaagctctatgagaggaggaacaacaacaaccatctcaagaacaccctcatgatcaacaccttggtccccaattttgcacacagctcaggattctcctcctcctcatcatcaccctgcaacaagccagagatcctctctccaagcttgcttgacttcccttccctcactctcagcagcccagtcactcctttgaatgatgacccttttgacaagtcctcctcattaccttcattgggaagcacttcttcagaggaagagagagccatagctgaaaaagggttctacttgcatccctctcccatgtctactccaagagactttgagcctcagctcttgcctttgttccctgtgacttcacctagagtttctgagtcaactacttga

SEQ ID NO: 85593 - DNA, 669 bp, Glycine max
  Peptide Sequence Number=SeqID_202371
atggaggattgctgcaaaatagccggccaaactcgcgggagtgacgatttcccttttctgagggcggcatcgggtagtccgcctttcctttttatgtatcattttctcttcatggtcttggttttggttctccccttgtcttccttccagtgtgctctacttgagcatctaaatatgaaattgacaggaaagataggttggatctccttgaacaacgtgtccaagaagctatatgagtttgattcgaatgtgtttcgccacttcaaggactatttcttcaaggtcctagttactgacgttgtggctgatggattgccactagtgttcaaccgggatgaggaaccttgcttcccattctaccagcagtcaaatcctaccgggttcaagtcttttgacgaggatttgttaacccttgtggaaaggttcgacaaggctatcttggagcaactgctggccttatcggatgcacgggccatcctgtctcttttttcgacagacgatcttatcgctgccatatatgggggtcaaccttctgctagggttttccccaatgatgaagttgttaaggtctcccccaacatgtctttctctgttttggctaagaggaagcgtgatgatagtgttggggtgtctgaccacaagaagttgaggggccctttcagcctctga

SEQ ID NO: 85594 - DNA, 213 bp, Glycine max
  Peptide Sequence Number=SeqID_202372
atgatgaaggaagtgatccacggtcacaactctgcagcgccttggctccacttttcctcttctccttcttcttctacatttttctctggtttaaggttgctgcaattcgacagtcattattcgagatacactgggtgcagtgggcagagaggttcaaagaacctaggagaattagcgagtggtgactacccgacatttggtgcactcatttag

SEQ ID NO: 85595 - DNA, 321 bp, Glycine max
  Peptide Sequence Number=SeqID_202373
atggggtgctataaagagcacaaggtcatttatgctacctacatgctaagtggggaagctgaagaatggttgaagtttgctagccagactttaccaagtgaggagggagtcaaagcttgggatgtgttcaagcatatagcaaatcctatctatatatctgcaaaatcattttcaggatctgataacttcttatcagacgactttgaaaaactcatgcttgtgagcaaggaagcatacccaagtatgtcttgtatagtcatcaactatgacaaagccatactttgttcctcccagaatcaatgttctagttggtctaaatag

SEQ ID NO: 85596 - DNA, 279 bp, Glycine max
  Peptide Sequence Number=SeqID_202374
atgtggcatacgcagattgtacactccatagacaagttggggttatggcatcgtttgcctgttttctttggactattatacttgggcattcgtcgtcaccttcaacaacaatacaacctcttcaacgttggaacaacaccagtaggaattaggttcaacccttctgattttccatacagaacagatgatggaaaatataatgaccctttcaacgaagttgctggcagccaagggtctttctttggcagaaatattctccctgtagatcataaaaacaag

SEQ ID NO: 85597 - DNA, 343 bp, Glycine max
  Peptide Sequence Number=SeqID_202375
ggagaatatttctgccaaagaaagacccttggctgccagcaacttcgttgaaagggtcattatattttccatcatctgttctgtatggaaaatcagaagggttgaacctaattcctactggtgttgttccaacgttgaagagggattgcacgatgaagagaaaagcgtctattattgtcatcctagccactgcttcatggaaatctttatggatgagttggtgtataactcttgctgcaagagctctaatgagatccgttactagagaccacatgatattgctctcttgtgagatcgatgacacaacagggctaattctggctagggctaagtttgatgaaat

SEQ ID NO: 85598 - DNA, 285 bp, Glycine max
  Peptide Sequence Number=SeqID_202376
atgtggacggaccgatttgctcttactttgaacaggagtcaagaacttccccgattgctagccaaggccaaagcagtggcggacacctactccgcccccgaggagatccacgaacttctcagctatttgcgaatcaagtcactcccgcattttatctctagcatgcattgtatgttggtctcgtcctttgtcacgggaagccggaaggtccatatcaccttcacatggggcactgcgcccccaaatgcgcaacttaaagtatgcccgagtcattcatccctatga

SEQ ID NO: 85599 - DNA, 348 bp, Glycine max
  Peptide Sequence Number=SeqID_202377
atgttaggatttacatgcgattctcctcaaatttcagccagcctgcatcagttagaccttgcaccttacgcttcagggccctaccatgctcaatggaacgccccggggcttctccatgacaagcacacgttgcgttcgagtcgtattctcagagaaatggaggttgatgaaccttggctggggttatggctaacattgaattatcaagtagatatgggagcaaggattgcctttgtggataactgggcggtgggtaaggacaaggaatggcagtcacagcatgggcttctccttcatcctcaacctctttcatttgcccccagtttctcattcgtccaagcaggatga

SEQ ID NO: 85600 - DNA, 223 bp, Glycine max
  Peptide Sequence Number=SeqID_202378
ggatttatcaaacaatagtttaagcgggtcagtacctgattttctgacacaactgcaatcacttaaagtcttaaacttggcgaaaaacaaccttactggtccagttcccggaggacttgttgaaagatcaaagcaaggttcactatcattgagtacaaaacacggccttagctgcaacagggagtctcctcctttggacaaacttcagcaatttaacacataa

SEQ ID NO: 85601 - DNA, 2670 bp, Glycine max
  Peptide Sequence Number=SeqID_202379
atgcagcaatataacaattggtatcaagagccaggttcttggagggatcttgcgatggggacatggtttgatgtggagaagttcacaggggaaaatgatttcagcctgtggaggatcaagatgcaagctcttcttgttcatcaagggcttgatgatgcactacaaggagcctctaagcttccatctacactgtcagacaaagaaaagaaagatttgctcagtaaagctcatagcacaatcattccttctcttggtgatgaggttcttcaagaggtagctgaggagaaatctgtagcaggaatttggctgaaacttgagagcctgtatatgaccaaatccctaactaacaagttgtacttgaagaaaagactacatcagctgaagatggaagaaggttcttctatcaaagaacatgtttctttgttcacaaaggtagttcttgatttgaaaagtgtagatgtgaggatagacgaggaagatcaagcagtaatgctattatgttctcttccatcatcctttgaaaatttggtggacactgtgctttttgggagagatacacttaccttggaggaggttaaagctaccctgaattctcgagaattaaagaaaaagataactgaaaataaaggtgaaggtggagatcctgaggcattgatggctagaggaagatcagaaaagagggattcaaagagcaaaaataagaggaggtccaaatccaggaacaagaaggcctgctactactacaagaaagagggtcatttcagaaaagaatgccctgaaaggaagaagaagaacaatgtggtggctgatggatatgaaagtgctgaagtgctctcaatctcaattgaaaagcacagtgaggaatggattctagactcgggttgctcattccatatgacacccaatctggaatggttcagctcctataaggagatagatggagggaaggttctcatgggaaacaatatggcatgtaatgtcattggcattggaactgttaaattgaagatgcaagatggatctgtaaagctgctccctgatgtgaggcatgttcctgagcttaaaaggaacctgctctctttgggaatgctagatcaatctggatgttcattcaaaggagaaggtggaactttaaaggtattcaaaggttcattacaagtaataaagggtacaaggcagaatggcctttacaaactacaaggtaacactatcttgaactcagggggcctagtttctatctctgaaccaaatgcttccaagctttggcattatagattaggtcatgtgagtgagaaagggctagaagaactacataaacaaggattgatcggtaatgggaattatcaaaagctaagtttttgtgaacattgtgtatatggaaaacaaaatagagttagtttccataatgcaactcacacaactcagggtatcctagattatgtgcactctgatgtttgggggccagccagggtaccttcattaggaggagcaaaatatttcataactttcattgatgattggtctaggaaagtctggacttgttcgttgaaacatgaaaatcaagcttttaagcatgtgaagctgttcagaactgataatggccttgaatacttaagtgaggaattcaatgaattttgcaaaaacaatggaataagaaggcacaaaactattagattgacccctcagcaaaatggccttgctgaaaggatgaacaggaccattttggagagggtgagatgcaaacttgaacctagagctaagaagggaatcttcttaggttatccggaaggagtgaagggatataaagtgtggttattggatcctgcaggtcccaaatctattatcaacagggatgtcttgcttggagaagaagacatgatagcagattatcaacagaagtctgattcagttcaaaagggtgttcaagctgagcaaaacaaacactctgatcaaggaattaggttggaggtggagaagcttgcacaaacatcaagtccagtagaggacagaaatgaagcatctcatgatgaacctatgatttcatcaattcttgaacttgttgatacttcatataacctggttagagacagacaaaaaaggcagattaaagctcctgtaagattgggttatgctgatctcatagcttatgctttgagtatagaaattgatgatcaaggcttagaaccaatttcttacaaagatgcaatttccagaatcgacagtgatcagtggagatcagcaatgcaagatgagtttgactctttaatgaagaatgatacttggaaacttgttgaaaagccagcaaagcagaaagttgtagggtgtaaatggattttcaaaaggaaaccagaagaaacaggaatggatagctacagatacaaagcaaggcttgtggctaggggtttcacacaaagagaaggaattgactataatgagattttttctccagttgtgaagcatacaagcatcagaatcatcttggcactagttgcagttcacaaccttgaattagagcaaatggatgtaaaaatagcttttttacatgggaatctagaagaaacaatctatatgagtcaacctgaaggatatgaggtaaaagggaaagaggagatgtgtcaaatggtttcagcagaagttcctatgacagttgtgtctacttcagaaggttga

SEQ ID NO: 85602 - DNA, 326 bp, Glycine max
  Peptide Sequence Number=SeqID_202380
agtatatagctctcactgaagttataaaggaagccatatggcttaaaggtcttgttcatgagctcgaaggaaagactggtcctgttgaagtatggtgtgatagtcaaagcgcaattgatctctctaaaaaccaagtttttcatgagaggacaaagaatattgacattaggatgcattacatccgagacatcatagcacaaggtgaagttaaagtgaggaaagtggctggagcaaacaatcctgcagacatgctgacaaaagtagttccatgttcaaagtttactcattgtttaaacttagtgaacattggaacttgtgacacttga

SEQ ID NO: 85603 - DNA, 330 bp, Glycine max
  Peptide Sequence Number=SeqID_202381
atggcggctgatgtggaacaggtttcgccattggcattggcgaaacacgtgaggtgttgtttcgctcctggcgatggcgaaaagcttgtgctaaaggctccctctccagtgcttcgttctgtattaatgacatcttcttcatcatgttcatcaaatataaaaattaaatcttgtccagttgatgatgaagttttatggatgcaagataagcatgtttcaaaacatatttggaatggggaagaagatagaaaattacacattagacgagttgtccctacgtatcaaggtcaagaagaaatatcaggcgaaattattcatctacttcggtaa

SEQ ID NO: 85604 - DNA, 724 bp, Glycine max
  Peptide Sequence Number=SeqID_202382
atgttgtgcgccaaaccaaagatcttctgctctttgttgatcgtagccccaaaacccgcaaaagaaaacgtgaggagaaggttcattaagaagggtcaccatacaaaccaaggtcagatttcaacacacccaaacccttgggaaggttctagaggtagggttagttttgtaatctgcacaagccttttgaagcccctgagcgtagcgagggttgtaggaggaggaagtgttgttggagaggttggtgacgaactcgaagcaatgagagaattcgatggtgtgggccccactgagggcgacgaattcttcgacggtgaagccgcatttggcgaagagttgggtgatttgggagatgggcatggagggggtggagaggtgggaggatacggcgaaggcgagggaggtctggccgttgcaacgaccgaggaagacgaggaagaaggggccgccgagcatggtcaggaggtcgcaggtggcgtcgaagaggatgttagagcaagagatggtgttggggcaggagagctcgagggcggccttggcacggatgatgaggtcaaaggtgtcgcttgggagggaatggttgatgttggcgttgcgctcaaccttggagaaggcgatggaggagagaaggatggaggcatcgcagtcattggggagaaggcagtcgtggaggaagaggcggagggtggcaatgactgtggtggggctcatgatctgcttgcgg

SEQ ID NO: 85605 - DNA, 660 bp, Glycine max
  Peptide Sequence Number=SeqID_202383
atgaaagaagagttaaaggagaccatcaaaattgagttatcccaaatgacatcgcatcaatcaccccccattgaggaaaatatccaagtatttggtgcatgtgtgagcataaaggggagttgtgctaaaactgttgtcaatccattaggggaagagcacgtcattgatgtcatgccaactataaggttgcatgttcaagatgatcattctacccgcctggtggccgtgggaaaagtatatgaaggggcgtccaccatacacaacatgccttatgtagatgatgtggtcaaggtgagtgttgcaaaagtttacgacgataacgctcaagtcccttttcccatgtcaaaggttcaatatgtgagacagacccttgacacattcattgcatggccgagacaacttgtgaaacatgtttcacgtgacaaatgtttgaacatatctatactacagttgtggatgatgtttatggatgagttgggtataaggccgggtcatggttccgtgtacagattccttaagcctcagttcatacacaatgcaaaggatacatatgatgaatgtgaaaattacaatgaaacatggatgaaggaatcacaaagagaggcctactgtttgcttctgacaagtgcaccagatcacgcaagtagtataaaacgataa

SEQ ID NO: 85606 - DNA, 606 bp, Glycine max
  Peptide Sequence Number=SeqID_202384
atgccttccataattgaagaacatgaagtggatgacgtacatgaaaatcataatgatcatgatgaaggtttatgggagtacattccaaccttgactctaagaaacttgcatcagcccgggccaatagttaatgtcaatcctgtcactgggggaggatcaagcccatataaagagaagttccatagctatttaggggtggtcactcgagaaaagattcctattgtccattctaattggaaagctatactgaaatctctaaataatctaatatgggatgacattttgggaaaatttgctatcccagaagcatccaatgccaagaagaagatgttgtcatcggtggccattatatggaggcaatttatgtcatccttgacgactatatacgtatatgcagacaatgagagtcaagataatcatattcctagtaaaaagtatggcctttatcctgaaacctgggaggaatttgctgcaagttgcaaaaccttgaattggcagataattagaaagaaggctcaggaaattaaaaaatacaatgactgtccacacttactgtctcatgggggttgtgatctgcttgaaaagaagctcatggatgagaaataa

SEQ ID NO: 85607 - DNA, 168 bp, Glycine max
  Peptide Sequence Number=SeqID_202385
atggttacccctgggatagctacaactttaaatctacaggcattggcagaggagatcaaggcaagatatgataaagcagttgtcaaagttgttgacctggtacgagagaaggttaagaatttaaagaaatttgacaaaaactttgtataccatgaaagaatcttataa

SEQ ID NO: 85608 - DNA, 970 bp, Glycine max
  Peptide Sequence Number=SeqID_202386
atgacaccgatcaatccaataaggctcacagaactagtcaatctagtgccaaaaccaacaagaagaagactaagaagaagcagaagcagaatcccaataacgtctgaggatccgaggaagcaaaaccctaaggcatttgccttttcttcctccaacaaagccaagtgcttgcaatcacgcgccgtcgagaaagagcagcgccgcctccacgctcccatcatcgaccgctcctacggcgggcctactccctacgtcgttgtcgtgcagggccctcctcaggttgggaagtcactgttgataaagtctttggttaagcattacacgaagcataattttcccgatggaagcaaaggcgggtgcagtttgcagtttgtggaatgtccgaatgatatcaatggcatgatagatgccgcgaagtttgccgatctaacacttcttcttatcgatggaagttatggtttcgaaatggatgctatttttgagattttacttcacttgaaggaaacctttgagttccttaacatattgcaagttcatgggttcccgagggtcatgaatgacaaaatagaagctttggataaatatcagcctgggactggttctgatgaagatgaagatgcactaaatagtactgctaagaatggagtccacttgcaagaacatattgattttcatgatggaagatggaggagaagagcaatatttggaaatgattgtgtagattcagaaggggatgaggatggtgctaccagtgatgatgatatagaatcttcagaagaagaggaggaagatggcaatgataatcatgacacaaatggtgtgagcttttttgtacgtgtggtggcaatggaagaagctgtgttggtgttggcttttgtgggcaagttgagaaggcaccttctgctgcttgttgtggcaatggtgcttgtgctattagtctcttcatttgcttcacctctcagcgatgaag

SEQ ID NO: 85609 - DNA, 303 bp, Glycine max
  Peptide Sequence Number=SeqID_202387
atgcaaactaggtcaaagtctggaattgttcagcctagaattcatcctactcttcttcttgctcatatggaaactaagtctactaagcaagccttgactgacctcatatggttagctgccatgaaagctgagtatgatgccctcatcaacaacagtacttggactcttgtttctctgcctcctaacagagttcccattggttgtaaatgggttttcagaattaaagagaatcttgatggtacagtcagtaaatacaaagccagattagtggccaaaggattccatcagcagtatggaaactga

SEQ ID NO: 85610 - DNA, 354 bp, Glycine max
  Peptide Sequence Number=SeqID_202388
atgaaatcactttttgaagagtactatgttgtgatgaatgagtttgaagctaactcacaagaagctcatcttaatgaagaaggtagtgatgatccttatggtttcaaccaatttttccaaacaaccgaatctagcaaaactaaactaaatatttacttagatgaagctttagaatcgggtcaagaagatttggatgttttgagttggtggaaactaaacttgggtcgatttccaattctaccaaacatgacaagagatttgcttgctatacccatctctatcgtagcctctgaatctacctttagtactggaggaatagttatcgatccacatcgtagttctctcacaccatga

SEQ ID NO: 85611 - DNA, 402 bp, Glycine max
  Peptide Sequence Number=SeqID_202389
atgggcccgaaatctaccctaaggctcatgagaaccctagggccttctcttgcatctctagcccaatcttattggagtcttctatccaatgcccttggggataggattgcatcagatgggttggaagataaaatggattttgtttgtaaaattcgtgtagtgatcaaatatgtaagatcttctctttctcaattggctaacttcaagaaatatgttataaagcaaaatattgattttaaaggtcttgtttgcttagatgtggaaaccagatggagtttcacctacttaatgttggatgctacgttgaaccaccaaaaggcatttgaagagtttctaatggaagaaatgaaatatgcatatgagttacgaaatgagggtggtgttcctatatctgaagattag

SEQ ID NO: 85612 - DNA, 1089 bp, Glycine max
  Peptide Sequence Number=SeqID_202390
atgcagattttgttgctgggagtgaagattctaatgcctattcagcaaattctctctttctcatatgaaatccttcaagtacgctggtgtggttctattcctcttaggcctgttccttactgtttgtaccccctgtctgttagtctttgtgttgcatccctgattgctatcactccatgtcgcttgcggaaacaccttgtcctcaaggtggtagttagcacggagttggtcccaatcctcccaagaagtatcgtcagggcacagaccatcccattggaccaagacctcccattttggtgtagaagagtccgacaagcatttggaatccacaatggccagaggagtaataagaggttgattatctatggcggtggccgacagagtgattgcgatgtgaaaataagcacttgctccctgtctccggattataggacaaagctagggtggggtgggtcgggtgggcgctctaattggataaggtcaccgaaggttgcgtcttcttcattagctattaagaggaacataagagaggcacatttagacaccgatgttggggttgtcgcgaggcctggaagcaatggggtcgcaattgccgacaagggccgcgggggcggcacgacaaggtccgataatacggttcgcaagatctttaaacttcgaaaggtaatttgtgactgtggaccgctgtgtaagcttgaaatgggcaccggtggggtcctcgtattgcgacggggcaaaccatatctgcaacacttgaaggaatcctggccaggaggtgaactaaccattactggtcatccactgaaaccaggccaaggcacgcccctccatgtagaaggaggcgatggtcagcctatcgtgctcgagcgtagcatggtattcgaagaactggttgatcttaaagatccaaccaaggggttcggtaccatcaaaccgtgggacatcaagtttcaagcggtgagggttcgaggtggaacacaggtggagtggtattggacgaggaaggtgagggagaggaagtctcagtttggttatggcatcttccaatctatcggaagaagctttggacctagtggattccgccattga

SEQ ID NO: 85613 - DNA, 1023 bp, Glycine max
  Peptide Sequence Number=SeqID_202391
atgtcatgctctctaacaaagttccaggtatacctacgcaggaaccgtgagggagaaatggatcctaaaggtgatatatgggctgccccatatcgatggggctgcatggtaatagcatacaagacaaataaattccaaaagcataaattggctccggtagaggactgggcagatctgtggcggcccgatcttgcagggaggatttcaatggttgattctccccgagaagttattggagcagttttgaagtatatgggggcttcctacaatacaaatgacatcaacatggaagttaatggtgggagagatgctgttaaacataatttggctttgcttgcaaaacaggttcgactgtttgatagttcaaactatttaaaagcttttggagttggagacgtgtgggtagctgttggatggagtagtgatattattcctgctgctaagcgcatgtctaatgtcgctgttgttgttccaaagtccggagcgagtttatgggcagatctttgggtattactcttactgttgagtgttatcttgctttttaaggcaattcctgctgcctctaggattcaaacaaatcggattggtggacgcatcaggggaccatcaccattaatccatcaatggatagagttttgtctgcaatctgcaagagcactcccttttaagcaggaggtgatcccaggtgcctctccctctcatcttcaaggtcattcggccaatgtgcccgtggagttaaccaagggtgggccgaggctaaatggcaacctagttgatggagcacctccaccagacatcttagaaaagtgtgagtttctagagccattatctaattcaacattgtcagattaccactggttgcttacctctatccaggaacctggccatggattgatacacaaaattttaacacttgtgaaggtccattttctgtattacaaggttaagagaagaggctgcgttcaagccacaacaatgcgatctgcatgtaagctgtgttggttctgccctccgtatggctaa

SEQ ID NO: 85614 - DNA, 210 bp, Glycine max
  Peptide Sequence Number=SeqID_202392
atgggatgctacagagatggtgatgtagctccatatgaagcttgtaggctgctagcagttggtgtctcgctaaccaaggcttgtgcgcttagcgagaatcatgcgctaagcgaggcactcagcccgcttagagagttgggagaatctgagaagcatctacgcgctcatcatcagctcactcagcaaagcgtttgtctcttcccacgctaa

SEQ ID NO: 85615 - DNA, 318 bp, Glycine max
  Peptide Sequence Number=SeqID_202393
atggtgccggtcaaaagctatcattgtgggagttggttagaaatgggtccaagtttaattgactttgcgatgaccgaggggtctagtgaccttttggcatttttgagccaattgttggaaaatgtgggcgagaacattgcaactctagtggtggtcaccattgttgagacagggacttcccaagaagttgcatgttggcctaagaagcactcagtgctcaaggagaaacactcgcctcctccgatcatacttctggggttcatgtggattgacagagaagtaggtacttctcctgatacaaccccgagtcagacctag

SEQ ID NO: 85616 - DNA, 540 bp, Glycine max
  Peptide Sequence Number=SeqID_202394
atgcatacctattcccaaacatcgcccatcttgtcgaaactagatactagcaagaagctgattttctatctttcagtctcagataaggccataaaggcagtattggtacaagaagagagaagtgagttgaggccaatgtatttcgtaagtcgggtgctacaggatccagaaatgaggtaccggttgatggaaaaggtagcatttgcacttgttaatactactttccatctccgtcaatattttcagtgccctaaaatcactacttggactaattgtcacatagccaaaatactacacaagcccaaattgctaggacaaatgatgggatggtcaatcaaactttcaaagtatgaaattgcctatgaattgagaggtactattcgggcacatgagctacccgatttcaacaacgagttgcatcctttactgccacaattcaagcatgaatggtggacaatgcatgtggatggctcctctaactggcatgggagtggaactagtgttatcctggaaggacccaacgacgtgaccatggcataa

SEQ ID NO: 85617 - DNA, 423 bp, Glycine max
  Peptide Sequence Number=SeqID_202395
atggacaataaagaattaaagaaacaattaagtgttgttgttgatgggaagcatgaaagagaccaaagctttttagtttattggcaaggactcgttggtttattgtttatgggaatgccttggaacaagtcacaaaaaaattctttggttgttagcattctaagaaagcaaaacccacaagaaaagggaggtttaccaatttgcaacactaacattggctacaaaagttacggcactagagagagagtcttgagcaatgccgatggtggctatagaagcggtgacaccagagacagagccttaagcaatgttgatggtggctacagaagtgatgacaccaaagagatagccttgagtgatgcagacattggctacaggaagggcaatgccagagagaaagagtccttgaaccttgagacttga

SEQ ID NO: 85618 - DNA, 1086 bp, Glycine max
  Peptide Sequence Number=SeqID_202396
gggactgaggccataagaagcataagggcagacttcaaatataatcaagatggatttcctcttcttccttgcggccttcaatctttcccagttgagctaagatatcttgcttggatgcattaccctctgaaatccttgccagagaatttttctgtggaaaacctgaatttggtgaatttaaaagaagttaaagtctctggttctgaaaacttgaaggagctgccagacctttcagaagccacaaatcttgaagtgctggatatcaatttttgtcctcagttgactagtgtgactccatctattttctctctcaacaggcttgagagattgtctgtagcttattgttcccttacaaaaattaccagcaagaaccacctaagctcccttagatatctcaaccttgagtcatgcaaaaagctaagggaattttcagtggcatcagagaatatgattgaactagatttatcatccacttgtgtcaatgcatttacctcatcttttggatattgcacagcattgaagactgtattgtttccatcagttgctcaacaactcaacgaaaacagaaaagaagttctgttttggaattgcttgaaattggatgaagattctctcaaggctgttaaactaaatgcacatattaatttgaggaaatttgcataccaacatttatctgcaccagatgaaaattttgatgattatgatcgtacttatggatctgatcagctttgttatatccggtcctatggtgaaggcaataattggttattagacttacattctatatcactatccaaaaaccagaaaaggtttaaaatcaaggttgaagcaatggaagcagcagtggcttgtcagagggacgtggggttaaaagggttgggagtcagcctaataaacacctcagcatatcacagtttcaggaaacacataaacaccacaaagcatcgcaatttcgttcaagaaatgagcacctcagcagatcacagtttcattcaacgaataaaaacctcagcagatcaccagcttcattcagcaaacaaaatcctcagcagatcacagcttcattccacaaatggaagtatctga

SEQ ID NO: 85619 - DNA, 285 bp, Glycine max
  Peptide Sequence Number=SeqID_202397
atggcttcagctagtttcctgaacaaccctagtgcggcgcacgggagagaacgctctggtactgccgcacctgattccagcccacaagacgctgccggagtgcatgcattccttccacgtggtgtgcatagatacgtggctctattcccattccaactgtcccgtttgccggactcacgccacgccttcgccggcggtggagcgccggttgccggagttgaatgcgcaacacaccatagatatcatgcaagtagctcgcgttcaaaatgggtcagcccgacttga

SEQ ID NO: 85620 - DNA, 327 bp, Glycine max
  Peptide Sequence Number=SeqID_202398
atgactcttcacttaaccattgaacctaaaaatattgatgaagccctaagtgaagactattgggtgattgctatggaagaagaaccaagccagttcactaagaacaagttgctcatgggtacaatcaacaaagaagggattgactttgatgaaacctttgcaccagtagcaagacttgaagctgtcagaatactcttagcctatgcagcacacaaagacattaaactatatcagatggatgtcaagagtgcatttataaatggattcataaatgaagaggtttatgtgaagcagccacctagatttgaagataaggagaaaccttag

SEQ ID NO: 85621 - DNA, 549 bp, Glycine max
  Peptide Sequence Number=SeqID_202399
atgggtgagctaaagttcttcctagggcttctaataatccagaaagatgatgaggatgagaaaggtaatgattctccaaaaagggagtacaaagcccctgctttgtttaaagataagaagcttcaacagaagtttgatgctagttgggtcagcaagaaagtggtcaaaggaaggtttcctaaagatagctcaaggctttatgaagattggcttgagaccatgggactcagaaaaacaaaggcaactaaatccatcaaatccacttctggtgtttcttatggaatgctaatgactctggtgttcaaacattttgaagtctctctagatggatctgaacaaggagaaaacaatgaagaagaagagagtcaaaagggtgattcttataaagatgatgaccaaaatgaaggtatccatccttctaagggtgtggaggttgaagatgttctaaacctagtggttcctaaactgacccaagatgatctcaatgtggagaccatagatgatatttttgccaaactaaggactactaacttaagtttgaagaaatga

SEQ ID NO: 85622 - DNA, 207 bp, Glycine max
  Peptide Sequence Number=SeqID_202400
atggagatgagaccatggacggagacgcgagatgcgaccatggccggagatgagaccaagtccttcattgttgacactagtgaaggtgacgtattgcggtggtggccagaggtgttgacgccagcaaaggtcacacgagacgaatgggccatggcggagaggaagaagataaataggaggaaagggggaagcttctggaggtgttga

SEQ ID NO: 85623 - DNA, 546 bp, Glycine max
  Peptide Sequence Number=SeqID_202401
atgaggaattggaagacaacaccactaggcgtagccaaagaagaagagtggtacatcgtaatcgtgaagaaggtcatgatcgattgttcaatgactatttttcaaaaaaaacttgtgtacagagagcttcaattccggagaaggtttcgtatgcaaaggcatgtgtttctccgaattgtaaacgcattcaacaaccatgatgaatactttcaaataagggtcgatgcactacgtcgaaaaggcttatctccattgcagaagtgcacaactgctattcgtatattggcttatggatcacatgcagacaatgtggatgaatacgttcgaattggtgaaacaactgcagtggaatgcttggagcgatttgtattaggcatttgcaccatatttgggaatgagtatttgaggagaccaaataatgaagacatcgaacgcctactacaaatgggagtggcacgcggatttccaggtatgctaggttccattgactgtatgcactgggaatggaaaaattgtctagttgcttggaaaggtcaattttgttga

SEQ ID NO: 85624 - DNA, 294 bp, Glycine max
  Peptide Sequence Number=SeqID_202402
atgtttagggttactggtgaagctactaaggccaaggagactctcacaaatctcttaaggatgcaaatactaagatacaaaaggatgaaagttgaacatctcaaccaggagtttgagcttctcaaggttaatgctaccaaaaccagggagaagctgaaggccaagatcataagaactcatgaggtcgacttcaagaaggagattcgtcaggtcaaacactttttcaaggatgctgacttttccttcttcgatatcaacaaggactcaattgttaaggagagttggttgacgtag

SEQ ID NO: 85625 - DNA, 207 bp, Glycine max
  Peptide Sequence Number=SeqID_202403
atgaagcttgcctatgagataaacctcctcgtgaagcattggagggaggcacattgtgaggttcctggcatctcagggggtgtagtcttaaattccattgttgaagaggagatcagaaaagattttgaggtccttctaattcattggaaggaagcacttcataaggctgctagcatcttgaggtttgtagtcctaaatccaacttaa

SEQ ID NO: 85626 - DNA, 546 bp, Glycine max
  Peptide Sequence Number=SeqID_202404
atggagtgtcacagaacaacagggcaagtggtagtgccagtgttctatgatgtagatccctctgaagtacgtcatcaaacaggccactttggaaaagcatttcgaaaccttgagaacagacttttaaaagtggtagaggaaaaggaagaggaaaagctacaacgatggtggaagacgcttgctgaggccgctggcatctcagggctttctgtaataaaaacacttccagctttctctggtcaaagtgagattttggataagatagatctcctcgtggagcattggagggagacactttgtgaggctgctggcatcttggggagaggaatgttgattgctgaaaagttaatagatctcctagtgaagcattggagggaaacactgtgtgaggcactttgtgaggctgttagtttctcagatggtgcatacttatattccagagaatttgagatcggttttaaaatagaactgcttgtggagcattggagtgaggcaatttgccaggcggttggcatctcggggggtgcacacctaaattccaagtaa

SEQ ID NO: 85627 - DNA, 534 bp, Glycine max
  Peptide Sequence Number=SeqID_202405
atgccgtgcctcaacctcagcaccaacgtgtccctcgaaggcgtcgacacctcttccatcctcgccgaagccacctcctccgtcgccagcataatcggcaaacccgaagcctatgtgatgattgtactgaaaggatcagtacccatagcttttggtgggaatgagcagccagcagcttatggagaattggtttccattggtggtcttaaccctagtgtaaacaaggaacttagtgctgcaattgcttcaattctggaaaccaaattgtcagtgccgaagtcgcggttcttcttgaaattctatgacaccaaggcaacaaccttccttatagagatatacggtgtaatgtttttcaaacaattaagggggttaatggttccaacttcggatggaatggatctacattctgaaatccgaattccatgttacattggttgtggtaccttgaatgttggatggagtgttcattatgtttcacccgtgtttatgtctatgtttgtatcattatataagtacactcgggatttctggtag

SEQ ID NO: 85628 - DNA, 1671 bp, Glycine max
  Peptide Sequence Number=SeqID_202406
atgggtagtaattgtcttaccacatgttgtacggggaatttcttcaagaaaaagaaatctctccccattgataccatattcaagcttcctgttcctgttgcaaattcttcttggcctcaaggtggtaattttgctagtggaataatcgatctgggtgggctacaagtgtctcaaatatcaacattcaacaaagtatggggcacctatggcggcggaccggacaatcaaggcttcaccatgtttgaagcatcaggaattcctcaaggtttctttatgttaggtagctactgccaacccaacaacaagcctctttttggatgggttcttgtggcaaaagatgtgtctaaaagcacaagcaaccccactttaaagcaaccaatcgattacacgcttgtatggaacagtgcatcaatgaagatcaaccaagatggtcccatctatgtttggctaccaacagcacctgatgggtacaaagctttaggccatgttgtcaccaccacaccaaataagccttcttttgacaaaatcaggtgtgtgaggttagacctcactgaccaatgtgagacaagtttattgatttgggaatcaggcagcttcaatgtttatgacgttagaccaagcaatagggggattcaagctcctggtgttagagtaggcacatttgttgctcaaaatggtagcaccgaacctccatctattgcttgtttgaaaaacaacaccaatgctatcccaaaatacatgcctaacctacaacaaatcaaggcaataatgcaagtttactctccaactatgtgcttgcaccctgatgaagaatacttgccatcttctgtggattggtttttctccaatggagcactactttacaagaaagggcaagagtcaaatcctgtttcaattgcaccaaatggcacaaacctgcctcaggatcataacaatgatggtgcctattggctggacctgccttctgatgcagccaacaaagagagggtcaagaaaggagacttgcaaagtgccaaaagctatgtgcatgtgaagccaatgcttggaggaactttcactgacattgcaatgtgggtcttctacccattcaatggaccttcaagagcaaaagttgagttcattaatgttaaattagggaagataggtgaacatgttggtgactgggagcatgtgacactaagggtaagcaacttcaacggcgaactatggcaggtctatttctcacaacacagcaagggtgcatgggttgattcctctcagattgagttccaaagtggtggtggcaacaaaccattatactattcttccttgcatggccatgcatcatacccacatgctggccttaatctgcaagggacagataacataggcataaggaatgacactgccaaaggtgacaaaatgatggatatgggagcatttgaattggtttctgctgagtatttgggttatgcagttatagagcctccttggctgaactatttcagggaatggggtcctaaaattgattatagcatagatgttgagttgaagaagattgagaagttcttgcctaagaatctaaaagatgctttggagaagattatgaggagtttgccaagtgaggtgctgggagaggaaggacccacaggtccaaaagtcaagaataattggattggagatgaagtttaa

SEQ ID NO: 85629 - DNA, 423 bp, Glycine max
  Peptide Sequence Number=SeqID_202407
atggcgtttaattttcagactttgttcactgcactcatagtaattgccatggttttagctggttttgtggttgcaacatactgcatctggagcaaggtcttgcacaccgagaaaaatagtatcacagcctaccaaaaggcattagcaaaagctacaagcacagaaatcaagtataagaagaagcatgaagacgtagctgaaggtcataaagatagcacttgccaatgttttaaaaaccagtccacggccgtgaattcgggcgcaaaactaagattttcaggattctcacgtccacaatgcaaccccaattttagccgcattaaccgtattaatccgcaatttcccacaacatcaaaaatcatgacgaaaccacaaccgcgaccgcaatttacaaccttgacacctgtgcctgggagactttga

SEQ ID NO: 85630 - DNA, 372 bp, Glycine max
  Peptide Sequence Number=SeqID_202408
atgcataaaccgaaagaggcactagactttgctctcaaggagacttcatccaacataagtgcaagtgttgtaatgagggacaaactttcctgtacctatgacctggttgaacaaatgcactacctctatgctagagtggtgaaagccaaggatttgctatggaaagatgttactggtggtgtggatccctatgttgaagtgaagcttggaaactacaagggccttaccaatcactttgagaaaaagtccaatcctcagtggaatcaggttttttgccttctccaaaggattcaagcttctgttctggaggtggtgatcaaagacaatgatgctattgtggaagattttgtagggagagtgatgtttgattaa

SEQ ID NO: 85631 - DNA, 2020 bp, Glycine max
  Peptide Sequence Number=SeqID_202409
atgtcttctgaaaattttgttcaaccagccattccacgtttagatggtcactatgatcattggagcatgttgatggagaatctcttgcgatccaaggagttctggcaggttgttgcagatggtgtggcaacaccaagtgatggcgtagttcttacagatgcacaacaaaaagaatatgaagtgatgaaattgaaagacttaaaagccaaaaattatttgtttctagccattgatcgttctatccttgaaacaattctttgcaaagatacttccaaggaaatttgggattcaatggagaaaaaatatcaaggctcctcacgagtgaaacgtgctcaaattcaagcgttgagaagagactttgaagtccttcaaatgaaagaaggtgaattagtaactgattattgttcaagaaccatgggtattgctaagccattgcttctaccaatactcattccaacaactctagaggaaggggtagaggtagaggtagaggaagaggacgtggagattgaggaaatagagatttcagcaataattctaaagataacaatgatcaatttcaaggcaatggtagaggaagagatcatgataaatcaaaggtacaatgctatggatgagaaagaagtggaaaccttattgatggctgttaaagatgcaaaagacagtgaggcagaaatctggtatgtagacactggttgtagtaatcacacgagtggaagtgatattaagatgaaaaccaggaatggttttgtagaaacaatttctaatgtgctctatgtccctaacttgaaaaacaacttgttaagtgctggtcaattgcaagaaaaagataatgaagatgaagagttgcagacaagggagctagaagaacaacaaattccaacaatcacagttgaagatgaaagacttcaacgagcaagaagaaggcctgcatggatgtctgattatgaagtaacagaaattgaagatccgattactcattttgctttgttttcagattgtgaccctacgacctttgaaagtgttgtcaaagaagaaaaatggagaaaagcgatggatgatgaaattgattccattgaaagaaataatacttgggagttgtgtgatcttccaaatggacataataccataggagtgaaatgggttttcaaaacaaaattgaaaagaaatggtgaagtggataaatataaggcatgcttggtggccaagggttacaagcaacagcatggggttgattacacgaaagtgttttcaccagttggaagacatgatacaatcaggttagtagttgcactagcagcacaaaatgtgtggcctatatttcaacttgatgtaaagtcagcattcttacatggttatttggaggaacaagtatttattgatcaaccccctgcttatgtgaaaattggaaatgagcacaaagtttacaaattaaaaaaggctctttatggactaaaacaagcccctcgagcttgctatagtcgcattgagtcttatttcataaaagttggttttacaaaatgcccctatgagcattcattgtttattaaatttgatgaaaaaggaaaaatgctcatagtatgcttatatgttgatgatcttatatttactggatgttgttctctcatgtttgatgaattcaagaagtttatgatgaatgagtttgaaatgactgattttggcatgatgcattactttctgggtatagaaatagtgcaatcagatgttggaatttttctttctcaaaagaaatatgtgagagatattttggacagatttcatatgcatgattgcaattctgtaaacactccagttgagtgtggtttgaagtttcacaaagatcctaaaggaaagaaaataaacagtacactttataaacagattgtggaaagcttaatgtatctaaccgcaactaggcctgatataatgtattctataaatttgattatcagaggtgaaaagtttaatctattgggattcactgatagtgattatgctgaagattcagatgatagaaaaa

SEQ ID NO: 85632 - DNA, 120 bp, Glycine max
  Peptide Sequence Number=SeqID_202410
atggcttcatcatcagccaatgtgattgtgtattatgatggcttcatcataacaactaaacatggttcaacgtttgctattggaaacaacattaaagtctaccaaatggtcaagtggtga

SEQ ID NO: 85633 - DNA, 727 bp, Glycine max
  Peptide Sequence Number=SeqID_202411
atggctgaggcagttggtggtgcattcctctctgctttccttgatgttgtgttcgacaagctgtctacagatgaggttgttgacttcatccgtggaaagaagcttgacctcaatttgcttgagaacttgaagaccactctgagagtggttggagctgtgcttgatgatgctgagaagaaacaaatccaactctccagtgtcaaccagtggctcatcgaactcaaagatgctctctatgatgccgatgacttgctggatgaaatttctaccaaatctgcaactcaaaagaaggtatgtaaagtgctttctcgctttactgataggaaaatggccagtaagttggaaaaaatagttgacaaattagataaagttttaggaggcatgaagggtcttcctttgcaagtgatggcaggggagatgaacgagtcatggaatactcagccaacgacatcactggaagatggatatggcatgtatggtagggatacagacaaggagggcataatgaagttgttgttgtcagatgatagcagtgatggtgtactagtgtctgtgatcgctattgtaggcatgggtggggttggaaaaaccactttagcccgatctgtgttcaacaatgacaatttgaagcagatgtttgatttaaatgcatgggtttgtgtttctgatcaatttgatattgttaaggtcacaaaaactatgatagagcaaatcacgcaagagtcat

SEQ ID NO: 85634 - DNA, 390 bp, Glycine max
  Peptide Sequence Number=SeqID_202412
accgggaaaaatagaccggactataccctggtccctcgggtccaatgggtgcacctgactgtccccagttcagttggaacagaaatcaccaacattcataggtggggagctggactgaggtctccctatttgactatgaaaggagatcccttccccccgctttcaaaaatgatgaagatgaagtccgcggggctgcagatggccgtctcctgtccccctgccggtggggaatccgctcccgggtcgtcgcttgcgtcttatggcccgtcctctaggcaccttttgaaggcagggagtgtgacaacggtttggtggcccgaaattgacttggcttcgccaaaaggcctcatctctagaagcccggctcgcgaggcgtacctctcgcagtag

SEQ ID NO: 85635 - DNA, 1821 bp, Glycine max
  Peptide Sequence Number=SeqID_202413
atgcctagaggaatgggaatgttaagtcatttgcagcatttggatttctttattgtgggcaagcataaagagaacggaatcaaagaactggggacactttcaaatcttcatggttcgctttctattaggaatttggagaatgtaaccagaagcaatgaagcattggaggctaggatgctggataagaaacacattagtcatttatccttggaatggtctaatgacaccgacttccaaactgaattagatgtactgtgcaaattaaaacctcaccatggcctggaatatctaacaatagagggttataatggaaccatatttccagattgggtgggaaatttttcctaccacaacttgagaattctaggtttacgtgattgtaataactgttgtgtgcttccttcgcttgggcaactaccatctcttaagcagctctatatttcaagattgaagtcagtgaagactgttgatgcagggttttacaaaaatgaagattgtccttctgtgacacccttttcttcccttgaatttctatccattgatgagatgtgttgctgggagttgtggagtatccctgagtcagacgcctttcctctactcaagtctcttaaaatagtggattgccccaaactaaggggagatttgccaaatcaccttcctgctctggaaacacttatgattagaaattgcgagcttcttgtctcttctctcccaagggctcccatccttaagagattagagatacataaaagcaataatgtatcgttgcatgtgtttcctcttttgttggaatcgatagaagtagaaggaagcccaatggtggagtccatgatcgaggccatctccagcatcgagccaacttgcctccaacgtttaacattgatggattgctcgtcagccatatcttttccgggtggtcgtctacctgcatctgtgaaggatctgtgtatcaacaatcttaaaaatctggaattcccaacccaacacaagcacgagttactggaatcactggtcctagataatagttgtgattctctcacgtctcttccattggttacctttgcaaatctcaaaagtctcaaaatcgataactgtgaacatatggaatctcttttggtttcaggggcagagtcatttaagagtctgtgttctttgagaattttccgatgccccaactttgtatcattctggagagaaggattgcctgcgcccaatttgactcgaattgaagttttaaattgcgacaagttgaagtcattacctgacaaaatgagtagtcttctcccaaagttagaatatctccaaatatccaactgcccagaaattgagtcgtttccagaagggggtatgccacctaacctgagaacagtttcgattgggaattgtgagaaactaatgagcggcctagcatggccatccatgggcatgcttacccgtctcactgttgcgggtcgatgtgatggcatcaagtccttccctaaggagggtttgctgcctccctcccttacgtctttggagttatatgagttgtcaaatctggagatgttggactgcacggggcttctccatctcacatccctgcaaaaattatccatatggagatgtcctttgctggagaatatggctggagaaaggcttcctaaagctcatatttatgcgtgtaaagctgatcttccagggcaaaaggaggaggaagcgagggcgcagtcagctgatggcaaagtgtttaagattgttccatggcaccatctggagcatagcaccagcaactccctgagcatacaggccttaagccatgacttgactggttcagataggtaa

SEQ ID NO: 85636 - DNA, 264 bp, Glycine max
  Peptide Sequence Number=SeqID_202414
atgcaaagtctagctggcataagtgaccatgcgctaagctgccaaatgctcgttaagccaccaaatgcgtgtgggctaagctcagatgcgagctacagttggtctccaggttggcttcttgcgctaagcggatttcttgggctaagcgatcctaatgtgttaagcgaggatgtcgcattgagcgtcacacttcaattcttcaatcctcttccatacctctgttttatatctacaaaaaatacaaccaaaattactataaaataa

SEQ ID NO: 85637 - DNA, 420 bp, Glycine max
  Peptide Sequence Number=SeqID_202415
atgggctccacaagcagatctcgacatttaccttcgcctccatgtagatcttggcgtactaagcttcttcggcgtgttgtcgaagttgttgcacaccgtgaccacaatgctcacgatctagttgacgatgcggatgcacttgaacacgttcgtggaattgtcatggttgacaacagtgatgttgagcatgtagatatgtttcatgtgctagtggatctccacattgacaatgatatggtcgctcaatgccgcaaaggggtcattgtcgatagactccatggtgtaggcgtcgtcgggcgtgcagtgcttgttgacttgaaccaattttggtgcaagaagcgattgcctcaattgagtctaaagagtatgtgtgaagattgtgattctccaagctcaacatcggacgtttggaaattgtga

SEQ ID NO: 85638 - DNA, 342 bp, Glycine max
  Peptide Sequence Number=SeqID_202416
atgaatgtcgagatatgcttgcacatggagcttgggttggagctagttcgaatcgggcaagttgagttggattgtgttgtttgttggaatcgcgaaaaagccatcgaagctaacgatttaggcgcatgtccccatgccaacaaaggtggggacatcgtcgtcaataaccccctcattattgtgcgcaccattaccaccatggcgccaaccaccctacctcgtctcctccgtgtcatggtgccacctgaacaattgagtcccatcaccatgcgcacctttgcatcctcaactccccgatgccacaagattcgtgtgtggcctcaactcccctgcaataactag

SEQ ID NO: 85639 - DNA, 171 bp, Glycine max
  Peptide Sequence Number=SeqID_202417
atgaagaacattgcaaagcacttcaacagcaatggaagcctcagacaaccgtcgcgaaagaagggcgatgcggtagtcgatatggttggtgacgcggtggcggacaatgggcggctcggtggtggaaagcgggcagcaaagtggcttgaggcacatgcacatgggttctag

SEQ ID NO: 85640 - DNA, 552 bp, Glycine max
  Peptide Sequence Number=SeqID_202418
atgacagcagaactagcaatgtttacaattgataaaacttcaggatcaatcaggagatctgaaataatgttttctgaatgtactagtggttacttggcaccagagtatgcaatgggtggccagttaaccatgaaggctgatgtatacagttttggggttcttatacttgaaataatcagtggcaaaagcagtgcaaggacaaactggggagggtccaacaaatttctattggaatgggcttggcaactgtatgaagaggggaaactgttggagcttgtggatccagacatggttgaattccccgagaaagaggtaataaggtacatgaaggttgcatttttctgcacacaagcagcagcaagtagaaggccaatgatgtcccaggttgtggatatgctgtccaagaacatgaggctgaatgaaaagcaactaacagcaccagggttgttccaggattcaggagcttcctctcaaaagaagtcatcctttgaatccactggctatcaatttagctctaacccttccagtattactcagttggccccacggtga

SEQ ID NO: 85641 - DNA, 3198 bp, Glycine max
  Peptide Sequence Number=SeqID_202419
atgatgcacctcaagaacctccaaagcaagacccttttcttcgttttctcaccctccagaaccttccaccgccctcactacaaccccatcagaagattctcctcccccatccacaaagattcgattttgatccctcccacgaagacccttctctacgcttccttcttctgcgcccttattcgcctctacttggcctgtggcaggttctacattgcctccgacactttctctcgcatgcgtgccctctccctcgttccctccttgcccctctggaacgaccttttgtacgaattcaatgcctctggcttcgtttcgcaggtaaaagtgctgtattctgagatggtcctttgtggggttgtgcctaatgttttcagtgttaatttgttggttcattcgttgtgcaaagttggggacctgggcttggctttagggtatctcaggaacagtgtttttgatcatgttacttacaatactgttgtttggggattctgtaagcgtggattggctgatcagggttttgggttgttgtctgaaatggttaagaagggtgtgtgttttgattcagttacttgtaatattcttgttaaggggtattgccaaattggattggttcaatatgctgagtggattatgggcaacttggttggtgggggtgttccactagatgctataggtttgaacaccttggttgatgggtattgtgaagtgggtttggtgagccgtgcgttggatttggtggaggatggttggaagaatggtgtcaagcctgatattgttacttataatactttggttaatgctttttgtaagaggggtgatcttgcgaaggcagagtctgttgtcaatgagattttgggatttcggagggatgatgaatctggtgtgttgaatgattgtggtgttgaaacttgggatgggttaagggatttgcagccaactgttgttacgtggacaacattaattgctgcatactgtaagcatcgaggaattgatgatttcttttctctttatgagcaaatgattatgagtggagtcatgcctgatgtggttacttgtagttctattctttatggactttgcaggcatggtaaattaactgaagcggcaatgttgctgagagagatgtataatatgggtttagatcctaatcatgtctcatacactacaattattagtgctctattaaaatcagggagggtaatggaagcttttaatcatcaaagccaaatggttgttcggggcatttctatcgatctagttttgtgtacgactatgatggatggacttttcaaagctgggaaatctaaagaggctgaggaaatgttccaaactattttaaagctcaatcttgtcccaaactgtgtcacttatacggcattgcttgatggtcattgtaaggtaggagacgtggagtttgcagagacagtgttacaaaaaatggagaaggaacatgttcttccaaatgttgttaccttttcttctattataaatggatacgccaaaaaaggaatgctcaacaaagcagttgaagtgttaaggaagatggttcaaatgaatattatgccaaatgtttttgtttatgctattttacttgatggctattttaggacaggtcaacatgaggctgctgctggtttctataaggaaatgaaatcttggggattggaagaaaacaatatcatatttgatatcttattgaacaacttgaaaagatctggaggcatgaaggaagctcagtcattaattaaagatattctctctaagggtatttacctagatgtttttaactactcttctctaatggatggctactttaaagaaggaaatgagtcagctgctctttccgtagtacaggaaatgacagagaaagacatgcagtttgatgttgttgcttacaatgctttgactaaggggcttttgaggctggggaaatatgaaccaaaatctgtgttttcaagaatgattgagttgggtctgactccagattgtgttacatataactctgtaatgaacacatatttcatacaaggtaaaacagaaaatgctttggatctgttgaatgagatgaagagctatggggtaatgccaaatatggtcacttataacattcttattggtgggctttgtaaaactggtgcaattgaaaaagtaataagtgttttgcatgaaatgttagctgtggggtatgttcctacacccattattcacaagtttctgcttaaagcatattcaagaagtagaaaagcagatgcaattttgcaaattcacaagaagcttgtggatatgggcctcaatctcaaccagatggtgtataacacactaatcactgtattatgcagattagggatgactaaaaaagcaaatgtggtgcttacggaaatggtgataaaaggaatttcagctgacattgttacttataatgctcttattcgtggttattgtacaggcagtcatgtggagaaggcttttaatacttattcacagatgttggtgagtggaatctctccaaatattactacttacaatgcccttttagaaggtctttcaactaatggtttgatgagagatgcagataaattagttagtgagatgagggaaagaggacttgtcccaaatgccactacttataacatattggtttctggccatggtacctataatgtgcttattcaagattatgcaaaagcaggaaagatgcgccaagctagagaacttttgaacgagatgttgacaagaggaagaattcctaattcttcaacatacgacgttctaatttgcggatggtgcaaattgtcctgtcagccagagatggacaggttacttaaactgtcatatcagaatgaggcaaaaaaattgctgagagaaatgtgtgaaaaaggacatgtgccatctgagagcactctcatgtatatcagttcaaatttttctgcacctggaaaaagagatgatgccaaaaggttgttaaagacagtcattggactgtatagatcaactgctgaagaggctacggagaaaatagcacaattctgctttgcacagattttaaggtttatgtttgcacaagtgacagaagcaagcattgagcagaaatttgaaggcatcttgagactcaattctaatagatattacaaggcactgtcagatcaagttgtacgtgtcaagtctgtgtaccttgctgcctcttctgcatcagattaa

SEQ ID NO: 85642 - DNA, 1758 bp, Glycine max
  Peptide Sequence Number=SeqID_202420
atggcattggtaattgatgatcgcttgaaagtgtgggatgagaaggatcaacctcgggtgcatgttgtccctgcatttgctccatactatgctcctcaagctgaagcaagcaatactatccctgtcctatgtgttgcaagaaatgttgcttgcaatgttaggggtggcttctttaaggattttgatgatggtcttttacaaaagattcctcaaattgcctatgaagatgatatcaaagatataccttctcctcctgatgtgagcaattatctagtttcagaggatgatggctctatttccaatggacaccgagatccattcttgtttgatggcatggcagatgccgaggtagaaagaaaattaaaggatgcactatcggcagcttcaactatccctgtgacaactgctaatctagatcccaggctcacttctcttcagtacacaatggtgccttctggttcagttcctcctccaacagcacaagcatctatgatgccatttccccatgtacagttccctcaacctgctacactagtaaagccaatgggtcaagctgccccttccgaacctagcttgcatagctctcctgctagagaagaaggtgaagtacctgaatcagaattagacccagatacaaggcgtaggcttctcatattgcaacatggacaagacaccagggatcatgcatctgctgagcctccatttcctgttagacatcctgtgcaaacctctgctcctcatgttccatcatcacggggggtttggtttcctgcagaagaggagattggttcacagccactaaaccgggtagtacctaaagaatttcctgtagattctggtccattgggtattgcaaagccccggcctcatcatccctcctttttctctaaggttgaaagttctatttcatctgatagaattctccatgacagccaccaaagattgccaaaggagatgtatcacagagatgatcgcccaagattaaaccatatgctctctagttatcgttctttttctggtgttatttgtttcagtgatttgattttgaatgttataccggctggattcgaacccagcccttatggaattgtcttacgacaattaccaaccatacggaccaagaatgccggtgatgatatcccctttagtaggtcattttccagccacagggatcttgactctgaatctggccattctgtattgcatgcagatactccagttgcagtactacaggaaattgcactgaagtgtggaactaaggtggactttatttcatctctggttgcaagcactgaactgcagttctccatggaggcatggttttctggaaaaaaaattggtcacagagttggcagaactagaaaggaagctcaaaataaggctgctgaggattctatcaaacatttggcagatatatatttgtctagtgccaaggatgagcctggttctacatatggcgatgtgagtgggtttcctaatgtaaatgacagtggttacatgggtattgccagctctcttggtaatcagccattgtctaaagaggattcagcttcattttcaactgcatctccatcaagagttttagatcctaggttggatgtctctaagaggtcaatgggttcaatctcttccctgaaagaattgtgcatgatggagggtcttgatgtcaattttctatctgcacctgctccagtgtcaacaaattcagttcagaaagatgaagtacacgcacagtttttcgttccttcaatagattag

SEQ ID NO: 85643 - DNA, 294 bp, Glycine max
  Peptide Sequence Number=SeqID_202421
atgagttgtggctgctttggagcctcaactctcaagaagaaaaggaatccttctgatactcctaatgagattgatgccttcaataattctgcactattgtacaatttcatattccttctattggctttaccaatgagcctacacttttctgactgctttccacttgataatgttaagaatttctctgataaagacctgagactggccactgataactataatccaagcaaaaagctaggacgaggaggttttggtatcgtgtaccaggtatttaggtcacaggctcaagtataa

SEQ ID NO: 85644 - DNA, 411 bp, Glycine max
  Peptide Sequence Number=SeqID_202422
atgatgcaaggtaatatatggatatctccgaacacccttggcttggtgcaaggcatgacacttctcaagtttcagataggaccatctcttgaaaaatccatatttgcacctaaagattattcgagttcacagttcagaggccttaaggctgtgttagccaaggatgatggtgtaaacaggaccgtgaccaagaagctacttgagaagcttggttttcatgtaattgctgtttcatcaggatttgagtgcctgagtgctatcagtggtgctggtaactcattcagaattatcctgttggatcttcacatgcctgaaatggatggctttgaagtggtaaagagaatccggaagttccatagccatagttggcccttgattatagctcttatagcagtgcagatgaacatgtga

SEQ ID NO: 85645 - DNA, 381 bp, Glycine max
  Peptide Sequence Number=SeqID_202423
atggccagccaggcaaggaagtcgtttcagaatgtcatgagccatggaatgcggagggctatgcattgtattctggggatgctgtcattatttcaagaggataatttgagaaaacgaaaagggaggcttccggttagagatgaaacctttcattcgatgatgagggaagctgcttccactgccaagtgcttattactcaagagttctcagccagatgaagcaatttcaacaatacattatactggtaggaggcagtactacaacaatgaaactaaggaggggctgagcttcagcatgtgcagaaaagttggtacagaattatccaatgtggaattgtttatgatgtttgaaatgggtggtgaaactatcataacaagttag

SEQ ID NO: 85646 - DNA, 489 bp, Glycine max
  Peptide Sequence Number=SeqID_202424
atggcttccgcaaattctaatcctcctcctcctcctccaccaccaactttggtggctgatttttcttttccggcgaatgtgatggcgattccaattcctgtgtctgcaatgctgattcaaacagcgtttccacaacaggatctgacggctacacctacaggaatacccgaaagactgagggagaacgaggaggccggagaggcccatggcgtcggagaagtggcggaggaggaagcggttgcggtagttggaatcggagtcgtcggaggaggagaaagaggggggattggcggcggggtcgtcgaagaggtcctcgccggcgaagaggtcggcggggtcgaggcggaggggaggttcgacgttgaaggaagggcggcacagacgcatgacgcgaaacgccagggaatgggatcctcctcctccctgaccaccctgactcatctcttgttcttcttattcactttcaaagaattgattctatttcagagg

SEQ ID NO: 85647 - DNA, 321 bp, Glycine max
  Peptide Sequence Number=SeqID_202425
atgaaggagcattgcatcacagtttctcccatttgcatgccaactaaggtcttttgcgtcgtctccattagcaaacaaacgcttaaaccttggaatgatcaaaagataacacaacactgtggaagcaatgtcttccaaggttattttgatgatgccaaagaatcaagagttaagcaaagtttcaaacaaagattcaagaatcaagttttaagatttaagattcaagaatcaagtttcaagaatcaagaatcaagatcaagatcaagattcaagactcaagattcaagaatcaagagaagactcaatcaagataagtattaa

SEQ ID NO: 85648 - DNA, 708 bp, Glycine max
  Peptide Sequence Number=SeqID_202426
atggctttcaaaggttgtttgaaagactggatagggaagcctttccattttgagtgtgcatggctgtctcatgagaattatgttgaaactcttaataatgcctggaacaagagggagcctttggtatccaagttggagaatttgaagtctactctttccgtttggaggaaaaacatttttggagagattcataagaagaagcagtctattctggcgcgtattggtggtattcagaacctattctactggggtaatcacaacccttttcttattaatctggaaaagtccctgcatgaagagattggggtggtgttatatcaagaagaattatcttggttccaaaagtctagagcccaatggctacatgatggggatcaggatactagatactaccacttaaaaaccattagcaggagaagaagaaataaaatcagtatgttaagagatgggaatggcaactggcttgaggatgagcaacaaatcaggtctctagttaacgaattttacattaatctattttctgatgatgacagggatgatagatggtcagtgtctcctttgtcctttcctatcttggatcagcaacattatgatagtttgggagttgatgttcttgccgaaaaggtcaagatggctttgtttggcatgaaattgtggaaggctcctgggccagatgggcttccagctggattttttcaaaattcctag

SEQ ID NO: 85649 - DNA, 369 bp, Glycine max
  Peptide Sequence Number=SeqID_202427
atggattttctccttgccagcttcggcatgtcaaatttacgaccaagggacaatggatgggaggtcgtggtggttataggagttgttgctggtgcggatcagaaaaaatgcggagaaaatggtgacagaacaaggttgaggcgtggagggggaggaccaaatcttagatctgagggaaaaaaatgtaaaaggaggggagaaagaaaccgacgacggtcagttggtctccgcggtggtgttgttgcttctcatgtcggacatcaacgacggagaaaggaggttatgcgtggtggtgatggaagttgccggcgaggtcaaaatggaagaaaagagcgccacaaagcgaagacttgtaggagaaaaaagtaa

SEQ ID NO: 85650 - DNA, 2157 bp, Glycine max
  Peptide Sequence Number=SeqID_202428
atgagttgcctatcaactgttgtgactaatgtgaaatggaatggccagagatcttccatgtttcctcccaagtgtggattgtgccaaggagattccctatcgccctacatttttgttttgtatgttgacaagctgtctcacttgatttcaaaggcagtggaggatggtgtttggaaacctgtgaagatgggaaggaatgggtcgttgatatcccatttaatgtttgcagatgatttgatcctttgtgggcaaactaatttggagcagatggaggtagttaaggacattctttataatttctgtgatatgtctggccaaatggtgagtgctgaaaagaccaggatctatttttcgaaaaatgtgaattctcaaactagaagagatttggtgagcaggagtggtttctttgaagtttcaatgttgggttcttatctagggattcctttgctgggaaaatcccctagacagagggacttccaacatttgttgaacaaagttgaagacaagttaacagcttggaaggccaagcaattgtcgttggttggccgcatcattctagctaagtttttgattcaggcgattcctgtccattcaatgataagcccttatatccctgcttcagtcctcaaaaaaattgaaaaagctgaaagatcatttgtttggggggatcaacaaagtaagagggagtttcatgctgtggggtggccaactttaataaagcctaaggatgaggggggtttggctatgcgtaacttacagtccatgaatttggcttgtttaatgaaaataaggtgggctattcggaatgatggggagtattgggctgtgggaaaaagtgactctgttagtgtgtggtatgataggtggatcagtgctgatattattaagttgagcaatgttatgcaggtcatcccagatcatgtagctaattataaagtgaatgatatggttaagcaggatggtcagtgggattttgaacttttgagtttgttgatccctcaggatattattaaatgcataaaagccattattcctcccagagataatgctgatgatgatagacgcctatggacaggaaataagctgggggagtactttgttgctagtggatataatcaggtgaatggtttccaaaatctcagtcaaagtcatatatggaacaagatctggaagattaaggccccagaaaggatcaaggttttcatttggcaggttactcatgaaaggcttttgacaaatagttgtattgctcataggggaaatggtcaagctagttgccatcattgtgttatccttgaggaaaatattcttcatgttttgagggattgtcctctggccaatttggtttggcttcatcttctagaccagtctaatgtggctaattttttctatcctgatctaatggagtggattgatatgaatttatctagagacttgaatgccacatctaaagatgattggcaaagtgtttgggctcaaggatgctattttctttggtattggagaaatcaacaagtgcacaattcctcctttgtaaggccgtttaggctgtgggaaagtatattgcaaaactgtaggaattataagattcttatggtccatatggatagtagtcaagttgtgagcaaaaagcagatcatgattaagtggatgcctcctgatcaacggtggtataagcttaattctgatggtttgaaggtaggggatagtggaggaactggctatggtggtttgatcagagatgagaatgggagatgggttgtgggttttgtaaggaatctgggtattgcttcagcttatgtggctaagtcatggggtgtgcttgaaggtgttactctggctcgtcagagggggattgatttccttgagatcaacgtggattcgaaagttgttgttgatggactgaagggcgacaaacaagggtgtcttgagggctggacaatcgttggggctattaggaagatggttagtggcttggagcaggtgaagattagtcatatctatagggaagcaaatcaatgtgcggatttgcatgtcaatcatgctcgtactcaagaggaggatttgatgattttggagcatcctatagggctgctgacccagttgttgcttatggattcttgtggagttgaaactcctcatgtagttgttgtttag

SEQ ID NO: 85651 - DNA, 1229 bp, Glycine max
  Peptide Sequence Number=SeqID_202429
taaccattcatcatcagtgggaggattatcagagaattagcgagaagccttctcctttgatgttggctagaagagttgaaatgttggtgcgtttggaagaacctatgccaggatgggtaacacttaatacagatggatctagttgtcaaggtatagctgggtgtggtgggcttatttgtggtcctagagggcgttggattaggggattttcaaaggttggcagagctaatgccttcatggcggagttatgtgggctgtttgaaggattgaagttgctccaaacacaaggatatcaagctgttaatgtccaggttgacttggaggcatcggtgaagagtgtagtgggcaacaatgatggttgcgttgtaggatggaaattcattcgctgttgggttgtgcatggagtaggtaagcaagttcacactccaaattccatttcgaaacttcaccagcttcaacgctcgagcaaaagcctcaaagaaggagagaggctcgaaccagacgctgattccaagcccaagaccaagtccgttaagaggaacgagataaagaaggaaaagtgcattcaggccgcgcttgaaaaggaaaagaatgtgagtgaagttgaagatagtggaaagcaggaatctctagaggcattgacctcgcagataagtgacatggttgctattgcaaaaattatgaaagccactttggttttgcctacattggatcatgattccttttggacagattctagtcaaacagtgaatctaggcctgaaatctgaaacagcttcaagcggagtctcaggggcttcttcgaggtatggatattttttagctattgtcagctctagaccacgggttataagctgggaaattggggaagagattccaaagttccgtaatgatttgggaaatgtagagcacatttctataccgagtgatgccaaaaatttagttacattagattttgaggatcaacatgaggctgctgaaggagtccttcttgatgatgatttgaatgagccaacaatgggagagaaacttgctagtctaagtgttctggatgggaacaaatcaaggagtgatatagagcaagaatcttctgtcccaacaaagcctccaagtgcagactctgtatatgttttgcttaagcaagcattaaatgctgatgatcgcacccttctgctagattgcttgtttacacaaaatgagaaggttctctttctctcctatttctattga

SEQ ID NO: 85652 - DNA, 624 bp, Glycine max
  Peptide Sequence Number=SeqID_202430
atggcggtggtcctccgtgaacttctccacgtatggtggtggagtatacctacaaagacactccgacacttaattagtggtgttattcctctaatcgttggtgatgccacctctgttggtggtgttggtgctactaagggagagcgtcacccaaacactagagtttgcttcttcccaagggaggacgaggttaagtcccctctacatgttcctcctcataatgttattgacctagactcgaaggctactgtcatccaagttttggtttatcgtccatttattcctcatcccccttctcctagaaaacctagtaaggtcagaaaagagttccctcctacaacccttctaggctactcttgggttcacgaggaattccaattctatgaaattagtttccaaacttatgaatctatcattgacatccttgagtttgtcaagctctatcacattgatggactgaatgtgatggaattatggccaagttcgattactaatccatcaagaaggcttagactgagaaggttccaaaagcaaaggctgagaaggttcaggccaacaaggccaagggaaagcaacaagaccgcatcgatgactaggttcctccttcccttcccatcagcctag

SEQ ID NO: 85653 - DNA, 267 bp, Glycine max
  Peptide Sequence Number=SeqID_202431
atggtcaagtttggctacaattccatcaagaaggctcaagccaagaaggctgcaaaagcaaagactatgaaggttcaggccgacaaggccaaggttcctcctccccctcccatcagcctaggtgttgttgagagggccaatccgggtcctcaagatgaagggccttcaaaaaggctaagagtggagctggtgccactagttgttacttcttccattgagagtcaccccgtcttactttctatgaaggaggagactgtttctctttag

SEQ ID NO: 85654 - DNA, 174 bp, Glycine max
  Peptide Sequence Number=SeqID_202432
atggaggccagtgtctcatcctctattggcctcccttctcccaaacaccacgaaatctcaatctcaaccctcaccgacgtcgttggatgtggtgaagacggggtgaagggccaatgtgaagcagattttcaaggaggaaggctgggtggggttgacacgtggcatgggacctag

SEQ ID NO: 85655 - DNA, 198 bp, Glycine max
  Peptide Sequence Number=SeqID_202433
atgaagatgaatgtcttctctccagcttctctgccttcttctctctatttttacgtagcttcaacttggtctagcttggttacctttggtttcctaccaactcagtgttttaaaggcttttggacttctcgacacacgaagggtttttcatctgctaagcgagctgactgccttgctaagcagatgaggctcgcttag

SEQ ID NO: 85656 - DNA, 192 bp, Glycine max
  Peptide Sequence Number=SeqID_202434
atggcggtgaaccttcaatgtatcatgatcatgatttcacaggctaagcccatgatgaaccatacgtggtccactcctatcttgaaaagctgctcaaaacggatccccattatcagagccccaatgatttcaagctatccgaccgagctaggcattctaacacaagggtgcaaatatactgatagtaactag

SEQ ID NO: 85657 - DNA, 456 bp, Glycine max
  Peptide Sequence Number=SeqID_202435
atggcccacttagcggaagttgtagaccaattagagctgcagaactcgctaagcgtgcatctacacgctaagcccaaaaacctctcagcaattgctctgctcatcatttgcacatcacaccatttgcactttgctactttgccttttcactccatttctctactccaaggagttgaggctgacaagccaaattctgggttttgcgatgaactcgctaagcgagcttgcctcgctgagatgaacttgctaagcaagccctactccgctaagcgagttcatcaaatggccttaaagaagagacgtgcttcatcctctcgatctcaggagccctatgacacatccagatttttgtctgaggttacttcggagagatatgaaactaatgtgcacaacaggaatatcctcccagagaggaatgtggagttggcttactcccattacgatgagttcctctga

SEQ ID NO: 85658 - DNA, 315 bp, Glycine max
  Peptide Sequence Number=SeqID_202436
atgcaaaacataagagggaaggtggtggtttcatctgtgtggaaggtttccatgatgttctcagagatcaaactttcaaacttgcataaccaaagtttgagcaccttaacggaaaactttcaagtaaaacaccagaaagctcatatttatgcgtgtaaagctgatctcccagggcaaaaggaggaggaagcgagggcgcagtcagctgatggcagagtgtttaagattgttccatggcaccatctggagcatagcaccagcaactccctgagcatacaggccttaagccatgacttgactggttcagataggtaa

SEQ ID NO: 85659 - DNA, 1660 bp, Glycine max
  Peptide Sequence Number=SeqID_202437
atggagagaatgagagggatagaaagtgtgttgtgggtgagtagaggatccattcttggattcaacagcctttccaatagcgcagaaattaagtgcattgagagtgagagacaagcactcctcaacttcaaacatggcctcatagatggttttggcatgctgtctacatggagggacgatgacagtaacagagactgttgcaaatggaaaggcattcaatgcaacaatcaaactggtcatgttgagatgcttcatctccgtggtcaggatacacaatatttgataggtgcaatcaatatctcttcattgattgcccttgaaaatattgaacacttggatctcagctataatgattttgaagggagtcctatcccagaactcatgggctcgttcaccaacttaagatatctcaatctctctgattgttcatttgttgggagtattccttctgatcttggaaagcttacacatttactgtctcttgatctaggtaacaatatgtatctccatggacaaatcccttatcaacttggaaaccttatacatttacaatatcttgatctaagtgataattatctagatggggaactcccttgtcaacttggaaatctctcgcagttgaggtatcttgatcttgatgcaaattcattttcgggagcactccctttccaagttgggaatcttcctttgttgcacactcttggacttggtagcaattttgatgtgaaatctaaggatgtagagtggttgacaaatctgtcttgtttgacaaaactcaagctaagttcactacgcaacctttcctcttctcatcactggctacaaatgatcagcaagcttattccaaacttaagagagttgaggctatttgattgttctctttcagatacaaatattcaatctctgttttattcaccttccaacttttccactgctcttaccatccttgatctttcttcaaataggctcacatcctcaacatttcaactgttgtcaaactttagccatcatcttccggagctttatcttccttataataacattgttttgtcatctcctctatgcccaaactttccttctcttgtgatccttgatctttcttataataatttgacatcatcagtctttcaaggtagtttcaacttcagctcaaaacttcaaaatctttatttgcaaaattgtagtcttacggatggaagttttctaatgtcatctttcattatgagttcttcatcttctcttgtttccctcggtctctcctcaaatctgttgaaatcatcaactatattttactggctctttaactccaccaccaatcttcataaccttttcctttatgataacatgttagaaggtcccattccagatggatttgggaaagtaatgaactctcttgaaggtctttacctctacggtaacaaactgcaaggcgagattccatctttctttggtaacatgtgcgcattgcagagtttagacctctcaaataacaagttgaatggggaaatttctagcttcttccaaaattcttcatggtgcaacagatacatatttaagagcttggatttatcttataaccggttgactggcatgttacctaaaagcattggattgctatcagagttgacggatctttacttggctgggaattctttggagg

SEQ ID NO: 85660 - DNA, 594 bp, Glycine max
  Peptide Sequence Number=SeqID_202438
atggtaataaagggtatttctcctatccttttactcacatcattcacatttgtaagaggaagtaaacctggccgcaacataggatttgacatggatgaagatgacctcgttgaaatggagcagtgccatggcgtagttgctgcatcagccatatttgatgaagaaatagagtctaatttgaggagttctactaggctggggaccaaaaagaagattggtttatggagaattattgttgctcataatcttccttatacaaatccaagacacaaaaggaagtctatatggcttgatggaaagcttgagcttcttgttgatccatatcaaatccttgaaaggtttttgtggaggaagaatgcaagttttgcaatatctaaacattatagacgctttgatgtatttgttgaggccaaagcaaataaagctgctggaaagtatgagaatgcctctattgactttcagattgacttttacaagaatgaaggactgactccatatacagaggccaaacttcctattataagtgatgttcctgaaggatgtgtaatagtacgagaccatgttcccattagcgatctttttacatgtctttga

SEQ ID NO: 85661 - DNA, 288 bp, Glycine max
  Peptide Sequence Number=SeqID_202439
atgacgctagcgctctctctccctctcagcttagtagctctctctccctctcagccactctcacacaccacacttagagttctctcacaagtttggttggcaatgtctcttcttgcggatggtctggctgttgctgggcagccttctgcactaaatattaaggactacttcattatgaattggaacgggatcaggaccttgggagttcctaaggagctcatgactacacatggcagacaccgtagttatagcttcatattaggcctaggtttcagtggtgttagctga

SEQ ID NO: 85662 - DNA, 228 bp, Glycine max
  Peptide Sequence Number=SeqID_202440
agtactatgctcgtggcattgggaaaagtgtacgacacttcatcctccatacacaatgtgccttatgcaaatgacatggttagggtgagtgttgtcacagtttaccacggtgatgctcaggtcccttttctgatgtcagaggtttggtttgtcagccaagctgttggcacagtcgtcgcatggctgaaacatctagtcaaagtggtatctcatgtgttagacaagtga

SEQ ID NO: 85663 - DNA, 360 bp, Glycine max
  Peptide Sequence Number=SeqID_202441
atgacaatccaaatggcttctaggaaaaggaaggcaccgtctacacctacccaagtcagatttgatagatccagattcacttcccaagaggcttgggaaaaatacactgacattgtggtgcctcataagcttttaccagaaaggaatgtggtggtctactatacagtgtttgatgagttcaagggggaactcgagagatgccactgggatgaagagttgactgattttgttgacgacaacattgatgttgccattgtgaaggaattctatgcaaacctctctgaccccgaggacatctcacctaagcaggtgagggtgagaggtcatctaattaagtttgatgaggatactctcatttga

SEQ ID NO: 85664 - DNA, 312 bp, Glycine max
  Peptide Sequence Number=SeqID_202442
atggcgcaatcacaacacaacatgagtatggtgattgtcaaatttttagggtggtatgcgaacagaaaaggggatttggcgacgggacatctccccgaagatccgatgatgattgtaacatatccacgaagatccagcgacaaagatgacttctgtggcttaaacaactttaacaacacattgtttgagttagagtttaagagcgaagtttgtgtcgtcgtagtcgcgaaggcgataaaggaagacatggtcaaggttgcgactgtcggaggagactgtggccatgaaatacctttccaatattgttgctag

SEQ ID NO: 85665 - DNA, 738 bp, Glycine max
  Peptide Sequence Number=SeqID_202443
atgagcactctccaccgatccacaatcatcagcaacaacaacaacaacctcctcctcctcctccttcttcttcatcttctcttcattatcaacactcccacattccagaacctcaatttcaaacctcggagtctccgagctcaacctcgcaagcccaaagtccccaattctcggcgagaaatcgcgatcaagcaaaacgttgctcggtttaatgtcgccgtgaataacaggggggtcgcaggagtgaagaaagtgaacacctttcgctatgttgaggataatcgagaagcgcgtgttccagttagagagttcggggcacttgcggtgcaaaagcgcgtcttggaggttgccgttgtgcatgagctcgtagaccaggaggaagcggcgtcgtttcgggtcggagcagaagtgcgtggcggtgatgacgtggcgggagaggagcttcgaggcgaagaagagttcgttgtggaactcgcgctcaccctggtggtggttggtggcggagtccatgagcttgacggcgacgggggcgccggcgagggtgccggcgaagacggggccgaagcctccgtggccgaggcgcgtggagaaggagttggtggcacggcggaggacggagaaggagaggcggtgcggcggggaggtggtggccggagaaggagggtaggtggtagcgcgtttgcgggtgagggtgcggtggcagaagaggagaaggaggaggaaaagggagcatgttga

SEQ ID NO: 85666 - DNA, 1245 bp, Glycine max
  Peptide Sequence Number=SeqID_202444
atggaggatggtggtttgggtgtggagcaatcgccttcgccggagatggcggcgatgacttcgccggagacgggtttggcggtgtccgccgctgaggcctcgccggggtttgagaagggtagtgtgcagagtgagaaggagggtgtgaagaagattaatgggagagggttgaagagtaattctgtgagggattggtggtggaagcatgagaatgaggttggggttggggagagtaaaaaagttaaggattatgtgatggagtggattgggagggatgtgaataaggaaagggtgaaaaatggaattgaatatggagatgtggtggtagggaaggaagagaaaaataagaaggagaagaagagaaggaagaaggaattggaatggtgggaatcaatggaagaggaaaagcttgatggggttatgaagaggaagagaaggacggtgagggaatggtggaaggaggagcgttttgaggagaatgcgaagacgacggcaaagaagaagaagaaaaagaggaagggtgggagtgtgaagagtgatgatgagaagtgtggtgatgattggtggatgagtgatgatgcaatggataagaggaagggcaagagtaggagtaggaacaaccgtgggaacatggattggtggatggatgggttgagtggtgagttatggagagggaggaggaataatagctttgattctgctagtggggagattccaaagagtggtggtgtgagtagtactcctagtatgaggggaactgtgtgctatgttgctcctgagtgtggctatggtggggaagtgtctgagaagtctgatgtgtatagctttggggtgttgttgcttgtgatcatttcccggcggcgcccacttcaggtcagcggttcgcccttgtctgagtttcagagggcgaatctgctgtcgtgggcacgccattgcgcacgaaatgggaagcttgttgagctgattgatgagtctactgagttgttggataaggagcaagctcttctctgcatcaaggtggcgttgctttgcttgctgaagtcacctgctcgtcgtccttcaattaaggaggttgtgggaatgctcagtggggaattggagccaccccaattgcctgtcgagtactcaccttcaaccccttcaaggttccctttcaagtctaggagaaaaggcagtggaagtttacctatgacagaaacaatgtatagggatttaggaggggaaagctatgctcttaccatttga

SEQ ID NO: 85667 - DNA, 195 bp, Glycine max
  Peptide Sequence Number=SeqID_202445
atgtcgcgcttagtgccaccatcgtgcttagcacgacgagctgatctcgcgcttagcgcacaggctcgattcttgtgctcttctagattctctcatcacactaagtgtgctgtagctgcgcgtagcggtagatacgagctgagcccacaggttccgcttaacgcgactgctccttttagcacttcaagactttag

SEQ ID NO: 85668 - DNA, 756 bp, Glycine max
  Peptide Sequence Number=SeqID_202446
atgccacttccagagatagaagataagtcaggggtagtgattagaacttttgggcattatgctacggtcctagtggatattgatttcgctctacaactaagagatcagattttggtggagtggaaaggctatgcttttttggaaggaaagggtgggaaaaagtcagaaaccatttggcaacaaagcgataacaatgttattatgcctgagtcatctccactaggggtgggaataggccagtccacttctaaccctatggctcaaaatgtccaacctaaacatctacctaggagtgtcccccccagggcctctaacctcatttcgaaagaaaatattgacactactttgcagctttcatccactgaacccgttggttcacatgcctttgatttagtttcttctataggttcccctatattccacaaccaaatagattttgttgctctaaaaggagtatccaaggataaggaaggctcagatgaagagaatgttatccctttgggagaagatgaccctgaatttgaagtagtgttgtctaaatcccagaagaagagacttagacaaaaatctcgaaatgcgaaagcgctgaatcaccctagagccttcttgggtgatttcaacaccactttgggagctcatgagaaaattggatggtgccccctgcttagagcctctagtgatgatttcttcgattggagcattctctcaaacctcactcacctccactctagaggagccgaattcacttggactaat

SEQ ID NO: 85669 - DNA, 1206 bp, Glycine max
  Peptide Sequence Number=SeqID_202447
atgccagaggttaggatcattgccaagaatttcatggacatggtggcttccatgcctgccatgaagctcgataagctctatgaaaacggattcatctgtgaagctattctcaggtctgttccacctcttgcgaagaaatatgtcatacagatgctgcatattgatgtgccagtggcagctaaattgttggaggaatgggtgcttccggctggagtttcaaagcacagagtggccattgataggttggttcaattgagagttttccttgaagctgttgacaggaagaatgaaaagacttacaaagttaatccaacatttcagagaagtctccaaaaacttttagtacaaggtggaactttgccaagggaatcaatgccttctaatattactgtaaggctcccaacattagagaatcttgaggcttatgctctagaacaatgggagtgtttcttattgcaacttataagcccaagtcaggttgaaaagcccttaaatattagctcttccttgatgaaggttttccagcggcgtatcctgagtcacagagacaaagaagctccaaaattaactgaaagtggtttccagtttttgctgatggatacaaatgcacagctttggtacatcatcagggaatatatctctaattctgaggtagctctaaccagtgttatgaaacctagtccggtcattgacctggtcgaggatagaggtgttgatgcagctgatttgatctcattcatgctggaacttagttttcatgtcattggggaggcttatagtgttgacacattgactagttttcagaggaccataattaatgacctagcagaccttggattggtaaaaattcagcagggcaggaaagggagttggtttatacctactaaattggcgaccaatctttcaatgagcttggctgattcatcatctagaaaacagggatttgtggttgtggaaacaaattttagagtttatgcttactcaacttctaaattacattgtgagatattgcggctattctcaagggtagagtatcaacttccaaatcttattgttggggctattacgaaagaaagcttatatagtgcttatgaaaatggcattacagcagagcagatagatggtaatgatttatttcttgctatgcttttgttaggaataaggggcccattcctaaagtgtattccagaaggattaggaagatag

SEQ ID NO: 85670 - DNA, 645 bp, Glycine max
  Peptide Sequence Number=SeqID_202448
atggaggggcgaggatgttgtgagatgtatgtagcttccatgcgcaagtctttcaaggactccttgaaagtccttgaagctgatatccaacacgccaataccctggcctcagattttccaagggagtatgatggtgcatgccttcagatgagaatgtcatacagtccagctgcacacctgttccttttcttggtacagtggacagattgccatcttgctggagcccttggactgttaagaatcctaatttacaaggtctatgtggatgggacaaccaccatgtctacacatgaacgaaaagcaagtattagagaattctatgcggtcatttatccctctttgttgcaacttgaaaaaggtgtaactgatactgaggataagaagcaaaaggctgtgtgcatggagaggtaccgtagaagagatgatgaggagtataggcagtcttctgacatagacattgaaagagaagatgaatgtggaatatgcatggacatgaatagtaagattgtgcttcccaactgcaatcatgccatgtgcctgaaatgttaccgagaatggtactccccctacttcctcaactctatacagtcactactaagtgaccaccgtatttcagtggtagtgaaatgcgtgattgcaccatag

SEQ ID NO: 85671 - DNA, 144 bp, Glycine max
  Peptide Sequence Number=SeqID_202449
atggggtcggaaagctcatcaaatcccatactgtgggaaacatatatggcagcgaagtcggtgttcttgttggttcagaagatgccggcagggatgagcgattcttgggtggcgttgagttatggcttggaagggaagggttag

SEQ ID NO: 85672 - DNA, 123 bp, Glycine max
  Peptide Sequence Number=SeqID_202450
atgcctccaaattctcaaggcaaaaataggcacaaccactcatggtgttgtccacaaaataagtgtcaggtatatcaccaggcagatcgatggggcgtacaggttgtggctttggcttcttag

SEQ ID NO: 85673 - DNA, 156 bp, Glycine max
  Peptide Sequence Number=SeqID_202451
atgacggcgacaacgacaaagtatatttcgttgaagcctttgggaagagacggcaccgtcaggcgccatttggtggaggagattctaattgtggtgcctaggtacgccgtcaagcctatggtgacggtggcattggaaagcacggaccaaaggtaa

SEQ ID NO: 85674 - DNA, 408 bp, Glycine max
  Peptide Sequence Number=SeqID_202452
atggctacatctgtgtactcgttttacctggacaaaacagaagagaacactgagaaaaaggatggcgacaaagtgttgaatttggtctcttgtgcagcattttccatgatgtccctgagcttgtcaagattaactggtctcggattcattagtttcagggccaaagacaccagcaatatctccgattattttgcttctattctacttaagaaatcactcaaggtctattttcaccaagagctaattggggactatgtaccacccagagtggttgagcaaattgagaaggctaaagtttccgtcatcatactttcagaaagttatctggatacaacttggtgcttggatgaaggaagggagggtgaaaccccatctcaccctgcactgtttccttatctaccagagtaa

SEQ ID NO: 85675 - DNA, 285 bp, Glycine max
  Peptide Sequence Number=SeqID_202453
atgtcgcagcaatggggctctccatgtggaagccaatgcaccaataaatacgctgccctcggcaaaatcccatggcgaatattctgcaaaaagggttgcgactcagatggagagacatgggaagaatgtttggaggactgcaatcaaatatgctacaaggatcccgtactaaaggaccagcagtggagtgcttatattgatcgttcccctggagctgccagttattcggaggaatgctttcatgcgtgtgtatctggctgcggttacaaggtcggttggatttga

SEQ ID NO: 85676 - DNA, 1050 bp, Glycine max
  Peptide Sequence Number=SeqID_202454
atggacaaactgaacgcagcagtaacacagaccttgacattgtatattgagattcaacaatgcaaggttaggagtatgacaaacatatgctcaagaggccaaaaagctgctcgaacgaaaaactacagtggtgcagaacttgaaggtgttgtgaaaagtgctgtctcatatgctttaaatagacaattgagtctagaggatctcactaagccagtggaggaagagaacattaaggttacaatggatgactttttgaatgcactccacgaagttacttccgcatttggagcttcaactgatgatcttgaaagatgcagactccatggcatggttgagtgtggtgatcgacataagcacatttatcaaagagcaatgctacttgtggagcaagttaaagtgagtaaaggaagcccacttgtcacttgtctcctggaaggttcccgtggcagtggtaaaactgcactttcagctactgttggtatcgacagcgacttcccatacgtcaagatagtttcagctgaatcaatgattggtctacatgagagcaccaaatgtgcacagattattaaggtttttgaggatgcatacaagtcaccattgagtgtcatcattcttgatgacattgagagattattggagtatgtgcccattggtcctcgattttcaaacttgatttctcagacactgctggttctgctcaaacggcttcctccaaaggggaaaaaactaatggttattggcacaacaagtgaactagatttcttggaatcaattggattttgtgataccttctctgttacttaccatattcctaccttgaacacaacggatgcaaagaaggtcctagaacagttgaatgtgtttactgatgaagatattgattctgctgcagaggcgttgaatgatatgcctatcaggaaactatacatgttgatcgagatggcagcgcaaggggagcatggtggatctgcagaagccatcttttctggcaaagagaagattagtatcgctcatttctatgattgcctccaggatgttgttaggttataa

SEQ ID NO: 85677 - DNA, 2896 bp, Glycine max
  Peptide Sequence Number=SeqID_202455
aaacaaacagggcactgagtcaccgatgcaactcagcagcaacgtactgattccggcgaacaaacccccaagaccgttattcttcaaaccccgattctgctccaaccccaactcgcccgagtcgaactcgctccaagccgagaccctcaagactctagaatggggctccgtgtgcaagcagctctcggcgttcacctccacctccatgggctctgccgccgccctcaacgcccgcttgcccatcggccggacacgccgcgacagccagaggctcctcgaccagacctccgccgccagactcgtcgccgagcccctcgacttttccggcgtccacgacttgacggagattctcggcgtcgccacctccggccacttgctgaccatccgagagctctgcaccgttcgccacacgctcgccgccgccagggaactgttcgatgctttgaaacgcgtcgcttccgcttctaatcatccacaaagggcttcacatagatatttgcttccagatggtgtagttctgaatgttagcagctctggggcaacttactttatggaacccaaagatgcaatagatctgaacaacttggaagttaggctttcaagctctgagaaggccgaggaaagtgtaattttgagtatgcttgcatctgaaatagcaaattcagaatcagatataaatcatttattggataaaattcttaaggttgatcttgcttttgcaagagctgcatatgctcaatggatgaatggggtatgtcccattttcagcttaggtaattttgaaggccgtgattccgttgaagatgatgatgataccttggtcacacaagaggatgacgatttaacagtagacattgttggtatacgacatccattactcctggagtcctctctagagaacatttcagacaatcttacactaagatctggaaatgctgctgagtttggtaatggaaatggaacaatggcttctaaatatatgccacaaggcatatcagacttccctgtgccagttgattttaaaattggacatggaactcgcgtggtggtgatctcaggtcctaatactggagggaaaactgcttccatgaaaacattgggcctggcatcacttatgtcaaaggctgggatgcatttgcctgccaagaaaaatccaaaacttccttggtttgaccttatccttgcagatattggagatcaccagtcccttgaacaaaatctctcaacttttagcgggcacatatcacgtatttgtaagattttggaagtggcctcaacacaatcacttgttctcattgatgaaattggtggtggaactgatccttcagaaggtgttgctctttctgccagtatcttacaatatttgaaggatcgtgttaacttggctgttgtaaccactcattatgctgatctgagtagtatgaaggaaaaggatacccgttttgacaatgcagcaatggaattttcacttgaaacattacaaccaacttatagaatcctttggggatgtactggtgattcaaatgcgttaagcatagcacaatctattggctttgatagaaatataattgatcgtgcacaaaaatgggtagaaaagtttaaaccagaacagcagcaagagcggagaggaatgctctatcagtcactacaggaggaaagaaaccagttaaaggctcaggctgaaaaggctgcatctgttcacgcagaaattatgagtgtgtacaatgagatccaaggggaggcagaagaccttgatcaacgtgagatggaacttatggcaaaggaaacacaacaggttcaacacgagctagagcatgcaaaatctcagatagaaactgtgatacagaaatttgagaagcaactcagaatttctggtcgtgatcaactcaattatcttattagagaatctgaatctgcaattgcctccattgtaaaagctcatactcctgctgatagttttcccatcaatgaagctgatcgtgctttgtatactccacaaattggagagcaagtccatgtaaagggattggggggtaaattggctactgtggtagaatcgcctggcgacgatggaacaatcatggtacagtatggtaaagtgaaagttcgtgttaagaaaagtaacatcatagctattccatctagtagaaagaatgctgtaactagttcttcttccacacatcaggggaggcagagtttgcggaatggagaatacagggataatgtagacaacaaaaccaacgatgatatttcttatggtccagtggtgcgtacatctaagaatactgtggacctacgaggtatgcgagtagaagaagcttctatccaacttgagatggcaattaatgcgagtcggccatattcggttctctttgttatacatgggatgggcactggtgctgttaaggagcgtgcacttcagattctgcaaaaccacccacgtgttaccaattttgaaccagaaagtccaatgaattatggtagtactattgcttatgtcaattgccaccatgcgtttaccgccgtcgccgcaatttgtgccaaggagcgctccggcgtccacgctgtggaggaagccgtcaagagcgtcatcggctctgtctacgaaaagttccacctcgttcctgacgagctcgtccgcatcgccaaccgcaaccccgacctctccggcgccgctgtgcaccggcctaccccgcctcccaagaccaccgcctttggcattgccggagccgtttacgccgagtgcgagctggcggcgaaggagctgtacgagaggtacgagggcaaggcggagcaatgcgcggtggcagcggctgttccctcgggtgccgaaggcggcatattggacggagaagtacaacaagaaagttgcggcagcggcggagaaaggttgtag

SEQ ID NO: 85678 - DNA, 654 bp, Glycine max
  Peptide Sequence Number=SeqID_202456
agggctgacaccctcacctttagagggctacatgtcctcgccttcagaggactgcacctcttcgccttcagaaggctatacgtcctcgccttcaaagggcagcacatcctccccttaagagggctacacgtcctcaccttaagagggctgcatgtcctcccctttagagggctacacgtcctcgccttcagagggctgcacgctctcgcctttagaggacttcatgtccttgccttcagagggctatacgcccttgccttcagagggctacatgccctcgcctttagaggactacacgtcctcgccttcagaggactgcacgtcctcaccttcaaaggactacacgtcctcaccttcaaaggactgagcgtccttgccttcaaagggctgcacgtcctcgccttcagatggcttcacatcttcgccttcagaggactgcacatcctcgccttcaggggactacacgtcttcgcctttagagggcttcacgtcctcgccttcaaagggctacacgtcctctccttcagaggactacacatcctcgccttcgaggactgtatgccctcgccttcagtgagctacacatcctcgctttcagagggctccatatctgcgccttcagggaactcaaggtcctctacccttagtgcataa

SEQ ID NO: 85679 - DNA, 288 bp, Glycine max
  Peptide Sequence Number=SeqID_202457
atggcagtcacagcatgggtttctccctcatcctcaccctctttatttgccccagtttttctcagtcatcctagtaggatgatcaaatttgcctcttttcggacccacattgatcctttcactggcgaagaccaaatctgcaaagctttgagggtgcgcagcccaccatcttttcatagtagggtaatcgataatgtgtctaccatcacgattatcgtctccctttccattattgggggtaccacctgggccgccaagatccctccaccttttgggcgtgttctttga

SEQ ID NO: 85680 - DNA, 564 bp, Glycine max
  Peptide Sequence Number=SeqID_202458
atggaggccatgaaagagcaaatgaccacaatgatggaagccataatgagtattagaaaaatgatggaggtcaacaaggctatagccgttgccataggaaccgccactgaggttgacccgactcacccatctagcctcaatcaagtaaattatccagtctcggatatggtagggcagggaggcgaagcattaggaagtacgggcgacctccattttatgcaagttcagaacaagcattccttcccaccatatggcttgcctcctaactatacaccacccaatgttgcacacgctcccgatgagaatgtcaataactccactcctatactcattgagacccaacaaccccaatctggtcaggcacaggtccctcaacccacagaggaggcacatgaggcaccccgagaccacaatctagcaaactttgagcctcacctcaaatacgccgctgaggggcaggcattttgtggcgtacccctgccctcagtatcgcccacaaccataactcttgcattttgtggtgggaagagtccctccttctatgttggaaaggggaaaatttga

SEQ ID NO: 85681 - DNA, 510 bp, Glycine max
  Peptide Sequence Number=SeqID_202459
atggagagggagatgataacagtgatagtagacacgctaccagtgttctactataagaagatggtgggttacacaccttcaggctttgccgatttagttttcgtcgacgaaaggattgaaatgggtctgagaagagacaaatttgattatcttgctttgatgaataggaagcctgggggaaatggagagaataagaaggaggaaggaacccatgctgtgactgccattcctacatggccaaatttcccaccagctcaacaatatcatactcagccaatatcagcccttctcattacccactatcacaccctaatttcattcggggatgatcattggccaacatttggattcttgctggccaaattaagctgcttaacgttaattgtcacacaatccgtaggctcgcctgggcaagcaagttacttctggaggaagcaagcagctcaccggggcaagctgagctcgcctgggcgagctgctgtgcaacctcctcccctcattttcctataa

SEQ ID NO: 85682 - DNA, 786 bp, Glycine max
  Peptide Sequence Number=SeqID_202460
atggccttagagcactacctttcgcaggaatggaaaaccagccccagcccgagcccgagccccatgacagtgacagaaaaccttgatgggtgttttgattgcaacatctgcttagattttgcacatgaaccagtggtcaccctttgtggccacctatactgctggccctgcatctacaagtggctccatgtccaaagtgcttctcttgcaccagatgagcaccctcaatgccctgtttgcaaggatgacatatgccacaccacaatggttcctctctatggccgtggccagggcatagctcatagtgaccgtgatggaaaggcatcatcctatagaggcagttttataccaccaagaccacctgctttgggtgctcaatctctcatgtcaacatcatctcaaagtgctcaacaacttccatatcgcaacccttatcagaatcagcatttcaaccctcctttgtaccaagatgaggatgaatcatcatcacaaatgctgaatcctggtgccaacatggtggcaccaggattccccaccttgtggttgggatgtttggagagatgctttatgccagagtctttggcaactcagaaaatttatacaactatccaaattcttatcacctggggggaaaaatcaaatgtctctcatgcaagtcgtggtggtagttttgttgtgatatttgatattgcagataaatgtaaccgcaattacgttgctgttaaatacgcagttgcagacggattgagtgaaaaatcttttcctttgaagatattaagggaatag

SEQ ID NO: 85683 - DNA, 1076 bp, Glycine max
  Peptide Sequence Number=SeqID_202461
atggcgagtcggttcgggttatcgtcttcgtcttcctctgcgtccagcatgagagttaccaacacgcccgcgagcgacctcgccctcaccaacctcgccttctatactgctcatgacaccataggcagcggtcagattgcgttgaatgccgttcaacgccggtgtgccaaagtttcttccggtgattccgtacaagtgagccgatttgtgccgcctgaagatttcaacctcgcactgctaactcttgaattggaatttgttaaaaaggggagtaagagtgagcagattgatgctgttctactggctaagcaacttcgtaagagatttatgaaccaggttatgactgtggggcagaaagtattatttgagtatcacggaaataattatagctttactgtcagtaatgctgctgttgagggccaagaaaagtctaattctcttgaaagagggatgatttcagatgacacatacattgtttttgaaacatcacgtgatagtggaattaagattgtcaatcaacgagagggtgccactagcaacattttcaagcagaaagaatttaaccttcagtcactgggtattggtggcctgagtgcagaatttgcagatatatttcgaagagcttttgcctctcgtgttttcccaccccatgtgacatctaaattaggaatcaagcatgtgaagggcatgcttctttatgggcctcctggaactggaaagacacttatggcacgccaaattggaaaaattttgaatgggaaggaacccaagattgtaaatggccctgaagttttgagcaaatttgttggtgaaactgaaaagaatgtgagagacctttttgctgatgctgaacaggatcagaggacccgaggggatgaaagtgatttgcatgttataatctttgatgaaattgatgctatttgcaagtcaagaggttcaactcgagatggtactggagttcatgatagtattgtaaatcagcttcttactaagatagatggtgtggagtcactaaataatgttttacttattggaatgactaacagaaaggacatgcttgatgaagctctcttaag

SEQ ID NO: 85684 - DNA, 294 bp, Glycine max
  Peptide Sequence Number=SeqID_202462
atgacacaggggcttggtgttgtttggaacaaggaagaaggctttgttgaagatgattttgttgtggactttctaggagagaatgctctcttagcaagcattgctgaaaatgagaagcaaactgaaatggctgctagggtttcaacatggaaacaaagaattgagaacaacttggaagaacaggaatcacatccaccatttgatatccaagactatggtgagagagttcttcacaagttcttcgtgctttcccttgaagcaagcagtagtggtgtcctatccttttctaatttg

SEQ ID NO: 85685 - DNA, 471 bp, Glycine max
  Peptide Sequence Number=SeqID_202463
atgggagacgaaaatcattgcaagatattagatcacatcttacatgtaagggtatcagtcctacttatacaaaatggttatggcaaggtgaattacctcaaatgtcaacagtcccttcgattgaggcaagctcaggcacccttgtataaaaaattagaaaataattctgtgaagcccttgtatttgggatgcacaaccttcacacggttatcgagggtgttagctttggtgaacttgaaggaaaggtttgggtggagtgacaaaagcttcactgaattgcttgtgttattgaagaatatgcttcctgaagacaacatgttacccaagaatcattacgaggtgaagaagattttatgtcttgtggatgatgaaaaaaccttacatggcatgcacatggcagaaaaaatgatggattgctccgtcatcccgcagattctccccaatggaagacaattgatcggttgtatctag

SEQ ID NO: 85686 - DNA, 789 bp, Glycine max
  Peptide Sequence Number=SeqID_202464
atgatttgtcaacgtggaagttttgaaattagggaacataacatagccattcgagcgcgcgcaaacgcggaatcatcaacgcttgagtttctctcaactcagaaattgtgtcttcactcttcacttagctacgaagcgttcgcaatgtctgcaagcaaatccggttcaagaaagcgagcatccgaattcgaacgcgcaaaatctgacaagaacaagcgatcagccacggataacttcgatctcgatttggatttcgatctctcagatgacatcaaaggaatcgtctcggcgctgcaccttatcagagacaaggctcagaaggacggtcagaagaagaacgaagagactatttccagtgtgggttctgaggttaagtctatgatcgagggattgaagtcaaaaattgagaaggacaggcaaagctttgctaaggcgctttcaaagagttccaaagagtatgaaagttcattgaagaatgaaactgccaagtttcaagcatttcatgagaatttttgcaaagagaaagccacttctctgcaagccctgaaagatattatctccaaatttgaagaggaaaaggaaaagctatttgtgagatatgaacaactgaggaagaaggaaagagttatgatatctgaacaagaaaaagcctgcaatcataaaattgcccaactggaagactcgttgagaaagaagaaacaggatgataaaactttcagcattctaaggaaaactcttggttcattcttggaaagtacctcggacgaggatttccctccagatgattga

SEQ ID NO: 85687 - DNA, 1194 bp, Glycine max
  Peptide Sequence Number=SeqID_202465
atgaatgagtcaacaataagtaacaaaaaaagatactaccattggctcataatagccatccattcttcacttgtgttggtgtgtgcatcagcaacaataatcctcagaagattgtactatgaaaagggtggaaaaagcaaatggatgggaacacttgttcaacttgctggtttcccaattcagcttcctgtttacttctttttagcacccaaaaatctcaccacaaataatagcattcatccaaaacaaccatcagtttcaatgctatcatttatctatgtctcaattggcctactcgtggcattagatcgttatttatattcagttggactatggtaccttcctgtttctacctattcactcatttgctcatcccagttggctttcaatgctttcttctcctacttcctcaactcactcaagttcacaccttacataatcaactctctagtccttctcaccatttcctcaacccttcttgtgtatcaaaatgagtcatcattagatgatgatgatgattcagattccacaaaaatctccaagaaaaagtatgtgattggattcatatgcacaattggtgcatttgcagggtatggactatggctttccattacacaacttgtgttcaagaaggtcataaaaagagaaactttcaaagtggtcttggatatgatatcatacccttcccttgtagctacccttgttaccttagtaagactttttgctagtggagagtggagtggtttgaaagatgaaatgaaggggtatgagatgcgaaaggcttcatatttgttgaaccacactttcactgccatactttggcaagtctttactattggttgcttggggcttattcgtgctcggtccctgttcatcaagaacctaaatttcaagactatggatgaaagtctgaggaaacatttaactgaacacatgaaaaagggaagcattttgagtgtcaagatgaagaagcatttgaaaaatgggaaaaatgtttctatggggtttggatttgttgagtttgactcccctgaaactgctacaaatgtttgcaaagatttacaggggccagttttggacagccatgctcttattttacaaccttgtaatgtcaagaatgatgggcaaaaacaaaagacaattgagaaggatatgagtttaacaaaattgctcataaaaaaatgttgcttttga

SEQ ID NO: 85688 - DNA, 487 bp, Glycine max
  Peptide Sequence Number=SeqID_202466
atgacgataatggtcatggcggcgaagatggtgctagttaatgacggtaatggtggcggcgacaatcatagtagctgcaatgacgatgacaacgacgacaacgaagatcatggtgattttgaaagaatgatgatgagggacatgaagggtagagtacttttccttgtggcattgctgatgtttctgttggcatcagaggtgttgattttggaggctgagggtgctggaggagaatgtggaaagacccctatagggtctgcagctgctagcctaagcccatgcttgggtgcagttagcaatgtgaaggcaaaggttccattggcttgttgtgcaagagttggtgctttgctcaagactgctccaaggtgcctctgtgctgttctcttgtcacctctggccaagcaagctaagatcaaccctgccacagccatcaccattccaaagagatgcaatatcaggaaccgacctgctgggaagaaatgtggaa

SEQ ID NO: 85689 - DNA, 483 bp, Glycine max
  Peptide Sequence Number=SeqID_202467
atggccaagaccaagagactcctcacactttttctaaggttccttgccattggagcaactatagcagcagtgatcgttatggtgacaagccatgaatctactgaggtcttcaacctaaccttcactgccaaatatagcaacgatccagcattcaagtactttgtggtagcagaagccatagcatgtggatacagcctaattctcctcttcacatgttcccaaacttcacttgggcgtttggttctgatccttgatgtggtgatagcaatgctactcacttcaagcgtgtcagcagcactagcaatagctcatgttggcaagaaaggcaacactcatgctggttggcttccaatttgtggacaagttcctaaattttgtgaccatgtcactggagctcttgttgctggtttcgctgcagctataatatacttaatacttattttttgtcctctttactctgctcagagccccctctatctgtga

SEQ ID NO: 85690 - DNA, 216 bp, Glycine max
  Peptide Sequence Number=SeqID_202468
atgaatgggaagattggcttctttgttattaaagttagtttggctaaagcttatgataggcttcgatgggcctttgtggagaaagtgatggttgaggtaggtttaccacctagtatggctttctcatctaattattcaacaagaggatggtggttggatccctatgaaggtggggaggaatgggtcgagaatatcccatttgatgttcacgaatga

SEQ ID NO: 85691 - DNA, 177 bp, Glycine max
  Peptide Sequence Number=SeqID_202469
atgtctattcctgtgcctaagggaatcattgaggatattcagaaggtgcaatgttcctttgtatcggggaatcaacctaggcgtaggagagttcatgcagtgaattggggtgaaggatttggtggtggaggggatcaattggaacatggatttattattgacaattcttcccattaa

SEQ ID NO: 85692 - DNA, 243 bp, Glycine max
  Peptide Sequence Number=SeqID_202470
atggtgactcataatagtacaacctttactcccaaaaccttggaggctatggtcttcttgttgacgaactcagcacgtcgccagaagacccactttttcaagttcttggatgtcgaaaaagtattctacatgaatggaaggctcattatcattgtatatgctagaattttccaaggttgggatggtttcagtgacgggggtgtttgcaagggccatttgagagggagaaagtctaaggtttga

SEQ ID NO: 85693 - DNA, 543 bp, Glycine max
  Peptide Sequence Number=SeqID_202471
atggctggctccaagacaaccctctttgacgtccataagttcgtactatttcacttgatggagaatctgccatttgaccttccacacaccatatatatcaacattattaagaacctcaagggcttaggttctctagaggacatctactatgttgccctcatcaaaaagcttctaagggatcaaggagtctattatgtgttcaacaatatggaagaggattacaagtatactttactagttaaaggttcagtggttgctaaaaaacaaaagtttagcaaaactaacctgaagtctatgaaagtggccttggaacaaactttgaatgaggctctagaagtggacgtggatgccatcaatgagcaccttggtctggatagctttggaattacaagaaaaattaagaagatcatggttgagcagcaaaagaagaagaaaactagaaaacaatcccaaagatatgaagaagaggaagagcttttggccaaggaacacaagaccaagataaaaaagatgatggaactcataaaccaagaaggggggtga

SEQ ID NO: 85694 - DNA, 300 bp, Glycine max
  Peptide Sequence Number=SeqID_202472
atgccggattactatgaatgtaggccagaggaaaacattgttcatccattaatggctccattggagatgccattccaaaacctatcaaggtgtaacagagatggaggtggacgtggttgtggagttgaatgtagacttatagagtggcgtgaggaagaatggacacatgtgcgggtgtatcagcagcaacaactttccttttttggatggccacttgtaagaacccttcattatcatcatcagacttactttggtctttcaccctttgtgcgacaagatttaatgtgggtggacacttag

SEQ ID NO: 85695 - DNA, 231 bp, Glycine max
  Peptide Sequence Number=SeqID_202473
atggtcaatggaatgccccggaactcccccatgataagcacatgtcatgttggggttgtatcctatgggaaatggaggttgagaaaggtggcctttgtggatgattgggcgttcttggttatagggtggtgggtgtcgcaacctgcccttcgacgggaggacgatgcgaggctcacgggagcgtcttccaaagaaggaaaacgcgcggagtcgccaccaacgtttatttga

SEQ ID NO: 85696 - DNA, 411 bp, Glycine max
  Peptide Sequence Number=SeqID_202474
atgagaggagaagattgcacaggagctcgctcaggcgagctgcttgcttcctccaaaagtaacttgctcgcccaggtgagctgcaatcccgccgcccgattgaccactagcgaaagcccaatcagcgaaacctgtcaaaagaaagggcataagaggcatcaggtatatcaacataagaccttcaagtcttgcaaagtaagggagacatttgaagtctcgatgaaagactctgatagtcttagaaaagataaagagcggaagacactgattgtctctgcatgccaatggactcgcttgtctctggaaggcaaaggagactgtaatagtctcgaaaaaatgaaagcggatgaccatgattgtctctgcatgccaacagattcgcttgtcttcggaaggcaaatgagactttaa

SEQ ID NO: 85697 - DNA, 846 bp, Glycine max
  Peptide Sequence Number=SeqID_202475
atgcgttttgactatgaagacacttcatctgaagcctttaaggctttaccatcagatgctataatccatttgcctcctccaacttggactcgtccatttcgaccatctattgtcaagattcctcctcattggctagcatttgcaactcaacaactggttcgaccctccactgagatgacaccctctcaaggacgcttcgcaagaagtggaacctcccaaggttcaattcaaaaagaagtgcaacctgcaaacgtccaactctctaatgaagatcgctcaaaaagaaaggacttaagttgtatcactaggcacacataccttctgtcgaaacctacccttcggcaggagggcgacgcgagactcgatggtgcatcttccaacaaaggaaaacacgcagggtcaccacggaaaacattagaaaaactaaaaaaggcaaaagaaaaacaaggcatttgggatgaaggtagctcgcccaggcgagttggttacttcatcatgaagttattttggtggcccaagtactccttcatccaacgccttcttcaacatccctccattccatataggggaacttggaacttgaggccaattgatgttgtcgttgttgctgagaaagttgcgagagaagctgctgagaacgaagctgccactgctgttcaagttgaggcatctgtcaaagttgtggacaacactgttgtgcatggggtctttattgaccttacaaatattggtgtcatgggtgaaactagcaaagggtctaatgtagctatggctgatgaagttgaaccactcattccagattctgtgtccaagcagtctacaacttcaaatgaagccacttcttga

SEQ ID NO: 85698 - DNA, 363 bp, Glycine max
  Peptide Sequence Number=SeqID_202476
atggaggaattttggagcatgatttgtggggattctgtttgttctgaggctaaaacattcaaggatgaggacatcccaaagttgccggagtcggatcaagcagagagctgctatttatttgtcttttgtagatcaattgagcaggcagaaaaaaaaggaaccattgtcacaaaaattgtatttgtgggcaataattctgtgacatcggagagagattttgatgtcaggactttttgctttgctcaagtgatggttctcgcagtgctttgcaatactccattggcaaagttacagcataagtttctgaccaaacttttggtagtacaagatgagagatcaaggctggttcggaggctctactga

SEQ ID NO: 85699 - DNA, 207 bp, Glycine max
  Peptide Sequence Number=SeqID_202477
atggaggccagtgtctcatcctctattggcctctcttctcccaaacatcatgaaatctcaatctcaatctcaaccctcaccgacgccattggatgtggtgaagacggccactgtgaagcaggtgctgcataccgcatgctttttggccttgcgattttattcgggttggctgagagggaaactctagtgtctgtttccactggctga

SEQ ID NO: 85700 - DNA, 1368 bp, Glycine max
  Peptide Sequence Number=SeqID_202478
atggttctccaaacttcatctctagggtttatagtgaggaggcacccaccagagctagtagccccagccaaccccactccccatgaagttaagctattatctgacatagatgaccaaaatggccttcgttaccaacttccactggtgctattctttccttaccagccttcaatggaagggaaagaccctgttgaagtcattagagaagcactatccaaaacacttgtgttttactatcccttcgcgggaaggcttagggagggtcctgatggcaaactaatggtggattgtaatggagaaggtgtcatgttcattgaggctgatgcagatgtgacaattgagcagtttggtaataattttatgcctccattcccttgctttgatgagctcctctacaatgttcctggttcagatggaatgattgacaccccactgctgcttatacaggtaacacgtctcaagtgtggtggtttcatctttgcactccgaatgaatcatactatgtgtgatggaagtggaatttgccaatttctgaaggcgttatcagagatagcacatggtgcaccaaagccttctattctccctggctggcacagggagattctatgtgcaagagaaccaccaagaatcacatgcatccatcaagaataccaacaactaccacctgattcaagaagcatcttcataccccatcaacgttccttcttctttggccccaaagagatagcttcactccgtgctcttcttccccaccaccttgccaccaaatccacctcctttgaagtcatcacagcatgcctctggcgctgccggaccgcatcactaaaatggcaaaaccctaatcaagaggttcgcttgttgtgcattgttaatgcacgctttggaaactgtaggttcaaccctccattgcctgatggtttttacggcaacgctttcgtgtttccggcggcggttaccacagtagggaagcttctgggtcgctccttagggtatgcagtggagctagtgaagaaggcaaaggatgaagcagatgaggagtatgtgcactctgtggctgacctaatggctatcaaaggaagaccttgctttactaagttagggtcttttatggtatctgatctcacaaaatctgggttaatagatgttaaccttggatggggtaaggctttgtattctggggtagctaagggtggtcttggtgatattcctggggtgagcttctatgtgccctacaccaactccaaaggagagagaggcagagtcattccaatttgccttcctgaagatgccatggagaggtttgagaaagagttgcatgacactctcatgatcaagaataacattccaatgttaatgtccagtctctaa

SEQ ID NO: 85701 - DNA, 228 bp, Glycine max
  Peptide Sequence Number=SeqID_202479
atgtggaagcaggaaaaggcaaatgacgaaaaagagtttacattcaaagacggttatttgctaataaccgtctttgaactgtgtgtcagaatagacattcaaagacggttattgcaagattctgtccatttactagtgcaggcgcctccaaccccatcacaacacttgcatacaactccaagcgttgcaaaaatctttgagtaccctgcaattacatcacatatataa

SEQ ID NO: 85702 - DNA, 207 bp, Glycine max
  Peptide Sequence Number=SeqID_202480
atgtcccgccaggagaaatggcgatatgcactgtgtacacgttttctcactcctactcagcctatcccgccagaaggaatggcggtaccccttgcctgtcccgctgctgcgactggcggtacccactatcccgccattggcactggcggttcaagcttcccgccagtgtcaatggtggcacccatgttcaaatatacccaaccttaa

SEQ ID NO: 85703 - DNA, 1941 bp, Glycine max
  Peptide Sequence Number=SeqID_202481
atgaagtacgtgctggtgactggtggagttgttagtggccttggcaaaggtgttactgccagcagtattggtttgcttctcaaagcttgtggacttagagtcactgccattaaaattgatccttacttaaacacagatgcgggaacaatgtccccctttgagcatggagaagtgtttgtgttggatgatggtggtgagaaacctgacccctctttctgttcaaaggtggacctggatcttggaaactatgagcgttttatagacatcaagttgacccgtgataacaacataactactgggaagatttaccaggcaagttgtttatgtttagactttagagttatgacgcagattttgaagatcattacaaaatttttcactaaatctgtcattgacaaagaaagaaaaggagactatttaggaaaaactgttcaggtcgtgcctcatatcactgatgctattcaagattggattgaaagagtggcccacataccggtagatggaatgatcggtccagctgatgtatgtgtcgtagaattgggtggaaccataggagatattgagtccatgccatttattcaggcattaggacaattctcatacagagtaggtgctggcaacttttgcttagttcatgtcagccttgttcctgttttgaatgttgttggtgaacagaaaacaaaagcaacccagcatagtgttcgtgcactgcgtggccaagggctgactccacatatcttagcatgccgtagcactatggtactggatgagaatgcaaagggaaaactctctcaattttgcctaattccggcagaaaatattgttactctttatgatgttcccaacatctggcacattcctttgcttttaagagatcagaaggctcacgaagcaatgtttaaagtgctgaaccttcatggtgtagctaaagagcccaatttagaggaatggacttgcagagctgaatctagtgatttgctttatgaaccagttcgtatagccttagtagggaaatatacgtgcctttcagattcctacctctccattctaaaggccttactgcatgcttctgttgattgccaaaagaaacttgttgtggactggattccagctagcaatcttgaaactgcaactgcaaaagggaatcatgatgcttataaggctgcttggaagttattgaagggtgctgatggtgttcttgttcctggagggtttggggatagaggagtgcaaggaaaaattattgcagctaaatatgcccgcgaaaacaggattccattccttggtatttgtcttggaatgcagattgctgtcatagagtttgctcgatctgttcttggtgtacaagatgctaacagcactgaatttgagccccataccaaaagcccatacatcatatttatgcctgagggatcaaaaacacacatgggaggcaccatgcgccttggatctaggaggacatatttccagaccaaggaatgcaaatctgcaaaattatatggctgcaaaagcttcattgatgagagacatcggcatagatatgaggtatttcattgtgatgcacaaaattatcttgtgaatgtgaatccggatttagtagcctgccttgaaaatgctggtctttcttttactggaaaggatgaaacaggtcaacgcatggagattcttgaactacctaaccatccttattttattggtgctcaattccatcctgaatttaaatcaagaccaggaaaaccttctcctttgttcttagggttcattggagcagcatgtggacaattggatgctgtcttacagcgctcttcaattgttgataacagtctctcaaaaggagtagatatctctccagtgaaaacataccgaactagaaccacgacaaagacagcttataggactgctgaatatgtatatggaagttgcaatggattgcatttctaa

SEQ ID NO: 85704 - DNA, 1551 bp, Glycine max
  Peptide Sequence Number=SeqID_202482
atggcttccttcaagattctcttcctcttcatccttcttagcttcctcaattttgcaactactgaggcacaggatcaaagctccacccctgtcgagttatcccatgcctgctacgttggcaactctatcgctagcagtgccttccaaataaacgttaggaccctcctctcttccttatcaacaaacgcccccggcgacaacggattctacaacaccacagtccctgcactaaacccttctgactctgtctttggactcttcatgtgcaggggtgacgttcctcctcagctttgtcaacaatgcgtccaatatgcaacccatatactacgctcacagtgctcactgtccattgaacctgtgatttggtacgatgagtgcacggttcgttattccaaccgctccttcttctccaccgtggacactaggcctgcacttgccttcacgaacgctacaaatatctcaaaccaggaaagtttcatgcgttcaatgttttctgtaatgaacataactgcagatgatgctgctgcggatgacaagaagtttgccacgaggcaaaaaaccatatctgaatttcagagcctttattgtcttgctcagtgcactccagatttgtcactccttgattgcagaagctgtctcagtaaagttataggagacctttcatggtgctgtgaaggaaagcagggagcgagtgttctataccccagttgtaatattaggtatgaattgtaccctttctaccgctccacaaatacaactataccaccagcgtgggttcctgcaacaaattttcccgatcaggattcacaaatttcagaagatccaacttatctaaaccacagttgcccaaccaatgtaactgctgacagcactttccaaatttatctcagtaaccttctctcttacttagcttccaatgccacaaatgggaagaaatattacaaggacaacgtagaaactgtgtatggcctcttcatgtgccgaggcgatcttccctctcaactctgccaacaatgcgtcctcaacgcaacccaccgaatatcctcagtttgcaattcacttcaagagggaatcatttggtacagccactgcatgcttcgatattccaatcggaatttcttctcagaagtggaagaaagtccaaattttgacatgctgaatcttaccagttcctccaccagcatcatccccgggcaagactacttcacttttacattatcagataccatagttaagctggccaaagacgcaggggatgccgctgacaaatacgttaccaaatcattaaaattgactggttcgcaaactctgtatactcttgttcaatgcacgcaggatttgtctagtgagggttgtcggacctgtctgaaagatataaatggaaaaattccatggttccgcttgggaagcgtagggggaagagttctatatccgagctgcaatctcaggtttgaattgttcccattttacaggggtagaggtgaagaaactccgtcgccaatggcgggtaatccttctacaccaggccttcaaggtaaagttgacaagtaa

SEQ ID NO: 85705 - DNA, 528 bp, Glycine max
  Peptide Sequence Number=SeqID_202483
atggctagaggaaagatccaaatcaagaggatagagaacaccaccaagaaggccaacgagctcactgttctctgcgatgccaaggtttctattattatgttctccagcactggaaaactccacaagatcgagcaatcaacaaagcagttcttcgatcaataccagatgactctaggagttgatatttggaactctcattacgagaatatgcaagagaacttgaagaaactgaaagaggtgaataggaatcttcgtaaggagtttaggtatatatatctttcatcacttcgatcgatctctttgagaatgggagattgtctgaatgagctgggcatggaagatctcaggctccttgaggaaggaatggacaaggccgccaaggttgttcgtgagcgtaagcttagagaactagtactacaggatattggtacttatgacttgccagttgaagaatgccactattgctgtcgatgccttgtctgtatgatgctgtggaatttttttcatgcgggtccacttgttacatga

SEQ ID NO: 85706 - DNA, 243 bp, Glycine max
  Peptide Sequence Number=SeqID_202484
atggttggagcattctcgcaaaacatcgtgaccctgactggtctccctatgatcttacttagtgagagtcacctgacaaacttattgtgtgctaggaatgtgataactcactccctgtgtgtggttgtgtttggatcctgtgatgatcttgaacttgtgtctgggagagcagaaaataggtggatgactatgaagaatctcatgctagaggacacgggaacacaacgctctgataggatgtga

SEQ ID NO: 85707 - DNA, 237 bp, Glycine max
  Peptide Sequence Number=SeqID_202485
atgttgactgttttgcagagaaaagcaagaaagagtcttaaaagtattcttagagacaattttggtgatgaaagtgtcactttagagccattgcaatttagtttggctgtaattgaagcagcaaccaacaacttttcaaatgataataggattggcaaaggcgggtttggagaagtttacaagggcaatctttctgatggacgacaaatagctgtaaaaaaactcaaaaagttctaa

SEQ ID NO: 85708 - DNA, 1164 bp, Glycine max
  Peptide Sequence Number=SeqID_202486
atggcttcccacaagattctcttcctcttcatccttcttggcttcctcaattttgcaactactgagccacaggatcaaagctccacccctttctatttatcccatgcctgcaacgttgacaactctatcgctaacagtgccttccaatttaacgtcaggaccctcctctcttccttgtcatcaaacgcccccggcgacaacggattctacaacaccacagtcccttcacaaaaccccacagactctgtctttggactcttcatgtgcagggatgaagctgctaaggatgacaagaagtttgccacaaggcaaacaaccatatctgaatttcagaacctttattgtctagctcagtgcactccagatttgtcaccccttgattgcagaagctgtctcagtaaagtgataggaaaccttccattgttctgtgaaggacagcagggagcgagagttctatatcccagttgtaatgttaggtatgatttgtaccctttctaccgctccacaaaaagaactaaaccaccagcgtgggttcctgcaacaaattatcctgatgcagattcacaaatttcagaagatccaacttatctaaaccacagttgcccaaccaatgtaactgttgacaccactttccaaatgtatctcaagacccttctcttttacttgtcttccaatgccacaaatgggaagaaatactacgaggacaacgtagagcaaactgtgtatggcctcttcatgtgccgaggcgatcttccctctcaactctgccaacaatgcgtcctcaacgcaacccagcgaatatcctcagtttgcaattcagttcaagagggaatcatttggtacagccactgcatgcttcgatattccaattggaatttcttctcggagttggaagaaagtccaaaaactgacattctgagcgttaccattccctccaccggccccatccctgagcaagacttcttcaattatacaatatcaaataccatagttaagctggcggaagaggcagggaataacactgagagatatgcaaccaaatcattaaaattgactgattttcaaactctgtatactcttgctcaatgcacgcaggatttgtctagtgatgattgtcagaaatgtctggaagatataaatagaaatattccatggttccgctag

SEQ ID NO: 85709 - DNA, 354 bp, Glycine max
  Peptide Sequence Number=SeqID_202487
atgggagattgcttggaggatattattggtgaccttggacaagagtcttttcagcaagcacatgcccctatgtatgatacattacaaagtgattcaaagaagcctttgtatccagggtgcaacaatttgttgacgctgttgttggtggtgttaagtctggttaatgtgaaggccaaatatgggtggagtgacaaaagctttagttcactggagtctccaagaagaattggcttagcgagcaggctcgctaagcccaattccacaaattttcaaaacagagaaggatttgcgcttagcgcggcaaggcgcaactactctactaaacagcactggcttagcgagcaagctcgctaa

SEQ ID NO: 85710 - DNA, 1626 bp, Glycine max
  Peptide Sequence Number=SeqID_202488
atggcttcctacaagattctcttcctcttcctctttgttagcttcctcaattttgcaactactgacgcacaggatgaaagatccaccgctctctttctatccctttactgctacgatggcaacactaccgctaacagtgccttccaatttaacgtcaggagcctcctctcttccttgtcatcaaacgcccccggcgacaacggattctacaacaccacagtccctgcactaaacccctctgtcttcggactcttcatgtgcaggggtgacgttcctcctcagctttgtcaacattgcgtccaaaatgcaacccagcaactaagctcactgtgctcactgtccattgaagctgtgatttggtacgatgagtgcacggttcgttattccaaccgctccttcttctccaccgtggacactaggcctgcacttgccttcacgaatgctacaaatatctcaaaccaggaaagtttcatgcgttcaatgttttctgtaatgaacataactgcagatgaagctgctaaggatgacaagaagtttgccacaaggcaaacaaccatatctgaatttcagagcctttattgtcttgctcagtgcactccagatttgtcaccccttgattgcagaagctgtctcagtaaagttataggagacctttcatggtgctgtgaaggaaagcagggagcgagtgttctataccccagttgtaatgttaggtatgaattgtaccctttctaccgctccacaaatacaactataccaccagcgtgggttcctgcaacaaattttcccgatgcagattcacaaatttcagaagatccaacttatctaaaccacagttgcccaaccaatgtaactgcttacagcactttccaaatttatctcagtaaccttctctcttacttagcttccaatgccacaaatgggaagaaatattacaaggacaacgtagaaactgtgtatggcctcttcatgtgccgaggcgatcttccctctcaactctgccaacaatgcgtcctgaacgcaacccaccgaatatcctcagtttgcaattcacttcaagagggaatcatttggtacagccactgcatgcttcgatattccaatcggaatttcttctcagaagtggaagaaagtccaaattttgacatgctgaatcttaccagttcctccaccagcatcatccccgggcaagactacttcacttttacattatcagataccatagttaagctggcgaaagacgcaggggatgccactgacaaaatacggggaagagttctatatccgagctgcaatctcaggtttgaattgttcccattttacgggggtagaggtgaagaaactccgtcgccaataccgggtagtggtgaagaaactccatcgccaatggcgggtaatccttctacaccaggccttcaagttggtcctgaaggtgtcactttagagccattgcaatttagtttggctgcaattgaagcagcaaccagcaacttttcaaatgataataggatcggcaaaggcgggtttggagaagtttacaagggcattctttttgatggacgacaaatagctgtaaaaagactctcaaaaagttctaagcaaggcgcaaatgagtttaagaatgag

SEQ ID NO: 85711 - DNA, 477 bp, Glycine max
  Peptide Sequence Number=SeqID_202489
atggttctccaaacttcgtctctagggtttatagtgaggaggcacccaccagagctagtagccccagccaaccccactccccgtgaagttaagctattatctgacatagatgaccaaaatggccttcgttaccaacttccactggtgctattctttccttaccagccttcaatggaagggaaagaccctgttgaagtcattagagaagcactatccaaaacacttgtgttttactatcccttcgcgggaaggcttagggagggtcctgatggcaaactaatggtggattgtaatggagaaggtgtcatgttcattgaggctgatgcagatgtgacaattgagcagtttggtaataattttatgcctccattcccttgctttgatgagctcctctacaatgttcctggttcagatggaatgattgacaccccactgctgcttatacaggttatcttagacatgcattttatacattga

SEQ ID NO: 85712 - DNA, 900 bp, Glycine max
  Peptide Sequence Number=SeqID_202490
atgccacctccaacaaacaatatctctcctctgtccttaactccaaaattctcaaatccatctccttcctctctttcgacttcatcttctccacccaatttgccacaacctatcaatcctccacctcgtcaatcaagtggacctagccaaccaccaccttatatttctgagtacaagtgtgatctccctcctcttaaattgacttgggatattgttcatacccctccttatgtttgtcccattggatgcaaatgggtttacaaaatcaagaggttacccaatggtagtgttgagtggtacaaagcccgcctcgttgcaaatggcttttctcaaattgaaggtgtgtactacttcaaaaccttctcccctgtggttaaaatgtcaacaatccgtgtagtccttgcccttgcctccatcaattgttggactcctcaacaattggatgtcaacaatgcgttcctccatggggacttatctgaagatgtttacatggtgatccctcctggactacatggattcagtccctctcagagttgcaaacttcacaaatctctctacaagttgaaacaggcaagtcgcaaatgcgtcaaacagatcctccgctctaattttctcattaaggatttggggacattgaaatattttttgggaattgaagtgacacattctgatcaagggatttctctatgccaaaggaagtattgtcttgaccttctcaaggattcaggcatgcttggatgcaaaccatcttctacacccatggatagtactcttcgacttcatgttgattcctccgtccttcttactgatccacttccatatcaaagactggttggtcgcttaatttacctcacaagcactaggcctgacatagtttttgccacacaacaattgagttag

SEQ ID NO: 85713 - DNA, 1554 bp, Glycine max
  Peptide Sequence Number=SeqID_202491
atggcttcctacaagattctcttcctcttcatccttcttagcttcctcaattttgcaactactgaggcacaagatcaaagctccacccctctctatatataccataactgctccggtggcaacaccaccgctaacagtgccttccaaataaacgtcaggaccctcctctcttccttatcttcaaacgcccccggcgacaacggattctacaacaccacagtccctccaaaaaacccctcagactctgtctttggactcttcatgtgcaggggtgacgttcctcctcagctttgtcaacaatgcgtccaaaatgcaacccagagactacgctcaatgtgctcactgtccattcaagctgtgatttggtacgatgagtgcacggttcgttattccaaccgctcctttttctccaccgtggacactaggcctagagttggcctgttgaacactgccaatatctctaaccaggaaagtttcatgcgtttaatgttttctacaataaacaaaactgcagatgaagctgctaaggatgacaagaagtttgccacaaggcaaacaaacatatctgaatttcagaacctttattgtctagctcagtgcactccagatttgtcaccccttgattgcagaagctgtctcagtaaagtgataggagacctttcatggtgctgtgaaggaaagcagggagggagagttctatatcccagttgtaatgttaggtatgaattgtaccctttctaccgctccacaaatagaactaaaccaccagcgtgggttcctgcaacaaattttcccgatgcggattcacaattttcagaagatccaacttatctaaaccacagttgcccaaccgatgtaactgttgacagcactttccaaatgtatctcaagacccttctcttttacttgtcttctaatgccacaaatgggaaaaaatcttacaaggacaacgtagagaacactgtgtatggcctcttcatgtgccgaggcgatcttccctctcaactctgccaacaatgcgtcctcaacgcaacccaccgaatatcctcagtgtgtaattcagttcaagagggaatcatttggtacagccactgcatgattcgatattccaatctgtatttcttctcagaagtggaagaaagtccaaattttgacatgctgaatcttaccagttcctccaccagcatcatccccgggcaagactacttcacttttacattatcagataccatagttaagctggcccaagaggcaggggataccactgagagatatgtcacgaaatcattaaaattgactgatttgcaaactctgtatactcttgctcaatgcacgcaggatttgtctagtgatggttgtaagaactgtctggaggatataaatggaaaaattccatggttccgcttgggaagcgtagggggaagagttttatatcctagctgcaatctcaggtttgaattgttccaattttacaggggtagtgatgaagaaactcaatcgccaatggcgggtaatccttctacaccaggccttcaaggtaaagttgacaagtaa

SEQ ID NO: 85714 - DNA, 291 bp, Glycine max
  Peptide Sequence Number=SeqID_202492
atgataaaggtcgttctttttttgttctgctttgcctctgcactgaccctttcagtatcggagtccaaatctgcttctgtgcaacctcatgcagctgaatctttctctgttggatatattcagatgaagactgcagcgaactgttcttacctggtagttatatctacgagttgttcatcgcctaagttcactacggataagattggtattacgtttggcgatgcttatggcaaccaggttttgcattttttccttcaatcaatttcactatttattgtggagtgtatttaa

SEQ ID NO: 85715 - DNA, 1119 bp, Glycine max
  Peptide Sequence Number=SeqID_202493
atgaagcatatgaatgccactcttcctcatactctccctgaggatttgatcacagaaattctgatgatgttgcctgtgagatcgatattgcgttttaaatacatgtgtaagtcatggttttctcttatttctcatccagaattcgctcgatcccactttgccctagctgcaacacccaccaccagactttttctgtcagccaactatcatcaagttgaatgcacagatatagaggcatcacttcatgatgataattctgccaaagtagtctttaactttcctcttccgtcaccccaagacaaatattataattgcgtgatagatatcgtgggttcatatagaggatttatactcttgttaaccagtggtgcctttgatttcatcatatggaatccttcaacgggtctccggaaaggagttagctatgtgatggatgatcatgtatataatttctatgttgatcgatgtggctttggatatgactcatcaactgatgactacgtgatagttaatttaagaattgaagggtggtgcacagaggtccattgtttctccctgagaaccaattcatggagtcgcattttgggtactgctctatattatcctcattattgtggacatggagtgttctttaatggagctcttcattggtttgttagaccctgtgatggtcgtcctcaagctgtgattatttcatttgatgtgacggaaaggggattatttgaaattccactgccacttaatttcgccgttgaagatgaaatatatgtcaaagatgaaatatataatttgagggtcatggaaggatgtctgtgtctctgtgttgttaaaatggggtgtggaactacaatttggatgatgaaagaatatcaagtgcagtcatcgtggaccaagttaattgttctaatttataatcagtgtcatccttttctacctgtcttttacccaatatgtttaaccaaaaacgatgagtttttgggatcaaatcataagacattagtgaaacttaataagaaaggtgatttgcttgagtatcacgcacgttgccacaacatgggcagtactattttagtacgctgtggtgtgtatagagagagtttgctatcactccctgagtaa

SEQ ID NO: 85716 - DNA, 1045 bp, Glycine max
  Peptide Sequence Number=SeqID_202494
atggctgtggatcttccctcacatcacttctcgcgccgaaacccacccttccattcgacgccgccctacgatctcgccgtttacctcaaaacgacgttgttaatttgttatggagttcactttgctgaagctgttgactatgctgagaagttgttcattaggtctgaaattaaccaaggttttcaaaaacagccggtgactttttggggactccgtgaccgcaattgtggccgcatccttatctcaacaatgtttataaggggtcttgttcaattttctgaaactgcaggacatgttagaggattttcaagctcgaattttgattggaggaatcttattgtgaacgagaatgtgaatgcagatgattctatgcaggatgcagagaacagaaactccgaaaagtggaataatatgaggctgaatatgaatgcagatgcaaaagctcctccaaattttgtgcagaatagagggaacataaactccagaagctggaacaatatgcgacagaatttgaatgctcctccaaattttatggggaatagagagaacataaactccagaagccagaataatctgggccagaatgtggatgcaaatgcagatgctcttccagattttatgcaagataaagagaacataaacatcggaagcaagaatgatgctgagactggctggaactctaggcctatggactttgtaagaggaattatagatgaagataattttatgaagggttctccctttcatcagtatcaatatgagcaggatgctgattttgttcatataaagatgttgcgtaataatacctttgttactgtaacagattctcaaggaaatataaaactcagtggctctgctggtccattgaaagacctgaaatcagggcaaaagctttctaggtatgcagccgaggcaactgcggaagttgttggccgaaaggctaggggtttgggattgaaatctgttgtcatgaaagtgaatggatttactcattttaggagaaaaaggaatgcaataatgagctggaaggagggctttactgctg

SEQ ID NO: 85717 - DNA, 1456 bp, Glycine max
  Peptide Sequence Number=SeqID_202495
atggaaggaaaagaaaggagaagaaaatctgcagaatacgaagcagtggtaagtgcaggcccgcacctgagacgcctccaacaagcccacgctcacctggtggtgacaggctgtcaccggagccgcgctctgctcacgaagctcctcacgctatcgtgcgccgcgggttccatcgcctacactcgccgcctcttccgttccgtttccgacccagattctttcctcttcaattccctcatcaaagcctcttcaaacttcggtttttccctcgacgccgttttcttctaccgtcgcatgctacactctcgcattgttccttccacttacaccttcacctccgtcatcaaggcctgcgccgatctttccctcctccgactcggcacgatcgttcattcccacgttttcgtttctgggtatgcctcaaattccttcgtccaagccgcattagtcacgttctacgcgaaatcgtgcacccctcgtgttgcccggaaggtattcgatgaaatgcctcagagaagtatcatagcttggaactccatgatttcggggtacgagcagaacgggcttgccagtgaggctgtggaggtttttaacaaaatgcgtgagtccgggggcgagccggattctgcgactttcgtttcagtgttatctgcttgctctcaactgggatcgcttgacttggggtgttggctgcatgagtgcattgttgggactggaattagaatgaacgtggttcttgctacctcgttggtgaacatgttttcacggtgtggtgacgtgggaagagcacgtgctgtttttgattcgatgaatgaagggaatgttgtttcatggacggctatgatatccggttacgggatgcatggctatggtgttgaggcaatggaggtttttcatcgaatgaaggcatgtggggtggtgcctaatagagtcacttatgttgctgtgttatctgcatgtgcgcatgcagggctaattaacgaagggcgtttagtgtttgcaagcatgaagcaagagtatggtgtggtgccaggagtggagcaccatgtttgcatggttgatatgtttgggcgaggtgggttgctcaatgaggcataccagtttgttagagggcttagttctgaggagcttgttccagcggtgtggactgcgatgcttggagcttgcaagatgcataagaattttgaccttggtgtggaggttgctgagaatctcatctctgcagaaccagagaatcctggccattatgtgttgctttctaacatgtatgcattggcggggaggatggatagagtggaatctgttaggaatgtgatgatccaaagaggccttaagaagcaagtgggttatagcaccatagatgtcgaaaacaggagttacctttttagcatgggtgacaagtctcaccctgagactaatgagatttactgttatttggatgagttgatgtggaggt

SEQ ID NO: 85718 - DNA, 1314 bp, Glycine max
  Peptide Sequence Number=SeqID_202496
atggttgcaccttatgaaatttttcggattgagaaacatgaaggttcaactgtaacccccactccttatgagacaaatgttgaagagttaactcatgagatgattgaacacaggagtctaccttcttctgacaagaagggaaaggacttgttaaatggtgatggtactaggaagaattgtgaaaagaatcttggggaatgtagttccttttcccttcctcgagctgcctttgaacttttctccagcattaaagccagcattttccaaacttttagtggaactctactttcaggagcagtttcctcagtacctacatttgaaaaggagaatggatatgcttatccagacaagaaggattcggaaacttgtgacctctttactgaacaacatccaatgactgagttgcaatatacagaagacaaaacttcatatcctgaaaatataaagattcatgagaagaatgattttccattttctttagacagcaacagttcaaaccagttcaagcaatttgatgttaaagaaaattgccctgaccaccatttttttgttcagggaaaagggttgtcaatatcgcaggtaaaaagaagttgggtgaaaaaggttcagcaagaatggagcatcctcgagaaaaatcttcctgaaagaatggatctcatgcgagcagctattgttggtgcatctggaaccccttatcatgaagggttgtttttctttgacatatgcttccctccggagtatcccaacaaaccacctatggtgcactacaattctggagggctccgattaaatcctaatctgtacgagtcaggaaaaatttgtctgagtctcctgaacacttggacaggcacaggtactgaagtgtggaaccctggagcctccactattcttcaagtccttctctctctacaggcacttgtccttaatgagaagccttatttcaatgaggctggatatgaccaacaaatcggcagagctgagggagagaaaaactcagtcagttacaatgaaaatgctctcctcgtcacaaccaaatccatgatgtatctattaagaaagccaccaaagcattttgaagaactggtggaagagcacttcagaaagcgctaccaacatatacttcttgcttgtaaggcatatcttgaaggagcttcaattggatgtgcttttgatagtgaaaaaaatgaacatgaaaaccagaagggtacttcaacaggatttaaaattatgcttgctaagctcttccccaagcttgtagaggcattttctgataagggaattgattgcagtcagtttgttgatctgcagaaataa

SEQ ID NO: 85719 - DNA, 696 bp, Glycine max
  Peptide Sequence Number=SeqID_202497
atggcgagtaggaggtgcctgcgagcgttaactcaaacgagaccgtttctcttccgaaaagcatcctctcttcgctcactcgccgtgctttccatttcccaactccaacgcttctccacacgctttcaccgcacgcgcctctgtttttgcgcaatgcccgcacctccgttcgacgaagaagatgatagtgacgaggattacgatgaagaagaggattatgttgacgatgatgacgtcactgtgtcaagagggaaaaaagtatacacggcggaggagaaggaagcggaagcggcggctattgggtacagagtggtgggtcctcttcaaaaggaggaagatagcgtttttaagccttacgagcctgttttcgctgttgttcagattggttcgcaccagtttaaagtaagcaacagagacagcattttcactgaaagattgaagttttgcgaagtgaatgacaagttgattttgaacaaagtactattgcttggctctgctagtcagacaattgttggcagacccatagtaccagatgcagctgttcacgctgttgttgaggagcataaaaatggaaatgcaaaattagacagcaatggtggatatgatagcacaaagaggcaacgagctaggcatagtttgaagacaaaagcagaaaagaggagtttgaggcaagagaaaaataagacaaacttataa

SEQ ID NO: 85720 - DNA, 1350 bp, Glycine max
  Peptide Sequence Number=SeqID_202498
atgggcttaactaagagattggtattactccctccacccacgggttattttttgggctaccatcttcctccagggcatccgtgtaatagcttcacactccctcccccgcctgctgataaaaagcgtactgggccacgtctgtgttaccttcctgtggaagaagccattggactgatgccagcattgccctcaccttcaccggtccttgggaatttaacatatgtctatgaagaaaatttaagtagagatggagaatttggtggttcagactttggtgggtatcctactttgaagcagagaaatgattcttttgatatacgagagtcgatgactgtgcactgtggatttgttagaggaattaaacctggccgcaacacaggatttgacattgatggagctgacctttttgaaatggagcagtgtgatggagtggttgttgcatcagccatatttgatgaacaaacagaaaaatatctgattagttctggtaaattgggaatcagcaagaagattggtttatggagaactattgttgctcgtaatcttccttaccctgatgcaagacggacaggaaagattccaaagcttttgttgcatagattggttccgaatgctcgctattctatatggcttgatgggaagcttgagcttgttgtggatccatatcaaattcttgaaaggtatttcttcaaattgatctctctgacattagagctcattgagggctggcataagtggagttttcagtttttgtggagaaagaatgctacttttgccatatcaaaacattatagacgctttgatgtattcattgaggctgaggcaaataaagctgctggaaagtatgataatgcctctattgactttcagatagagttttacaagaaagagggattgaccccatatacagaggctaagcttcctcttataagtgatgttcctgaaggatgtgtgatagtacgagagcatgttcctattagcaacctctttgcttgtctttggttcaatgaagttgaccgatttacttcaagggaccagattagtttctcaaccgttagggacaaaattttgtcgagggtagattttcattttaacatgttcttggattgtgaaagacgcaactttgtagttcagaaataccacagggatctattgttgcgcctggcgccaccagcttcaccccctcccccatctcctcctcctccattgccagtgcttgaaacatcacctgaaaagggtgcaaactcacccattagaagaggccctggaaggcgtggaaaagatcgacgagctggttcacggcgccaccgcaaagttgttgctggaggtagagagatggaaccaagttaa

SEQ ID NO: 85721 - DNA, 489 bp, Glycine max
  Peptide Sequence Number=SeqID_202499
atgaatgccttgaagcgaatcattcgatacatcaaaggcaccatcactcacggtttacatctctctccctcctcagctgacaaactcaccacatatactgatgctgactgggggggatgtccggacacccgcaggtccacgtccggttattgtgtttatcttggagataatttagtttcatggtctgccaaacgtcaaccaactctttctcgttctagtgcagaggcagagtatcgtggtgttgctaacgttgtctctgaatcctgttggcttcgaaatttactcttagaacttcagtgtcctattgcgaaagccacactagtatattgtgacaatgttgctcgtggccagatacgcgttctacatgttccttcacgctaccaaatagctgacattttcacaaagggccttccgctgcagctattcagcgacttcagagatagtctcaacattcgtcctcctcccgtttcgactacgggggtgtattag

SEQ ID NO: 85722 - DNA, 273 bp, Glycine max
  Peptide Sequence Number=SeqID_202500
atgtctgctccattgggtattggaattcgttctggaagttatgggtctttggataaacaggtacagaacgggactgcacgcaaggcttcgaagatgctcaaggagaaggagaaggagaggctgttcctttggatctgcaagttcgccggccgcaagaaggtcggaatgctcttcctttgcctcatctccgccgcgcaccaacccgagttgggtctagcggaagggactagtttccgtaatgtggcgaatcaaggtttgaataatgctggttag

SEQ ID NO: 85723 - DNA, 186 bp, Glycine max
  Peptide Sequence Number=SeqID_202501
atgtatgtggctccgaacaacgatcgatctctggggaggagcttcgattctgatcatgaggagactccttcacctccccttttcactgacccaagtcagacatcttcaagcccatttcacatccaccctagtgagagtcccaccttagtcattgtctctcctcctcttacaggaaacaactattaa

SEQ ID NO: 85724 - DNA, 2059 bp, Glycine max
  Peptide Sequence Number=SeqID_202502
atggctttgattaactggttgtctatggaaaaggctttatcgaaagagacaaaatctacttcgtccggtaagaacgagcgtgtgacgattcgcgagttctgcgcgaatggaagttgcatggaagcgaaggaacttgaggccaagcttgatgaaggaaatattcaagaagcagaatcggcattgcgtgaagggttgtcactaaattttgaggaagcaagggctcttcttggaaagttagagtatcagagaggtaatgttgaaggtgcacttcgtgtgtttgatgggattgatcttgaagcagccatacagcgattgcaaagttccctttctgaaaaaacacctgttaagaaaggccccactcgcagtgaatcaccttcctccgtctctcagcatgctgcaactttggtgcttgaagccatctacttgaaagccaagtctctacaaaaactggacaaatttactgaagctgctaaagaatgcaagcgtgttcttgatgccgttgagaagatatttggtcagggtatacctgatacacaagtggacaacaaattgcaggagatagtcagccatgcagtagagctccttccagagctttggaaacagactggttgctataatgaggcattgtctgcttataggaatgcccttcttagtcaatggaaccttgataatgattgctgtgcaagaattcagatggcatttgctgtgtttatgctgtacagtggggtggaggcaagtccacctagtttagccgttcagattgatgggtcctatgtacccaaaaataatctggaagaggcaattctgcttctaatgattcttttgagaaagtttagccttggtaagataaattgggatccttctattatggaacacctgacttttgcactttcagcatgtggtcaaacttctattttggcaaagcaatttgaagagttggcacctggtgtatatcaccgtattgaccgatggaattttttagctctatgtaatagtggagctggagaaaatgaaagtgctttgaatctgctaaggatgtcattgcataaacatgaaagaccagatgaccttatatcattattattggctgcgaagatttgcagtgaggatcctcatcatgctgctgagggagcaggatatgcacagagagcaatcaatattgctcagggcttagatgggcatttgaaaggtgtgggtcttcggatgttggggctttgcctgggaaaacaagctaaggtttcttcttccgactttgagaggtctatgcttcaatccaaagctctgcaatcattggaggaggcagttagactggagcaaaacaattatgatctaatttttgagctggctattcaatatgctgagcaccgaaatttaactgctgctttatcctgtgccaagcagttctttgacaaaactggtggctctaaattaaaaggttggagattgcttgctctggttttgtctgcacaaaaaagattttcagaggctgaagtggtgactgatgctgctttagatgagactgcaaaatgggagcaggggccactactcaggctgaaagccaagctgaagatctcccaattacgacccatggatgctattgaaatttaccgttaccttcttgcattggttcaagcccagaggaaatcgtctgggcctctcaaacttagttcacaggatcatggattcaatcccttgcctgcaaaactcttacctaaggggatttggagtgcacttatggatgtgatcattggtattatgttcgatggtcgtggagaatatcaagaagctcttattggtactttcaatgcggtcctatttgaaccaaactatgtgccaagcaagatcttgatggcttctttgatactgaaaatgggttttaaagcttcacctgttgctagaagcttactttctgatgcacttagaatagaacccactaaccgtatggcttggtattacttgggattaactcacaaggctgacggccgattagtggatgctgcagattgcttccaggcagcttccatgcttgaagaatccgatcccattgaaaatttcagct

SEQ ID NO: 85725 - DNA, 3993 bp, Glycine max
  Peptide Sequence Number=SeqID_202503
atggggacaaatggagacctggcaagtgaagttaagaaagaagaggaagagaatgcctttgatggagaattcattaaggttgagaaagaagagaatgtcattgatgataagtcccacaaaactgaaagaagctcagattctcctagcagagaatttctagaagcccaagagaagatacaggaactcgaggttgaactccaaagactaacagaatctttgaagacctctgagcatgaaaatgatcagctgaagggagagatctcagttacaaaagagaaattggaggagagtggaaagaaatatgaagagctcgatctgagtcacaaaaaattgcaggagcagattcttgaggctgagaatagatataatcagcagctcggcactcttgaagaggcactacaaagtcaagaagtgaagcagaaggagctttttcaagtgaaggaagcatttgatggtatgaaccttgagcttgaaaactccagaaagaggatgcaggaattgcaggatgagctacaactttcagcagatgaggcacggaaattcgaggagctacataagcaaagtggttcacatgctgaatctgagggaaagaaggccttagaatttgagagactacttgaagaagccaagctgactgcaaaaggaatggaagatgagatgtcatcccttaaggaagaattgaagggagtttatgataagattgctgaaaatcaaaaggttgaagaagcacttaaaacaacaacagcagaactctctaccatccaggaggagttgacactctcaaaatcccagctattggaagttgagaaaagactgtcttcacgggactctttagtggacgagttgacccaggaattaaacctgataaagacttcagaaacacaggtaaaggaagatatgttagcacttcaaaatctattggcctctacaaaggaagaaatgcaagaaaaaatttctgagttagaaattgcaaggtccaagttgcaggaggaggaaaaattgagggaatcaattgaagctgcactcaagagtcaggaagctcagtttgtcactgtacaagaggaactgactaaatttaaaacagaaaaagaaactcttgaagcaaccgtggaagatctaactggtagtttgaagaagtttgaggagctgtgcgctgatttagaggaaaagctaaagctctcagacgaaaattttcttaaaacagattctcttttatctcaggcactttcaaacagtgcagagcttgaacagaaggtgaagtctttggaagatctccataatgaatctggagctgctgcagctactgctactcaaaggagcctagaacttgagggacatattcagacatcaactgcagctgcagaagaggcaaaatcacaattgagggagctggaaacacgcttcatagcagcagagcagaggaacgtggagcttgagcaacaattaaacttagtacagttgaaaaccagtgatgctgagagagaagtggctgaattatctgagaaaatatctaatctcaacgcaaaattggaagaggccgaggaagagaagaatcttcttaattgccaggtacaggaatacacggaaaaggtagctcaacttgaatccgaattaaatcaatcatctttaaggagttcacaattagaggaggagctgaagacaatcaacggcaagtgtgctgagcatgaagaccgagccagtatgaaccatcagcgtagccgagaactggaagatttaatccagggttctcactccaaattggaagatactgataaaaaggtgagtgagttggagttgttactagaagcagagaaatacagaattcaggaacttgaacaacaaataagcacattagatgagaagcgtaacgcttcagaagcgcaggccaataaataccttgatgatgtatctaatctgacatcagaacttgaggcaattcaagcacgagcctcaaccctcgaaactacactgcaagcggctaatgaaagaggaaaggagttggaagattctttgaatgatgtgacagaagaaaagaaaaagttagaggatgctgctaacagtttgaatgagaagcttgctgagaaagaaaacctattggaaattttgagggatgatttaaatctcacacaagataaattgcaaagcactgaaagtgagctccgggctgctgaattgagagagagtgaaataattgagaaacttaaatcttctgaagaaaatcttgtcgtaagaggaagagatatagaggagactgctacaagacactcagaacttcaattgttgcacgagtctctgacgagagattcagaacagaaactccaagaagctatagaaaaattcaacaacaaggattctgaggttcagtccctgcttgagaaaattaagattttggaggaacagatagcaaaggctggggaacagtctacatccttgaagaatgaatttgaagagagtttgagcaaactgacttcattggaaagtgaaaatgaagatttgaaacggcaaattttagatgccgagagcaaaagttctcagtcttttagtgaaaatgaattacttgtaggaacaaacattcaactgaaaaccaagattgatgaacttgaagaatcattgaaccatgctctatcagagaaggaagccgctgctcaagaacttgtgtctcataagaacagtataactgaactgaatgacttacaatcaaaatcctccgaaattcaacgtgcaaatgaagctcgcactctagaagtagaatcacaattacaagaagcattgcagaggcatactgagaaggaatcagaaaccatagaattgaatgagaagctgagtacactagataaccaaataaagcttttcgaagaacaggcacgtgaagcagttgcaacttctggaactcataaagctgaactggaggagagtctcgttaaattaaagcatcttgaaactgtcattgaggatcttcaaaacaagtcactccatcttgaaaaagaaactacagggctgaatgaagagaactcaaagcttaatcagggaatagctagctatgaatctaaattaagtgatttacaggagaagctctctgcagcacttgttgagaaggaggaaacagttaaagagctactcaccttgaaggatgtcataaaagaattagggacagcacatagtgcagaagtgcagacattaaattcacagatatcttcagtgggggatgagaagaacatgctcaatgaaactaatcagaatttaaagaaggaacttcagtctctgatatttgaccttgaagagaagctgaaggaacaacagaaaattgaaggttccctgagatctgaggttgaaactctcaaagttgaggttgctgagaaatctacattgcaaagtcagctggaggaaattgaagggaaactggcacaagctgaatctagactaaatgaagaggttggaagtgttcaagctgctgcttctcaacgagaagcagatttaagttcaaagttggaagactatgcacaaaaattcaatgatagaaatgtattgaatgataaggttgcagaacttgagaaagagttgcaacttgcacgggatgctattgctaaccagaaaggagcagagtcccagaagttggaactagaggcagcattgaagaattctcttgaagaacttgaaactaagaaaaatgatatctctcttttacagaaacaagtgacagatctagagcagaaattgcaagtcgctggtgataaatcctcagtcaagggcgatgagggtgttgatcagaaagaagggttggaagtaaaatccagggacattggatcaagcctttcaattccatcaaaaagaaagagcaagaaaaagtcagaagtaacaagtgctcaaacatcatcttcatccgagactcatgttcaaactggccatgattctcctatcataaatttcaagttcatcttgggagtagctcttgtgtccattgtctttggcataattcttgggaagcgttactag

SEQ ID NO: 85726 - DNA, 1142 bp, Glycine max
  Peptide Sequence Number=SeqID_202504
atgcttcaaagcttggtcccccgatcccctcgcacttcaaaccccaacgctatgaaaactaagcgcgccgttgacgccggaggcgattcccccgccgacgaaccttccttcaagcggaccaacttctccggcgagaaaactacggccgaagctgaggaggagcaagccttcgatcccgagcctcacggcggcgattccaccggtctcaaactcctcggtctgctcctccaatgcgcggagtgcgtcgccatggacaacctcgacttcgccaacgacctcctcccggagatcgcggaactctcttcgccgtacgggacctcgccggagcgcgtcggtgcgtacttcgcccaggcgctgcaggcgcgcgtggtgagctcctgcatcggctcctactctccgctgaccgcgaaatcggtaaccctaactcagtcgcagaaaatcttcaacgcgttccaatcctacaactcggtgtcgccactggtgaagttctcgcacttcaccgcgaaccaggcgatcttccaggccttagacggcgaggatcgagtccacatcatcgacctcgacatcatgcaaggcctccaatggccaggattgtttcacatcctcgcctctcgctccaaaaaaatccgctccgtgagaatcaccggattcggatcctcctcggagctcctcgactccaccggccggagactcgccgattttgcgagctcgctcggtcttcccttcgagttcttccccgtggaaggcaaaatcggaagcgtgacggaactgagtcaactcggcgttcgacctaacgaggcaatcgtggtgcactggatgcaccactgcttatacgacataacggggagcgatttagggacgttgagattgctgactcaacttcggccgaaactgataacgaccgttgagcaggatctaagccacgcagggagcttcctggcgcggttcgtggaggccttgcattattacagcgcgttgttcgacgcgctaggggatggtttgggtgcggacagcctggagaggcacacggtggagcagcatctgttgggctgcgagatcaggaacatcgtggccgtgggggggcccaagaggaccggcgaggttaagttggagaggtggggggatgagttgaaacgggccgg

SEQ ID NO: 85727 - DNA, 1092 bp, Glycine max
  Peptide Sequence Number=SeqID_202505
atgaatgccactcttcctcatactctccctgaggatttgatcacagaaattctgatgatgttgcctgtgagatcgatattgcgttttaaatgcatgtgtaagttatggttttctcttatttctgatccagaattcgctcgatcccactttgccctagctgcaacacccaccaccagactttttctgtcaaccaacggttatcaagttgaatgcacagatatagaggcatcacttcatgatgataattctgccaaagtagtctttaactttccccttccgtcaccggaaaacgaatattataattgcgcgataaatatcgtgggttcatgtagaggatttatactcttgttaaccagtggtgccttagatttcatcatatggaatccttcaacgggtctccggaaaggaattaggtatgtgatggatgatcatgtatataatttctatgctgatcgatgtggctttggatatgactcatcaactgatgactacgtgatagtgaatttaacaattgaagggtggcgcacggaggtccattgtttctccttgagaaccaattcatggagtcgcattttgggtactgctatatattttcctcttgattgtggaaatggggtgttttttaatggggctcttcattggtttggtagactctgggatggtcatcgtcaagctgtgattacttcatttgatgtgacggaaaggggattatttgaaattccactgccacctgatttcgccgttgaaaatcaaatatatgatttgagggtcatggaaggatgtttgtgtctctgtgttgctaaaatgggttgtggaactacaatttggatgatgaaagaatataaagtgcagtcatcgtggaccaagttaattgttccaatttataatcagtgtcatccttttctccctgtcttttacccaatatgttcaaccaaaaaagatgagtttttgggatcaaatcataagacattagtgaaacttaacaagaaaggtgatttgcttgagcatcaggcacgttggcactacatggactgtactattttagtacactgtggtgtgtacagagagagtttgctatcactgcctgagtaa

SEQ ID NO: 85728 - DNA, 1011 bp, Glycine max
  Peptide Sequence Number=SeqID_202506
atggagaacattgctattcgctttggggatgttcatggcaaccaagaattcgctcgatcccactttgccctagctgcaacacccaccaccagactttatctgtctgccaacgatcatcaagttgaatgcacagatatagaggcatcacttcatgatgacaattctgccaaagtagtctttaactatcctcttccgtcacctgaagacaaatattataatcgcgcgatagatatcgtgggttcatgtagaggatttatactcttgatgataaccagtggtgccttagatttcatcatatggaatccttcaacgggtctccggaaaggaattagctatgtgatggatgatcatgcatataatttctgtgatgatcgatgtggctttggatatgactcatcaactgatgactacgtgatagtgaaattaaaaattgatgggtggtgcacggaggtccattgtttctccttgagaaccaattcatggagtcgcattctgggtactgctctatattatcctgttgatttaggacatggagcgttctttaatggggctcttcattggtttgttagacgctgtaatggtcgtcgtcaagctgtgattatttcatttgatgtgacggaaaggggattatttgaaattccactgccacctgatttcgccgttaaagatcaaatatgtgatttgagggtcatggaaggatgtctgtgtctctgtggtgctaatattggtcgtgaaactacaatttggatgatgaaagaatataaagtgcagtcatcgtggaccaggttaattgttccaattcataatcagtgtcatccttttctccgtgtcttttacccaatatgtttaaccaaaaaagatgagtttttgggatcaaatcacaagacattagtgaaacttaataagaaaggtgatttgcttgagcatcacgcacgttgtcacaacttgggctgtggtattttattacgcggtggtgtgtacagagagagtttgctatcactccctgagtaa

SEQ ID NO: 85729 - DNA, 1260 bp, Glycine max
  Peptide Sequence Number=SeqID_202507
ggagaaggtggtgtctatcatgctttaaccacatgtgagaagattctagctaggacttctttagtctgtcaactatggtcggtcagtatggggttttgggatcagccaggatacttgggtgttatgcttggtcagcctgcccggacactccaattgggagttcttgacttggaactactaatggaaggggctgtattggagactgtagctaaaattactcatgataaagcaaagagaaatgaaacacatgagggaaagtatggttatactcatatgttccccgatgtagtttctcagttgcatcttataatggattattggattgccacaagagcatttcagtttcaagatgtgttctcactggaaaatgaagattctgatgatgtgacaactttgattgacaaaaaggacaatgtctttgtgatgtcaaacaagaaatccaaatatcctgtgcttcaagtggatttgaggctaatatcggatttggtggttgtcatagtttctgcagccattggtggaattgtcttttcctgtttggggcaaccggttattgtgggctatcttcttgcaggctcccttattggaccaggcggtttgaagttcataagtgaaatggtgcaggttgaaactgttgcacaatttggtgtagtgtttcttctctttgctttggggctggagttttccctggcaaagttaaaagctgtgggacctgttgctgttcttggagggctacttcaaattatcatttttatgttcatgtgtggcattctttccatgttatttggagccaaattgtctgagggtgtttttgtcggttcctttctgtcaatgtcatctacagcagtggtggtgaagtttttggtggagcggaatagtaataatgctcttcatgttcaagttacaattgggactcttatttttcaggattgtgcagtgggtttactatttgctttgctcccagttttgggtggtaacagtggccttttacaaggactaatgtcaatgggaaaactgttgctagtgttgtctttgtatatcactgctacatctgtattgtcttggacatttgttcctcgctttcttaaactgatgatgcggctgtcatctcagacaaatgaactttatcagctagctgctgttgctttctgcttgttatcagcatggtgcagtgataagcttggccttagtcttgagttgggttcgtttatggctggtgttatgatttccacaacagactttgctcaacatactttggaccag

SEQ ID NO: 85730 - DNA, 327 bp, Glycine max
  Peptide Sequence Number=SeqID_202508
atggggatgaaccagttacaagaattgtgggagtctaggagggagagagagaacacctacggtagaggtagagaagatgaaagcatgatgaaggagcattttgcttactctagtggtggcaggatgttgtcgtcaaaggtttgtctaataggggtgagttcaaactacgatctcgttcatctccacgacgattatgatatcactagttaccaagtctccaacattcacactggtgatgttgttgctagtgatgtcgtggtttttcctgacgcagagctagtcaaaaaagttgatatgcctatggaggaaatgcctgatttggcttaa

SEQ ID NO: 85731 - DNA, 2880 bp, Glycine max
  Peptide Sequence Number=SeqID_202509
atgtatataggacaagcattgatgaagattaagtcttcattcagcaatgtggcagatgttctgcatgattgggatgctttgcataatgatgacttctgttcctggcgcggagtcttgtgcgacaatgtcagcctttctgtgctttttctgaatttgtcaagcttgaatcttggtggggagatatcaccagccattggtgacttagtaaacttgcaatccatagacctgcagggaaataaactaactggtcaaattccagatgaaattggaaactgtgctgagcttatttatctggatttgtctgataatcaactatatggtgatatacctttctccatatcaaacctaaagcagcttgtgtttctgaatttaaagagtaatcagttgactggtcctatcccctcaacattaacccaaatttcaaacttgaagactcttgatcttgcacgaaatagactcactggtgagattcctagactgctctattggaatgaagtcttgcagtacctggggttgcgaggtaacatgttgagtggaactctgtcctctgatatctgtcaattgactggtttgtgtgacgtgagaggcaataatttgactggcaccatacctgacagcattggaaactgtacaaattttgcaatcttggatctttcatacaatcaaatttctggggagattccctataatattggatttcttcaagtagctactttgtcgcttcaaggaaatagactaactgggaagattccagaagtcattggtttaatgcaagcacttgccattttggatttgagtgacaatgagctaataggacccattcctcccatactaggcaatttgtcttatactggaaagctgtaccttcatggaaacatgcttactggaccaatacctcccgaacttggcaatatgtcaagactaagctacctgcaattgaatgacaatcagttagtaggccaaattcctgatgaacttgggaagcttgtacatttgtttgaatttgtcagtggtgttaacttgcttcaattactgtcatccaggaatctagccaataatcatcttgaaggatctattccacttaacattagctcatgcactgccttgaataagttaaatctttctgcaaacaacttcaaagggagtatacctgttgagttgggccatataataaatcttgacacgctggatctatctagcaataatttttcagggcatgttccagggtcagttggttatcttgagcatcttctgaccttgaacttgagccataatagtcttcagggtcccttgcctgctgaatttggaaatcttagaagcatacagattattgatatgtcattcaactatctgttgggtagcgttcctccggaaattggtcagctgcagaatcttgtgtctctgattttgaacaacaatgatttgcgtgggaagattccagatcagcttaccaattgcttaagtcttaacttcctaaatgtctcatacaataacttatctggggtcattcctctcatgaagaacttctcacggttttctgctgacagcttcattggaaatccattattatgtggaaattggttaggatccatatgtgatctttacatgccaaaatccagaggggttttttcaagggctgcaattgtttgtctcattgttggtaccatcacattattggccatggtaactatagcaatctacagatcaagccaatcaacgcaattgattaaaggatctagtggaactgggcaaggcatgttgaacataagaactgcttatgtttattgcttagtattattatggccacccaagcttgtaattcttcatatgggcttggccatccatacctttgatgacattatgagagttactgacaatctcaatgagaagtatattgtagggtatggtgcctctagtactgtgtacaagtgtgttttaaagaattcccggccaattgcaattaaacgactatacaaccagcatccacacagctcaagggagtttgagacagaacttgaaactattggcagtatcagacacaggaatcttgtcactttgcatggttatgctctaactcctaatggaaatcttcttttctatgactatatggagaatggctctctgtgggatcttcttcatggtccctcgaaaaaggtaaaacttgattgggaggcacgcatgaggattgccgtgggaactgctgaaggacttgcttacctccatcatgactgcaatcctagaatcattcacagggatataaagtcctcaaacatcctgctagatgaaaactttgaagctcgtctctctgattttggcattgccaaatgtttgtcaactgcaagaactcatgcgtcaacgtttgttcttggaacaataggctatattgaccctgagtatgcccggacatctaggctgaatgaaaaatccgatgtgtatagctttggcattgttcttcttgagctactaactgggaagaaagcagtggacaatgattccaatttgcatcacttgatattatccaaggcagataacaacactataatggagactgtggatcctgaggtgtctattacctgcatggatctgacccatgttaagaagacctttcagcttgctcttctttgcacgaaaaaaaatccttccgagaggccaaccatgcatgaggttgccagggttttggcatcactactcccagcacctcccagtaaaaatatcttcgtcccttcttcaaagaccattgattatgcacaatttgtgattcaaaagggaaaacaaaacaacctccaccctctacaaatggataggctacaacctcagcagttctctaatgatcaatggtttgttcgctttgaggatgttgtatcaaataacagcctctag

SEQ ID NO: 85732 - DNA, 576 bp, Glycine max
  Peptide Sequence Number=SeqID_202510
atgaattctagagagtatagcattgttacattttcttcaaattctgccacacgtgacaccccttcttcctttttagttcggatggtcatgagaatatctagagctagatggtttaactttttaagaagagtttttcattaccaaaatggatcaagctctaatcttggctccaaccctttcaattctagcacttggatgatgctggagtttattaccttggttgtccagataaccattataacgttcactttggccatttccgagagggagaggtctatttggcctatgaggatatggatttctggttatgatattggctgtattcttaatttcctgctacttattcatctgacacaaggaaatgctcagaacctttctgatatggaacagcagagaaacaatgaagaaaccaggatgtcacacttgatgaataaatggcgacttgagcttttcttcgccatatggtttgtgttgggcattgtttgggtttttgagtcacgttttggatctttccatgaagctccaaagctccacgtgcaccctcctcggctacaacatgaacatggcttcttctga

SEQ ID NO: 85733 - DNA, 261 bp, Glycine max
  Peptide Sequence Number=SeqID_202511
atgcatgtcttacagaagctaattgcttatggtgctctttcaatttcagtatcagagactattcaaagacctatgctcggtccagatattatgatgaagcaaaaccgtggaatgaaaggttgtcgtatactagtagaaggttcaaacatgccttttacccctgagggagttcagattctgaggaaagccagtgttctcatcgctccttcaatggctgccggtgctggagggatgaggttgtggctggagaacttgaactga

SEQ ID NO: 85734 - DNA, 450 bp, Glycine max
  Peptide Sequence Number=SeqID_202512
atgctttcagataaaagatttattcgggagtactttgaaaccaaccagaaaagaatacgacaagtgcacgatgaatttgtgggttgtttaagtaaactaggaatcaagtgtgccaagagcagtgctggtatgtactgttgggctgatatgagtggattaatccgaccttatagtgagaaaggagaaattgaattatgggagaagtttttgagtgttgctaagatcaatataactcctgggtcagcctgccattgcatagaaccaggatggtttaggatttgttttaccactataacattagaggagatccctttgttaaggcctgatgttgcagccagaagttgttgtttagaaattttggaaaggaatgtgtacatccctagttatcaagttcagttgtcttgcggaatccaaaatttattactttgcgggagaaatattctcttgtaa

SEQ ID NO: 85735 - DNA, 279 bp, Glycine max
  Peptide Sequence Number=SeqID_202513
atggaggatgagtcatccgaggccaccattccagagccattcattgcaaaggaggaggcaggtcacttcagagcctcctgcaccagtggtggacctatcctcgcctcagtagaggagcatgcagtagacccctccgctcctatactagagatactagaggactcgaccacactagtccagactttgaacacctctcctctagctactccagtacttcatctaacagatgatgaggatgttcagacacaggacactcaggaccagtcccaggaattctaa

SEQ ID NO: 85736 - DNA, 503 bp, Glycine max
  Peptide Sequence Number=SeqID_202514
gaatccatcgtgctctggcctacaatttatttccaaatggttcgctacaaagcatcatatttccaccagatgataagcaggatttccttggctgggagaagctgcagaacattgctcttggtatagctaaagggattgagtatcttcaccaaggttgtaaccatcccattattcactttgacatcaatcctcacaatgtgttacttgatgacaacttcactctaaaaatttctgattttggcttagcaaaattgtgttccaagaatcctagtttggtgtccatgacagcagctagaggaaccttcggatacattgcacctgaagttttctctagaaactttgggaatgtgtcttataagtctgatatttatagttacagaatattgttagacatgtcttctccacaagatttccatgtgttgtatccagattggatgcatgacctagttcatggagatgtgcatatccatgttgaggatgacggtgatgttaaaattgcatag

SEQ ID NO: 85737 - DNA, 171 bp, Glycine max
  Peptide Sequence Number=SeqID_202515
atggagcaaaggaatgctaatgatggtggtggtgcagcaacaaaaatgcagagacggaggagagaggaagaagggctcttgttcgacggctttgatggaggagttgcaagcaatggtcgagcaaaggttgaagggggaacacaaatgatgccaatttctggaatccgatga

SEQ ID NO: 85738 - DNA, 510 bp, Glycine max
  Peptide Sequence Number=SeqID_202516
atggaggcgctggctaaactggcgaattataaaggtaacgtggcgatcatgatcggcaacctgaccgatgccggcgcgctgcagcgcaccaaagatgtcgagcaggtggtggcgaaatacccgggcatgaaagtggtacagaagcagccagcaaactatgcgcgcaacgaaggcatggacctgatgctcaactggattggcaacggtgaagcgatcgatatcgtcgcggccaataacgatgagatggcgattggtgcggcaatggcgctggcaaagagcaataaaaagattctggtgggcggcatcgacgccacgccggacggcctgaaggctctggcgcaggataagatgcaggtgacggtgtttcaggacgccatcggtcagggaaaaacctcggtagacgtggcgcagaagctgattaaaggcgagaaagtggcttcacacgtgtggatcccgttcgagctggtgaccaaagagaatatgcaaaagtacgtcgagcgcagccagtag

SEQ ID NO: 85739 - DNA, 264 bp, Glycine max
  Peptide Sequence Number=SeqID_202517
atggacccggagaagtccaacagggccctggggtttccaggtcgggttacgggcctctgtcagtcctacaggatgcccgtcccccccagcaagggatcgcacccgcaagacacccaatggacccggaaaagtccaacagggtcttgggcgtccgttgcccctaacaaggtcattaggccccccattaatcgggctttcatcaagaagtactgcacccccaggcaggcacagggcgagacaccacaacagcctggggatggctga

SEQ ID NO: 85740 - DNA, 216 bp, Glycine max
  Peptide Sequence Number=SeqID_202518
atgtatcctcagctcgcccaggcaagttgttacttcattctgaagcaaccttgctcacccaggcgacttgattacttcaccatgaagttatttggtggcctgggtgagccaggggtcagaaaaagcttccaaatgacccttttgctctcccttttgggtattttccgcattccataccgaaacgttgcaaaacctttcgtattgcgcaacaactag

SEQ ID NO: 85741 - DNA, 219 bp, Glycine max
  Peptide Sequence Number=SeqID_202519
atgacctccctaaattgcgctcagctcaccatttgggctcagcgcgcatccaacgctaagcgtagctttagcgtgcttagcacgacagaagaatttggcagagcattaatatcaacgccgtgtgctaagcacgagatctgctcgctaagcatgatggttgtctttagccaggctcagcgcatgactggcactaagctcaaatccactaactcacgctaa

SEQ ID NO: 85742 - DNA, 186 bp, Glycine max
  Peptide Sequence Number=SeqID_202520
atggataagccaaagtgttcatctcctagggagaaaacgagtgaagtcgtcaccaacgcttacttaaggaaaatgttagaaaaaccaaaaagagaagtctctttacaaggaattaatgttaattctcttcaatttcaggcaaaaaggagaaaatttgaagaagtgccaaagtggatgtcgcgctaa

SEQ ID NO: 85743 - DNA, 258 bp, Glycine max
  Peptide Sequence Number=SeqID_202521
atggttcatgtgaaccctttcattgggaaagctttagacccacttaaagagaagttcgacacctatttggggatagtagccgagataaggaaatttgatattccagaagtgtccaatgccaagaagaaggtcatttcaatggtgggtacaagatggagacaatttaagtcctatctcagcattaaatctgtatacgcagaaaaggaaggtgaacatgggattccttgtaataagtatggtctagatgaaaacatatag

SEQ ID NO: 85744 - DNA, 276 bp, Glycine max
  Peptide Sequence Number=SeqID_202522
atgggcctgaaatctgccctaaggctcatgagaaccctagggccttctcttgcatctctggcccaatctacttggagtcttctatccaatgcccttccgggaggaaacattggtggaggcataggaaaccttgacagatttcatgcggttgcgattgagggcgaggtcaaggagaatgatgttgttgccgttgaggttgaggagagtccctcgaggatgtacaagccattgacacgactgaacataaagatgattgcatggataacaccgatgtag

SEQ ID NO: 85745 - DNA, 357 bp, Glycine max
  Peptide Sequence Number=SeqID_202523
atggtcttaaaagaagagttagccgcttgctcaaggtccaaaaggaacttgactcagcgtttgtgcgagacagagaccaacatgttagctatcattaccaaggtggtggacgagtatgcccaagtgtacgcggaaaaggaggctagaggaagggtgattgactcattacaccaagaggcaaccatgtggatggaccgattttctcttaccttgaacgggagtcaagaacttccccgattgctagctaaggccaaagcgatggcggatacctactccgccctcgaggagatccacggacttctcgactattgtcagcatatgatagatttaatggcccatataattaggaaccgctag

SEQ ID NO: 85746 - DNA, 1413 bp, Glycine max
  Peptide Sequence Number=SeqID_202524
atgaagaaattttacttttttatattgctgttgatcaatttttttgtgttcggacaaatcaactataccattactcccggacagtttaacgaaacagatcagatcacactgacagttcctggtgatcagattgatgaatcgacctggaacgttagtaaccacgcgatttatatttgggcatggtcactggataccaactacatgaatagtcagaattgtcctacaaatgggaactggaacaattctgatgatcagaataaactgaattataattcaacgacagatacgtattcactgacttttacaccaacaactttttttggaagaacaggaatcggaagatttggttttctattaaaagacaaggcgggaacccatcaaacttctccggatatttttgtaaatgtaggagtattaaatctcaccctgacaaatccgctgccaaatagcttgacatctgtaccttcaggaggttctgtttctatatcagcaacaacaaacgtcgccgctaattttcaattaaaagctaatggagttgttgtaaattcaacatctactccttctgtttcgtactcttacacctatatggtatctgcagatgctgatatggaactcattgctacagataattccgggactaaaaatgcgaaattcataatacagattccaagaaatgtaatatctcaggctattccttcatggatacgtcaaggcattaattatcatcctaccgacaatacaaaggttggtttagcattgtatgctccccataaaaactttgtgcatgtcatcggaagttttaatagttggacagtaaatgataattacctgatgaaaagggatactacaaaccctgatttatattggattgagttagatgggattaccccgcagcagctgtatacttttcaatacagaacgaatgacctgaaaaaagtagcagatcctttttctccgcagattttgtcttcttacgacgaccaatggattccgtcatccacatatcccaatttgccaccctttcctgcgggacagaattttgaagtttctatgtttaaaacagggcagccaaattataattggcaggttaccaatttccagagaccagataaagaagatctgattgtatacgagttgctattaagagattttacacaggaaaaaaactggcaatctcttatcaataagattacctatttgaagaatttaaaaattaatgcgattgagcttcttcctattatggaatttgaaggaaatctttcatggggatacaatacctcttttcattatacattagataaggcctatgggacaccggagaaatttaaagaatttgtagatctgtgccatcaaaacgggatcgctgtgattttagatgtggcatttaaccatgctacgggaagatcaccactc

SEQ ID NO: 85747 - DNA, 210 bp, Glycine max
  Peptide Sequence Number=SeqID_202525
ttgatcttagctcatcagtgggctaagcacgcatccaccactaagcgcagctacaacatgcttagcgcgacagaagaatctggcagggcatcaatatcaaggtcgcgcgctaagcgcgagatcaaggcgctaagcgcaacagttgtctttagccaggctcagtgcatgactggcgctaagcgcaatgtcacgaattcagagcctatttaa

SEQ ID NO: 85748 - DNA, 726 bp, Glycine max
  Peptide Sequence Number=SeqID_202526
atgtgtttacaaggcaatgcccaattaattgatgatcaagaaactaataaatttgcaaagtggattctagatattggagatggagttattgggaatcaaaatgatggatatgctactgttgaaattcctgagtacctacttattactaaatataatgaccccattgatgctatagtcaaatcaacatttccaaatttatatcaacatcacagtaatcctgatttcttcaaatctagagcaatattagcttccaccaatgaaacagttgaagaggtcaatgattatatactttccttgattccaggtgaacaaatggaatacttaagctctgattatatagagaagtcagaaaacattgacagttggcatttccaatcaatcacaactgaatttctcaattcactaaacacatctggtctgccaaatcatcgtatcaagctaaaaatcggtagtcctataatgttgctaagaaacttagaccaaatgcaaggactctgtaatggtactagattagtaattactagactagtcaaacatgtcattgcaactgaaatcatttctggcaaaaatcttggcgataatgtttacatcccaagaatgtcaatgtcaccttcacaatcaccatggcctttcaagcttttaagaagacaatttccaatcatgctatcctatgcaatgacgattaacaagtctcagggccaatcactttctatagttgaactttaa

SEQ ID NO: 85749 - DNA, 654 bp, Glycine max
  Peptide Sequence Number=SeqID_202527
atgagtctggcgggctttgtgcgctggcggtttgatgatccccgaggcggtcggcttttcgctggtcgccggtctttcgccgatcgtcggtttgcacaccgcgtttattatcggcctggtcacggcgctgttcggcggcaagccgggcatggtttccggcgccgccggctctattgtggtggtgctgatgagcctggcggcgcagtacggcatgggctacgtgctgtgggccacgctgtttgccggggggattcaaatcctgatcggcgccttccggctgggcaagttcattcgtctggtgccgctgccggcgatccacggcttcgtcaacggtctggcgatcgtcatcatgctggcgcagctgaagatgatcgccgggcaggggccgctgatgtacggcctggtggcgctggcgattgcggtggtggtgctgttcccgcgcctgaccaaagccattccgtcttcgctggcggcgctgctggtggtttcggcgttggcgatcggcctcaatctgcacacgctgcgggtgggcgatctggcggacatttccggcgcgctgccgcacttcagcctgccgacggcgccgttcaccctagaaatggtgcgggtggtgctgccctatgcggtggtgattgccctggtcggtttgattga

SEQ ID NO: 85750 - DNA, 237 bp, Glycine max
  Peptide Sequence Number=SeqID_202528
atggcagtcacagcacgggcttctccttcatcctcaccctcttcatttgccccagttttctcattcgtccaagccaggatgactaaatttgcctcttttcagacccacatcgatcctttcactggcaaagaccaaatccgcaaagctttgaaggtgccacttgagctgctaggttctccacctttgggcgtattctttgaaagattcgtgccccctttttttgcacatgttttgtag

SEQ ID NO: 85751 - DNA, 462 bp, Glycine max
  Peptide Sequence Number=SeqID_202529
atgaaaagagaaaaacatgcctcgtatagtagtcataactcttgcaaaagcctaagtgaagaacttcgtgactattacgaaggaaggcataggtcacatcttagacctcactcccatagaagagaaaaaggacacattacttctcaatgcccctccacaaaaacgatgattatgaggggccaagacatttatagtagccaagatgaggctactacttcaccttcctctagtgaaagtgaaaaagcaaaaggggaagaatctagtgaagaaatctacccccaagaagaaggacaaccattagtggttaaagagaagtgcaaggaggcacttgctagcattgccacacctcttgggcttgagtttattcctcaagtaaagaagttgttggatgagggtttggttcgcaagagcttaaatccttgtgctttgttggtgcccaaaataggtattattaggcactaa

SEQ ID NO: 85752 - DNA, 213 bp, Glycine max
  Peptide Sequence Number=SeqID_202530
atgacatcagggagttcataccttgcacacacacttgaattggatcaaaggtttcccgggaagacgagacaagatttcctcgatgagttcgtcacagaggagtggcgaccatgcgaagcgccgaaacactctgaatccaaattctgtacctatcaagacatgcaccttcgtgaacagtgcatatatatatgtcccaatgtttctagggtttaa

SEQ ID NO: 85753 - DNA, 1171 bp, Glycine max
  Peptide Sequence Number=SeqID_202531
atggaacagacaggccagcgcccagatggtggcgcagatgaagaagccgagtttgaggccaatgacatcaatcagccagccgcagatcggttgaaagaagttgacagtgacgccggcgagaaacagcaccagcacccaccagcgcagatgacggatgacgcgtttcgtgccggttgcggcaatccctgggttcaaactgcggttcatcggattctccattcattattaacagcatgtgtgagcaacgtctgtgactgcctggccggaggtggagtccataccggccagcgcataactccctggcccttgattgccgggcgtggcgtgatgcgtcctcctgatgcggtatttgtgatctggttaaccaaaatcatttatcaggttgacttccgccgggctttgagagtgatgctcaggcccgtaggagagaacgacatgaagcagacctggcgctggtatggccctgacgatcccgtttcactcgccgatgcccgacaggcgggcgctaccggcattgtgactgccctgcatcacatcccgaacggcgaggtgtggccagtggaggagattttgcagcgcaaagcgatgattgaggcggccgggctggtctggtcggtagtggagagtgtgccgatccatgaggagatcaaaaccggcagcgggcagtgccagcagtggatcagcaactatcagcagtcgctgcgcaatctggcgcagtgcggcatccacaccgtgtgctacaacttcatgccgattctggactggacgcgcaccgacctggcgttcgagctgccggatggcgcgaaagcgctgcgcttcgatcagattgaatttgcggtatttgagctgcatatcctgcagcgccagggcgcagaaaatgattacagcgctgacgagatagccgaggccgctgcgcgcttcgccagcatgagcgaagagcacaagctgcggctgacgcgtaacatcatcgccggattacctggcgcggaagagggctacacgctggcgcagttccgtgctcagctggcgcgctatgacggcatcgacaaagcccggctgcgcgagcactttgccacgttcttgcgcggcattatcccggtcgctgaagaggtcggtatccgcatggcggtacatccggacgatccgccgcgcccgatcctcggcctgccgc

SEQ ID NO: 85754 - DNA, 189 bp, Glycine max
  Peptide Sequence Number=SeqID_202532
atgccagccgacgtcggccaggaaaagatgacagatcgaggtctcaagaagaagcatgaccggatgactccgatcgaacatttccaaatcgacatcgtccaaccaacattgcgcaatttctttcacaaacgctggccgataatatttctttcggtaaaggatgctttcgttgttgggtatcgcctataa

SEQ ID NO: 85755 - DNA, 435 bp, Glycine max
  Peptide Sequence Number=SeqID_202533
atggtgcccgtcgataattgtgccacaattactggacgacagaaaaaacgcttcagtctctctgcctccctccctctcgtgttagccttcttcctcctccatcccaccattttttcttcttcttcctcacctgaactgcttttgttcttcttcctcacccatcacctcacctcacccgcgttcttgctcctcacctcaccctcgtctcaaaaaagcttcacccagcgtcgtcatcctccacgccgcgtttgttctccgctgagcatcgtcttcttcctctgtgttgggagtccctgttctgcaaccgcgcctccattggtgttgagtagcccaggcaaattaagggtggtgttctccctccgcacgtcggcattgtcaagcttactcatcaaggttctttctttctcacaaggtgttagttacacgaattctcag

SEQ ID NO: 85756 - DNA, 205 bp, Glycine max
  Peptide Sequence Number=SeqID_202534
atgttgataatcattgatcaatataaagagaaggtgaacctagctgctagtcatgggcaaatgctggaagatgaacaggcaaaggtgtcgaccttgcgggttgaaagggaagcgagagaaggggtgatagagttattgcataaagaagccatgaaatggatggatagatttgctctctctctaaatgagagtcaagagctccaag

SEQ ID NO: 85757 - DNA, 543 bp, Glycine max
  Peptide Sequence Number=SeqID_202535
atgacggcgatacgcatgtcagtacctcgcctttgccagcacccactcggggatggccttgagtcccttgaccaacccgaacgccgccatcacgcgcaggccgtaccaggtcaggtcaatttcccaccagcggaagccctggcgcacggtgcccgggaagaagtggtggttgttgtgccagccttcaccgaacgtcagcagagccagccagagattgttgcggctgtcgtctcgggtctcaaagcggcgacgaccgaagcgatgagccagcgagttgatggtgaccgtggcatggaacagcacgatggtggaaatgaagaatccccacaccagcagctgcgggccggaggtgtgcaggcccggagcccattgctccagtgctgcacccaatgcatacaggccgatggccagcagcacgggaatggcggtatcgaaacggtccagccagcgcagctccgggaagcgcgccaggtccggcacccgcgacagggtcggtggcgaaggcttcgcgggtcaggaaccaacccatgtggctgcgcctga

SEQ ID NO: 85758 - DNA, 264 bp, Glycine max
  Peptide Sequence Number=SeqID_202536
atgatgaaagtgcccgatggcgccaccgtggcggcgatgttaaggctggagcagattctcggccggcgtccgggcgcctctaccggcaccaatttctggggcatgctgcaggtggcaaaacggctgcgcgcgcaggggcaatccgccgcgctggtcacgctgctgtgcgacagcggcgagcgctatccggatacctattacaatccgcagtgggtcgctgagcaggtcggtgatattcaggcgtggcagcgcgagctgcaataa

SEQ ID NO: 85759 - DNA, 285 bp, Glycine max
  Peptide Sequence Number=SeqID_202537
atgaccctttcatcatggcagaacaagctagacaagtattttacgtgcaagacccttgtgatgaaaggtgagacagaggtcaccaaagcaatggttcagcttcagaatgtgtcgcaacgtgccctttcgcgggcgagcgagggcgaggctcacgggtgtactttccaaaggaggaaaggtgcgcggagtcgccaccaacgtttatttgtggaaaacatctgggaaaaccgaatggttctcggtcaaaatgaacattctaagttcgggagtcgtatttacgcttga

SEQ ID NO: 85760 - DNA, 603 bp, Glycine max
  Peptide Sequence Number=SeqID_202538
atgccctcaaaatcctcctcacactcgtggcacgtgttcaccgccacgaatattcctcatcactctcacgcgccttacagccaaaaccacgcttacaccatggaaatctgcatgaccgacctcgaccccgtcctcgcccggaagtttttccgccgccccggcgacggaaaaaccggtgactccgcggggaaggaaatgacggagctcaccggaatcggcgagattaactcgcacgcgctcgtgtgcgattttgcgttcgacccgtgcgggtactccatgaacggcatggatggggagtggtactccaccattcacgtgacgccggaagacggttacagctatgcgagttttgaatgcgtggggtccatgtccgatgacgtggacataatccacgtgttgaggaaggtggttcagatattccgaccggggacgatgtcggtttctacgacgtcgtcgttggggagcgaggtgtggagagaggtagcgggtgcggtggagcccatgggactgaagttgagaagctgcgcgatggaccagttcccggattctgggagtgttgtgtttcaaacatttacgccgcttcgccggaaaagtgcacagtag

SEQ ID NO: 85761 - DNA, 351 bp, Glycine max
  Peptide Sequence Number=SeqID_202539
atgtttggggtgcataatgataactttccattgtatataaagcaggaacatctttctgaaatagcacatgatggtcaatgtctgagcatctctgttatacaattgtggattttgcatatgactgaaacaagtatgcgagcagggaatatcgatgtgtatggattcctcgagccatactccatacaaaaatttgggcaatcgcaatttgaatcagaagattatattaagaaatggatgcagaattcactgagagatgtgtacctaggagcctacttgaatggtgctttgaagggattcaacaacagtcatggaagtaaatccaagggtgttgctagatggattttagttaaa

SEQ ID NO: 85762 - DNA, 174 bp, Glycine max
  Peptide Sequence Number=SeqID_202540
atggaacttatgccatttcatctttttgtattcagtggatctcatcaattgttttctggagaaagagagctcaccaaagcaagtagggttatgacgataataggattcctgggagagggagaaagaagtagggattccatggcgggtgcaagggagaagggtagggttaagtaa

SEQ ID NO: 85763 - DNA, 273 bp, Glycine max
  Peptide Sequence Number=SeqID_202541
atgcaggatatgctattgggttcaatggatacttcggctacagcaattgagtggacactttcagagctcctaaagaatccacgggtgatgaagaaagtccaaatggagttggaaactatggtgggaaaagatgaggctccatccagtggcaccgttactaatgccacaccaatcgagggaagattgcatggttggagactttttcataccaagaaaatcaagggtggtagtaaatgcatgggcaattatgagagactcaagtgcatggagtga

SEQ ID NO: 85764 - DNA, 453 bp, Glycine max
  Peptide Sequence Number=SeqID_202542
aaccatcctcacacatacttcagtacccctgcagtagaaccttcttcatcaacccgaccaaatgagcctgagttcacaacagagtcgggcttacctaatgaagaactcaatccctttagtgaggaccaagacgaagtttttcacaatcaacctcaggaagaagatcataaggaagaagcctggcctgtgtcaccaatcacaaatgttccaccacatatacaaaattttgaagaatcctattttcaagattttgaatatgggcatagcttgaattgcgatgaagtcaacatcttgtgggaactctcttcgtttttgatgatgctaaagtataatcaaacaagattgcttcaagaaacattcaaggttaagcaaacagagattgcttcaagattaaatctagatgaagaaaacaaagatcaagaagaaagctacgtcttagtctatctttgttga

SEQ ID NO: 85765 - DNA, 249 bp, Glycine max
  Peptide Sequence Number=SeqID_202543
atgaaaaaatccgacaagaaaaatttcaaagataagaaagaaaagaaagcatatatcacttgggatgataatgacatggattcatcaagtgattcagaaaatgaaatcataaatctgggcctcatggccaaagactatgaaagcgaagaagaggtaacgtcttctaactatgacttatttatttcttttgatgaactccaagatgaattcaatgattttcataaagaatcatcaaacttgccaaattag

SEQ ID NO: 85766 - DNA, 504 bp, Glycine max
  Peptide Sequence Number=SeqID_202544
atggtggtggagaaggaaacactgccaatgcaaccacaaggatgtcaactagtagagggttacgttatgttccatcattttttttggagtttcaaaccgtgtataaatgagtttcaatattgcaagcccatagttcaggttgatggaacatggttgtacgataagttcaaggggaccctccttatggcagttgcacaagatgcatatgcaaagatggagcctatgtttaattattactacaacatgttgagcgaggaagcaaatgctaaccgagcaattaattgtcttagcaagattctaaatctacccataggtgcgctagtaaaatccatatataaggttaaggcattgttcaacaaaaaggggagaaaagctgcaataatgcttgcttttaaccaagtttatatggaagtactaaacaaaggcatcgaagatgcacttagaaaggcaaacactcacaacattcttcagtttgatcgacgtgacacacagttcttggtctaa

SEQ ID NO: 85767 - DNA, 555 bp, Glycine max
  Peptide Sequence Number=SeqID_202545
atggggcgccagcggcaagaacagcaccaccaccgcttccgccgcccctctgaccccgactcccgcccccatcgcctcggatccagaaccgcgcgcaaccgattctcgctccctctcaaaccattgccaccaccacaactacacaaagccgaacacgatgacgcagacgacgccgtgcagaagccatggaaccagcgccctcgcaagcccacgcttctccccaaggccacaatcaagatcggcaccggaccttcccgaaaccaccaccacgccaccaacaacggagaattccacgacggcggcggcggtggcggtggcgacaacaacaaccccgcaccgaagtcgctgtggctccgtgggttttctgtcaagagtggaaatttcttctttgttaattgtctttcagtggggagtttcttattttatttggttttagtgcttgtcagttatgttgaggtgtcatttgaaggattcaagaaaggatttagactacgggaaattgtggaagcctccatcaaatcatgggtttataccctgtacaaagcctactcctaa

SEQ ID NO: 85768 - DNA, 234 bp, Glycine max
  Peptide Sequence Number=SeqID_202546
atgtctcaacttctctacatgttcttagtggcaagaattatgataggtgaaattgtcaaagatgttcaagaacttggagtgaatcccatagaggcacaaaggatgaaggatcaagaaagtgtgactgattattttactcgaatattgatccttacaaatcaaatgaagagttatagtgagaagctaaaagatgtgatggtcatcgacaagattctaagaaccttgaagggatga

SEQ ID NO: 85769 - DNA, 174 bp, Glycine max
  Peptide Sequence Number=SeqID_202547
atggtgacaccaaaggagcacgttgaagaaatacgaaggaacaagttttccattggcaaggaacccaacccttggttgaagatttgcaacaagcagttaagaatctctccgttgaactttataccaaagacgctcacttccttattgccaactcattcaggttccattcaataa

SEQ ID NO: 85770 - DNA, 214 bp, Glycine max
  Peptide Sequence Number=SeqID_202548
atgggtactggagacagtccacgtgcatcaattagggatgaggatggtgttgatgtaggtacctgggacgatccacatgcaccaatcagagatgaatatggtctaacttcagttgaaggtgaagatggtgtaggtgcaacatccaaagatctgattagcatagatatagtagatggggatatggtagatgatggcagactatctctaggtggta

SEQ ID NO: 85771 - DNA, 318 bp, Glycine max
  Peptide Sequence Number=SeqID_202549
atggctccaaagaagctcccagccaagaggtctaggaaggatgcaactggaaagggttccagtgcggctccccaggcagatatggactttgatcgacacaggttccggagtgcggaacaccagcaatgttttgaagccattaaagaagaaggagtcagagacaagcactcctgggtgaggggccagtggatccctttcgatgagaatgccattaatcaatttctggggcatccactggtcttggaagaaggccagcattgcgagttcagccagtggaggagtcaggccttaggctttgataaggaggctatcagctag

SEQ ID NO: 85772 - DNA, 411 bp, Glycine max
  Peptide Sequence Number=SeqID_202550
atgttgctacttagcaacattttccccagtgaccataattcagacctccccttgctgaagtgtcagttggtctacgccatcatgactcagttctatggagtgtcggtcgccccaccaagctcattcggcctcctatcagcagagccttcattgagaagtactacatgcccaggcaagtgcagggtcagctatagatgtgccaccgcctcctctagaggaggtaccatctctgagagtcaggaccccaatcctttcccttggcctacccccgaacagttcggggccatggtgacctggcctggagacgagactgattttgagacgcggccaggacccgtaggagcccttggggatgacggaggagttcaggaggatgaaggcatggctgacatgttggatttcttcacttga

SEQ ID NO: 85773 - DNA, 285 bp, Glycine max
  Peptide Sequence Number=SeqID_202551
atgatgatgctaatccgatcaaaatgcaaacttgtgaaaatgtgtggtgtttgcgtttgtgggtctctcgaaatgtgcatgtactcgacggaaagcgtggtggcgagtctcgaaaatcgcgtgtttaaggttggggatccagtgattccagtgagtcctattctgaagcagtgggtggaagaaggcagagaagtcaccaaacttcagctcgaaaatctcgtttaccgcctcactcaatctcgtcgcttcacacatgcccttcaggttgtgtttggaatgaggtaa

SEQ ID NO: 85774 - DNA, 363 bp, Glycine max
  Peptide Sequence Number=SeqID_202552
atgaaaaaatacaaaggggaaaggaatattgaacaaatatggaaaaatcccatgtcattgtcactggcggtggttctgcaagcgagcggtgatggtggctcgagggacagtcgtggtcacacaagagagcgacgttggtggttcaacgtgtggcggcgaagggtggttacgaaacgaaaaagaaggaaaagggggaagaagaagaagtcaatgagaaaaatgaagttggaaaggtgggaaggggaaggaagattatggagttggatggggaagtgggggaagggggaaggttctggtgagaaaaagaagaggggtggggaagtgggaaaagcaacatggggaaggagaaaggttctagagtga

SEQ ID NO: 85775 - DNA, 1737 bp, Glycine max
  Peptide Sequence Number=SeqID_202553
atgagcaatgaaaggaactatgagttgtctccgggaaacattgctaaacagatcaacctgatatcaaaagtccgtggccttgaacaggcagagaaatattttagaggcatccctgatgctaaaattgagttcaagatctatgctgctcttttgagatgctatgcggaacataaatctgtggaggaagcggaggctgtcttgaaaaaaattaaagagttgcatcctgtgaatataactgcatgttgtaatatgatgttggaactctatgctaagaagggtaagtacgagaaactggataggttgatgcaagaaatgaaagagaaagatatatgcaatgctggtacatatacgattcggttaaatgcatatgtgatcgccacagacataaaggggatggagaagttacttatgcaaatggaagttgatcccatggcaactgtggactggtatacatacatgactgcggcaaatggttatcggaaagttcacaattttgagaaggttgcagcaatgttaaagaaatcggagcatgtagccagaggcaagactaagaggcttgcttatgaatctattcaaactatgtatgccattattgggaataaggatgaggttcatcgactttggaatatgtgcactagtcctaagaaacccaacaaaagttacatacgtatgttaagctcgttagtgaagctggatgacatcgatggggcagagaaaattttggaagaatgggaatctgtacatgaaaattttgatgtcagaattccaaatttgatgatcagtgcttattgtaaatggggacagtttgataaggctgaggcttatatcaggaggcttttggatggtggcaagcatttagatggaagaacatgggaccgattggcgtgtggctataatgcaggtaatgatatggagaatgcagttcaggcaatgaagaaagcagtctcgacaaatctagcaggaaggaggccagacccctttactctggttgcatgtgttaaatacctgaaagaaaaaggagacttggatttagcccttgagattcttaagttatgcatagagaacagccatatctcagtcacttcctatgatggactgcctgaagcaagagcttcatcgcttatatgcttacccagacacttcgttttaagcagtatggagagtagtccctctcagctgagaaattggatttgggtttgttattccatcatgcaccttctcgctaaatcactttcaccatcgtgtaatctttcgtcattcacggcgtcgtcgcctgtgactacggttaatttagaatcacactgttcgggtcaccccaaaatcatcaaacctagtttcaatcacaacaggatcaacaccttgcacactggttccactgtagaacatgttgaagtggatgaggaagaagccaaactcgatgtcattgtggaacccattttatctaattactacaacacttccactctctctcacaagtcactacaaactgcgttggccattcaccttgccatcaaacatggcaacacaagacttccaaggattaagaatcccaacgcctacatctcaaaaacttttgttcccttacgcgtggttacaaaatctgaactcaacaacctctctcgcacaacacaagaattggaagggaagagggggtgcttgggtggcacagggaagaggacaacggtgcaaggaaatagtcattttgaaatgggggtgttttctgttggagtcttttag

SEQ ID NO: 85776 - DNA, 474 bp, Glycine max
  Peptide Sequence Number=SeqID_202554
atgggacctggagcaattcagcagcaatgtttaggcgccttcagagctaatggatcagacttttttttgcgtgtgtgggaagatagcaaggtggaacaaccacccaagaaaaataggctttcatactttatgactactccattggatcatcacaaagacctaaaagataaagcaaagtcagtttggggagatgaggaccttgcatgtatatccctaaatcctggtgcctctgctatgcataaacttaggtgtggcaggccacagccatcttgggatcgtacatgtacagcagcagcagctgctggcctgctctcagagctccaacttcttccacagtttagcaccgttggattggatgaacaggaagaagcagtagaacatgctttaacagtcctattagatgccctcacaaatagacgtcttcgcgtgggaaggtctataacacgaaaaatgaggcataccaacatccaatag

SEQ ID NO: 85777 - DNA, 145 bp, Glycine max
  Peptide Sequence Number=SeqID_202555
gaggtttccagactatggaaagctaaatcctctgttggatcttccctgtaggtacctgattggaaactggtctgattctaaagtccttgatagtacggggctaagttgttgtactgtcacgaggaatcggggtacaagaacttag

SEQ ID NO: 85778 - DNA, 330 bp, Glycine max
  Peptide Sequence Number=SeqID_202556
atggcgaaggaagaagaacaaggaaactcgacagagatatacatacctatgtatttatgtgcatacttgagagtatatacatacacacacttagggaaatgcagaaagaggaagaggaagcctctcgaagagaacagattctccgctctagggttttgcgagaaacacggacatttcgccattgatgacaatgacatcattgaggatgggtcgtggcatttttgtatcgactacagagccctcaatgtgttggctgttaaagactgtttccccattctgacagtagatgagcttttagacgagcttcataggtcctctattggggcatga

SEQ ID NO: 85779 - DNA, 609 bp, Glycine max
  Peptide Sequence Number=SeqID_202557
atggccttgctagtcaacaatgctaatggctctgccaatggtcttctcggaaaagccaagaagcttatttcgatactgaccatgggattgaaccacaactatgcggttgaccctgccacactgccagaaggagtggaggttactcataggaaccttaatgacggaagttgtgctggccttgcattccctgctcaaagaataatgtctcttcaataccacctaaggcatccccaggaccccatgattctgattgcggttaactatgttgtgaataatgtaattgaacttgaacttcaagggggcccaaaacatgttaagtacgctgtagttggagggctttcagatcagattcggcaacttagggaatcgattgaattacctttaacaaatcctgagttttttctcagggttggaattggaatgaaactccccaagggattgctctggaagccaccgcctgaggaggaggactcatcgtcgccactgtcgtcctccgccctcaaatctgttgtcttaccgctctctcacgacagggaagtctctgtcgatgaaaactgtctattcacagagtcactgaaggcaatgggcggcgagaacattgacacgtaa

SEQ ID NO: 85780 - DNA, 483 bp, Glycine max
  Peptide Sequence Number=SeqID_202558
atggagatgcagcggaaggcaaaggagaagaggaaaggggaggcacctccactagggaataagccatggaagaagaagcttcaccaccatgaatgtgccttgaataagaatcttgaagaggatgctttaatggaggaaaagaaagagagaaggggggagcacaaaattgaaggaataaaagagggagagaagtggaactttgaagttttgaaactacaagtgagaatagagcaagaaaatgaagtgaaaatcaagcttggagttgaaaatcgaggtcacttacctaaccttgatggaagaatggctcaacaacacttggtaaaacttggaagaagaagaaaaatatggtctcctctttctacaaaagcttcagaaaaatgggagaactggcctagactttggcttttaaaaacaacacttattgtgggtgaaatgcttggaccaatgggattgcaaggcctaatccttatctttttaatttaa

SEQ ID NO: 85781 - DNA, 378 bp, Glycine max
  Peptide Sequence Number=SeqID_202559
atgaggggtggaggttgcacatcagctcgcccaggcgagttggttgcttcctccagaagtttccttgcttgcccaggccagctcaactcgcccaggcgagctggtttcttcactcctaagttttttgggaaatccggtttgccggaaagtgcaccgggtcgtcaattaattaggcaagctttgaaaagtgttgtttttcaccttctcgctaagccaatctgctggcttagcgagcatccgctaagtgcatcactcatgggctatgcgcgaggaagactctggaagaagattagctgtacaggttcgctaagcgcaccgcttcatctcactaagcgcaccgcttcagtccatccgctaagtgagaaaggcgcgtgctaa

SEQ ID NO: 85782 - DNA, 375 bp, Glycine max
  Peptide Sequence Number=SeqID_202560
atggctatgactcgtatcctagtactgctgtgtttggtttttgtatcacacatgggtgaggcaaaagtacttgtgccctctgctatctctgcttgtgaacgtatatttgagtacttccccaattgcttagaattcctggtgggggatccaaattatgttaggccatcaagaagatgctgtcaacatgttgtgaagcttaacatattagcccgtcataggacaggccccaggaccatttgttggtgcattcaggtcatggttaagggaatgacaccagcattggtcccctccaagatacaagatcttccccttatgtgccacaccaccctcagctttcccatctctgatagcatcgattgctccaaggttggttag

SEQ ID NO: 85783 - DNA, 2676 bp, Glycine max
  Peptide Sequence Number=SeqID_202561
atggcgtctttaccttctagtcgcagcaacggtggttccaacggctttgatttgggttccggcgacatcctttgttcgtacgaggaggacaataccaaccacgattcttctgacggcactcacatcgatcccgccaagggttctcatgcatcaaggatggcaagaacatcagtagttcctgctacagcctatagttcgtctgaagattctttgagccaggatgtgattgcaattgttgagaagagtatgaaaacacatgctgacaaccttatgcggtttcttgagggacttagtacaaggctgtcacagttggaattatattgttacaatcttgacaaatcaattggagcaatgcaatctgatttaacttgtgaccatgaggaaacagattcaaaactcaaatctcttgataaacaccttcaggaagtacacaggtctgtgctaattttgagagacaagcaagagctagctgagactcggaaagaattagccaagcttaaacatgttcggaaagaatcatcttcctcaagccatttgcagtcaaatgaggagagatcttcaccttcttccatggatccaaaaagaattgataatgtatctgacacacagaaccaagagctagctcttgccttaccacatcaagttgcaccccggcaacagcctgtggcatcctcctatcaagtgccagccccaaatgtgagccaagccactcaacgacctcattattacttgatgcccacccatttgcccaatccacaagctgttactcagcttcctcagaatcagtatttgccttctgatccacagtatcgaattccactatcaacatcatcatctcaggtaatccaatccccacctgtgcaacaattttcacagtatcagcagctacagtaccaacaacagcaatgggctccacagttaccaccacagcaggtgcaagtgccacctccacaaccaccctcagcagtgtctcaagtgagacccccctcaacaaatgtttacactccatatgctaccagccaagctacaaatcctcttcccacagaaacactaccaaacagtgtgccaatgcaaatgccttattcaggaattccaccccaaggatctagcagtggtggtggcggcagtgatgctatgccatatggatatagcggagctggtagaacagttcctcagcaacctctgctccagcacatgaggggctctttttcagcacagccaggtgatgtgtatggaaatagtggaacgcacaccatgcgtcctccggctagttcctacaatgtgtatgatggtgagaatgccagagcacattatccacctgaaccttctcattatgctcaagctggatatcctccaactagtgcatcccttcacaaccctgcatcacataatcttatggtcccgagtcctagccagtcacaatttattcgtagccatccctacaatgatttgatcgagaaatttgtgagcatgggatttagaggcaatcatgtagcaagcattatccagaggatggaggaaactcagcaacctatagattttaactctgtacatgaccggttgaatgtgcataatccccagaggggatggtcagggttggtttccgtggagacaattgggcttggagtgagggaacacatttttaccggttctgtttcctctcttgtatggttcatgtcaggtcaagaaacgagttttgtcacattggggcagagggttttggcaaaccctctcaaagttcaaatgcattatggccaccctgatgtgtttgacaggttttggttcataactagaggtggtggcatcagcaaagcctcaagagtgatcagcataagcgaggacatctttgccggctttaactgcacacttcgtggaggtaatgtcacgcatcatgaatacattcaggttggaaaaggaagggatgttggattgaaccaaatatcaatgtttgaagcaaaggttgcaagtggaaatggggagcaagtactaagcagaaatgcgtatagattgggccataggcttgatttttttcgtatgttgtcattcttctacactacagtggggttctttttcaacacaatgatggtggttctcaccgtatatgtattcttatggggcagattgttgcttgctcttagtggcattgaagatgctatggaaagtaacagcaacaacaacaaagcactagggttccttcaagctgtttgggacttcttgaccatgcagctccaactttcatcagttttctacacgttctctatgggcacatgcagccacttctttggaagaatcatcttgcatggtggagcaaaataccgagtcacggggcgtgtctttgtagtggagcataagagttttgcagaaaactatagactctatgctcgcagccattttatgaaagcaattgaactggggctaatagtaacagtttatgcatcacacagcactgtagcaactgacacgtttgtttacattaccatgaccttctctagttggttcttggttgcatcatggatcatggcaccgtttgtgttcaatccttctggctttgactggttgaaaactgtgtatgattttgatgacttcataaactggatttggcaccgccaaagggtgtttgctaaagctgaacaaagctgggaaaaatggtggtacgaagagcaaggtcatcttaag

SEQ ID NO: 85784 - DNA, 261 bp, Glycine max
  Peptide Sequence Number=SeqID_202562
atgaagcagtctcttctgctgagaggcgaaagcagtgaccagagttaccagtcgcggggaatattccggcgctccgatgctatcgcctacggctccaactacgagaaagccgctgcgttcatcgatctggtagtgtcttcgttaatattgctgtttcgtaatacaagagctacaaaattgcgaaggatctttgtttccacagagatgaatagaagtaggagatgccaaagtggagaggaagatgaaaattttcaaaagtag

SEQ ID NO: 85785 - DNA, 390 bp, Glycine max
  Peptide Sequence Number=SeqID_202563
atggttcacatggagctacgagaaaccatcattatcttggttgggatgcttgacacatacttaaatgtcttggctttgtggcttctgtttcttctttttgctagctgggtggcgtatgtgttttttgaggatacaatacaggggaaaacagtattcacttcctatggtactacattgtatcagctgtttcttttatttaccacatccaataatccagatgtttgggttcctgcatacaagtcttcacgttggtattgcctgtttttcatactatttgtgctggtgggggtttactttgttacaaacttaatccttgctgttgtttatgacagtttcaagagtgagttgactattccattgtcagacatagctaccagcctaccacactga

SEQ ID NO: 85786 - DNA, 549 bp, Glycine max
  Peptide Sequence Number=SeqID_202564
atgggaagcaacaacactgtgtcaaagatgggtaggttccttcttcccctcccattagcttgggtgttgctaaaagggaaaactcaagtcctcaaggtgaagggccttgaaaaaggccaaaagtggagccagttccaattgttgcttcttcctctattgagagtcttcctttctgcgaaggaatggactacttctctttgggttaaggacttcaatcctagcacccttatcaggtctccatggcttagcctgttggatcacaacatgctaagggaacctagcccctatgacatggagattgctaatttctgggttgacgaatttatgaaggtcaatgtcgagtcccaaaaggctcaaattgagtgtgccaaatttgaatgggctttgattgaagccaccaaggccaacaacagcctgctgcaatcaattgaaaattccaagaagtctcttgaagatacagagacaaagttaaagaaggccgagatccaggaagaggccttaaagactaggttattctccatcgagaattatgctaaggctttcaaataa

SEQ ID NO: 85787 - DNA, 624 bp, Glycine max
  Peptide Sequence Number=SeqID_202565
atggtttctgtgggcccaggcaagttctacggcaccagcctcccccgccctcggatctacaccgacgtcaagttcaacgaccaccgcattgacccacccactcccgtcaacggcccacttatgtcctgggcccaagaagcccactggtccatgggcggcctcagcttcaagcgcctccgcctccagggcaaaatagaaggcaacgtcgaaaggctccgctaccagcgcgagaaggcccaagcccaaagcccgagcccaccacccccgccgcgctccgttctccgcggatccaaaagaacttcctccccttcgccgccactggctccgttcgcgacgaaacgccgaaggtgcatggatctgatcctagaagaagaggttgaagctccgagtgctggcgttaggaagagtcgcttagtgaagaagcttggcgatgattttgatagggtggcttctttggagaacgagggtgctgaaacgacgtcgttgaagactcggagtaagagattggttaaaggtggcaaacctgtgaagaagatggcggttgaagagtcggagaaatcaaagcccaaagcaaagaagagtacagctgaagctgctgggaagagctttgtttctgttaacgct

SEQ ID NO: 85788 - DNA, 786 bp, Glycine max
  Peptide Sequence Number=SeqID_202566
atggagcttactgtcttgaccaggaaaaatactatcaccggaattgaatatagaaatgaccccagcatttttggttgggaattgattaatgagcctcgttgcatgtctgatccttcaggtgacactctacaaggatggatagacgaaatgtcaacttttgtcaaaatgattgacaagaaccatctgttgactgtgggtctcgaaggtttttatggtccaaacgatccaaaaagttcaactgtcaaccctgagctttgggcatccagacttgggtctgattttattcggaactccaaaatatcacacattgatttcgcctctgttcacatctatcctgaccattggtttcatgagcaagtattcgaagatcaactgaaatttgtctacaagtggatgctttcccacattgaagatggtgacgaagtattgaagaagcccgtcttattttctgaatttggactatcaaaaacgaaccagaacttttccttgtccgaccgggaaaaaatgcatagagctgttctagacataatatataaatctgctaaaagaaacaggtctggagcaggtgctctggtttggcaattcctagttgggggaatgaaggagttttctgatgaatatgggatggtcccatgggaaagttcgtcaactccccatgtatttattgaacagtcttgcagattggccaatgcaaagggatggactcaactggatattcttataaacaaagttcaattcaaattgtgtcatactgataaacaaaatctacaaggaagacccatgtag

SEQ ID NO: 85789 - DNA, 531 bp, Glycine max
  Peptide Sequence Number=SeqID_202567
atggattctgccaaagtctttctccagagaagtttggcgattctggaggagaatggacagtggcatcaagaggctttgcacaaggtggagaaaaaggaccttgacggcaaggtggagagcattgcggttgagagggatgggccttcaaaggtagttattgatttagaagctcaacttaaggagtcggagtacaggttggaggagtccgagttgtgggctgcgaaggaaaggttcttcgccaaggaccttgacatgggtctctttgaccctttcaaggatgtgaaggatggtgtcttgcttgacgaggaagacattgctgcagaggaggaggctgttgatgaggcagggtgctgcagagcaaggcggccttgtaactatgacaattatttttatttttcttcaatgcacatgctttcctttgatgacgaacttcgcactgtttatgcatgtcttgtgtgtatgtcatgctgtcatgatgatgagtgtggaatctttgacggtgtaggaagtaagacctttgtcgatgtatag

SEQ ID NO: 85790 - DNA, 954 bp, Glycine max
  Peptide Sequence Number=SeqID_202568
atgacactaaaagcggctccgaaaaaaccctctcttcggataaagaagcccaagcccattagcgaaaaggcaccaaattttcagccgttggagcgccaacctatcccgccaagggtcgtgttcccgccttcgcaaccttctcattctcactccctatttaacaatcacaccctctctagtctcaacccttgttcgcgctttcaccatcttctccgttcctcatttcgcaaagccacaattgtcaccattcccaaccctaaccctaacccttctcaaacgatggtagtttctctcggtcctgggaaattctacggcaccagcctcccccgacctcggatctacaccgacgtcaagttcaacgaccaccgcgtcgacccacccgttcccgtcaacgacccactcatgtcctgggcccaagaggcccactggtccatgggcggcctcagcttcaagcgcctccgtctccagggcaaaattgaaggcaatgtcgaaaggcttcgctcccagcgcgagaagttccaggctcaaagcccaagcccaagcccaccggcacgcgccgacctccgcagatccaaaagagctgcttcccctctgactccaccggctccggtcatggcgaaacggcgaagatacatggatcttatccaagaggaagaagaggaagaagaagaaggggttgtggttcggaggaccagtgttcggaagagcggcttggtgaagaagcttggggatgattttgacagggttgccctggaaaacgatgagtccaatacggtgtcgtcgttgaagacgactcgtggtcggaaattggttaagaatggtgaacttgggaacaaaacggtggttgaagtagctgaaaaatcaaacaccaaaggaaagaagagtgcaagtgaagccgagaagagccctggggttagaacttcttccagattggctaaacgtgtgtccaattaa

SEQ ID NO: 85791 - DNA, 183 bp, Glycine max
  Peptide Sequence Number=SeqID_202569
atgaatatcacatgcatgacatgtggcacctctgaggatacaacgacagttctcaaacaacatctttgtggaaaccgtcgtggtaccattctaagacagttgccacgtgagaccatcgttgtatgtcacgtgaaactaaccatacaaagacgactaccaggaaaggactatctttgtatgtga

SEQ ID NO: 85792 - DNA, 459 bp, Glycine max
  Peptide Sequence Number=SeqID_202570
atggcaaaagtggaagaagaggaacaacccacttcaccaattcacacatcaccttcctcttacgtgctactgcttcaaatcatgagcaaaagaaaaacctgggtgtgcatctttgtgcttgtttatggcttgctcttcacatcttcgtggaattttctcaagtccatggtttcgtggtacaagttgcgagctgcagagtcatcaataacttcgtggtggcctgcactctatgcctcggtgcttcttggtgcggtttttggggtgctttcgatggttgcagctcttgctgtggttgttcctgcggttctggttttgctgaaagaagggaacattgtggctgctgtttgtgctgttttggggtacttcgttcttgggagaacgaatgggaagggtgttgacagaattgggtgtgtgagtttggtgattaattctgatgcaatgcatttgtttagaatttag

SEQ ID NO: 85793 - DNA, 2700 bp, Glycine max
  Peptide Sequence Number=SeqID_202571
atgaatgctaggttgggggattttgggcttgcaaggctgcatcaccatgaacatgtggctgaaacaacaagagtgatagggactctggggtacatggcacctgaacttgtccgaatcgggcgaccatcagctgcatgtgatgtgtatagttttggagtattggttttagaagtggtgtgtgggcgaagatccatcatagcagatcagccaccattggttgattgggtgttttcccttgtggagaatggggagttgagttgtgctattgacgagcatttgaagggtcaaagtggatacaatgctgaggaagctaagaggctgcttcatttgggtttgttatgtgttagtacagaccctggtgttaggccaacaatgaggcaggtggtgaaagcattggagggaataaaatgcacggagtgtaacaaagattgcatccattttgctctgcttggaaaaataaactcagcagcatcatggtctaagagttctacaagttctgctaatgtaaattatcctacctttgatgaaattttgcaggccaagttttactctacagcatctttaagcgtctcttgtcccagtccacagccagagtcagagtttgtctcagaaggaagtcctttgccaatgtctccacttaagctccttgtcattcttcttcacactgtaaccatttttacttcagcttccactactgaatttgtctacaacacaaacttcaacaccacaaatatcatcctatatggaaatgcctctattgagacctccattcttactctcacaaatcaaagtttcttctccataggccgtgctttttaccctcacaaaatacctaccaaactagccaactcttccacctttctcccctttgcaacctccttcattttctcagttgtccccattaaaaactttatcactggtcatggctttgtcttcctattcacgccatcaagcggtgtaaatggcacgacctcagctgagtatatcggtcttttcaatcgcagcaatgaaggcaatcctcagaaccacgtttttggagtcgagtttgatccagttaaaaatgaagaagagttcaacgatataagcgacaatcatgtcggtgtcgacataaactcgcttcgttcctcaacttcacacgaggctggttattggggtggaaaaggtgacaaagaatttaaggtgttggatttcaaaaatggagaaaactatcaggtatggattgaatttatgcattcccagcttaacgttactatggctcgggcgggacaaaagaagcctcgagtgcctcttatcagcagtaatgtcaacctttcaggcgttcttatggatgaaacatacgttggattcactgcagcaacagggaggataatagacagtgctaagattcttgcttggagttttagtgattcaaatttttcaattggtgatgcattagtgacagaaaatttgccttcatttgttcatcataaaaagtggtttcctggagcacaagctttcgcggtaggtgtcaccagtattgtgtttgtgttaatcattagttgtggttatgtagcatttttcgttctccgcagaagaaagacacaagaagaagttgaagattgggaactggagtattggcctcacaggattggtttccatgagatcgatgcagcaacaagggggttttctgaagagaatgtggttgctgtaggagggaccgggaaggtatataaaggggttttgcatggggtagaagttgcagtcaagagaattcctcaagaaagggaagaagggatgagagagtttttggccgaggtttcaagccttggcagaatgaagcacagaaatttagtaggattaagaggctggtgcaaaaaagaaaagggaaatttgattctagtttatgacttcatgagcaatggaagtttagacaaatggatatttgagtgtgaagagggaatgatgctaacatgggaagagaggattcaagttttgaaaaatgtagccacagggattctatacctgcatgagggttgggaagttaaggtcttgcatagggacattaaagcaaacaatgttcttcttgataaggacatgaatgcaaggctgggagatttcggattggctcgtatgcatgatcatcagggacaagtggtcagcacaacaagagtaatagggacagtaggatacattgctcctgaagtgattcaaagaggaacagcgtcaactttgtctgatgtgtttggttttggaatattggtgttggaagtaatttgcggacgaagacctattgaagaacataagccggggctaattgaatggctgatgtccttaatggtgcaaggccaattgcacagtgcagttgatgaaaggttgaaggctaaagggggatacaccatagaggaagctgagagattgcttcatttgggtttgttgtgttcacatacagaccctagtattagaccaacaatgaggcaggttgtgaaaattttggaggtggaaattgacagcattgagtctgatgaagataacatggaaatgagtttgcttggaaaaataagatcagctactacgtggtctagagctgaatgtgctttaccatacagtggttacccttcttttgatgaagttaagatgttcagttttaattctaggacttctagaagtggctcaagtacctttctaggatcagaatcagaaatcaccagagaaaacatatga

SEQ ID NO: 85794 - DNA, 270 bp, Glycine max
  Peptide Sequence Number=SeqID_202572
atgtgtcgggggtttattggttctctttgtttggtggggtatgaaatcaggtgcggtgaaggtgaaggtactggtgttgagcattgcggtggtcgacggcggcattcgaggtacgcagaaggtggtgctgctattgggaagatggacgaagatgagtggatgtatgaaagtataatgcctgaagaagcgcatatggattatcaaaatgaagaagcatgtggtgtgaatgaaccatatgttgattattccgatgcgttcaagacttctcag

SEQ ID NO: 85795 - DNA, 570 bp, Glycine max
  Peptide Sequence Number=SeqID_202573
atgggagatcgattagatgatatgattagcgatcttggacaagagctttttcagcaagcacatgcccctatgtatgatacattggaaactgattcgaagaacccattgtatctagggtgcaagaagactttgaccttgttgtcggtggtgttaagtctggttaatgtcaaggccaaatatgagtggaataacaaaagcttcactctattgcttcagtataagaaaattcatggatgtcctaataattgcatattgtacagatatgagtttgaagaaatgcataaatgccccaagtgtggtgtatcacggtacaaaatgaaggatgatgatgagtgtagcagtgacaaaagcacaaagaaaggcccccagcgaaagcgaaactacgatggaatgctctatcatccgactgattcctcccagtggaagaagattaatcgtttgtatccgaattttagcaaaaaggcaagaaatcttaggcttggacttgccattgatggaatgaatccatataacagtttaagcactcagcataagagagttatatggatgatgatcccttataccaaatga

SEQ ID NO: 85796 - DNA, 2091 bp, Glycine max
  Peptide Sequence Number=SeqID_202574
atggggtgcatagcttccaagagtgcagctgttgaagacagcagggaaggtgtggcaagggaattcacttcatctagcaaaagggcgaccgcgaagatgaaggtttccgcgtcgaattcggagaaaagggtcgatggagtttgggggaaagacaaggttttggatggtgttgatatgaaagcttcattaattgacaaggaatccagtggttcgatgcggtcgagtgataataagaatgggaggaagaaaaagcagaaacgtgaattggctgttcttgatcatcctggtgttggaagggttccaaaggctttagaaggagagcaagttgtagcagggtggccaacttggctttcttctgttgctggtgaagctatccaagggtggataccacggaaggcggatacttttgagaggtttcataaaattggccaaggaacctacagtactgtgtataaggctcgtgatttgactgaccaaaagatcgttgcattgaagagggtacgctttgataattgtgatgctgagagtgtcaagtttatggcaagggaaatccttgttctgcgtaggcttgaccatccaaatgtaataaagttggaaggcttgataacatcgcagacatctcggagcttgtaccttgtttttgaatacatggaacacgatcttacaggacttgcatcaagtcctagcattaatttttctgaaccacaggttaaatgctacatgcagcagcttcttagtggattggatcattgtcatagtcgtggtgtcctccaccgcgacataaagggctcaaatcttctcattgacaataatggcatcttaaagattgccgattttggtctggcaaattttattgacccccatcacaaggttccattgaccagccgtgtagtaactctgtggtatagaccaccagaacttttacttggagcatctaattatggagttgctgtggatttgtggagcactggttgcatactgggggaactatattgtggcagacctatattacctggaaaaacagaggttgaacaattgcataggatatttaaactttgtggctcaccatctgaggattattggcgtaagctgcggacgccacattcaacagtattcaggcctccccaccattataggcagtgtgttgctgaaacatttaaagaatgcccatctgctgccacaaggcttattgaaaccctactttctttagatcccacacttcgaggaacagcaactacagccctgaagagtgagttcttttcatcggaaccccttccttgtgatccatcaagtttaccaaaatatcctcccagcaaagagattgacactaaattgtggaaagaagcatcaaggcacggagctgatggaggaaaggagcaaaaatttagaccaggaggtcgacaagagaaagaacctcagacatttatattatccaaagacaatgctgactctcacatatcaatgcagcaagggaaacgccttccaaactcaaggagccggaatgaattcttcaaccctcacagagaacctgcgtttggacatttggtttttccacaaaagcagtcagaagatcataaagaaacactaaattatttctccggccctctttatcagaggcctttgcattcaggtccattggttccaggttatggctatgaaatggctggaagggaagctggtgggcggcctcatgtttcaagcaaagtcaacctaccaaaactatctgggttagtggcatctaggacctcattgtctggagatcaaaaagaaaatccagttccgttgaagccccgagaaacaattcaagtacaggagtcaactaatggatcagagtcaagaagaaggcatgataaaaaacgccattctcagacaattgatcccaggcaaatcgaaaatggaaaattttcaactgaaacattaattcaggatgggcatggatccatgggaaacaatatctaccacctctctggtccattactgctttcatcaaacaacatggatcagatgctcaaagagcgtgatcgaaagatccaagaatattcaagacgagcaagaatgtacaagtctggtgagatagctcatgcaaagtaa

SEQ ID NO: 85797 - DNA, 1336 bp, Glycine max
  Peptide Sequence Number=SeqID_202575
atggactgtttcgatgaggcgaatggggagcttgaaaatgttgtgagtgttgggtgtagtgaagagggttctgagaaagaggcaaagacagatattggtgcaattgaggatgctgtgaaggttcttttgcttgcgcttggggaagatatcaacagggaaggtcttaggaagacaccacttcgtgttgccaaggcccttcgtgaaggaaccagagggtacagacaaaaagtgaaggacattgttgaaggtgctttattccctgaagccggtctagaaaacaatagaattggtcatgcaggcggcacaggtggacttgtggttgtccgagatcttgacctttattcctattgtgagtcttgcttgctaccattccaattcaagtgtcatgtgggctatgtcccttctggccaaagagttgtgggtttaagcaaactctctcgagtggttgatgtatttgctaaacgactccaggagcctcagcgtcttgcagatgaggtttgttcagcattgcatcaagaaatattgccagcaggtgtagctattgtacttcagtgtacacacatcccctttccagacatagaatcaatctttcttgaatcgaaccaacaagtgtgggtgaagacacttgttttgtcaggttctgggatttttgaaaacaaaagtgaagatgcatggtctgatttcttttgccttctaagatttagaggtatcaaaatagaaaacattcatttgagaggatcatctgaccaatgctggtgtccatctttgactgctctttctgctaaagtttcctccaaaattgtaccagtcaatcccgcaatggtgactgcaggacgcctagtcgattttgtgaaatggctattgaacttccaaagcattgacatggatgtgaagctgaatcgttccctttgtgatggaatagatactttaaacctcgatagggaggttaacttcaatgacagacaaatacattctgagttgaacttgccattttggtcacaatgtgagcatcatatacttccatttcatggtgttgttcacataggatacttcctttcagaaggatctaatcccattggaaaatcccttttacagtctgtagtacatttttatggtttcaaactccaggttcaggaaaggcttacaaggcaaatagcagaaaccattgcaccactattattaggtggacatgtaatagtagttgtagaggcaagtcacacatgtatgatttctagaggaattgagaagtttggaagtagtacagctaccattgctgtattaggtcgcttttccactgacctcgctgcaagggatgcattcttgcagtgtgttgcaa

SEQ ID NO: 85798 - DNA, 627 bp, Glycine max
  Peptide Sequence Number=SeqID_202576
atgaaccacgaagacaaactcaccatggacctggttccaccatctgaacacctctgctacgttcgttgcaacttctgcaacactgtcctcgcggttggtatcccatgcaagaggctgttagacactgtgacagtgaagtgtggtcactgcagcaacctctcctttctgagcaccagacccccaagttctcaaagccaaagcgttgatcacaccctcagtctgcaggggttttacagtaatgccaaaaagggacaagcatcatcttcatcttcctcaccaacaacatctaacgagtcagtgtccccaaaagcagcatcatttgttgtgaaaccacctgagaaaaagcaccgtctcccttctgcttacaaccgtttcatgaaagaggagatacagcgcatcaaagctgcgaaccctgagatcccacatcgagaagctttcagtgctgcagcgaaaaatgctttagggttagcactgcacatacttgtaactagcttaacgtttcttgaaactcacaaaatgttcatacatgttcctaacttgtgctccacaactaattcacagtgggctaggttcattccaaattcaccaaccagttcagtttctgcaactaaagttaatgctgattga

SEQ ID NO: 85799 - DNA, 363 bp, Glycine max
  Peptide Sequence Number=SeqID_202577
atggccatggttggaacaagtaaagctgcaaaattcttaagagctaatggaattactcttttcaaagtacgtgaagaaacagtagagctactagggaaatctgatttgtatttcttcagccctgagcatcctccattgactgaaccagcccagaaagcccttgattgggcaatcgaggagaaattgaagtcaggtgaaggaggagaaataaacgtgacacatttacttctaggaatttggtcacagaaagaatcagcaggtcaacagatcttggatactctaggtttcaatgatgaaaaagccaaagaacttgctaaaacaattgatggggatgttgatttgagtttcaaaaggcaagcttaa

SEQ ID NO: 85800 - DNA, 348 bp, Glycine max
  Peptide Sequence Number=SeqID_202578
atgagttttgcggcgtacaagatgatgcagtgccccaccggcatcgacaactgcgccgccgggttcctcacccactcccgctctgacttcgtccctctccagcccgacgacctcgacgccgagtggccctcccgcccccgccaccacgtcggctccctccccaacctcgtcgtcaccgccgccaacgtcctcgaagtctacgccgtccgcctccaggaggaccagccgcccaaggccgccgccgactcccgccgcggcgccctcctcgacggcattgccggggcctccctcgaactcgtgtgccactacaggttccgcctctgtccacttactcgttctggaatttga

SEQ ID NO: 85801 - DNA, 1989 bp, Glycine max
  Peptide Sequence Number=SeqID_202579
atggctgttttgagcattggaggtggtgatgtttctaggaggagagattctatcatgttaacttttgcagatgcaaagatttcagttcttgagtatgatgattctattcacggacttcgtactagttctttgcattgttttgagggtcctgaatggcttcatctgaaaagaggaagagaacaatttgcaagaggaccagtggtaaaggttgatcctcaaggcaggtgtggtggagttcttatctatgatttgcaaatgataatactaaaggctactcaggctggttctggtttagttggggaggatgatgccttgggatcttcaggagcagttgctgctcgtattgagtcatcttatatgataaacctacgtgacttggatatgaggcatgtaaaagattttacgtttgttcatggctatattgaacctgtaatggtgattttgcatgaacgtgaactcacttgggccgggcgtgtctcatggaagcatcatacttgcatgatatcagcacttagtatcagcacaactttgaagcagcatccacttatttggtcagctgttaatcttccccatgatgcgtacaagcttcttgcagtgccctcgccaataggtggtgttcttgtaattagtgctaacactattcattatcacagtcagtctgcttcttgtgcattggccttgaacagttatgctgttacacttgacagtagtcaagagataccaagatcaagtttcaatgtggagcttgatgctgccaatgcaacttggttgttaagtgatgtggccttgctgtcaacaaaaactggtgaactgctattgcttacgcttgtttatgatggaaggttgagattacactccaactggcatatgataggaatgtcttttactttaagaaaagagaatcttactattgtcagtactccggataactattttcagcattacttcaatgttctgtttcctgttcctcattttttgtcattgtatcatctcatgctacttttatggaagtggaaggtgtttctactcaaagctttatctgggttgtacagagacttgatctttccaagtcaaaagcttcagttctgtcatcttcggttaggggacagtatgctagtgcaattttcttgtggatcaggtgtttccatgttgtcatccaatctaaaagaagaggttggtgatattgaagcagatgctccatcaaagagattgcgaaggtctccttctgatgctttgcaagatatggttagtggtgaggagctctccttgtatgggtctgctccaaatagaacagaatcagcacagaaatccttctcgtttgcagtgagggattcattgattaatgttggtcctttgaaagatttctcatatggtttaagaataaatgctgatgcaaatgctacagggatagccaaacagagtaactatgaattggtgtgctgttctggtcatggaaaaaatggttctctttgtgttttgcggcaatcaattcgcccagaagtgattactgaggttgaacttcctggttgcaaaggaatttggactgtgtatcataagagcacacgctctcataatgctgattcttctaagatggctgatgacgatgatgagtatcatgcttaccttattattagtttggaggctcgtactatggtactagaaactgctgatcttctgagtgaggttactgaaagtgtggactactatgttcaaggaaaaacacttgctgcggggaatttatttggaagccatggactgttaccagttgctggggaaacagaaaccactgctgaatctccggtgacctattcagcggacgacccaccatcaggagcgcctgcagcccatctacccaacgccgtcaacggcgccaccatcagacaccagaagcgccctcatgcgcgtttcctaggtgtgtcaaacagcatcaactttggaagttctactagcatgtcttgccaccattcaggcctcgcttttggcaactag

SEQ ID NO: 85802 - DNA, 798 bp, Glycine max
  Peptide Sequence Number=SeqID_202580
atggcttccattcccacactctcttcaaccctacctacactctctgctcactccttatcccattcaaaccccaacaaccactgcactctccctcccacatctctcttcggcaccaggatcaccctcctacgcgccacctcatcgtctcattccctccccaacaccaattgccgtgcaacctcagccaccgtgtcgtttagcctccccaccccgaaacccctttcggatacgcccgagaaaaccccaaagtggtcggagaggggtataaaatcgtatgcaatgggggaattggaagcgaggaagctcaagtatccaaacacgggaaccgaggcgcttctcatggggattttggttgaagtaatagccatgaaaactagtccttctatcagaacttggttgccatactttatggtctatactctgccaattaccaattggatgaatgctccttgttgtattgatatggacataggaacaagtaatgctgcaaaattcttaagagctaatggaattactcttttgaaagtacgtgaagaaacagtagggctacttgggaaatccgacttgtttttcttcagccctgagcatcctcctttgactgaaccagcccagaaagcccttgattgggcaattgaggaaaaattgaagtcaggtgaaggaggagaaataaacgctacacatttacttctaggaatatggtctcaaaaagaatcagcaggtcaacagatcttggctactctaggtttcaatgatgaaaaagccaaagaacttgctaaaacaattggtggtgatgtttga

SEQ ID NO: 85803 - DNA, 2898 bp, Glycine max
  Peptide Sequence Number=SeqID_202581
atggagtgttggatatgtcttgatgataaccacaattctgtagttctggcctgtgcaaaagttgttcaatgtgtattgagttatgatgcaaatgagaactattgtaatatctcagagaagatagcaacttgtgacatggatatttgcacggctccagtttttaggagcagacctgatattaatgatggattccttcaagggggtttctggaagtacagtgccaaaccttctaatattcttcctttcagtgatgattcaatggataatgagaccgaaggaaaacatactattcaagacgatatagtggttgctgggcaagattttactgtaggtctagttcgcatgggaatccttcctaggcttcgttatcttttggagacagatcctacaacagctttagaagaatgtattatttccgtactgattgctatagcgaggcattcacctacatgtgctaatgctgtactgaaatgtgaaagacttgttcagacaattgcaaatagatatactgctgaaaattttgaaattcgatcttctatgattagatctgtaagactcttgaaggaagttatttctgcatcatcagctagagaatcattcctaatgtttcatttgattttggaaaaggttttagctcggtcggaccggaaatcttgtttagagtttataaagaaagggtattttcaggctatgacttggaatttatatcaaagcccttcctccattgaccactggctaaggttagggaaggaaaaatgtaaactcacatctgctctgattgttgaacaaatgcgtttctggagggtctgcattcaatatggatattgtgtgtcttacttctcggaaatgttccctgccttgtgtttttggttgaatccgccttcatttgaaaaacttgttgaaaacaatgttttggatgaatctacttccatctctagggaggcttaccttgttctggagtctttggctggaaaacttccaaacctattttcaaagcagtgcctaaacaatcaacttccagagtctgctggtgacacagaggtatggtcttggaattatgttggtccaatggttgacttagccataaagtggatagcaagcagaaatgatccagaagtatctaagttctttgagggacaggaagaaggaagatatgactttactttccgagatctttctgcaactcctttgttgtgggtgtatgctgctgtgactcacatgcttttcagagtgcttgaaaggatgacatggggggatactattgaaactgaagggcatgtgccatggcttccagaatttgtacctaagattggacttgaggtaatcaaatattggtttttgggcttttctgcatcttttggggcaaaatgtggaagagattctaaaggcgaatcttttatgaaggaactagtttatttgaggcagaaggatgatattgaaatgtctttagcttccacctgttgtctaaatggaatggttaagattattactgcaattgataatctgatacagtctgccaaggctagcatctgtagtctcccatgccaagaacaaagtctctcaaaagaaggaaaagtgcttgaggatggcatcgttaaagggtgttgggttgaattaaggtatatgcttgatgttttcatgttttcagtttcttcagggtggcaccgcatacagtccattgagtcatttggcagaggaggactggttccaggggcaggaattggatggggtgcctcaggtggaggattttggtcagcaacagttttattggcacaagcagatgcaagatttcttgtctatttgctggaaatttttgaaaatgcatctaaaggtgtcgtgactgaagaaacaaccttcaccatccaaagggttaatgctggcttgggattgtgtttaactgcaggacctagagataaggttgttgtagaaaagacattggatttcttgttccatgtctctgttttgaagcaccttgatctctgcatacagagtttactcttgaataggaggggtaaaacctttggctggcaacatgaagaagaggattacatgcacttaagcagaatgttatcatctcatttcaggagcagatggttgtctgtaaaggtgaagtctaaatctgtggatggcagtagttcctctggcattaagacctctccaaaggttggtgcttgtttggaaaccatatatgaggattcagacacgtcttccgtgacaactccgtgctgtaattctataatgatagaatgggctcaccagaaactaccacttccagttcacttttaccttagtccaatctcaacaattttccatagcaagcgggctggtactaaaattgttgatgatgtactacatgatccctctaatctgcttgaagtcgccaaatgtggacttttctttgttttaggtgttgaagcaatgtccatttttcatggcactgacattccttctcctgttcaacaagtatcattgacatggaagttacattccttatctgtcaatttccttgttggaatggaaatacttgaacaagattggagcagggatatttttgaagctttgcaggatctttatggtgagcttcttgataatgcaaggttaaaccaaagtaaagaagttatttcagatgataaaaagcatcttgagtttctgaggttccaaactgagattcatgaaagttactcaacttttcttgaagaacttgtggagcagttttctgctgtttcttatggtgatgttatttttggccggcaagtttcactttatctacaccgttgtgttgaaacttccattcgacttgctgcctggaatacactgtccaattctcgtgttcttgagcttttgccacctttagaaaaatgcttctctggtgctgaaggataccttgaacccgctgag

SEQ ID NO: 85804 - DNA, 1159 bp, Glycine max
  Peptide Sequence Number=SeqID_202582
atggagtttaaatctgttgcaggtatctgctcagcaatgggagagcgaccagtacatgttaggcagtttgaccaaaaagctgtaagcttgaaagaagagctagcaagagtttgcccagagctggaagaaatgcaagaaaggaagtctgagcgtagaaatcaatttatagaagttcaagaacagattcaaagtatcacaaatgagatttatagtccaagtattacagcttctgtagatgaaactgatttatcattgagaaagcttgaagaattccagacagctttttgcatttcaaaaggagaagtgagcgcctcaagaagtttcaagaccgaccaactgactaccttaaattctctctgttcagtgcttgtcttggacttagcagatactccaagatccagcttcaacaatgttggagctctggaatttgatggatacacctctggaagagcaacggatggtgaggcagaagtatatacgttagaagagttaaaatcaagcaaaatgaaagagcttgttttgaagaaaagagcagagcttgaggagatttgtcaaaagactcatttgattccagaaattgatagtgcagtgaaatatgttgttgaagctacagaatctggatctgtggaccctgctattgtgcttgaacaaattgaacttcagattgcccaagtaaaagaggaagcttttgtcagaaaagaaatacttgaaaaagttgagaaatggttgtcagcatgtgatgaagaatattggcttgaggagtacaacagcgacgaaaatcgatacaatgctgggagaggttcttatcttactctcaagcgagccaagaaagcctgtgccctggttaaaaaacttccagcaatggtagatgctttaacttcaaaaactgtagcatcagaaaaggacaaaggcattgagttcacatatgatggtaactactccctatcacggcaagagaaggagcaagagcgttgtaggcagtgggaactgaagaaacttcagggacaaataatagtggaaaaggaggtggaagccaaggccacatctcagctggttgattttcccataatttctagccagtatatcaagcattcctttgatctagaagaggagaatattgctggtgttcctatgagaaaatactctaccggtgctggaa

SEQ ID NO: 85805 - DNA, 246 bp, Glycine max
  Peptide Sequence Number=SeqID_202583
atggtgaaacttggatacttgagactgaccatgagtgagatgatgggtacaaatggaaataatctgcacatctgggctaggagggcgagggcgaggccagctgagcttccttccacatttgtagctcctactccagcatccacttcagaagctccatcaatcccagctcagagtgattctcagtgctttgaagctatgctttggagcattcatcaggaacagattatgttacttcagagtttatag

SEQ ID NO: 85806 - DNA, 1704 bp, Glycine max
  Peptide Sequence Number=SeqID_202584
atgaactatgataaagaaataaggcatcgtgagagaaaaaaaggtaaaggaattgaagtaggagatgagagtgtgaagcaaatgaacaaggagaaagagaagaagatgacagcggtgtgttgtgcaatggataatcaaaagaagggcaaaggaggagaccaacccaagaagttagcgaaggtattgaatacgagctctctccaaataaatgaaaaagatgcttttcagttggttggttccatcgtcgaaaagggtatctctgattcacacaacaaccccacaacaacaccacccttccattttttccccaaacccactgttcttcctttccccgttgcgcgccatcgttcacatggccctcattggcgtccactgagtagtagaggggatgatgatggtgaggatgatgatagtgacaataatgttaaggatgaagaagataaaaatttgcaggagtttgaaaaagtttcagcctttgccaagccggtacagaggaggaggaaaaagggtttggattttagaaaatggaaagagatcactcgggatgatagttcttccttcgggaaggaatcagagaaggatgtgtcaagctttagccaaactactgggaaaaagaagaatgaaaagggcagtaagagcacatacaagaaaacctcatctttggatgataatgtcatttctccaatgaaagtggatacaaaaccactgttagataactcagatggtgggtttatcaattcaactaccactatggaagtagatacattaaataaggtagatcatgaggaaaaagttaaacacgccagaatttatgatgacaaggagcaaaatgaatctgtgcctggattggaccaaatttcttctgattggatgcctgattacaattttggatccctggatgtgcaaaggccagggcaaactgacttgaattcaagcatgctgtcttgttctagttccaatagtattagaagtgaacaaaagtccgtgtctcttgatagtgaaattgatgctgagaatcgagctcggattcagcaaatgtcagctgaggagattgcagaagcccagactgagataatggagaagatgagccctgcattactaaaattactgcagaagagggggcagaataaattgaagaaactaaaattagaagtggatattggctcagaatctgtgaatggacatgctcagagtcctcaggatgcaaaacatctacacacagaggatgggatcgctcaaacagtgattgtgccaccatccaaagaaaagctagatgatgagaaaattagcacgaagacttcaaccaccgctagtagtagtgcatggaatgcttggagcaatagagttgaggctgttagggagctacgattttccttggttggggatgttgttgattctgaacgtgtatcagtttatgacaatgccaatgaacgtgactatctacggactgagggagatcctggtgctgccggttatacaattaaagaagcagtggcactcactagaagtgtgattcctggacaaaggacccttgcattgcatctcctttcatctgtgcttgataaggcattacactatatttgcgaagacagaacagggcatatgacaaaaattgagaacaaagttgacaaatcagttgactgggaggctgtttgggcttttgcactcggcccagaacctgagcttgtgttgtcacttaggtaa

SEQ ID NO: 85807 - DNA, 723 bp, Glycine max
  Peptide Sequence Number=SeqID_202585
gacgttactatgaagattatgtccttctctcaacaaggatatcgagcaatttgcattctgtctgcaaatggcacaatttcaaatgttacactacgccaaccaacttcttctggtggtactttaacatatgaggggcggtttgaaattctttccttgtctggttcatatataacaactgagaatggattaacaaagagcagatctggtggtatgagcatctctttggccggtccagatggtcgagtaatggggggtggattggctggtttgctggtagctgcaggtcctgtgcagagttttgatggactttcttgtgccatatcaactaaaaagaaaaataaagatagagcacatgcattgaaagaactaaactacatgtatgaggaacattttactggacacttctcatgccatcttctgcatcaggttgttgtggctagttttcttcctggtcatcagctggagcagcagaaaccgaagaagccaagggtggagcatataatatcaatggctgcccctatgcatgtcaaccctacttcagctgctgaagaaataagaattggtcttggtggagtaaagccaatcatgacaccagctgcttttcaagtggaccacatttttggcaatggccaaagctctgggaactcagcttctgatgattcagcctctttccctgaaaatgagtccaaccccagccatgcagatgctggagttgcatgctaa

SEQ ID NO: 85808 - DNA, 681 bp, Glycine max
  Peptide Sequence Number=SeqID_202586
atggcggagtccaatcctcacttctccgacgacacgccctcacctgcttcttccgtcgactccccatccccgccgccgactttcaacggcatcgtcatggtgtcgcagccggacacccaggacgttttccacacgccgccggaggactcatcgcttcactcctccgacaacggaggcgtcgaacgttgtgccgttaatctcgccgtcgacgtagatgccgtgagtcaggggttcgtcaatttctgcgatggatcgaagttcgttgattcggggaaggattcggattttctaggattttcggaagttcaaccgacgcaggaaaagaacgtgggagagagtattatggggagttccgaaggaaagctggtgtctgaggtgaacgatatttcagtgaagaataactgttctgggaaagtggcatgcactgctgatggggttgtggaagcttctggaatgctgaagagtcgtcgttcgaagaatgaagcagcaactggaacggaacgtggtggcaacaatagtgagaaatggaatgtttttgatgtgttgagagttttctcacagaacaatgatgatgttgaagaaaatcatgatcatctcagtttgttggatgtggcaaaggctcatggggtaacttttcctcgcccaaggtggtggccagacgatgataagttcgaaccttaa

SEQ ID NO: 85809 - DNA, 2169 bp, Glycine max
  Peptide Sequence Number=SeqID_202587
atgtcttcttttctgtctgattctgccattggactaggcaacaatgattctaggggctcgaatgagcaacccatcatggatcgagaggtcatctcgataagtggttcctcgtttaaggatacctaccaaggtgcctctgatagcgagtcctcctcctcggagaggccagtcccgattactgtgatcctcccccgttctgcttccgggggtgtaaggagagctagtagtggcggagataatgctactaattctaccaaggtgtttctccaaaggattttgacaattctagagaagaatggactgtggtaccaagaggcagtgcaaaaggccataagggtgaaccaccaaatgacttccaaggttggcggtgcactggccaagttgttgcgcacccgattagatggtgataacttgtttagatgctgcaagagcttgtatgctgagaagatggacctgggtggcaaagtggagagcatggcggtccgacttaaggaattggagtccaagctagaggagtccttgttacgggcagccaaagaaaaggaggcaagcaacgagctagaggaagagttgattttgtacaggaaggaggccaatttctttgcaaagggccttgacttaggtctcttcgatccattcaaggatgtgaataagggtgtcctgcttgatgaggatgagattgatgcagaggaggaggctgctgatgaaacacacggtgctgcagagcaaggcgatgatgcttatcatggtggtcttgtaaaaagtagaatgacgtggagtcatctcagcttctcccctgatggttgtgaggagttgtttttgatttgcccctggttgaaggtcttgcctaaccagtgtagggataggttgcttgacttgctgagttcctcctctgatgattatgaggaggtagaccttttgtaccttgagttcccgtgggggtggaacttagtactggaaagggcttcaccaagggtgaaccttgggtatgtcgagtcttggactagagacgtcgcggagcttgggtttgacaagtcttgtgtgcaacataagtatcgtgctcttgcatacacgacactagccatgggtgacatgtattggagacaaacttgcttgctcttgtatacatgcctcttacaaaatggcaagtactggaggcatggtggtgtaaatcagtgggactcaccaagggtgaaccttaggttttgcgagccctttgaaggattgacaagagaattgtccaacctgggttttgggcaccgtgctcttgcatacatgtcactcgccgtgggtggcacacactggagacgtggtgatatgctcttgcatatatgtcactcactgtgggtgacatatactggagtcatgattcaccaagatgatacgctcttgcgtgtgtgtcactcgtcgtgggtggcacacactggagtcgtggtggtaatatgctcttgcatgtatgctacttgccatgggtggtacacactagaggcttattatgatgctcatgcgcacatgtcactcgtcgtgggtgacatgtgggtagtgttccacgttcgtgggattgctttgccatccaactcttgtagtcgatacgctccgttgtcgaggaccttcccagttggggccaagctttcctgctcggggatcttttctggcttcatcttggactcgccatacgaggtcgtcgggttgaacagtagtctccttgtcaacggttccccaacttcaacggggatcatggcgtcagtgccatatgcccttagacttgtcaagtgtagtttgcagggccctgaggatgactctattagttgcctcttccttctggactttgaattgggtgtcgttatcggtgacaatggcgtatgggaggccgtacctggagatgagctcctagggcctttgtcagtggttccagtgtgttcattccccacaaggcgaagggctaaggggagcatagacggtgaaggttcttgtaccactacggtggctagggagcgtcttccggggtgttgtctaccctcttttgaaaagtttgccatcaaggatggtgtagtagctgaccttctgtttgaaggggtcaggcttcgtcctcgtttggtgcattgtgggagtttagagcgtctcctggatgatgatcttgaggtactcgaccttcttggcattggctag

SEQ ID NO: 85810 - DNA, 471 bp, Glycine max
  Peptide Sequence Number=SeqID_202588
atgaagaaccaatttgtggctgactttttggtacaatgcgttggaaacaacacaaccaccccaaattggtggaccttttacgttgacagtgcgtccaacgtaaaaggaagcagggcaaggatcatcctcgaaggccttgacaatgtcactctagagcaagccctcaagcccaacttcagagccttaaacaatcaggcagagtacaaggcactcattgcatgttgccaacacataccagaccaaggaaacagtgttgctcaagtactatcacatagtgatgaggacatgaccaagagcaacggcaaggatccacttgaaggacttggaggacctatgacaagggttagagcaaggaaagccaaggaagctcttcaacaagtgttgtccacactatttgaatacaagcccaagtttcaaggagaaaagtccaaggttgtgagttgtatcatggctcaaatggaggaggactaa

SEQ ID NO: 85811 - DNA, 588 bp, Glycine max
  Peptide Sequence Number=SeqID_202589
atggttgccgctgaaagattgaagctttttttgtgtaagaggaggagggggcttagaattttgttgcgggttgcattttggtggtgggtggttctactgttggttaatccagtggcgggtctcagacccttgagagaaaggactaggtcctgggatgacgaggggctatttacaagaaaggaggagagcaacttaggtcctttttcacaatggaacataacaggaacttacaaagggacttggaagtttttagatatcacaaatggatcttccagatttcctgacatcagaaaaacaaatggaaattctgtaattgaattagttagtacgcccacaaagatgagtggggtacattatgttcagggggtagttatgttccatgatgtgtttgacaatgagtatgatgttggcggttctcaagtcagaatagaaggtgtatatatatggccttttagacagcttcgaatgaaaatttctgtttgcaatgaaattggtatgctaagtgagcctgctgagggacatggcttgaggttattgaaggttaagtacatagaagcgtgctggccaagcccacatatatacaactaa

SEQ ID NO: 85812 - DNA, 177 bp, Glycine max
  Peptide Sequence Number=SeqID_202590
atggagccgccaaaagacagccatgacaccactgcgcacaaccacaaacgagaagtgacgagtttcttggtggcaccatggcatacgacaaccgaggttgttggcgagaagaggagcacgatagatagaggtgtttgtggtagtggggtcttcggattggagccgatggatgagtga

SEQ ID NO: 85813 - DNA, 1773 bp, Glycine max
  Peptide Sequence Number=SeqID_202591
atgccagattctttcctgatgccatctcctataaaggattcagacctgtcttctgaccttaattggcccattgctatgagaaaaggtaccattgatcaattcaaggcacgtttggtggcaaaaagttacactcaggtgtatggacaggactacacaggaagaggtttatatggagcaaccattaggttttgttgctcagggcgaatcatcgaacatgcaatttggtatgattcacatgaagccgaccactctgttttctactgccactcacctcagggatgcatctacctcattgtctatgtagatgacattggaataacagaccttggtaagcttcggtattttcttggtatcgaagttgctcaatccaaggatgatcctagtgtcaaattgtcaccagatcagagggaaccattctcagaccctggaagatatagaagactggttggaaaattgaactacctcacagtcactcgtcctgatattgctttgcatgttcctggaaaaggtctcatttatgaagataagggacattctcaaattattggctattcagatgcagattgggtggggtcacctagtgatagatggtccacgtcaggatattgtgtattgattggaggaaacttgatatcttggaaaagtaagaagaaaagtgttatagccagatcaagtgttgaagcagaatacagggccatggctttggtaacttgtgaactcatatggctggaacaacttctcagagagctcaagaacaatgaatgccctgcttgtcgcacacattgtgccagtcgtcgttccttgagagacgatccaaattatgatgccctcattgccgctttatatccagatattgagaagtacgaacaagaggagcttgaatttcgtgaagaggagaagaaccgcaataagcagattcaagcttcaatagcaaaagtagttcaacggcaatctgaagcattggttaagagacgtaaagacacaccaggtgcatttgtaactagaccgcagcgtaatcagcgaaacattcattctaggagacaaactcaagcaattgaaggatctgaagataatgaggaggaaaatgacaataatgaaaaggactcatcttcagctgatgaacgaagtacagaacaccggcagagaaggagaaagagatgggctagagttcgcccctctcaaccctcatcatccatggcaagtcctgatggtggatgcaatgatagtgatatggatataagtaaagaaaatcgtggaatttcaaggcaggtgtcgaaacatggaaagcttacatggggaaggggtggttttagaagtaacactcggcatggcagtggtggtggtagcaataacaaaagttctcgcagtagtcgattgtctaagtttgttgaccatctccgcaacttggatgaaaacactgatgagtttgatgtccatctcatgcttgtttctcttgaccaactaagtacaccaagtttgcagcaaccttacctttgctgtcgaccaactttgtctgtcaagcacctttatgaacacgttgctcgtcagacacctttgccggttgaaggaattgagatagtggcagtcaaaggatgctgcagtacgaactgtgacaagtcagctgatgagaattcggcccttgcatatgatgagctatcaaagctggttatagatccacacaaagatgaactggaaattttgcaaggacatgagactctggcagggcttagatccaaatgcatatccaagatggggcatttggtgagtgttaag

SEQ ID NO: 85814 - DNA, 654 bp, Glycine max
  Peptide Sequence Number=SeqID_202592
atggattttggtgcttggttatttttaaagtataaaggggaaggacttttcaagataaaagtctttgatttcattttgaatgaagttcatgctactgctccatggccattttatcatagctacaagaatcaattacccacaagagtttggtttaatgatcaatggcattatacccttgatgaaggagctgggttgcatgtcacatatgaggcgaggggaagattcaaaataaaaatagagcagcaagttccgatgcttttggttgagagacaagcactgaacgaggctatggagggagagaagaatggtcatcatcacttacctgaaaccagaggactttgcttgtccgaagagcaaactgttcccactattttaaggagaccaaggataggagcaggataccagctcatagatatcataaccgagccttttaggctggtccgtcgttgtgaagtgacagccatacttgttttgtatggccttcctagtgttgtcgcaacgtgcccttcgcgggcgaggctctcgggtgcgctttccaaaggaggaaagatgcgcggagtcgccaccaacgtttatttatggaaaacgtcggaaaaaccgaaggaaactggtcaaaatgaaaactctaagttcggaagttgtatttacacttga

SEQ ID NO: 85815 - DNA, 837 bp, Glycine max
  Peptide Sequence Number=SeqID_202593
atggagaagagtttgagttgtttcaataaggtgcctatttttgcgcttagaaaccccattttgttgagtgtgggcacaagatgtttgacgaaggatgcctttggatgccataaacggctgaaattgatgagagagacagctgatggagactgggaaccattttctaaagtgtcggtagaccaggatgtccaaattgagcatgaatcattaacggaaaaatggtggaagagcacactcgcggcgagccagagagataatataggccatgttaaatggacaattagctacaaaaaggacagactcaacagtgagggatggaagaaagtgtgtggtaccaatgccttgggattgtgtttgagacccattggtagaggacctaaggaagatgaagggaagatgcaagcaatagatttaccagtgtgtgcgacaaaatcaacaacaccagtagagtggaatcatctgaagatgtttgagctacattggcaaggcgagatggtttaccatgtagcttccaacactgatcagtactatgcaagaacagatgtatcaactatggtagattcaggaacattagatgtgggctttgacaaaatccgaagtaatacagcagatgttgattgcattgttggtgccatagggaggcaagatcacaattggaaacatggccggaaagggtcgcgaatgtgtcgtcatgcaccggggataggtgttgtttggtgcgtcaaaggagagacgcgtgagaactcaaatggagagacaagtcggacggtgggaccatcggctggaaatgtcaccggaaaagtgtttccgaaggcgacgacggttgtcggaaaatga

SEQ ID NO: 85816 - DNA, 378 bp, Glycine max
  Peptide Sequence Number=SeqID_202594
atgcaaacgaactacaaatcaaatggggggattcagaaaattcagacacaacaactcaaatggtacgaacaagcatcacccctttacacagccaaagggaacccatcacatccagaaacagaaatggcgaaattcacacgcagccacgatccagaaacagaggcatggaatcaaaacgtaaatcccaaaaaactgaacaacaaaacacaaaacaaaaagtttggaaacaatgcacgttcacgagagagtaaagccagaagatggggtttcgtcggaatctgccaagagaaaagaagaaaccttgagcacacgaagaaacgcaaaggcaaaacaaagcccaacccagttgagaaaaaccaattgggtcaccgaacataa

SEQ ID NO: 85817 - DNA, 1977 bp, Glycine max
  Peptide Sequence Number=SeqID_202595
gatgttcatgtaggtaacatagtatggctacgtgaaaatgatgaagtgccttgtgaccttgttttgattggcacctctgatcctcaaggagtttgctatatagagacagctgcgctggatggtgaaactgatctaaagacacgggtcataccttctgcttgcatgggaatcgatgttgatctattgcacaaaattaaggcaagatcttttctaaagtatctatgcttgggtgtaattgagtgtccctatccagataaagacatcaggagatttgatgcaaacatgcggctgtttcccccatttattgataatgatatatgccctttaaccattaaaaacaccattcttcagtcatgttacttgagaaacactgagtgggcatgcaatgaaaccaaaatgggcatgtgtagaggtataccagaaccaaagctcactgctatggatgctatgattgacaagttgactggtgctatatttatattccaaattgttgttgttctggttcttgggatagcgggtaatgtttggaaggatacagaagctaagaagctatggtatgttctttaccctcatgaaggtccctggtatgaactgttggtcatccctttgcgattcgagcttctttgttccatcatgatacccatttcaattaaggtttcgctggatttggtgaagagcttgtatgcaaaatttattgactgggaccatcaaatgattgacctagagactagtattccatcccatgcaacgaatacagcgataagtgaggacctgggacaagttgagtacattttgactgacaaaacaggcaccctcacagagaataagatgatatttagaagatgttgtattagtggcaatttctatggaaatgagaatggagatgcattgaaagatgtagagcttctcaatgctgtttccagtggttcttctgacgttgtacgatttcttacagttatggcaatatgtaataccgtcatacctacacaaagcaaaactggagatatcttgtataaggcacagtctcaggatgaggatgcccttgtccatgctgcttctcgattgcatatggtttactttaataagagtggaaatattcttgaagtcaagttcagcacttcaatacttcagtatgaagtcctggaaaccttagagtttacctctgataggaaaagaatgtcagtagtgttaaaagattgccaaaatggaaagatccttctcttgtcaaaaggagcagatgaggctattcttccatatgcccgtgctgggcagcagacccgacatttcattgaagctgtggagcaatatgctcacttgggattacgtacattatgtttggcttggcgtgagttaaagagagatgaatatcgagaatggtctttgatgtttaaagaggccagtagcactttggttgatagggagtggagagtagctgaggtctgtcaacgagtagaacatgacttggaaattcttggtgtaacagcaatagaggatcgtttacaggatgtggcttttgttgttgatggctgggcacttgagattgcacttacccactatcgtaaagctttcactgagctggcagttttgtcaaggactgctatatgttgtcgtgtgacaccatcacaaaaagcacagcttgtacagatcttaaaatcatgtgattatagaacattggctattggtgatggtgggaatgatgtaaggatgatacagcaagctgatattggtgtgggcatcagtggcagggaaggattacaggcagcaagagcagctgattatagtattggaagtgtctctggaactagcctcttcaattctgttagcttgatggcttataatgttttctatactagtgttcctgttctagttagtgtgcttgacaaagatcttagtgaggaaactgtgatgcagcatcctcaaattttattttactgccaagcaggaaggacaataaagaagttcatttcaactgaataa

SEQ ID NO: 85818 - DNA, 204 bp, Glycine max
  Peptide Sequence Number=SeqID_202596
atgcattcttcaacaccaaggatcaagttattgttacggaaacaagacgagattgcagttgcggcgcagtgtcacttgggtgagggtttcgctggtgtcgttgccgcagtcgcgacggaagtggcacgagagagaaaggagatgctcaacggtgagagagttgggggcgttagggtttcaccagggatagatcgggaacaatga

SEQ ID NO: 85819 - DNA, 345 bp, Glycine max
  Peptide Sequence Number=SeqID_202597
atggcaatgacaagggtgatgcagggtcttgttctctgcacacttttgttgtcggcggttttggtccaagaagttgaggcaagagtaatcagcaaagaagcaatgcagcgtaacaccattcctggatgcagcaaagtacaccccaatgtcgccgcttgtcatctgccattagttaacatcaactatagaagaggttgcactgatgtttcaaaatatactgatatatttggaacagagatgagggagattgccacgggattggtcgatgagggaaggcagttaaatctctccacactgaaggaagcgatgtatacgatgaagttgaggcactggttgagagcataa

SEQ ID NO: 85820 - DNA, 306 bp, Glycine max
  Peptide Sequence Number=SeqID_202598
atgggtatgaagtatcaaaaaattcatgcatgtcctaatgattgcatattgtacatagatgagtttgaagaaatgcataaatgccctaagtgtagggtatcatggtacaaagtgaaggatgatgaacgtagtagtgatgagagcacaaaggaaggccctccaacaaaggtgttatggtatcttcctatcattccaaggtttagacgactgtttgctaataaagatgatgcaaaagaccttacatggcatgcagatgggagaaactacgatggaatgctctgccatctagctgattcttcccaatga

SEQ ID NO: 85821 - DNA, 276 bp, Glycine max
  Peptide Sequence Number=SeqID_202599
atgaagctggttgatgatggctccttccagcagactcctcagaaagatgttgaggaagaagacagggtggacgcagacatctctcaagctgaaaagaaaaccaaaaataagatgaacgcacctttgtccaaggcttctccggcaccacatcgtccatcgcccactcttgttgctcctaaggcaacaggtgcaatggcccatgtatccaaaatggtagcacctaagaagcaacaaccttttttagattgggtgttgagtagtttcatggattgttaa

SEQ ID NO: 85822 - DNA, 813 bp, Glycine max
  Peptide Sequence Number=SeqID_202600
atggattcttcttcccatcagcaaaacccttgtctcctcattgcagacaaacaaacccaacaccaagaccaccctcttcccctgtcccctctcgcaacccccaccaaatccccatcccccgccgtccctcgcaacacctcgccgccgccggagtttccagattccgcgggggtgcgccgccgctgcaaaaccagagcaccccaaactgcgtccccgaggaaccctcgcaaatcgcggcggcgctccgagctcgagattcgagaagaaaaagattcaatctttctcgaagaggtcggaaaacccagaaagagaagacaaaccgcgcgaactaagaaggagaaacctaactctgctccgccttcaaccccatctccaaagagcgaagaagaaaatggtggtgatttcgaccgtgttgggcaggttgtgagtgatttgatcatgtggaagaattcgtcaaagtcaaccttttggtttgggtttggttctctttgtctcgtatcttcgtgctttactcaaggactcaactttagaaatgaggttgaagagaagagggaaatcaagctgaaagaggatgacatttcgcgtcttgcgaaattaattcttcctgctctgaattttgctctttcaaggatgagagcactgttctcgggagaaccatccatgaccctcaaagtagttccttttcttctactaggagcggagtatggccacttaattactatctggaggctgatttcttgtcagcttcagtgtccccaagctttattcttgctacactgctcagataaaccagagaggcatgagtccacctaa

SEQ ID NO: 85823 - DNA, 531 bp, Glycine max
  Peptide Sequence Number=SeqID_202601
atggcgacaccagcgacgacgaagcgaaaaccggtgttcgtgaaggtggatcagttaaaacctggcaccaacggccacacactgacggtgaaggtggtcagttccaagccggtgaagacggtgagcacccgcgtcgggcgaccgacggtgctagccgcgcacccggcgcgcattgccgagtgcctcgtcggcgacaaaaccggaaccataatcttcaccgctcgcaacgaacaggaaaaaataattagattgaaacacggaaaccaggttcccgttggctatgtagattgtgcattaaacggtatccatgttattaattcaaatataacgtcaggtcaagtggaccatatgaatgctggcgcaactgtaattctgcgtaatgcaaagattgacatgttcaagggatctatgagacttgcagtggataaatgggggcgtattgagcccacagaccccgcaaattttgacgttaaagaggataacaacctttcgttagttgaatatgaattagtgaatgttgttgaagagtga

SEQ ID NO: 85824 - DNA, 321 bp, Glycine max
  Peptide Sequence Number=SeqID_202602
atgttaggatttacacgcaattctcctcaaatttcagccagcccgtatcaattagacttcacactttatgcttcggggtcatacaatgctcaatggaatgccccagggctcctccacgataagcacacgttgcgttcgagtcgtatcctcagaaaagtgaaggttgatgaaccttggctagggttatggctaccattgaattatcaagtagatatgggagcaagctttctcgctgcaaaattcacttcttggttggtgtttttggtttgtgctaaaggtggtgttcgtcattggaagtatggtagacagactttgtggtag

SEQ ID NO: 85825 - DNA, 291 bp, Glycine max
  Peptide Sequence Number=SeqID_202603
atggataaagttgatatctttgtccctcatcctctcacgaacgcatgtttgcttattcaactttcaccggaatgtgggtataagccattggtctgtttgctcaagcaacctgcgctcctgagtgttgacttccaagaccgttcaatcagagattactcatcttgcacgttggtggggattaacaatgcacatagggacaaccctttcccttgtgttcaagaatcctctactacaagagacccacggtctcttaatcccttttcagaaataagaagaagaaatctctcttaa

SEQ ID NO: 85826 - DNA, 345 bp, Glycine max
  Peptide Sequence Number=SeqID_202604
atggatcagttgggatcgtgcccacaagacgcccagtcgacccgaagaagtccaacggggccctggggtttccagctctggttacgggcctttgtagtcctacagggtgcccgtttcccccctgcagatggattggttggtctgtgccgtcatgacatagggatcgcgcccacaaagacacctagtggacccgaagaagtccaacagggccctggggtttccagctctggttacgggcctctgtcagtcctacagggtgcccgttcccccagcgaggaatcgcacccacaaagacacccagtggacccggagaagtccaatagggccctggggtttccagctctg

SEQ ID NO: 85827 - DNA, 520 bp, Glycine max
  Peptide Sequence Number=SeqID_202605
tacccttaccttcagaggactatacgtcctcacctttagaggactacatgtccttcccttcggagggctacacgctctcgtctttagaggactacacgtcctcaccatcagagggctgcacgccctcaccttcagaggactacacgtcctcgccatcagagggatgcacatcctcatctttagaggaccaaacatcctcatcttcagaggactacacgtcctcaccttcatagggctacacgccctcaccttcatagggctacacgtcctcaccttcatagggctacacgccctcaccttcatagggctgcatgtcctcaccttcatagggctacacgccctcaccttcagagggctgcacgtcctctccttcagaggactacacgtcctccacttcagaggactacacatcctccatttcagaggactacacgtcctcgcctttagagggctacacgctctcgccttcagtgggctccacatccgcaccttaagtgaatttaaagtcctcttcccttaa

SEQ ID NO: 85828 - DNA, 369 bp, Glycine max
  Peptide Sequence Number=SeqID_202606
atggcatccaccgccggcgcagccgcgaggtctattttccgttcatgttccgctcgccgtgccgcgttccgtctcggctccgatgctaaagcggctcggtctccgttccgtgtcgcttccaacaaacctctctcgcaatctacactcaggtgtcccgttgaattgagcttttgtgtggaatccatgctaccgtaccatagcgcaactgcttctgctttgatgacttcgatgctatccgtctctcgccacagctatggttggcttcctgaaggtattgtctgtgctcctactgcattgcaaagagaagactatttgaagatcaagaagcaaggttgggatgacatggacctctttgatgtcgggctttaa

SEQ ID NO: 85829 - DNA, 663 bp, Glycine max
  Peptide Sequence Number=SeqID_202607
atgaggttcatcaatgatttgtccgggcaaggtggctatgggaagctggttcagaaagaattagaagtacaaaggcagcttgtagattatggcactggttctttgggttcttttccaccagttattccaacttcctctccaactgtacgcattcttttgagtagcctgtccgttgtccactcctgcatcctcaaattgtgcagtaacctgcagtatgaagaaattgcacaaattgatactttcaatagccaatatcttctgcattgtatgttcagttatctaaatcagaaattcaaattgtcattgtgcattactaagttcaatggtagacatggtggaggtcatggtcatggtggttcccatcgacatggtagaggtagtttcatactttcatctcatgacaaagacaatattactataggaagagacaccgagatgatgaccgccacatacacgagtcctcaaaaagaaattctgatcatgaatctcggaggaacactgaccacgaatccagaccggaaaaaaatccacggtttcgtgagagtggtgattctgatgatgacgaggaagatgatagaaaaagacgggcttaaccagaatttcatgcttgatcaagttgttttaaatttaaacatttctactgacataattaaaggtggatga

SEQ ID NO: 85830 - DNA, 900 bp, Glycine max
  Peptide Sequence Number=SeqID_202608
atggcttcttttgggaaccaactctctttctttttgctcttggtgcttgtcatctccccccaaattcaagctagagaaggcaagctctttagcttgttctcccatttcagaaccatctataatgtcagagaccctcttgacaaaacaaaagctgaatctccagcactagcaccagaaccagctctagaaccagcatcagcagcaccaacaccagaaccagaaacagcaccaacaccagcaccttcagctgaacaagaaattgggtcaacaataccatctggaccagcaccagagcctgaattttttgacagtggagaggcttatggcctctatggtagaggctcttatagccaataccctcccaccaaggagactcctaccgccaccaccacctttcaaaatgcgcttctgaatgaagacgtcaatgaggagagctacaaaactggctaccccaaatccaatttctacaacaacaacaatgaagagtacaacaacaatcacaacactagggaagagtacaggaacagttacattggtggctactccaacaacaactacaacgaaaaggaaaattactacaacaacaacaacaactacaatggcaaggaaaattactactactacaacaacaacaacaacaataacaacaacaacaactataacggcaatggctatgaggagaagagagagggaatgagtgacacaaggtccttggagaatagaaattactactatcatgtgaatagtgttaatgagaattataaccttaatgggtacgaatcagggagagggaggactactgaaaacgaaggttactatgagaagagtcagtatccaaatgagtttgacaccatggaagagtacgagaagcagcaggaagaacaaggctacaccccttga

SEQ ID NO: 85831 - DNA, 325 bp, Glycine max
  Peptide Sequence Number=SeqID_202609
atgcaaaaaaagaaggaatgcaagaaaagagaaaccaatgacgacgatgatgatgagttgcgagaagcctttagttccatgtatgacaaaagcggtggtagtggtgataacaatagttgtggtggctgtggatctaatggtggtggtgatggaagtagtagtagcaacactgacaacaataatgataatgactataacaacaatgatgaagatggagtgaaaagggttacaaggaaagggagggctcagggtgggggtggggggagaacgttgcccaaagagggggtcataattggaccaatcgttgacccaatcaaggtatcag

SEQ ID NO: 85832 - DNA, 873 bp, Glycine max
  Peptide Sequence Number=SeqID_202610
atgctgccagttgtgtcaggcttagcacgccctacgcgctcaaccaatcaccctttcacttccaggctaagcgtgccattcgcgctaagcccaaatctctctctgatggcatccaagaagaagcgtgcttcttcctcttgccctcaagaatcctatgactcctctcattttgtgtctgaggaggcatgggaccgataccagaccaatgttcatctctggaacatcttaccaaagaggaacattgagctagcttacttaaactatgatgagttcttgcataagttggtgcgtcgccattggcatcgccatctcacctaccagatggagaaccgcatcgacgtggcgttggtcaaagaattttacaccaacttgtatgaccctgaggacctctcccctaggcaatgtaagacctggagtgtcctctcttactccaagcttgcccccaccttccatacctcagaccttaacatggatcgagctaggttggtctatggacttgtcataaagatgaacatggatgttggcaccatgatctcttctcagatctctcagatagaccaatccaactcctcgaggttgggcttttcgactctaatcatagctctttgtgaagcccggggggttgtctctaactttctcaccttcgagtccctcagcctgaccattaatctggcctacattcacaagaattgctggaaccccgctgatccatctatcacttttttgaggtctcgcaaggccaggactacgactctagcagaggcacctccagttgctcctccacctcccaggccatcagcgtcttccttctcctccactccaccggaccagctcgtgcccatgttgcagagtattcatgatggcagtgcctag

SEQ ID NO: 85833 - DNA, 412 bp, Glycine max
  Peptide Sequence Number=SeqID_202611
atgtacaactattatgtgaaagggagagctcctgatcttgaaagtgtattggcagacttcatgacgtaccaagctagctctaaaggcgattgttattccatgcaacagcagggaactcagtttgaaagggactattcttttgtagattatcaatgggagtcagaatggcaaccttattatcacaatgaagcagaaggattgtctaatctgaatgacctgctaatgcaattcatagatgacatgactaaagttatggacagaagagaagaagagtatgcaaagattgaagcacatcaagaaaacattcttcaagttaccacaatccatcatcaattgatcaacgaagaagaaaaggatgaagtttccagtactccaaaatatccttgcatggaaattgctggttatgttatag

SEQ ID NO: 85834 - DNA, 345 bp, Glycine max
  Peptide Sequence Number=SeqID_202612
atggagaacccagtaaccactagatggaagccgttaagaggtaccgagtgtgtccttccggtcaaggagagaccaaacgacctacaaatggatgttctcatgttgtgtccatatgagaaccacatggatgtgagatctttggcacaacagtcccttttctctagcttcatcatatgtgagactaatgtgaggccttatcattcagaaaaagaattgattttggatagcgtcaaaagctatacgaagcttgctggatctcagagatatgctagaaggcacgattcatcatcaactcatgcaacaagctctaaaattgttgcaggagggattagcaacttggtgtag

SEQ ID NO: 85835 - DNA, 276 bp, Glycine max
  Peptide Sequence Number=SeqID_202613
atggggtgttacaataaaggtcacagcggaactcgtggcggatttggtagccatgagaaaactgtcggttttatgggcaaaaggctagagattccaaggcatgtgaatcctcaagtggctgccttgattgagctttgctgggccacggtcggggtagtagcccaggctaaacaagtactaatagaccaagcgggtcacaagcagcacagacagagaggcccaaaagaagaatcacagctcctcgaaggttccaggatttcgtgtgagcgatgctga

SEQ ID NO: 85836 - DNA, 336 bp, Glycine max
  Peptide Sequence Number=SeqID_202614
atgacaggacctgctgttaatcatagtggcagaatggatctacagcaaattgaagctctgggtgctaattatgctggtggaaacaaccatctgattactttgatttgtggtgcagaggaatacgagtctttcaatgaagtagaccggtcaataatggattacccaagtcatgaagttgatcttgacgaggaggatctagatattccatggagtgaacttattttgaaggagaacattgggacagggtcatttggaactttccttcgtgcagactggcgtggttctataagaatttctttgtttaattctttacatattcatttgtccatattttaa

SEQ ID NO: 85837 - DNA, 1848 bp, Glycine max
  Peptide Sequence Number=SeqID_202615
ggagcgttggaggagctgattctgatagacaattcgttttccgggaggatctctgagagtcttggggaatgcaagagtttgaggagggttaggcttaggaacaataacttttccggtgttgtgcctgaggggttatggggtttgccccatttgtatttgcttgaatttgttgagaattctctttctgggtcgatttctaattcgatttccggggcttggaacttgtcaatattgttaatttcggggaataaattttctgggtcgattcctgagggggttggggaattgggtaatcttgaggcttttgttgctgatcataatagtcttactggtcggattccaaaaagtgtggttaggttgagccagttggataggcttgttctcagagacaatcagctttttggagaaattcccgttggagttgggggttggaggaagctcaatgagcttgatttggcgaataataataggttaaatgggagtattcctaaggagttaggggacttacctgtgcttaattatcttgatctttcagggaatcggttctctggtgagattccaattaagctgcagaatttgaagcttaatttgttgaatttgtcgaacaatcagctttctggggtgattcctcctctttatgataatgagaattatagaaagagttttcttgggaatccgggtttgtgcaagcctctctctggattgtgtccaaacttgggtggtgagagtgagggtaagagcaggaagtatgcctggattttccggttcatgtttgtgcttgctgggattgtgttaattgttgggatggcttggttttacttcaaattccgggacttcaagaagatggaaaaggggtttcacttctcaaagtggaggtcgtttcataaacttgggtttagtgagtttgagattgttaaattgctgagtgaggacaatgttatagggagtggagcatctgggaaggtttacaaagttgcgctgagtagcgaggtggtggcagtgaagaaattgtggggagcaactaagaagggaaatggatctgttgattctgagaaggatggctttgaagttgaggttgaaacattgggaaagattcggcacaagaatattgtgaaattatggtgttgctgcaacagtaaggatagcaagctcttggtttatgagtacatgccaaaggggagtcttgctgatttgttgcacagtagcaagaaaagcttgatggattggcccactagatataaaattgctattgatgctgctgaggggctctcatatttgcatcatgattgtgtcccctctattgttcatagggatgtcaaatctagcaatatcttgctagatgatgaatttggagcaaaagttgccgatttcggagttgcaaaaattttcaagggagccaaccaaggggcagagtccatgtctattattgcgggttcttatggttacattgcaccagaatatgcttatactcttcgggtgaatgaaaaaagtgacatttatagctttggtgtggtcattttggagttggtaactgggaagccccctcttgatgcagagtatggggaaaaggatctagtaaaatgggttcactccacattggatcagaaaggacaggatgaggtgattgatcccactttggatattcaatatagggaagaaatctgcaaggtactaagcgtggggcttcattgcactaactcacttcctataacccgcccttcaatgcgtagtgtggtgaaaatgctgaaggaagtaactgaacttccaaagtcctttagtggaaaactctcttctccttattttcaggaagagacctcggatattgatcaccagggaagcttagtttga

SEQ ID NO: 85838 - DNA, 135 bp, Glycine max
  Peptide Sequence Number=SeqID_202616
atgactcagtgcagttaccctgaaaacaaccatagcatcattgtggagaggcacaaagatagcttgatcagaacatgtcctacatgtggtcatcacgtcaaatgccaggagcagtttgaatttaatgatctaagg

SEQ ID NO: 85839 - DNA, 198 bp, Glycine max
  Peptide Sequence Number=SeqID_202617
atggtggggtacgcaccctcaagctttgcggatttggtcttcatcggcgaaaggatcgaagtggaggatgagaatgaggaaggaacccatgttgaggttgtcattcctacatggccaaacttcccaccagcccaacaatgtcattactcagccaataatcttaagatggataggcttagaatgcagaagaagcagtag

SEQ ID NO: 85840 - DNA, 216 bp, Glycine max
  Peptide Sequence Number=SeqID_202618
atggatttcatattgggcattcttaacagaatagcaggagaaagaaaacctaagtatctagtgaaaaaagaaaaccacaactttgggaatctggatgatgatgagtctgagctcatcgttgtcccagttgaagtggaggatgatgatgagtctgagctcatcgttgtcccggttgaagtggaggatgagtctgaactcatggtcgcagtggtctga

SEQ ID NO: 85841 - DNA, 648 bp, Glycine max
  Peptide Sequence Number=SeqID_202619
atgccgaaggacaccttatataccgaaggccacaggcgctccacagcattcgtggattttcatgtattagtgtttttcctcaagaaccataatcttctgaccattccaaagatgagcataacatccccagcaccgttaggcatggtgaggaatcgcattatgagccagcactacacgttacaatttattgccacattccacaatgacaagtggccaccctactacccagactttgcccgctttgactatgacagggcctcataccagatacgactcagacaggatcaaggaagattgttctttgctgatggcctcaaacacctgagaaaacacttaggcatctatgagtcagtaaccatcaactttatggcgtgtgaacacagacggatttttaacctccatttcactcctccgctggaacaacaagcatgcgacagacccttactggcagctagaatgcatgtctggactcttgaactcacacagtccttgcttggtgatcctaaaccattggtgcttccacctcttgcagcaatacatcttccttcttgcggttttcatatgacgattctaagaaagttcgaccctccattgcaatggcctgtccttccagttggccctggctttcatgacaagcgtgttgcctag

SEQ ID NO: 85842 - DNA, 1323 bp, Glycine max
  Peptide Sequence Number=SeqID_202620
atggttaatgatcctgacgcagaagtcataaccctatccccaaagactctgatggccacaaacagattcgtgtgtgagatttgtctcaagggttttcaaagggaccaaaaccttcaactccatcgccgaggtcacaaccttccttggaagttgaagcaaagaacaagcaaagaagtaaggaagcgagtttatgtgtgtccagagaagacatgtgtccaccaccacccttcaagagctctgggggacctaactgggataaagaagcacttctgcagaaagcacggtgagaagaagtggaggtgtgagaagtgctcaaagcgttatgctgtgcagtcagattggaaagcacactcaaaaacatgtggcaccagagaatacaaatgtgactgtggcactatcttctcacggagggatagcttcatcactcacagggccttctgcgatgccttagcagaacaaacagctagggtgaacgcagcatcaaacattagcaactacagcatcatgcaaaatcccgtaggttctgacatggcaacccatttttcatcatttttcaagccaaattcatgccctgatcaggagccagcaccaggtaaccaaacatctaataagggtctatccctttggatgactcaaacatctcaggctcatcatgagacaatggttaacaacaataatttgcatgaattttatcaacttgggtctgttacaagcccaacagcaatttatggtactagtggcaatccacttgcttcatgctcgaatccaccgccctctaattaccagctaaattgggtgcttggaaataaactctccaccaatggaagccatcaagagctaactagcactgcttcacttccactagtcaataacattgttaaggataacccaaaccttcaactcataagtgtcccttccttgtatagctcacaacaccaatcccaccaaacaacctcagcaaacatgtcagccacagctttgttgcaaaaagctgcacaaattgggacaacttcatcggacccatcatcattattccttgcgagcataggtttgaaatgcaacagtccaggccaagatgggaacaaattttgtggcatgtacggttcaagttcagtactcacaagtcattggagtgaggcagagaataataataataataataataatcataatcattcgggtgatttgtcacaaatgccccctacaaaacgactccacgtacagaatgaagagagtgcatggggacagactagggattttcttggtgttggtgctgccaaccatttgccacccttcatcaatcaacggatggatttgagttga

SEQ ID NO: 85843 - DNA, 468 bp, Glycine max
  Peptide Sequence Number=SeqID_202621
atgaagctcacagactcgccggggatcgaacttccggtgaacgacgccgttttgtcccttcagcaagacaacgggtccatgcacgtgggaacctccgtgtggccctgctccctcgtcctcgcaaacgggccgtggaactcggcacgggctgcggcgttgcggcccatcctccgcaagaccctgaaacactccgtgctctactggaacaacccgcagcagatcgcagccctaaaccctcccttcgatttcgccgtcgcgacggacttcgtttacatccgcgaatccgttccttcgcttgtttctgctatggaaacactcgtctacgacaacggcgtcgttttgctcgggtaccggcttaggtcacccgaggcgcacgagcttttctgggaactctgtgaacgagtcttccacgttgagaaagtcccgcacgagcatctgcatcccgattatgcttacgaggaaaccgat

SEQ ID NO: 85844 - DNA, 372 bp, Glycine max
  Peptide Sequence Number=SeqID_202622
atgggttcctggtggttattgatattttataagaatcccttaaaattccaacaagaaagacattccagtggcaaaggtgcaaaaccattcagaccacctaaccccacttcagatctaggtccaatcacctgcggcgaagacaatgcagatggtgacagagcgtctcaaattcagatatgtttgtttgtttcacgtgatggcaaaaggaaggaggagttggtcaagtttgttgatgcagtaatcatcgttcttagttcaagtcggatttcccaaacaaccttcattggagtctcttgttgcttcaccctcatgatcatacctgaagttggtgcggcgaatttgggaagggaggaggtcacaatggaaatgtag

SEQ ID NO: 85845 - DNA, 687 bp, Glycine max
  Peptide Sequence Number=SeqID_202623
atgcaggaacgatatgtacattacgatgccatgaagagatgcttatgcgttaagaaggtgatatggaccttccggcttcccgtgacaaaagacgagatcaacatacaacgcgtgcgtgacgacatgatgcagacatgcaaaagcgcaacagggggatgtatcatccccttcaacaaacatattgtggcaataaggactaccagcaacaatatgttatcaaagagaaaaactctagatgaaggttcactgttatcaagcaagtcggagacccagcatgaccacagattcacctccactccttatgttcccatggacccaggagaaaagagggaggtggttgccgcccagctcgcccagacgagcagggttgcttccaccagaaggcaccaccttcttttggaaccctcaggaaggcccaagtgggcccggcggtcaagcaaaggtcccatgccaacaaataatgatccccagacgaaattaggaggcactgaaaccatcaaggagaaagaattggttggattgaacgatgaaggagatgttggtgcgagaaaggaaggggatggagtaacaaaattgggaatgggaaacacgagttgtggtatagggaacttgattgaatatccccatggtgccacaactgatggtgaagttctccattggggtgtatgctcagaggtgtatgaagag

SEQ ID NO: 85846 - DNA, 1122 bp, Glycine max
  Peptide Sequence Number=SeqID_202624
atgggtgccgacgaagactacgattacttgttcaagctggtcctcatcggagattcgggtgttggcaagtccaacctcttgtcccgattcacccgaaacgagttcagcttggagaccaaatccaccatcggcgtcgaattcgccacgcgaagcgtccccgttgatagcaagctcgtcaaggcacaaatctgggacactgcaggccaagaaagatatcgcgctattacaagtgcatactaccgaggagccgtaggtgctttggttgtgtacgatgtaacccgacacgtgacattcgagaacgtggagagatggttgaaggagcttcgagatcacacagaagcatacgttgtggtcatgctggtgggaaacaaagcagaccttcgacatttgcgtgcagtgtccacagaagaagccacagaatttgcagagaaagagagcatttacttcatggaaacctctgcccttgagtccttgaacgttgacaatgccttcatagaagtgctgactcagatatacaacgttgtgagtaggaagactcttgagactgtggatgatgacccttctacgaaagccttgcccaaaggggagaccatagttattggaaccaaagatgatgatgtctcagctcctcctccctgggaacgaacccgggccgaaggtgtggcggtacgaacttgtccgtcttgggcggctgaggagagagcaagggcaagtccttgtcggggctggaaacaacggggagcgacaagagcggtgaaccggttccggttcggcccaggggtcggagcgagatcgcgtccgatcctggttcggaccgggggtggttgtgctggatcggggtcggcggtggtggttgttgctgttgcggacgaggatgcggccatggggtttgttgggggcggagacggcggaataggaagcggaagaagaagagagagaaggattcttgttgtgtgggttggtggtgttggttttttcgtagatgtggttgaagttaatagaggcgggtgtgtggatctcggcatggacgttgacattggtggattgcgtgcggtggaagagggtggggtcatgtgcagttgtggtggacaaggtggggtcatccggtttgaagtagcatag

SEQ ID NO: 85847 - DNA, 798 bp, Glycine max
  Peptide Sequence Number=SeqID_202625
atgagaatcgcaaattcccacacacaattgattgttgatttcattttcctctggcggaagccatttttcgatctgttggtgtgctttctggaaaggtggtggatggcaaaaaacaacaagtacgcctctattaacttcaaccacatctacgaaaaaaccaacaccaccaacccacacaacaagaatccttctctctcttcttcttccgcttcctattccgccgtctccgcccccaacaaaccccatggccgcatcctcgtcctaacccgacccactcccaaacccatcacgccctccaccccgcaaccgcaacagcaacaaccaccaccgccgaccccgatccagcacaaccacccccggtccgaaccaggatcggacgcgatctcgctccgacccctgggccgaaccggaaccggttcaccgctcttgtcgctccccgttgtttccagccccgacaaggacttgcccttgctctctcctcagccgcccaagacggacaagttcgtaccgccacaccttcggcccgggttcgttcccagggaggaggctcccccgcccgggcccgaacttcggcccaacggccggcccaagtcgggtggcggcccggacaggatgagaagggttgggccgggtggcgtctcggatgcggggagtttggatgtggttcagagtaatgaaaatgctttaggtcctgtttggataaagttttcaataggtgatgagagtaatcaacatgctttagaagaagagcccaagttgttgtttttcatggttcttcggtttgttgatgttcactag

SEQ ID NO: 85848 - DNA, 177 bp, Glycine max
  Peptide Sequence Number=SeqID_202626
atggaagagaaagaatatagagagatccattcgggcagtaacgtcaaccaagacttaagtaagaggtggggccagacccaaaattccaacgcagccatgacgaaacccaataggaaagtcaataaaaatgatgaggaatataaatgggcacatgactcacacctaagttgtaattaa

SEQ ID NO: 85849 - DNA, 936 bp, Glycine max
  Peptide Sequence Number=SeqID_202627
atgaatctgaagaacatgaagattccgaacgttccaggcggcggtgcgtcctctgcgctgctgaagcttgggcttcttggtggaattggtttatatgcagctgctaacagtctctacaacgttgaaggaggtcaccgagccattgttttcaaccgtctagttggtgtcaaagacaaggtctatcctgaaggaacacactttatgattccgtggtttgagaggcctgttatctatgatgtccgtgcacgaccccatctagttgagagtacatctggtagtcgtgatctacagatggtgaaaattggacttcgagttcttactcgccctttgcccaaccaattacctacggtttatcggacccttggagagaattataatgaaagggttttaccttcaatcatacatgaaactttgaaagccgtggttgcccagtacaatgccagccagcttattactcagcgagaggctgttagtcgggaaatccggaagattctaactgaaagggctgctaacttcaatattgcccttgatgatgtgtcaattactagtctgacttttggcaaggagtttactgctgcaattgaagctaagcaggtagctgcacaagaagctgagagggctaaatttgttgtggaaaaagctgagcaagacaagagaagtgctgtaattagagcacagatcacttttgcatcccaagtgtgttcagttctccctgacctttcttacgaatcttttaatgatcagggagaagcaaaaagtgcccaactgattgggcaagctattgccaacaatccagcttttatcacactgaggaagatagaagccgcaagggagattgcacatactatatcaaatgcggcaaacaaggtttacctgaattcagatgatctattgttgaatcttcaagagatgaaattggagccaggcagaaagtga

SEQ ID NO: 85850 - DNA, 357 bp, Glycine max
  Peptide Sequence Number=SeqID_202628
atgcagcaagcttacttccatcaaaatcatgtacctactgtggtaaggataatcacacagtggatagatgttacaggaaaaatggttttcctccaaattatacttatagtaaaggaagaagtagctaaggaggctctgacaaagggagttctgatgagagatgaagcaagaaaacatggatatcctcctagacacaagctttacaggcctcaaggatcaaatgttagcaatgttaatgctatgaaagaagaaggtgatgaccttgctttggaaagaagtcaagaagtacaaaatgatgaagtgaagttgacctctcaacaatataaggccttgatgacaccacttcaacaacaatag

SEQ ID NO: 85851 - DNA, 947 bp, Glycine max
  Peptide Sequence Number=SeqID_202629
attatgagtcgttactcgataccgcgatgctggaacagtacatggatctggttggcccgcagctgatccaccaaagcctggagatgttcgaacagatgatgccgggctatctggcggtgctggactccaacatgacggcgcgcgatcagaaaggcatcaccgaggaagggcacaagatcaagggcgccgccggttcggtcggtctgcgccatctgcagcagctggcgcagcagattcaaacgccgacgctgccggcctggtgggataacgtgcaggattgggtggatgagttgaagcaagagtggcgcaacgacgtgcagtgtttgtcaactccgagcacgaaccagttgacagcagcgacaggagtaagagtgatgaaaaaggtgggtgtagtcctcagcggcagcggcgtttatgacggtacggagatccatgaagcggtgctgacgctgctggcgttggatcgtgccggcgcgcaggcggtgtgctttgcgcctgataaccacaacgccatgttattaatcacttatcgggcggaggccgcgcagctggatgcgctgatcgtgcccggcggctttggcgccgccaagaacctcagcaatttcgccgaagctggcgcggaatgttgggtcgatgaagatttggcgcgcctgacgcgcgagatgcataaggccaacaaaccaattggcctgatgtgcatcgcgccggcgctgttgccgaaactgctggatcaacaagcgcggctgaccattggcaacgatccggacctgggggaagtgattgacgccatgggcggcgaaccggtgatttgcccggtggacgacatcgtggtggacagcgatcacaagatcgtgaccacgccggcctatatgctggcgccgtcgatcgcgcaggcggccctcggcatcgataagctggtggcgcgggtgctggaactggccgaatga

SEQ ID NO: 85852 - DNA, 279 bp, Glycine max
  Peptide Sequence Number=SeqID_202630
atggggttgagtcgtcgttgtggctgcttcactagcttaactccatcctctaaaagtatcctatgcatgcagcaacaacttctcctcttgctcagcagcaagggaggcagagatgatcactggaaatttttccttgtcctccaaagggaaaataaagtgatgcaatcctaccgcccaagggcattggatagaagactccaagaagattgggccaaagatgcaagagaatgccctagggttctcatgagccttacggtagatttcgggcccatgggctaa

SEQ ID NO: 85853 - DNA, 243 bp, Glycine max
  Peptide Sequence Number=SeqID_202631
atggctaccaaaggttggagctttgttgaagcttcaatggtggaggaagaagaagagaatggcaacgtgagagagagagggagaaaggcttcagaaattttggggctgatccctcgcgtttctctgcgcccgtcggggccagttttcgaaagtaggcaatatatatatcaaaacgctcaggataaaaccccgagtgtggttcagaggttgattttgttaaattttaagttgcacgcaaaatga

SEQ ID NO: 85854 - DNA, 528 bp, Glycine max
  Peptide Sequence Number=SeqID_202632
atgcagctgccaccggaaaccgtctacgcgcaggtgatctaccagattggtgccctgaaaagccttgccgaaagtgaaggcgcgaagctggtgcacgtgaagccgcacggcatgctgtataaccaggcggcggcggatgcagcgctggcggatgcgattgcgcgcgcggtgaaagccgtcgatccggcgctgattctggttggcctggcgggcagcgcctcaattgccgccgccgcgcatcatggtctgcgcacgcgcgaagaagtgtttgctgaccgcggctatctggccagtggcgcgctggtgccgcgcagccagccgggggcgttaatcgaagaggctgagcaggcgctgacgcagacgctcaccatggtgcagcagcgtcaggtgcgcagcgtcagcggcgaatgggtggcggtgaacgcgcagacggtctgtctgcacggcgatggcgcccatgcgctggaatttgcccgcacgctgcgcgccgcttttgcgacaaatcagattgctgtcaccagcgcctga

SEQ ID NO: 85855 - DNA, 1578 bp, Glycine max
  Peptide Sequence Number=SeqID_202633
atggataacgtggtcaatctctggccgttactcggcattgccgcgattgtgctcggctttgtgctgcgcttcaacccggtgctggtggtgattgttgccggttttgtcaccgggctggcggcgcatatgccgctcggcgatattctggagaagctcggttccggctttctcaatacccgtaatctgccgctaatcctgctgttaccgctggcggtcatcggattgctggagcgccacggtttgaaagagcgggcgcagacgtggatcgcccggatcaaaaccgccaccgccggccgtttactgatcgtctatctgttcgtgcgtgagctgactgcggcgctggggctgaccagcctgggcgggcatccgcagatggtgcgtccgctgctggcgccgatggccgaaggtgctactgaaaaccgttacggcagcgtatcaccggagattcgtcagcggctgcgcgccatgtcggcggctaccgataacgtcgggctgttcttcggtgaagatattttcgtggccttcggcgcgatcatttttatgcacaactttatgcaggagtcagcgggcatcagcaccgaaccgttgcacatcgcgctgtggggcattccgaccgcactgtgtgcgttcctgattcatgctgcgcgactgcaacagtatctgatgtggctggccggggcgatcctgctgattgtcgcgctgctgtcatggcgcgatagcgccaacccacgccgttttaccaccggtttattctgggcgctgtacggtgtgattttcctgattggcgacggtgcttatcaactgatggggcagtgggccggtgatgcggagctgggacgtcgctggttgcatattgcggtgggcgcggcggtggtggtcatggcgctgattgccgggttcggcggcgtgcgcctcggtcgctatcatcagcgcagcgatgaacagaagcagcagagcgcgcagcgtctcggcaataagctgttcctgccggcgctggcaattccgctggtgacggtgattggcgtgctggcgttcaatcatattcccggtctgcaggataaggtatttggcccgggcaatcattcgacgctggtcacgctgttttcgatgatgattggctgcgtgctgggctggctgattgcgctgaagtttacccacgagaagccgctgcagtcgatgcaggagacgcggcgtttgctggatgcggttggctgggcgtttattttgccgcagatcctcgccacgctcggcctgctgtttaccagcgctggcgtcggcacggcgatttcgcatctgaccgaacactatctggcggtggataaccggctgattgcggtggcggtatatgcgctgggcatggcgctgctgaccatggtgatgggcaatgcgtttgcggcgtttccgattgtcaccgccggcatcggtattccgattctggtgctgcagcacggcggtaatccggcggtgatggcagcgatcggcatgttctgcggctactgcggcacactgatgacgccgatggctgccaacttcaatattgttccggcgcgtttactggagctgccggaccgtaacgcg

SEQ ID NO: 85856 - DNA, 225 bp, Glycine max
  Peptide Sequence Number=SeqID_202634
atgggaaaggcaagaggccaccttagggcggttagagctcacccaggcgagctgaaacttaaccttgaagcagtaagctcacccaggcgagctagtcccttagccttgaagttttttggtggcccaggcgagctaaatgctgtcctgggcaagctagtgcctaggaaaaataaggaaaatacccttttgcccttctttcttggtatcttttgtcttctagattga

SEQ ID NO: 85857 - DNA, 279 bp, Glycine max
  Peptide Sequence Number=SeqID_202635
atggcgactaggagcaaaagagaagcagagggtgttggtgatggtgatgcagaggttcgagacgcaggacaaggaggcgttcgtagagtacgccctgaaagaaaaagggaaggtcatggtcatggatttgatccacactttcgtgcccccttccaagagaggccttggcttggcttcccacctctgcgtcgccgcctttcagcacgcccaatctcactcgctatccatcatccccacctgctcctatgtctctgtaaggaccaacatttttgtgcttag

SEQ ID NO: 85858 - DNA, 195 bp, Glycine max
  Peptide Sequence Number=SeqID_202636
atggcttcctgtggtgaagcaaatgactccattgatgaagaagatctaaggcctacaagctccacatggagctacatcatgagtaggaggagcctagcggcgagggagggggcatggaaggcgaggaagcgtgggagaggggagaaccctaattcaaagatggtgtcagtgagcagggtgagatggcgtgactga

SEQ ID NO: 85859 - DNA, 177 bp, Glycine max
  Peptide Sequence Number=SeqID_202637
atgaagccaagtttgggatgcaacctgcaacactcccgagaatcaagatggcgagttacgggaactcaacaaaaaagtgaagaaaacatggtgcagctagtgatacggtggcaaggttcccacgacaatcagctctccaacgacgagaccaaaaacaaggaactcagacccgcctga

SEQ ID NO: 85860 - DNA, 137 bp, Glycine max
  Peptide Sequence Number=SeqID_202638
ttaagaaggtgatatggaccttccaacctcccgtgacaaaagatgagacccacatacaacgcatgtgtgacggcatgatgcagatgcgcaaaagcgcaacagggggatgcacagagtacgacaatatccataaataa

SEQ ID NO: 85861 - DNA, 309 bp, Glycine max
  Peptide Sequence Number=SeqID_202639
atggcactggtcttcgtggcatacctcctccaacgaggaatcacctattggaatgacctcccattccaccagggtttgatgtatggagcccctagaatcgcttctacccatgcctacagtagaattcaaaacaaaagacatggtggaaaagaggagtgtaccttgattacgatcggaggaaagaagaaatgcaaaggcaaaatcgacaactctagggatgaagagcacgctcaccctagagaatttaggggatacaatgcgaacaacgtttgtccaggctggaaagcttggcaaacgtgcaactcttaa

SEQ ID NO: 85862 - DNA, 2853 bp, Glycine max
  Peptide Sequence Number=SeqID_202640
atgaggattgagcaagagagtgatggagtctccgcttccacaaagcacctcgtctttgcgtattacgtcactggtcatggttttggccatgccactcgagtcactgaggtggtgcggcatttgattcttgcggggcatgatgtgcatgtggtcactggtgctcctgatttcgttttcacctccgaaatacagtctcctcgcctaatcattcgtaaagtgcttttggactgtggagctgttcaggctgatgctttgactgttgatcgtcttgcctctttggagaagtattctgaaacggcagtaaagccccgtgctcaaatcttggctcaagaaaccgagtggctgaactctgtcaaagctgacttagtgatctccgatgttgtcccagttgcttgtcgagcagccgcagatgctggcattcgctctgtttgtgtgaccaatttcagttgggacttcatctatgcagagtatgtcatggctgctggacttcatcatcgttcaatagtttggcagatagctgaggactattctcattgcgagttccttatccgtctcccgggatattgcccaatgcctgcttttcgtgatgttattgacgtccctctggtagtgaggaggttgcacaaatctgcaaaagaggttaagaaggaacttggggtaactgatgatgtgaagctagttattctcaactttggtgggcagccatcagaattgaagctaaaggaggaattcttaccacctggctggttgtgcctggtttgtggtgcttcagagactgcagaccttccgtctaactttgtaaaacttgctaaagatgcatatacgccggacattattgcggcatctgactgtatgcttggaaaaattggatatggcactgttagcgaggccttggcatacaagtgtccttttgtctttgtacgtagagactatttcaatgaagaaccttttttgagaaatatgcttgagttttatcaaggtggtgttgaaatgattagaagggatttactgactggtcactggagaccttatcttgaacgtgcaataagtttgaaaccctgctatgaagcaggcattaatggtggtgagcttagtggagcaagaagattgcgtgatgccatagttcttgggtatcaactccaaagggcccctggtcgagatattacaatcccagaatggtatgcaactgctgaaaaccaacttggccgctcaacacctggttcccctatggatgatggaagatctgcgtttagcttggacattgaaaactttgacattcttcatggagatattcaaggacttccagatactgtggcattcttacagaacctatctgaattacaggacaagcacactaggcgggagcgtaaggctgcggctaatctcttcaactgggaggaagaaatatttgtaacaagagctcctggaaggttggacgtcatgggtggtattgctgactattctggaagtcttgtcctgcaggtatcatatggctcagaattgagcaatcgtggcccaacatttgacatggatttatctgattttatggatgaagaagacaaaccaatctcatatgaaaaagcaaagaaatactttgctcaagatccttcccaaaagtgggcagcatatgttgcaggggcagttttggtcttaatgactgaaatgggtgttcaatttgaagacagtatcagcatgctggtttcatctgcagtcccagaaggaaaaggcgtatcatcttctgcatctgtggaggttgctagtatgtatgctattgcagctgctcatggattaaatatcagcccaagggatctggccatactctgccagaaggtggaaaaccacattgtaggcgctccatgcggtgtcatggaccagatggcttcttcatgtggtgaagccaacaaacttcttgctatgatttgccagcctgcagagattgttggccttgttgacattcccagccatatccgtttctggggaattgattctggaataagacacagtgttggaggtgcagactatggttctgttagaattggcgcctttatgggtatgaagatgataaaggccaaggcatctgaggaattgtctgagagttgggctgctaatgggttgaactatgatgaagtggaacaagatgacatagaactacttaaacaagaaacctccttagattacttatgtaatttgccacctcatagatttgtgactctttacgctaagacaattcctgagtccattgtcggtgagacatttttggagcaatatcaaaatcataatgatcctgtcactactattgatccgaagcgtacttacggagttagagctcccacaatgcatcccatatttgaaaatttccgagtcgtgaccttgaaagcacttttaacatctgcagcttcaacctatcagcttacagccttaggagaattgctatatcagtgccaccacagctacggtacttgtggacttggctctgatggaacagataggcttgtaaacttagtgcaagagttgcagcacagtgcagcatctaaagctgaaggtgggacattatatggagccaagataactggtggtggttctggtggaacagtttgtgtagttggcagaaactgtctcaagagcagtgaacacatttttgaggttcaacataggtacaagaaagctactggttatttgcccttcatttttgaaggttcatcacccggtgctggaaaatttgggtacctaaaaatacgtcgtcgagctaccccaaaaaaggctaacgccatcaaggatgatggtgcactcacctcagaaaaggctaacgctagcaaggatgatggtgcagtcacgatgaagaataatagttaa

SEQ ID NO: 85863 - DNA, 132 bp, Glycine max
  Peptide Sequence Number=SeqID_202641
atgcctagggcacaaaattccacagcacaccacagtgcctatttcgggaaaagagctctggaggcagcaagaggagcaacttttgcagagatacctaggtttttgcttaaattctgtatgctcttggtctga

SEQ ID NO: 85864 - DNA, 243 bp, Glycine max
  Peptide Sequence Number=SeqID_202642
atgactgtgagcaaacaccattcagtccatgatatacagttgagcttagctcatcagtgggctaagcacgcatccaccgctaagcgcagattcatcgtgctttgcgtgatagaagaatctggtagggcatcatcatcaaggtcgtgcgctaagcgtgagatcaatgcgctaagcgcaacagttgtcttcagccaggctcagcgcacgactggcgctaaactcaaatccacttactcgcactaa

SEQ ID NO: 85865 - DNA, 1146 bp, Glycine max
  Peptide Sequence Number=SeqID_202643
atgagtctttggtatgtggctcctacgttcttcaatccaagaggcatgaccatgaagctagatattcgaaagtccgacgcaccatccacaattgatgctaagcaagggatatgcatccttagggcatgcctagttgacgttggtgtagtcaatgcacatacgtcatttcccattagccttccgtaccatgacaacggatttttcatccacactcatgacttgactgtcacagccattagaggtgggatgaggctttcctggctctctaatgggaggataaggagttaccttcaagcttttagtgtagcactatcgaggctacttttggtctaccttgacaattatgatttctcctgccaggatcaagaatttcattataaggaccttagacaccatcaaattagagatgtgtatggagacgaccatggggtcatcctggttgatggggttgatgcctttgaaatctttgtcggtgaatgttatgagaggaaggcttctcggttactttgtgttgacgttaatatctttgatagtgtggagatgacgttttcgggactagatggacaacccttcataaaaaaatcctcccgcaatgatgttgattacacctctaatctgttgggcggcatctcgcatcttgcgatggtcatcatggtgccccctgaacttgcctccaattctgtttgcttggttttgttcattccagattttaagggaggtatggggccaacaacatggagtgtaaagccactcaagattaagattcctgatttagacagtgattcgaccgaacctgtccataaatttgtgaaggtgtcgaagttgttgatggaccaaggagggagccctttgtaccatgtcaatgtctcccccttaaaggatctagtaaagactcaacataggatcgcatcatcgtgttgtcgagttgtgcatccttcatggcgatgtacatgtgagattgtcgcaacctacccttttgcgggcgagcgaggcgaggctcacgggtgcctcttccaaaggaggaaaatgcacggagtcgccaccaatgaaggtattagcacctctcacgtcgacaaaagcggggctcttgctcctatgtaccctccatcgaagaggaaatcagacctacatatttctttcttaagg

SEQ ID NO: 85866 - DNA, 420 bp, Glycine max
  Peptide Sequence Number=SeqID_202644
atggcactaactggagttggacaaattgggcgactcccgcaagatgactgtccacccttcttttatgtctatcgctacatgtttgaggttctaaatttgacccttccactgaacaccttccaatgtgcccggttgaggcatctgaatgtggcaccttcacagtttcatcctaatagttggacaatggtgagggcctttgaggtcttgtctccatttttcactattcgatccaatgtgcctgatcttttctacaaggtcaaggcaatcaacatcgttgttgatgggttgccattgatgcatgatgggaacagggagccttgcttccacttttactgtcaatcagaccccacaaggttcaaatcctttgatgagagtctgatgtccctagaggagagggcaaacaaggctattttggagtga

SEQ ID NO: 85867 - DNA, 615 bp, Glycine max
  Peptide Sequence Number=SeqID_202645
atgcttccaaacaagcaaattgatgtagccttggtgaaggaattctactccaacgtctatgatccaaaggataggtcttcgacgacatgcattgtacgtggaaggataattcaattcgacacggagacgttgaaagaattcctagggacaccaatcaccattgttgagggggagcaactgaccacgtatgcccattacctccactctcacccgaattataaggccatcgcggccaagctatgcacccctggagggcgattccaacttaatattgaggaagcccctgtgctttcctacttcaacattgctctgacctcttatacgtcagacattaatcttgatcgggctcgcctgatctatgggctcatgatgaagatagagatgaatggagttgactcagaaacactggcatacgagtccctcagcccagtaatcaacttggtgtacattaagaagagctactggaatccagcagattcttctatcacctttccaagtctgaggcgagtccgggcccacaccactcaggatgcaccaccaccaccaccgtcaccagttgtctcacctccagccgcaccttctacgatcggcccgtcttcttcctcctctgcctag

SEQ ID NO: 85868 - DNA, 238 bp, Glycine max
  Peptide Sequence Number=SeqID_202646
atgaccatagatcatcctccactccctatggctcacacagacccaagtatagggcctaatatctcaatgccgcgcgctaagcgtgagatcagtgtgctaaaggcagcggttgtcttcagccaagctcagtgcatgaatgacgctaagctcaaatccacttactcagcacaccacaatgcctatttcgggaaaagagctctcgaggcagcaagaggagtagcttttgtagagagaccta

SEQ ID NO: 85869 - DNA, 228 bp, Glycine max
  Peptide Sequence Number=SeqID_202647
atgttagaaaaaccaaaaagaggtcagggaattttgaaaagaagggttcgggagttgtttatgcatagggaaggtatcaactcgcccaggcgagctggttgcttaaggatgacgacatttcatggcccaggcgccggagatgctgtagatgccggagctgatattgaccatgttgtagaccttacaacagctcagggtgaatgggacccatggccaacacaggactag

SEQ ID NO: 85870 - DNA, 267 bp, Glycine max
  Peptide Sequence Number=SeqID_202648
atggttcagctaagcgcacatcactgcgctaagcccaacatcttcactaaagcgctaagcaccgcctgccacgctatgatgcaatcctacctcccaagggtattggatagaagactccaagaggatcgggctagagctgctaaagaagtccctggggttctgatgaacctaaggggcattttgagtagtctttgtagtagggacttttattgtattttcatgtattttggcatgggggtgagcttagctattatagggggtgtgtag

SEQ ID NO: 85871 - DNA, 299 bp, Glycine max
  Peptide Sequence Number=SeqID_202649
atggcggctgatgatgcggcgtacattggccaggccgatgcccgtgccttcgaactcttcgacgtgatgcaggcgttggaacacgccgaacagcttgtcgacgtagcgcatgtcgaagccgcagccgttgtcgcgcacgaagaagtggtcttcgtcgtcgctgcgttcgtgaccgacctcgataacagcctggtcgcgctcgcgggtgaacttgatcgcgttggccagcaggttctgccagaccaggcgcagcatcgtcggatcggcttcgacctccggcagcggtgcgagcgtccact

SEQ ID NO: 85872 - DNA, 1104 bp, Glycine max
  Peptide Sequence Number=SeqID_202650
atgagggacctgcggccgatcctcctggttgaggacagccccaaggatgcagagctgactctggccgcattgtcgcgctgccagttgctgaacgatgtcatccatgtacgcgacggcgccgaagcgctggactacctgcgctgcgaaggcaagtttgccggcgccatgcacggcggcccggtggtggtgctgctggacctgaagctgcccaaggtcaacggcctggaggtgctggaacaggtgcgtagcgacccggatctgagcagcacgccggtggtgatgctgacctcttcgcgtgaagagcaggacctgcgagcgcctgcgcatccgcatgctggaggacagcgcgctggatgcggagctgatcagcgcacagttgcagcgcgccggcctcgacttctaggccgagcgcctgtggacccgcaatgcgttcatcgaggccatcgactacccagttgccctggcacgcgaacgcgtgccgcagacgcctttcatctttgtttccggcacgctgaccgaggaactggcagtacaggcactctcgcgcggtgcgcgcgactacgtggtgaagcaacgcctgctacgcttgcccgatgcgatccgccgcgcccgccaggaggcgcacgagcgtaccctgctgggctatgcgcaggccgcgctgaacgaaggccaggcccagctgcagcaggtaaccgatgccgtcccggcgctgatcgcccagttggacaaggaccatcgctaccggtttgccaacaaggcgtttctggactggcacggattcagccttgcagaactgttgggtcgcgcggcacgggatgtcagcgggacttctgccttcaagcacgccctgcccagcctggagcgggtattgcggggcgaacgcaccagcttccacgtcgaactgatccaccgcagcggcgaatcacgcgatgtttcactgttgcagaaagcccaactggcgctgcgctaggacaaccaggtactcgaacgacaggtgcaggcgcgcaccaccgaactgagggccagcaagcggcgcctgcaggcgatcttcgaatccagcttccatcatcaggtgctgctggatctgtccggacgcgtggttga

SEQ ID NO: 85873 - DNA, 234 bp, Glycine max
  Peptide Sequence Number=SeqID_202651
atgtatagatctcccacaggcaatttagtgcctctggacttggagattgaagctacgttaagaaggaacacaaccaagaggagaagaaaattactgcaagacaagacagtagcttccattctagaggaagaagctcattcttctgattctacatcatctgactcaccatcatcaagggaatccatgacatatttaccagaagttgttatcatggctgatgaacaccagcaaagg

SEQ ID NO: 85874 - DNA, 345 bp, Glycine max
  Peptide Sequence Number=SeqID_202652
atggttcggtgcttgtttgatcttgcaagagcatatgcccccagtacaattttcattgatgaaattgattctctatgcaatgctaggggggcttctggggagcatgaatcatccagaagggtcaagtctgaacttctagttcaggttgatggtgtaaataatagttccacaaatgaagatggtacccgtaaaatagtaatggttttagcagccactaactgtccatgggacatagatgaggcactgaggagaaggttggaaaagcgtatatacattcctcttccaaattttgagagtcgaaaagagctgatccgtatcaatttgaggactgtagaggcaagttag

SEQ ID NO: 85875 - DNA, 157 bp, Glycine max
  Peptide Sequence Number=SeqID_202653
aaaaagcactgtagaagagttggaagaattggacagcttgctcagcgtgcaacccaggctcagcgtgcaactctcgcttagcgggcaaagccaagctcagcgcaaagttcaaactaagcgtgagaaggccatgaggaaaagcccagggcatgcttag

SEQ ID NO: 85876 - DNA, 171 bp, Glycine max
  Peptide Sequence Number=SeqID_202654
atggccccagaaggactacctacaaagtcctccaatgcagcttcttttggcctaccctttatcaagatacaaatgattatacaccatgaaatgcctcttaataacattcttgtgagcatgccacatagcctcatttccaagtgtgagacaacggtcatttcaaggacttag

SEQ ID NO: 85877 - DNA, 1416 bp, Glycine max
  Peptide Sequence Number=SeqID_202655
gacctcatttgaagggcgagctcttccagatagtacgttaacaaaaccgttttctacttatgaagtattgaagccttatgatgtggatgcagggcctgctataccatggtttggtaaaacaggtatgggtactcagtatgaaacacatgactttattgaagatcttataagtgatggagtggaaggcatcaataacgcatggggcaagctgctgcgcgaaactcatcagcaactgcccggctacgaccagaacctgcgtatgcagggccagtacctggaccgtgaaaccggactgcactacaatctgtttcgttactacgacccggacagtgcccggtttacgcagcaggacccgatagggctggcgggtgggctgaacctgtaccagtatgcgccgaattcgttcagctggatagatcctctggggttgaataggtgtaaacctgatttttatgtcgggccagatggaccaagtgcgacgatgccctcgactgcttatcgttatatgaatagttcagattcatacgctgctaaaacaatggcatctaaatcagcgccattaagttattttggttatacaaaatataaaactggtagtgaggctagggatgcttatcaaattttctatgaaaaaggtaatattaaatcatggagtgatgctcgcctgttgggagaatttgatactttacagctttataagaatggtgttcctcaggttaaagttccgcttgctaatgggggggatgggcctggttatgaattatttacaagtgcttatcctcaatatgggaaaggtggtgctgttcagctactgccaattgagaaaggaactcctgtgattttcaataaagttagcgtgttaccggatcgcccgccgtcaggatcagataaccctgttcaacctgcatggttaacttctgaccgaccccgaacccggccacatgcagccgctactcccggtaaatccaagtggagtacagacagggaaggtcatggctgggcggtcgcgtgggcagggcaaaagcacgcgtccattcctccctatgaccagataggactggcgggtgggctgaacctgtaccagtatgcgccgacttcgctagggtgggtggatccgtggggggtgagaaagtgcagcaacaatggaaataaaagtaagcctgatttttatgttggtcctgatgggcctagtgcaacaatgcgagcgacagcgtatcggtttgtacgatataagaacgatgatggcagcttaaatgcgtggggacaaaagctgctctctgataagagtgctctgttcacctattttggtttcgataaatttaatagtggaaaagcaacaagagatgcttttcaaataaaaggtattgataaagttaatcctcttaatcctgatgatatgtcctggagtgatggtag

SEQ ID NO: 85878 - DNA, 138 bp, Glycine max
  Peptide Sequence Number=SeqID_202656
atgtctagcagaaggtccaggcagcaatctgcatccacaaggatctccgatgaccaaatcatcgacctcgtttcaaagttgcgtcaacttgttcctgagattcgcgataggcgctctgacaagtttcacgtaggttga

SEQ ID NO: 85879 - DNA, 516 bp, Glycine max
  Peptide Sequence Number=SeqID_202657
atggctaagagttcatacgtgagggttagattggctctccaagttgaaactagggaaggcaagactcgccaaagaaaagttcaagtcagcgctacacacatccggaaggagtgcactgagttacgagaggaaaacgcggccactgcaagagcccttgaacaagaaaccaaaagggcccacaaggaggaacatggccgagttaaattccgaggagctttgtggggtagcaacaatgagctcaagctccggagagagttagctgcttgtgcaagatccaagaggagtttggctcaacacttggaagccacggagcaaagcatgctagctatcatagggcagtacaaggaagagttgaaccagtctgtgacccatgaacagaagctggtagaggatttcgcacaagtgtacgccgaaaaggaagcaagagggagggcgattgatgcattgcatcaagaagcgactatgtggatggataggttcgccttgaccttgaatggaagtcaagacctcccgtga

SEQ ID NO: 85880 - DNA, 414 bp, Glycine max
  Peptide Sequence Number=SeqID_202658
atggtagacaccttgccggtgttttactatgagaagttagtgggctacatgccttccagcttcgtggacttggtattcgccagggaaagaattgaagtaggtttgaagagagggaagttcaattacgtctcctccacaagtaccaacgctaggaggatcggagcaactggggcaaaaaggaaggaaagagatacccatgccgtcacttcagcgcctgcatggatcaagccactacagacctcccacggccccccaagctccggctccaaccccgactcgcccgaccggcaacgccaactttggcgccggtttcaacgcgataaggaacttcccctgaggccaactccagagttcaccctgatcccaatgacgtacgaagacctcttgccatccctcatcgccaaccagatggct

SEQ ID NO: 85881 - DNA, 477 bp, Glycine max
  Peptide Sequence Number=SeqID_202659
atggggcgcttttcaaaaaaatttacccaaggggactcttttggacgtaaaacgcatgcatggtgcaagcaaaccgccaatgggactggcgggtttgctgttggtgaaggactcgccactacgagtggcgatatgcacatgcaacctgaagaactcaccattcgaagtggcgacatgcacagcaaggggaaccgccagctaggcgccaggggcacaggccatgcagcaggccatgcaggtgcagcagaaggtgcagtgcagcaggctggaatcgccattctcattggcgggatgcgcttcacgggaatcgccaagctggatggcgagttactttatttcaaatttctccattataaaagaagaaggtggatgtggaactcagcttcgcttgcattgctttcttcttcttcttcatattactctagttcttcatattacttcaatacattgcggttcttcttgttttctttctggtaa

SEQ ID NO: 85882 - DNA, 117 bp, Glycine max
  Peptide Sequence Number=SeqID_202660
atgcatactcaagcactcagcttcctagagaacagactcatcgctcaaacaagtcttgaaagaccacgagcttttagaagatgtgttttgagacttaccggtgatcagagcggttag

SEQ ID NO: 85883 - DNA, 600 bp, Glycine max
  Peptide Sequence Number=SeqID_202661
atggaatacgcacgggaagacgtacttaaatccattgaagagaacccctctgctgcctttgggcacctgaattttttgaaaaaattgcacaacccccttacctctgatgagattctaggcaaagttatccaaatcgaggccatcatcgatcagtttgcaagtaccgtgcagaaaaaacgtgaaaatagcgccagactggatgcccagaaacaggcacatatccttctgctcgagaaagcccgagttgctcaacatgaagtcgaacgtctcaccaaagaggcgaaagaaggatcttctgagatcaaagcctgcgatgataacatctcttcctgggaggccactattacaaatttgctgtctcaggtcgatgatctaaggcagagaattgtaacagagcaagccaaatgccaagaactccaggagaaggccgctaattcgattcagaagctggttgctgaaaaagggagggaaggcctgaaggcctttagcgcatctcaagttgtagcagatgaggcgagagctatggagagtgctgaccaggtcttaactaaagagatggccaccttgaagaaactatatgaggacttggtcatgcattag

SEQ ID NO: 85884 - DNA, 172 bp, Glycine max
  Peptide Sequence Number=SeqID_202662
atgagggtatggttgaaaggtagtgatggtgactacaaggagataaccatggagagtcatgcattggagttgtctaattatgcgattgctaacagttataaggtggagttgtttgtgaaatgtgctggtggtaatgagggggtcgtggatgaaaatttttatgaagacaata

SEQ ID NO: 85885 - DNA, 294 bp, Glycine max
  Peptide Sequence Number=SeqID_202663
atgtcgcagaggagcaatgcatcatcatctcgaacaagagtttcatcacaagttgttcttttttgtggttgtggtagaagggctgttaggcgtgttgctggaacaaatattaaaagaggaaggacgtttttcacttgttcaattcataaggatgaagttggatattgtgcgtactttatttgggttgatcaattgattgaagcacttggagttgataattcacttggaacattttccatggaacaaagaagacaatttggaagagaggaagataagacaatgtggaaggctcaa

SEQ ID NO: 85886 - DNA, 138 bp, Glycine max
  Peptide Sequence Number=SeqID_202664
atggaggtttcaatctcttctccgtctctgacgtttgagaattctatcggaacagtcgaaggaataatgaaagaatttccgggaaccactagagatgttgctatttggctgaagacacgtgagtccgctcagagataa

SEQ ID NO: 85887 - DNA, 213 bp, Glycine max
  Peptide Sequence Number=SeqID_202665
atggggatcaccacggctttcgaagaagttacgaaaattcacagattgcgaaaaatacctcctttcgatttccgtcacatcacggaattttcacggatcgcgcaagcctgcttccttttgatttctgacacgtctcgggacttcatttattgtgcaacaaaggatgccaagtatctcaaagcggctaaccagaggttgcatgttatcaagtaa

SEQ ID NO: 85888 - DNA, 171 bp, Glycine max
  Peptide Sequence Number=SeqID_202666
atggtcatagaagttgtctgcagtggaaactacaaagttgatatcaagcttctctccaacctttcccattggcaagttaacaaaaaggacatggacatggctctaactggaactggaacaccaaaacaagcgaaagcttctgactttagaaaaaaccttcagattacatag

SEQ ID NO: 85889 - DNA, 627 bp, Glycine max
  Peptide Sequence Number=SeqID_202667
atggatatgaggagaaatggttgctcaacatcatggtcattgatacacgtggtgcacaagataagaaagcctgcactcaatgacaacttacaatgcaagcaaatagagggttttcaaggttcaaggagaatggtttccttaagatacaaaattagttgggttgattggaacatataccaaataccagttaaggtttacatacttgattccaccgacaaagtgaggtcaaatggttccaaaatacttcatgattgtctggcagagtataccattccagctggtggtggtggtgattctcctcatgtccaaaaagcaaacatcccaatggaaaatggaggttatctaatttatggcactgctcatatgcattcaggtgttgtaaatgcaactttatatggacaggatggaaggactttatgtacatcaacaccaaaatatggaacgggaaaaaaggctggaaatgagaaaggttatctcattggaatgtctgtttgttatccacaaccgggttcaatcaagattcatgatggtgaaattttgactctagaatctagatataaaaatgagtttcgtactggagctatgggacatttctacatctatttggcagaggaactaccacaatga

SEQ ID NO: 85890 - DNA, 180 bp, Glycine max
  Peptide Sequence Number=SeqID_202668
atgacgtcgtcgttggggacgccgcactgcttcgcgatcgcttctgccatggcgccggcaccgacgctgattctctccgaaacgtcgtcgtcgacagcgagggagatagctgtgttctttcactctgccgccaccgtgggaggaggaggaggaggaggaggaggaggaggagtaccctag

SEQ ID NO: 85891 - DNA, 666 bp, Glycine max
  Peptide Sequence Number=SeqID_202669
atggccaacccaatctctgagactgaaatccccgacgaaacccttagccccaacgccatccccgatcctaaccaagaccaagattctaccatgcaagccccgatccccaccatcctcactgtcatcgacgacgaccccgagcccgactcctccaccggcgctgcgacttgcggcggcggcaccaccaccagacgcacgacgaagcggaagaaaggcccgaagagaaccgcgctagagagaaggtctcgcaagaagctccaggtaatcgtcacaaccctaaatcccattcctttcacaccagcaaaaaccctcgatttcgagaggcaccagagtctcttacggcggctggggctctggtacttcgtccacgtcgagtttgattcggcgctccgcggcgatctcctcgctcagctcatcacgagctacgtccccaccaatcggtgcagctacgtcaacggggttaggatcaatgtgaaccgcgccgatctaggccgcaccttgaagcttccggtgaagaagactggttgcggtggtggtgccaccgcagattcgatagactccgcggaatctatagcgtttgctgaggaggtggtgtatagttggatgcttctgcatgatggatatattaggaagccaaacttggaatcgctgcacacatacaactga

SEQ ID NO: 85892 - DNA, 381 bp, Glycine max
  Peptide Sequence Number=SeqID_202670
atgatgctaggcctaagccacccaagaataatcatacaaaaaaagcttcgaattcagtcctccattctctttcctacacttcccctcctccaaagaaaaaatgaactacccttccttccatcttcttcctctgcgctcatttgtttgcaccaccacaatggcatggccttcctccacccacaaacttctctcttctggggaaaaactaatacaaggtggcgggatatgctgtctgtggcggcactcgtcaagaaccagataaagcccattttccccttcaacaacttctaccaccaccaccagacaccatcactgctacctccgagcgtcacctccctccctccgcctcctcctctttcctgcgggttcaatcaaatataa

SEQ ID NO: 85893 - DNA, 1170 bp, Glycine max
  Peptide Sequence Number=SeqID_202671
atgcttgcaaacaacttggaaaacttccttttcaggcttaaatttcaacatgaagttaattcgaaagatcaacctagtatgctatcaaaattaagagcttgtaaggcttgccaagattggaagccacctagagatgccccaaaaagtgtaaacttccatgaggagtaccacaaggctctaaggacaaaatcctacgttgatttctttgacaaagctcaattacttgcaaaccagccttctatttattccaatcacaataaattctcagaaatcctccttgaaccaggccaagaaactatacattccgttattgatcatatttcaaagacaccagaactaaacaatctcatgctcagttactttgacatcagtgctgaggcttctttcatttgcagccatcttctccaaagcatcaaccaagtccagtgcaattaccaattcattgaaagagctctaggtatcatggatgatgatgattctcttgaaaaattcaaactaatcagttttgagctaaactcattcatcttctcaaaaaacccactttcaaaccttaacattaatcatgacttattcaagctcattagtgatgagaactcatcagtgttgttgcatcgtttgaaatcaatgagaaagaagttgggaaggaaagttaagctaatgacatatttgaagaaaacatcagaaatttgtgttgcaatgtatgacttagtggctatcactgccaatgttacagaagcacatactttaagcacactaatcatggggccaacaattctcaactttccatgcaagagtcttaataagagagagcttccacacttgaggttttcaagaagaatgtttcttagtaatgtttgtgatcagcttgatatagcagccaagggaacttatatattgaataaagactttgatacaatgactagagttgtggctcggctttatgatgaaattgaacataaaaggacaatggtgcaattctttttggacaagaaggatgataaattctctttgcaaatggtgaaggagcttaagaaaagtggtgatgggtttaggaaacaagtggaagaacttaaagagcatgtgtacttgtgccttgtgacaattaaccaagcaagatgtttggttactgaggaaatgacaaaaatgtgtacagaaggcattggagtgtag

SEQ ID NO: 85894 - DNA, 210 bp, Glycine max
  Peptide Sequence Number=SeqID_202672
atgggagttttccgggtccaaagcacaagtaagacgttttggaaagttgaacaatgggataatgcacttaacaagactacattcaacatgacgcctcctgaacctatgtgccaaaaacacttcatgccatctgtaccaaaaggtcagcgatgcaaatctgattatatctgtggtacaataagaataatcaagaaaggaagtaaaacataa

SEQ ID NO: 85895 - DNA, 321 bp, Glycine max
  Peptide Sequence Number=SeqID_202673
atggtgatgaacttcttcttgactcatcttctccttgaagtagcgtctccaatcatctttcttccttcttcattccactgtcattcatcttcaagaagaaaggactccattcatgaagaagatccaaggcctaatggctccacatggagctaccttctgaaagagttcccaaaagatttggtttctctcaagagagcacgtgtcatatgcttctacatgggtctgcctggtctttattcatctcttattcaaaagcacagactccaacacaaacaccagacacgacatcgacacagacaccgtgacatggctaaattctaa

SEQ ID NO: 85896 - DNA, 306 bp, Glycine max
  Peptide Sequence Number=SeqID_202674
atgcggccacagctgtcaccctcacagcatgaaagattgcttgcatgtgcggctggtggtggtgccgccgccgccgccagtcgcagcgccggtggaggcgtcgggctcggggtcgtcgtcgagcatatccccgccaccttgatggtggaggaaggccatgccattgtggtgagcgttgatcggatccatgatcgcagaggaagaggaagaagagaatggagatggagaatgaagggtggttcattttttctttggaggaggggaagtgtaggaaagagaagatggatagaagggtttttagaatga

SEQ ID NO: 85897 - DNA, 171 bp, Glycine max
  Peptide Sequence Number=SeqID_202675
atggtggaacctattgtagttgacgaggagtatcgcaaggaaagagaaatggctcgacgagaacttggcgttttcatcaccaacaataaattactgctttcatgtggaatgatgctgcaacctacgatgccaagagcagaagaggaggccccaactgttctatcagattaa

SEQ ID NO: 85898 - DNA, 180 bp, Glycine max
  Peptide Sequence Number=SeqID_202676
gcagaatttcaaatccttgaagcttttgacagtaggacaaagaagagaattcttcagattgtcggcgagaggtggaggcagtttaaatcagacttgaccaagaaatgggcccttgtagccgaccaggacggtgtcgatgacactgtctgtgaaaaatacggcattagcaaggagaaatga

SEQ ID NO: 85899 - DNA, 240 bp, Glycine max
  Peptide Sequence Number=SeqID_202677
atggcccgcacgaagaaaactgggcagatgatgtctgaggcagcaaaagaaatcgctgacaagatcggatcgttcgtcccccatggacatcaggaagtcttgactgctgccattgggcgagcagagcaccctggccgtgtccgtgctgctggaatcggtattaccataaagaaatattttggatcggctccacgaatgtcctgcaactcttcctccctgcctcctgaagacctacaatag

SEQ ID NO: 85900 - DNA, 402 bp, Glycine max
  Peptide Sequence Number=SeqID_202678
atgaatattacttatcacgaagcaacaaaagcgttaaacgaatcaattaaaaaagcagaaacacttggtattcccgtaagcatcgccgttgtagataccggaggacatctggtttcttttgcccgcttagatagtgtatacggagtgatagattttgctataaaaaaagcaagaacggccgttatgttcggagtagacacggaggtaatgggaaccatcattgctggcacagacattcacggatatggcatgctgaattcaaacggcggtctccttacaattgcaggcggcgtagtcatcaggaatgaaaaagggaatataataggtgctatcgcgtcttcgggaggtactgtggagcaggatagagaaatagcacttgaaggagcctcttctattttttaa

SEQ ID NO: 85901 - DNA, 789 bp, Glycine max
  Peptide Sequence Number=SeqID_202679
atgagtaagacgattttaattacaggagcagcaagcggatttggaaaaatagccgctttcgatttagcaagaaaaggacaccatgtaattgctacaacacaggtatacccccagatgagcgacatgatccgtgaagccaaagagcaaggggtagaaatgactgttgataaactggatgttaccaattcaagagatatcgcttatatcttaaaaaaatatgatattgatattttaataagcaacgccggtattatggaaggcggacctattgctgaacagcctttggatcttatccgttcaatgtttgaggtgaatgtattcggggctttggaactcgctcagggattcattaaaaaattcgttcaaaagaaaagcggaaaaatagtatttacctcttctatgggtggtttgtggacggttccgtacgtggcagcatactgcgcatcaaaacatgctctggaagctatagctgagggcttaaagacagaactggctccttttaacatcaaaattgcgacatgcaatccgggagtattcggaaccggttttaacgacaggggagtggattccataagacattggtatgatcctaaagaaaacttcactccggaatctgcttttgcaggagctgaagaatcgttagcccatcaactggatcctcaatctatggcagatgttattgtaaatgttacgttggatgaccatagcaacttcagaaatttacatccaaaggaaaccgaggattttgtaaaacaattacaaacagaagcctggagcgcaaagagctaa

SEQ ID NO: 85902 - DNA, 638 bp, Glycine max
  Peptide Sequence Number=SeqID_202680
cctccaccgttgaatccccaaccccaaaacgacgcggccgcaagaagaaacccgaaacacaaacaccaccctcaaacgacactcctcccccccaagacgcagacccgaaaaaagaagaagacgaagtgtacgactacgacgacggcgtggacttcccctactcggaccctcccttgatatgctgcttcggcgcggcacggagggagttcatcccggcggtgcgggtgcaggactacccgatgcacccggacatctactccgagtggaagatgctgcagtggaagccccccgagttcgcacgcgcgccgggtggcccgccgtccaacgtggcggtggcacacactcgtctcggggggcgggcggccttcctggggaaggtcggggacgacgatttcggagaagagatggtgctgatgatgaacgaggagagggtgcagacgagaggagtgaggattgatcccgggcgcaggacggggtgcgcgtacatgaaggttaggtttgaggaggggaggatgaagatggagacggttagggaggccgcagaggattcgcttcttgcaactgaactcaaccttgccgttttgaaagaggtttttgtcggtttaattactcgtttggttgtttctatacatgcataa

SEQ ID NO: 85903 - DNA, 393 bp, Glycine max
  Peptide Sequence Number=SeqID_202681
atgaagaaaggcgtaggtcacatcttagacctcactcctaaaggagagaaaaggaaagaaagcctcaagagctctcactcttatccaaagaaagacaaaggtcaaggtttcttagaggcggcaccttctaagcccaaagatgataaggggaagacaatagaaaagcaaccccctaaggctagtatgcaagagaagacaagctctataaagtgctttaaatgtcttggaagaggacacattacttctcaatgccccaccaagaaaaccatgattatgaggggccaagacatttatagtagccaagatgaggctactacttcaccttcctctagtgaaagtgaagaagaaaaagggaaagaatttagtgtagaaatctacccccaaaaagaatga

SEQ ID NO: 85904 - DNA, 204 bp, Glycine max
  Peptide Sequence Number=SeqID_202682
atggctgccattgattttgatgatgccaaaggagaatcaaacaaggttgattcaacaagcattcaaaggttaagcattgctttaagattaatacaaggttgcttcaacaaacattcaaaggttaagcattgcttcaagattaattcaaggtcaagcacacaagatcaagaaaaagataaggcctcaaacaatctcattggttga

SEQ ID NO: 85905 - DNA, 918 bp, Glycine max
  Peptide Sequence Number=SeqID_202683
atggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttctgatacaggtgtgggaaatgaaaaatctcaggagggatgtagctgctattggggatgtcatcgagtcagacgatgacacagaggaccgccgacgattggaccgggctcgagtattggtgcggacaccgcttccgccgttgataaggtcggaggtcatcgtccgtgtgggggagcttgagtatcgggtatggattgtggaagagacagggttcgaaggtgggtcgaaccggaaaggaagctcgccgtccgatgggtggtcggagatgataacatcggacgacgaaggggaggttggtgatgttcttgacgacactaataccaatttctccttctcgccggagctgcccaaccagaaattgtctccgtctcgtacccaacgggcagaaggagggaccgatgtgcgctgttgtgatcttagacccctgggtaatatccaggcagacgttacacccaaagaaaagtcaaaaggcactgtagaaggtatgctgggctctagctttggtaagctcaacctaggggacagcttcgcaggaacagaagaggaagctgctaacaccaaagaggtaacctgctataataccctacaggatgatcgaaggcacaggaatcacatagagggaaagtatttgaatggtggagcgaaagtagctgctgaccagacctttatcggggaagaagagggacat

SEQ ID NO: 85906 - DNA, 213 bp, Glycine max
  Peptide Sequence Number=SeqID_202684
atgactagaaagaggatacagatcaagaaaatcgacaacatcagttccaggcaagtgactttctccaagagaaggaaagggcttttcaagaaggctcaggaattgtcaaccctttgtgatgcagacatagctctcattgttttttctgcaactagcaagctctttgagtatgccagttcaaggagttcaggagagagtcatggatttttctga

SEQ ID NO: 85907 - DNA, 272 bp, Glycine max
  Peptide Sequence Number=SeqID_202685
cgatgcggatgaggcgccactcgatgtttccatttgcctgcatgcctttggtattgtggggtttggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactctta

SEQ ID NO: 85908 - DNA, 492 bp, Glycine max
  misc_feature (227)..(227): n is a, c, g, or t
  misc_feature (436)..(436): n is a, c, g, or t
  Peptide Sequence Number=SeqID_202686
atggtgatgccaagtttgcggggctgcttggttagccattgcttaagtttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccnccgtgatcagttttgttgccaggattttgccaactttggcttgcgccccggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgnctcacgagggtcaccaacggcacgtgcctttggggggccgatgccccctactgctg

SEQ ID NO: 85909 - DNA, 1685 bp, Glycine max
  Peptide Sequence Number=SeqID_202687
atgaagaagttttctctttatgcttgtatgctcaatttgagtatcttgattcttcttccctatagcaaagccagtcaggctgataaacttcaggagttgattctgtctaagagctcacagaagcctccagtgaccctttcatgggcagaggaagacgcagtgaaaactccttctcctgcttatgttgcaccccaagagggtcaaaaggaagctgacagaattgtggcactgcctggccagccctatggtgtgaattttgaccaatattcaggctatgtcactgttgatccaaaggctggaagagcacttttctattattttgtggagtctccatataacccttcaacaaaacctttagtattgtggctaaatggaggacctggttgttcctcattggggtacggtgcctttgaggaattgggacctttcagaataaactctgatggtgaaacactctatcgtaacaaatatgcttggaatgaagtggcaaatgtgctgttcttggaatcccctgctggagtgggcttttcctactccaacactacttctgactatggtcattcaggagataagtctactgcaaaagatgcatatgttttcctgatcaattggctagagagatttccagagtacaaaacccgcgatttttacataactggagagagctatgctggacattatgtgcctcagcttgcatacactattctggtgaacaataaattcagtcaacaaaagattaaactcaaaggcattgctgtatgttctaagactcttactgaaaattatgcctatgtgatacgataccacttaccatctcatctttctaacttcttgatttgtactgatgaaaattttcagatagggaatgcttggattgatgatgttgcaagtataaaggggatatatgattacatatggactcatgctttgagctcagatcaaacacatgagctgattgagaagtactgcgatgtcacttctgaaaacgtttcagctatgtgtgtcaatgcaacaagaacggctgctattgagatcggaaacattgacgattataacatctatgcaccactgtgtcacgattcttctctcaaaaatggatctgctggctctgtctatgattttgacccgtgttctgattactacggggaagcctatctaaatagaccagaggtgcaactagctcttcatgcaaaacccacaaactgggcacattgcagtggtgatactgattcagtggttccagtcacatcttccagatattcaatcaacaccctcaagctccctatccaggttccttggcgtccatggtattctggaaatgagtcaattgctgaatacaatgtgattgtgagaagttcttcttggaagatgtggatcttccttgctaatcagttgtgtttagcttgcaacgatttcaatttgttgtttatcctgattaactatggttgcaccacgttagctctttggagtcaagctaagcagcttgtgaatgggattcccttgccactagatcttggatccaacattgatgatgtaaaagtgaaagtcaccacggctgctgattctctctccaagaaggctaaagaaaattcaaggatgatacacaaagtcatagatggagtgagactggctcttgttactgttgctgttgttatgatctttgttgcatttctcggattgtgtat

SEQ ID NO: 85910 - DNA, 162 bp, Glycine max
  Peptide Sequence Number=SeqID_202688
tgcactaagcacaacaggtgtcttcagccaagctcagcgcatgattggtgctaagctcaaacccacttactcggcacaaaattccacagcacaccatagtgcctatttcgggaaaagagctctggaggtagcaagaggagcagcttttgcagagatacctag

SEQ ID NO: 85911 - DNA, 831 bp, Glycine max
  Peptide Sequence Number=SeqID_202689
atggcatatacatcacatatcctggatcaagtaaagactctgggattccgtcaagctacggatacatccatttcattaggaattgatgaccttttaacaataccttctaaaggatggctagtccaagatgctgaacaacaaagttttattttggaacaacatcatcattatgggaatgtacatgcagtagaaaaattacgccaatccattgagatatggtatgctacaagtgaatattttcgacaagaaatgaatcctaattttaggatgaccgacccctttaatccagtccatataatgtccttttcgggagctagaggaaatgcgtctcaagtacaccaattagtggatactgctgtacgaacatcagatgctggatatcttacacgcagacttgttgaagtggttcaacacattgttgtacgtcgaacggattgtggtaccattcaaggaatttcggtgaatacccagaatggaatgatgccggaaagaatatggatacaaacattaattggtcgtgtattagcagacgatatatacagaggttcacgatgcattgccgttagaaatcaagatattggaattggacttatcaatcgatttaaaacccttcaaacccaaccaatatctatccgaactccctttacctgtaggaatacatcttggatctgtcgattgtgttatggccaaagtcctactcatggtcacttggtggaattaggagaagctgtaggtattattgcgggccaatccattggagaaccgggcactcaactaacattaagaacttttcatactggcggagtcttcactggaggtactgcagaacag

SEQ ID NO: 85912 - DNA, 300 bp, Glycine max
  Peptide Sequence Number=SeqID_202690
atgaatttattgcctagcgctgttcatgtgtcctccaccatcgagtctggagccccgcgaatttatttcctagtgttgttcgccaattctccattctccatatttattcggagacccatgaattcattgcctagcgcagttcatgtgtcctccaccaacgagtctgaagccccgcgaatttattgcctcgcgctgttcgccaattctccattctccacttttatccggagccccatgaatttattgcctagcgctgttcatgcatcctccgttatcaagcgcggagccttcgatgactag

SEQ ID NO: 85913 - DNA, 942 bp, Glycine max
  Peptide Sequence Number=SeqID_202691
atgcgcgccaaaacgaatcgcaagtcaaagaaccgagtcgcgattcctccaccggcgaaatcggaatccatcatcgagacctaccgtcgcgacctgcaggagttcggcaccggtttgaagaaggagattgaggtcgctcaccgctccctcgagacggtgggccacgtcatcgaccaattcggaaacaccgtcgccaaaggcaccgctcacatcacatcatatctcgattccgataataataataacagaaacaaccccggcaccaaagaaaaaaagagcttcatttcgaagcgctatagtaggtttgactcacaggttcgtgcaattcagagtgacgttagcacttacaccgaagtgccggaggattcggatgagtataatgagtggaaatcgagagtttacaggctcaagaaagctgaggatgtgagggcgaggctcgtgaggagaatgtcgagggacgaggaggagttgagttgggatgttgaagaagaagatgagaataagggaaaagaaggagattctgtgttgcatggggatggaacaaatagattgaatgtggaagagatgcataagtctgctgaggaggggtctaaggaagaaaagagaggtgatttattgcaaagcaagggagatgagtctgttgaagaatcaaaggctggcaagaacaaagagattgtgataatggaaagtaaattaaatgatggaaaagattcattggttgcaaataagcactcgaagaatgagaaggaggaggaggaggaccttgagtgggatgagatagaggatcttagtagaattgatgaagagaaggcaactcggatgggtagccataccaaagttgatttgcggaagcgccgcctcagtgctgctcaagagcaagaagaagaagacttgagtagggaaattgaagaagatgatgagcctgctaatgctaaggcatga

SEQ ID NO: 85914 - DNA, 195 bp, Glycine max
  Peptide Sequence Number=SeqID_202692
atgtggtacgagggttgtgcaagcgatgtggtggaaagattcaagaggactggacagagagtaaaagaaccaatggttctatttccttctatgagaagagattcactagagtgtagtgggcagagatcgaagaacctaggagaattagagagtggtgactacccagtatttggtgcactcatttggcgcgaataa

SEQ ID NO: 85915 - DNA, 294 bp, Glycine max
  Peptide Sequence Number=SeqID_202693
atggaggtcaatcttgatgcttgtttgttggctctagaagtggagcttcaatctgaatacatggagattctgaagcataaggaattatttggttccaaaaatcaggagagaattggattagatctatttcccaagcttagtgaagatgcaagattggctttaactgccactactggaaaaagtgttttccacgacgattttgcgacctattcaaagacggttttgaactgttttagaagccaacatcatggaaagtcaagactttctacaatggttcttaaaaaaccgtcttaa

SEQ ID NO: 85916 - DNA, 1606 bp, Glycine max
  Peptide Sequence Number=SeqID_202694
atggcggctgtcccagcatcgcggaccgatccaccaccggcaatggtgcagccgccgctgctcgtctctgaccccttcgccaaggacgccattctcgcctggttccacggcgagttcgccgccgccaacgccatcatcgacgccctctgcggccacctcgcgcatctcgccgccgcatcctcagactacgacgccgctttcgccgccatccaccgccgccgcctcaactggatccccgtcatccagatgcagaagtatcattccatcgccgacgtcactctcgagctccgcagagtcgccgagaagaaaagcgagcacgaagcagcgaaaaaaagcgagagcagcttcgaagaggaagggaaattggagaaggaaacggcggaaaacggcggaaacgacggtgatgacgatgccgcgccggagtatgattcgccggacagtgaaattaccgattcaggatctcaggaaatgcaacccagtgtgatgaacaacaacatatgttctaatcatgaagaatgcgaaggacgttcttcacagataaagctgacaaaaggtttcacagcaaaggagtccgtgaaggggcatatggcaagttcttttgtttacaacttcaatagtcaatacgtgaatgttgtgaaaggattaaagttgtatgaggatgttttctctgaatcagaaatctgcaagctgactgattttgtgaaggagattcatgctgctgcccagaacggggagctctcaggcaatatagaaccgattccagcacttcttcatgatgtcattgatcaccttattcaatggaaattaattccagagtacaaaaggccaaatggttgtatcatcaacttttttgaagagggggaattttctcagccattcctgaaaccaccgcatttggaccaacctctatccacacttcttctgtctgaatcaactatggcttttgggcgtatccttatgagtgaaaatgatgggaactacaagggtccactcatgctctcattgaaggagggggcgagccctggtgcagcggtaaagttgtgccttggtgacttgttggtcatgggttcgaatccggaaacagcctctttgcatatgcaaggggtgagcattaccttctttagagtgaggccagactccaatcaatgccaatcaccaactcccaccatgacaactgcgatgactctttggcaacctagcattgctagcccatttactttgccaaacggacctctaagtggctatgaggctatgaatatgatgccccagttgggaatacttagtgctccaatggtcatgggtcagccagaaaacatgcaaggcatcttccaccgcgtgctcaaaaaggacgccttatggaattaccctccccagttgaatcacacacgggagagtccatttctgaacccagcattgctgttgaaggataggtatgatttctgtctcaaagctgtcatgggtttaaagagatgtgaatcaagaaaacgtggcttccatgcctcgtctgactgtctactggctgttgaggctgctacaagacagatgagtattagaaagtggttcaggacatcgaaagcattattaacaggagaatgggagggggaag

SEQ ID NO: 85917 - DNA, 249 bp, Glycine max
  Peptide Sequence Number=SeqID_202695
atgggggtgcaaatagaaaccaggcctacttgggccttcaggaagttcctccagaagggggtgccttctggaggaggcaacctagctcgcatgggcgagctgggttgcaagcttcttcctcttttccctataaatagagggaggagggaagaacaaaaacgttcaaccctcctggtatctgaggatgccttgaaattagtgagaaaaatcatttccatgaagaaaatccgagccgaggcgcttccgtaa

SEQ ID NO: 85918 - DNA, 264 bp, Glycine max
  Peptide Sequence Number=SeqID_202696
atggcttctaatttgaagagtaaaaccgcgaagagtacagaagaattgtgtcttaagttctctgttttagatatgcttcaaaacagagaaaacacgtgttgtttttgcttaaatttggttctcgctgaaattgcaaattgctcatattcaatcgcgagtttgtatgattctaaccaagcctgcatgagtttgaacaagcttacgctaaaacaatgtgactcgatggaggagggtatgacaagcacaggctgccaacccaagtag

SEQ ID NO: 85919 - DNA, 869 bp, Glycine max
  Peptide Sequence Number=SeqID_202697
aactgtggcaattataatggaagaagtggtggaagtaaaggtgagtggtagaccgagagagactcagagctctccggggatttcaactcccaaaagcccatttgcaactcgttttatgagcacccctttagccagccccatgaagaaggccattgaaaacatgcaaggttacttgggagaagttggtcgcttcaccaagcttgacccacaagatgattggcttcccatcaccgagtcaaggaagggaaacgcatactacgctgcgtttcacgttctttcttcagggattggatttcaggctcttgttcttccattagccttcaccagtcttggctggactaatcagcaaaatgtggcaacaagtgctcaacattcaaaagccataagagccattcatcgcatcaaacactattaccaagaacctaggcctgccaccgctcattcaaattctccatcattaacccccaatctccctcaaaatatgatgaaggctaagaatacaaaaggtgaaggagaaatccccatcaagtttgataactcaatccccatatccactccaagggtgcatgtccaggtatcaaaagttgcttcacctcaagttggaatatctgccaagattgaacctgaacctgaaccatggcatgttcaaggatcaagagttggtttattcaaagatgaacataataatggcaaagatacaatcacaggccctttgaaggaacagcatggtcttggaatgcaacaaggtaagaaaacactagatatcaatgacactttcactgattacattgaacgtgctaggcacagaatcagaaccgtgtcaaatgttggtagggggcagagccactctgcgccagatgaaactagtg

SEQ ID NO: 85920 - DNA, 414 bp, Glycine max
  Peptide Sequence Number=SeqID_202698
atgcaagaaggccctatgatgattttgggtggagtctgttgctgtttgggtgctgctctatactttttcgggagaagcaatggcagatatgcacaactgttagatgctgttaaatcgcccttgggagaacaacattttcttaaacaggaaaaggttactatttacgaagaaaaaagggaaaagaaaaaggttactcgtggctggacaccagattatgtttcaacatcatccaacagtaaagaagttccttggtatctggaagatgaatctagccgtgtgcatgtgattggagctcggaacgccatgcattttgaattacctgttcgaagggaggtttttggtgtcaacaaaactgagtgggtatatacttccaataggcaccttcttgactgttgttggaaaggtatgtcatag

SEQ ID NO: 85921 - DNA, 911 bp, Glycine max
  Peptide Sequence Number=SeqID_202699
caaactgctcaaatgcagttcttcttggctttggcattgttgaccaatgcactaagcgtgatgaaattataaatttactaatgtctgagactgccgaagcagggatagatggagcaaatttatctttgttatcagacttgatgaaattgcagttgtcaggcattgatgaaactcagcaaccattgtcatctcttatctacccaactagcaaattcaacatcctgaagcctttgctgtattttgttcaaggttcagccctttcatcaaagatcacggttcatccagatggtcaaatgacatttatgggtactgcaattgagttgaaagatcttctctctgtagttgccgagtcatacttatcaaaatgctcacgaaagggtgaaaagcaatctatgcttgttccacacttcagttgtcctgagaaagtcaaactcaagccatcaccaagaaagaacaagaaagtaggcagggaaagggatctctacaagaactcttcacatgcttgtgagacccttctgtccctgatggttgacaagaagcaacgtcgtaaaacagcaattctctcactgaagaaatccgggcctgagcttccggagctcctgacacaattttctgctggcattgccggtaccggccttgcagtcctgctatctgtgatgtgtaacctagcttgtggaagggctaccttttgtgcttatagcttgttcaacacagggtttggatttgggttggtttggctttctggggctgtaaataagctaagggccacgattgtcaacatcagcaagaatgccggaaaccttgctagcagtggtagtgctaaggcttgcttgagtaacatctccaatgatgtagttatttctggctggttggatgttacagtgatggcttttggagaagcagatagttag

SEQ ID NO: 85922 - DNA, 450 bp, Glycine max
  Peptide Sequence Number=SeqID_202700
atggggaatagaaactcatcatcaaagtcaaaggttcatggccaggtaacaagggctgcttcatctgaacctggctatgactttgactatgatccaattatggggatgcctgttactaaattcagagatgaatacataggaaaatccaagggagagaccccaggaaaattgaagggtactgggatgtactcatatcaacaaggtaatgccgcacttgatagcgatgaaactttcaacagtttcattcgacgtgccaagtgtaaaattagaaccgtgtcccacatcgatcgcgagcagagcaacgttgcacctgcaacgccaccagtgtacgaggccaatgccatggataaccaaaacgaccagttttcaaattttattcagagtactaagaagaagttgagaacaacatcaagcatgagaaagaatggttccttcaataacggctattga

SEQ ID NO: 85923 - DNA, 432 bp, Glycine max
  Peptide Sequence Number=SeqID_202701
atggggaatacaagctcatcaaattcaaaggttcatggccaggtaacaagggttgcttcaactgaacctggctatgacccaagaatgcgtatgcccgttgctaaattcagagatgaatacataggcaagtccacggcagagattagaggcactttgaagggacaacatggttctggggtgtactcagataacaccccacttgataacgatgaaactttcaacagtttcattcgacatgccaagtataaaattagaaccgtgtcccacatcggtagggagcatagcaacgttgcatctgcatcactaccagatgaggaggctaatgcaagggataaccaaaatgaccagttttcaaattttattcagagtgctaagaacaagttgagagctacatcaagcatgagaaagaatggtaccttcaagagaggctaa

SEQ ID NO: 85924 - DNA, 333 bp, Glycine max
  Peptide Sequence Number=SeqID_202702
atgatggaaagggagatgataatcgtgatggtagacacattaccagtattttactatgaaaagatggtgggctacacagcttcaagctttgctgattttgttttcgccgacgaaaggatcaaagtgggtctaaaaagaggcaaatttaatcatcttgcttggacgaatgagaaaactggggcaaatgaagagggtgagaatgaaggagaaacccatgctgcgactatcattcctacatggaaactcccccaccagctcaacaacatcattactcagccaatatcagcccttctcattacccaccacccagtcatccacaaaggccatccctaa

SEQ ID NO: 85925 - DNA, 186 bp, Glycine max
  Peptide Sequence Number=SeqID_202703
atgggacaccttagtgatcaaagggttcccacgaaccctaagagaataaagatcattcctgagtggcccactccaccaagtgttgagggaagaagcccagagtttcaagaacctctagatttgaggtcaaatccttttcaagggggaaggaatgatgtaatcctaccctcaaagggcattggatag

SEQ ID NO: 85926 - DNA, 372 bp, Glycine max
  Peptide Sequence Number=SeqID_202704
atgtctatcatggttgttggggaaggattggacctttctggaggggttttgcatttgaggctaggccgtatgctaaccattagtgaaagagaggtcgaggggcaagttttaccactgccccatggtgggctcccgatttggcacgttggactgagagtaccgtttgttaggaggacaagaggggggacctacaagacaaaggactctgatgctcaagtattagagataacccattggcccaatagcctggctgctaagggcaatgcgtccatgttcctgttccaaggctggcatagagggctaacatgtgtattggagtggcatgtcatttgctacatgtattttgtggaccacggacaatgcagattgtga

SEQ ID NO: 85927 - DNA, 918 bp, Glycine max
  Peptide Sequence Number=SeqID_202705
atgattgtcttttctttgttctttaagttactgtcactggccgtgttatttaccggacagacttttatggtttgtatgattgtgatgctgacaaatggtctggcgtcatcttttttctcaaccgcatctaaaatatatgtccgcgcaacatcgaaaaatatcagcgaaagcttctctgcgaggatgacactcagtaacgccggggccgctatctctccaatggttatcagcgcattggtatttttcgccgtgccgtttcgcccagccctgctcattctaatcgctttatttactatgggtgtgctggtcgccactggcctcaaaccgtgccagcgggttgccaccccggaggtaagcgcaacaggattgaccggtctgttcagtaaggaaaccgcgacggttgccacactgagcattgttttcgccatgctttattacacatttgaaacaatcgttcccctggagttggtacaaagcgatctgaaaagcctgattgggccagtaatgctgtttaatactggcgtgattattctgggtcaaatacctgtctataaatatttcacggaaaaatttggcgtggtaaatgcgctgttaattgccacagcgctctgcattgtgctgtttatcccgtggttcctgcagtgggctaaactgagcgggctgctgcttatcgtcgtgggcgtcacgtttctggagatgttttacggtgcggggatcgatacggtgattgcatctgccgactcggacaaaaaaattgcccttctggatggtgtatcaagtgtggcactttctgccggggccgcattggctgcagcaatttatggcgacccggttatgtttatcccattcgtcatgacactgtttgtactgagcttcttttttgttcgaggcgagaaaactggcctgatcaggccatga

SEQ ID NO: 85928 - DNA, 653 bp, Glycine max
  Peptide Sequence Number=SeqID_202706
aggacaacacgttctcgcctttagaagactacatgtcctcgccatcagaggactacacgtcctcgccattagagggctacaagccctcgcgtacagaggactacacgtcctcctcgctttcagaggactacacgtcttctccttcagaggactacacgtcctcgccttcagagggctacacgccctcgccttcagaggactacacgtccttgccttcagagggctacacgccctcaccttcaggggactacacgtcctcaccttcagagggctgcacgccctccccatcagaggactacacatcctcgccatcagagggctgcacaccctagccttcagaggactgcacatcctcaccttcagaggactacacatccttacctttagaggattacacgtcctcaccttcagaggactgcacgtcctcaccttcagaggactacacgtcctcgccgtcagacgactgcacgtcctcgccttcagtggactacacgtcctcaccttcagagggctgcacgccctcgcctctagaggcaaggtcatcaggaccccaactaatcgagctttcatcaagaagtactgcgcccccaggcaagcgcagggcgaaacaccacagcagcctggggatggccggcagtgggcaacagacgcat

SEQ ID NO: 85929 - DNA, 140 bp, Glycine max
  Peptide Sequence Number=SeqID_202707
tttcatcgtcttcgtcgacgcgcgttgagcacttgttcttggacaacagatatggacacgcgctagatttctgcaacgaaggtcatggagatcatatattgacaccgtcttccttaatcctatttcgttactcaagatga

SEQ ID NO: 85930 - DNA, 387 bp, Glycine max
  Peptide Sequence Number=SeqID_202708
atgcaatcacagggactcacagtgcctcctgagcctgaggttggtccttcagctgctcgtgttagtacaaaggagagttgggttgatccctcagggaacgatccagacacgggtgactcagacaaatgtgggttatacatcgaagaaaatcctccccgcttggttgccctaggaagactttctgagggatccacaaccgttcacaacattcctttgctacatgatcaagtgaaggttggtgttgaggaggttagagatacagatgctcccattcctgtacccactaaagaggttaagttagtggggcagacacttttcttgcttggtcgacatatcttgtcaagcgtttatcagaatagggagctatgggactggggaaacttatag

SEQ ID NO: 85931 - DNA, 201 bp, Glycine max
  Peptide Sequence Number=SeqID_202709
atgacccgcaccaagaaaactaggaaaatgacgtctgaggcaacaaaggaaattgttgagaagactgattcgttgaaggagcagtcctcacagggttcctttgtcgcccatggacgtcaggatgtactgactgcttccattgggcgaccagaacaccctggtcatgtgtgtgctgctggagccggtgtcacgatcaagtaa

SEQ ID NO: 85932 - DNA, 300 bp, Glycine max
  Peptide Sequence Number=SeqID_202710
atggtgcagagtctctgtttgatggcttctcatggttaccctcctggccttgtcttgcacccacaagtactgggcttgccctgcgctaccatgaagggctaccaaacattctttccttctccagtagcaaaagcagacctgatcagatatcagtctcgttgtcttgagccaagtccatgtgaggagtcaatgaaatctcaaaatgaatggtttgattataacaagtttgtcaatgtcgacttctcagttgaaaggcccatgcttattgatgaccaaggtattggtaaaaagtgtagatga

SEQ ID NO: 85933 - DNA, 207 bp, Glycine max
  Peptide Sequence Number=SeqID_202711
tcgtacttcaaggatttggtggggagggaagtaatcgtggagctgaagaacgatttggccatcaaaggaacattgcattctgttgatcagtacctcaacatcaagctcgaaaacactagcgtcgtcaatcaagaaaagtaccctcacatgtattcaaatttgagtatcggcgtcaatggtgtgcctgtggttactggtcaattttga

SEQ ID NO: 85934 - DNA, 588 bp, Glycine max
  Peptide Sequence Number=SeqID_202712
atgtatgaataccttgaagaggaaagagtccctgatcttgagagtattttggcagacttcatgacataccaagccatctctaaaagatcttgttatggaatgcaacagcagggaactcaatttcaaaggaaccagtcttctgcaggctatcactgggagtcatgctggcaactagattatgatgataaagcagaaggagttattaatctggatgacctgctaatgcaatttaaagatacagtagagtcaatgcaacaggcttttagaagaactacaactcatattagtaagttggtggatgacatggctaacactgcggccagagaagaggaagagcgtatagagattgaaacgtatcaagaaagcatttttcaagttacctccatccataatcagatgaccactgaagaggaaacgtctataatctccagtactccagaatactcctgctcggcctttgctggctatgttagaggaacagagaaaggtagattgaaactcactgtagaggatcaaaaagagtcttttgacctctttgaggccatgaaacattcagatatgggtgatgcttgttctgaggaggaagag

SEQ ID NO: 85935 - DNA, 2718 bp, Glycine max
  Peptide Sequence Number=SeqID_202713
atggcaattctcgcgccacgcttttcattctcagtgattcctcggaatcaccacaaactcaaacgctctttttctcacaaaccctttatccaaaggaagcagctttggcaccaacttggattgcaaagcctcgtttcccccttttcccttaaccccacttcttcaaaattgtgtgccacgtcacggttgtccattgaggaaacggagcagcaaatcggaaccttgacccgacccgaagacctaaaagggtcattggcgtatctgtttaggactgaaactggtggcggtttggtgaaagttcatgtcacaaggagaaatgataggtattctgtttacattgagatttcttcgttggatataagtggcggtgttggtgaagcgcttttgttgtgttggggtgtgtatagaagtgattcatcgtgttttgtggatctggatacgataggtttgagtgaaaatgcggcaatggggatgaatgttagtcccttggtgcaaaattctgatggaaagtttgcaattgagttggaatttgatgccaagcatgttcctttgtacttgtcgtttttcttgatgtcgtctttggattcagggttggagatcagaagccataggagaacgaatttttgcatgccggttgggtcgcttcctgggtacccttgtcctttgggggtctcttattctcctgatgggtctgtgaatttttctattttctctagacatgctgagagtgtggttttgtgcttgtatgatgagaatggcgtggagaagcctgctttggagcttgatttggatccttatgtgaataggacaggtgatatctggcatgtctcgtttgagagtgctaagggttttgtgagctatggttatcgctgcagacggggtgttcttaagaagaacaaggatgatggttttgctgagcatgttgttttggatccgtatgctaagattgttgggaactcttatcctgatggtgttggattagtgaagaatcttggatgtttgaggaaggaacctttttttgattggggtggtgatcgtcatccggatttgtccatggagaaactagtggtttataggttgaatgtgaagcgctttacgcaacacgagtccagccaacttccaagtggcttagctgggacctttactggtttggctaagaaggtgcagcattttaaagatctaggagtgaacgccgttctgctggagccggttttcacgtttgatgagaaaaagggaccatattttccttgccactttttctctctgatgcacatttatggaccatctggtggtcctgtatctgctattgccgctatgaaagagatggttaaaactatgcatgccaatgggatagaagttcttgtggaagttgttttctccaataccgcagagattggtgctatacagggaattgatgactcgtcctactattatgcaaatggagttggtggtttgaaggtgcagagtgctttgaactgtaactatcctatagtgcaaaatttgattctggatagtcttcggcattgggtgactgagtttcacattgatggcttctctttcataaatgcttcacacctgctgaggggatttcatggggagtacttgtctagacctccattagttgaagcaattgcttttgacccagtactctccaagactaaaatcattgcagattgttgggatccccatggcatggtagcaaaggaaattcgctttcctcattggatgagatgggctgaaatgaatacacatttttgtaatgatgtgaggaactttttaaggggtcaaaatcttcttagcgacctggcaacaagactctgtgggagtggggacattttttctggtggacgaggccctggattctcttttaattacattgccaggaactttggagtttctcttgtggacttagttagcttcagcagtgtggatgaattaagttggaattgtggagcagaaggacctactaacaacactgctgttcttgaaagacgactcaagcaaatccgtaatttcctcttcatcttgtttgtgtcattaggagtacctgttctgaacatgggagatgaatgtggccagtcttctggtggttttactgcatatgatggtataaagcctttcagttggagtgctttgaaaacaggctttggtaaacaaacctcagaattcattttctttttaagttcattgagaaagaggaggagctatcttcttcagaggaggagcttcttaaaagaagaaaacattgaatggtatggaagtgatggggatccaccaagatgggaagacccatcctgcaagttcctggcaatgattttgaaggctgaagtaacggagttcttagagagctctgtatcttctgatatatccggggatctatttattgctttcaatgcaactgatcatccagaaactgcagttttacccttgcctccagaaggaatgtcatggtaccgtttagttgacacggctcttccatttcccggctttttctcgaccagtggtgaagttgtccctgagcagacagaagcaatgcattcacctcccctgcaaagtccatccttaacagattgccatcagcttgggcaaagaaaaaagaagagcttctcacagtgcgatggtgatgataatgggggttcaaggcagtgcggtggttgcaaatgtagtggttgccagaggcgcctggagaaggcagcagactgcaatggcagcttctag

SEQ ID NO: 85936 - DNA, 1950 bp, Glycine max
  Peptide Sequence Number=SeqID_202714
atggcgactattggagatatttgtgtttcggcatccatcaatctgttgtctgcgttggcattcctgttggcatttggaatattgcgacttcagccctttaacgatagggtctacttcccaaaatggtatctgaaggggataagaggcagtccaacaggatccaatgcagtaaagaaatttgttaatttggactttgcaacctacatcaggtttctgaattggatgcctgcagcattgcatattcaagaacccgagcttattgatcatgcagggcttgactcaaccgtttatattcggatttatcttcttggggtcaaaatatttgctccaatcaccttacttgcttttatggttttggttcctgttaactggttcgggaaaacattggaagcaccgggagctaaggatttgacattcagcagtattgacaagatttcgatatcaaacattccatttggatcagataggttttgggcgcatattgtaatgtcatatgtcttctcatcttggacatgctacagtctttataaggaatacgggattatagcagaaatgagattgcgatttttggcagctgaacgtcgtcgtccggaccagttcactgtcctggtaaggaatgttcccacagatcccgatgaatcagtcagtgagcacatcgaacattttttttgcgtcaaccatcctgatcactatctgatgcatcaggttgtttataatgcgaacaagcttgcatccatagctgcaaagaagaagaaattaataaactggcatgtttactaccaaaacaaatacgaaagaaatccttccaagaggccaactattcggacaggtttcctgggtttcttggggaataaagttgatgctattgatcattatactgcaataattgataatttgagcaaacaagaagcccaagaaagagaaaatattataaacaatccgactgctgttattcctgcagcttttgtttcattcaaaacacgatgggcggcagctgtgtgtgctcaaactcaacaaactagtaatcctactatttggctcacagaatgggctcctgagcctcgggatgtcttttgggaaaatcttgccattccatattttgacctcaacatgcgaagattgctcatgacagtttctttatttttcctaaccttctgctttatgataccaatagcattggtccaatctctggccaacattgaggcaattgagaaagtccttcctttcttgaagccaataattgaaaagtcatctatcaagtctgttattcaaggctttctgccagggctagcattaaagatatttcttataatgcttccaaagattcttatgacgatgtccaaaatggaaggttttacttcgctttcaggtttggatcggaggttcacaaaaactgttggcagtacaatccccatgaaagccacattcttcatcacatacataatgatcgacggttgggctggaatagctgcagagatccttaggttatctccgttgattacgttccacatgaaaaacacattcttggtgaagacagaacaagacagacagaatgctatggatcctggtagcttggaatttgccacatctgaacctcgcatccagttatatttcatgttggggcatgtgtatgctccagtcacaccttttcttctccccttcattgtagtcttctttgcttttgcctacatgatctttaggcaccagataatcaatgtgtatgcccagcaatacgagagtggaggagcgttttggccagatgtccacggtcgagtagttatgggcttgattatatctcaaattcttcttatgggattgttaactacaagaggtacagataagtcgactctagtgcttattgcacaacccatcttgacattctggttccacagatattgcaaaggtcgcttcgaatctgcatttgtaaaatttccactagaggttggttaa

SEQ ID NO: 85937 - DNA, 934 bp, Glycine max
  Peptide Sequence Number=SeqID_202715
agatgcttacattgtgtatatgactgctctaagtgaattgaattgtggtgcaaaacaggatgtgtatggaagtgcgattaattgtgaacaagcaagaacgatcacaggagggccacagtgggaaggcagatggctgttagacacaactaccgagggcctcaaagatctagccgattttcttccagcttctttggttaccattgcaagctacttttcagctgaagatacgcgggacatatggaagccagcttttatggatggaactgactggattagccctgctgcaaatttagctcttgttgagcaacagataaagaaaatcttagcagccacaggtgtcgatgtcccaagccttgatatagatgggaattctccagctacacttcctttgcctttggcagcttttgtaagcctcacaattacatataaacttgacaaagccactgaacgattccttgcactgattgcccctgctgggagtgcccttgcttctggttgttcctggccctccttgcccattgtgacgtctttgtggatccagatggtgaagcgttggagtaactacttcgtgctctctgcttccagcactgttttccaccacaacaaggatgctatagttcaactacttaaaagttgcttcacatccacccttgggctaggctatggcagcatttataataacagtggtgccagtgccctcctcgacattgcaagtagtgatttgatgcccaagagagttgtaagaaaaccaagtttgggaacaaataagtttctcttggtggccttaaagcaagggtttgggctgccttacccttgggtcggccctgagcttgatggtgggtcgagctccatcatgggtccgggtggggttcaaggtgatgttacggttgcaaacatggatattgtggaggtgcccggagatggcgacagatga

SEQ ID NO: 85938 - DNA, 183 bp, Glycine max
  Peptide Sequence Number=SeqID_202716
gtgagggagattgagcaggaagtatacactgaaccagaaactgcccagaagaaagacacaaagctgactgctgcagttgatctgtctaaaaggttaaaggatttccgttccttgaatgatgctgccagcttgaaagttccatcatatttggaattgcggattatcatagtgatgcagcaatag

SEQ ID NO: 85939 - DNA, 141 bp, Glycine max
  Peptide Sequence Number=SeqID_202717
gaaatggctccgagaaagcttcctgcaaagagatccgggaaggacaaagcggctgaagggaccagtgccgctcctgagtatgacaaccatcgcttctggagtgctgagcaccagcagcgtttcgaggccatcaaaggatga

SEQ ID NO: 85940 - DNA, 656 bp, Glycine max
  Peptide Sequence Number=SeqID_202718
gaggtacaagagcagatgaaggctgacatggaggccatgaaagagcaaatggccacaatgatggaagccatgatgagtatgaaaaaaatgatggaggtcaacatggctatagtcgtggccacaagtattgccattgaggtggacccgactcatccatctggcctcaatccggtaaatcctccagtctcggatatagtagggcagagaggcgaagtgttaggaagtgcgggcggcccccattttgtgcaagttcaaaacaagcattccttcccaccatatggcttgcctcccaactatacaccacccgatgttgcgcacgctcccgatgagaatgtcaataactccactcccatattcattgagagccaacaaccccaatctgaacatgcacatcatttggggggacctcagtatcgcccacaaccacaacccttgcattttgagttggaaagactgcctcctgccatggtggaaagggagaaaattgatcatatagaggaaaggctgagggtgtcgaatttcgataagtacaaggggactacttgccctaagaatcacttgaatatgtacagcaggaaaatgggggcatactcgaaagatgaaaaattgttgatgcatttcttccaagaaagacttattggggcagtcctcacatg

SEQ ID NO: 85941 - DNA, 429 bp, Glycine max
  Peptide Sequence Number=SeqID_202719
atgaacataggggcgctgatctctggccagatgacctctatagcccagtctaatacttctagacttggattccctgctttaatcaccgcattatgtagagccagaggggttgtctctgatagcctcacttttgagcgcttgagcccggtcattaacttggcctacatcaggaagaactgttggaaccccgaggatctaacagtttctatccgaggggctaggggggcgagggcaaggctagcagagcttccttctacttctgcagctcctactccagcatccacttcagtagccccttctgtcccagttcagatagattctcagcacttggaagccatgcttcagagcattcatcagggacatatcattttactacaaagtttacagatgatggcacctctaaactcttccttcagtaaagcaatttaa

SEQ ID NO: 85942 - DNA, 486 bp, Glycine max
  Peptide Sequence Number=SeqID_202720
atggctccgaaacacatggagcagttgacgcaaaaaatcagggaccagctggaggagtcgatcacagaaaaagtgactcgacaagtactcacactacctcctgagcctgtagatggtcgttcagctactcatgtcagcacaaaggaaaatgttgttatctggttttgttcgttgcataataggctagacttcctgaaaggaattattatcaggtcagatatatttttcaatacatttacattagcattatttgggaacatcaatattttaattgtgcaattcacatccatgtttgtattgaacaatgctttgaaaggatttgacgatactccacaaagtaaatccaaggctactgctaggtggattgttgttaaatgtaatagacaaaaaggaagtactgcgtgcgagtattacgtcatgcaccggatgtcaactataatcttaggaagtttcaagaataattggaaaatggttaatttggggtaa

SEQ ID NO: 85943 - DNA, 726 bp, Glycine max
  Peptide Sequence Number=SeqID_202721
atgattgagtttcaaatgattgatggaaaatctatttcaaatcagatccatgaatttgaaaacattgtttatgacatgaaattgaaaggaatcgttttgcctgacattatgcttgtggctttcatgatatcaaaattgcctccttcatggactgattttgctcgaagcttgaaacataaacatgaaagttttacctttgatgatttgcttgtttgtctccacattgaggataaacatcgttcatctcaaaaacacttgcaaaaatctgattctcactctaaggcctatcttgttgagagctctagcaaacctttctctaagtccttcaaaaggcatgggtttaacaaaaataaatttggtagaaagccttccttttctaaaaataagaacaatgcttttaataacaacaataagcctaaggataaaaatttggggaatgaaattttttgctttgtttctgggcgagctaatcatttggctaagaattgttttcaacgtcatcgccagcccacgtctttccctaaaccgcaagctaatgttgttaccaccaatgctacctctgattccccatctgacaaactccggggctcatgttcattaatcaagcacacgtactgtgagcatggggaatgggagtatggcacatgtgttaggagaaggtcaagtgaagctagagctatcttcgggaaaggttattgttttagatggtgtctatcatatttctga

SEQ ID NO: 85944 - DNA, 459 bp, Glycine max
  Peptide Sequence Number=SeqID_202722
atggatgccctacaatatattaaggaagtacaatgtgcatttcacgacagcagagaaaagtttgacaagtttatggatgtcatgaaagattacaaatttcatagaattgatgttgggattgtcgtagaaaaaatggaggagattcttaaagaccatggggatttgattttgggattcaacaagtttttgccaaagggatatgaaatcttacttctagatgagggtgaggatgggtttggaaatgcttcgaaatatttgaagaagattcaggatcgatttgaaaacaaagatcatgtttacaagtcatttctaaatatacttcttaagtacaaaaataatggagtcactctttatgatacataccatgaggttgctacaatttttgagggtcaccgtgatcttgttcgtgacttcactaagtttctaccatctgtacatctaaggggaaaatctacttaa

SEQ ID NO: 85945 - DNA, 324 bp, Glycine max
  Peptide Sequence Number=SeqID_202723
atggaaccaattgcctccctcgcccagtattatgatcagccattgaggtgcttcatctttggggacttccagctatcaccaatggtggaagaatttgaagagatcctaggatgtcctctagggggaaggaaaccatacctcttctcagggttctaccctcattggccagaatttctaaaaaaggtccaaatctcggcgcaggaattagaccgccaaaggcaagtcgaaaatggggtggtcggaataccgagaaaatatttggagcgatcgacgtttttctcgcctatcataaccacaaggaaagtccggttgccgctatgctag

SEQ ID NO: 85946 - DNA, 285 bp, Glycine max
  Peptide Sequence Number=SeqID_202724
atggcctcctatggtgtggcgtctcctctctctctccctttctccattccgctaccattcatattccaagaagcaaaggaatccattgatgaagaagatcctaggcctacaagctccaatggagcttgcatcaactttttgctacaaggtcatgccatttggactaaagaatgttggggaaatataccaaaaagtgatgtcaaccaaagaggaattgaagtggatcatgataaggttcgtgcaattttggacatgccacctccttccagcaaaaaagacgtttga

SEQ ID NO: 85947 - DNA, 249 bp, Glycine max
  Peptide Sequence Number=SeqID_202725
atggttgagaaaaaggagggaagtgagatttttcctttcacaaagaatggagaaatagggaaccaaagcaagattttagaaagacttcattgtgatgcacagaagttgagaaacctccaaatcaccataaaagatttgatgaagaaagtagacataaatgagaagagcacaaaaggaaaaagtgttgagtttggtgaggtgaaagggcatcaatcaaaattgacatgggtgcatttaataccaacttag

SEQ ID NO: 85948 - DNA, 420 bp, Glycine max
  Peptide Sequence Number=SeqID_202726
atggtatccgtaatctacgaatctcatctattggaatcttcattcgaaaatttacttaaggaaagcctggaaagagacagaatgctgacgtatacttccagaggaattcataaggatgacctgcttttcgaaatggatgccgcactgattaaaaagataggatcccagggccagcaaaaatcctttcttatttcgctcaaactcgcccaaatgagtctcgtaaaagagcttaccggtaaaacgcccattcttttactggatgatatttttgataagctggatgaccatcgcgtggcacaacttattgagttggtcaataaagaaaatttcgggcagatttttattacagatacccatagggaaagaacggaaagtgtagttaagaaaataaatgaggaaagtataatttttgaaatctga

SEQ ID NO: 85949 - DNA, 183 bp, Glycine max
  Peptide Sequence Number=SeqID_202727
atggaagagagagaatggaagatcttcagaccaaataaattttcggcaagattgccattctcgactggcgatatcccaccccacatgaacaaagaggaaaagaccgaaacacccagcttcctctccaaaaacacttccctcgagaaaatcatattggtccgtgatcgtacgtttgatctttga

SEQ ID NO: 85950 - DNA, 303 bp, Glycine max
  Peptide Sequence Number=SeqID_202728
atgaccgcgacacaacaattagatctgctgcgacatccacctgtgacgcatgatgcctcgtttgtggagccacatatccctcaggtcccaaagccaccagcagcaacaccgacacatgcccgttctgatgtggaccaacctagacatgaagtggatgcttgccatgcgatcgctgaaaggttggagtgtttgctcaaccttaggatagtcatggcaggcatagagacacacaaggtcatggaagaatgcatcaagattgccaggggtgtcatagaagacgacaatgtgtatgtgaggtcttga

SEQ ID NO: 85951 - DNA, 177 bp, Glycine max
  Peptide Sequence Number=SeqID_202729
atgaaactcagaggtgacaatgatgggcacaacaccggcaacgacaccaacgagaggcaacgacaacatcacaaagagaggcatagaggtttggccatgaagagagtttcacgaaagcctgttgttgatgcggcaagatcaacatcggttctaaacaaaactgatgttaaagcatga

SEQ ID NO: 85952 - DNA, 1006 bp, Glycine max
  Peptide Sequence Number=SeqID_202730
agacatcatgattcacttgattgtgctgctgcaacctctaataaatctgagatttataaggaggaagcagggaatgcagcacaaaagcctaaagcaaagagggtggagagtgtcaatgttgatgcagaagcctttggtgatcacttggaaagttcagattgctctatacattctgaagttgaagcactagaacatatgatgaaaagagatagaggccatcaaaatgtgtcattggagaataagacaggagattcaactgtggtcaagatgagtgagaaaaataataatgccgatgtcggcgactgcatgattcttgatgaccatgaaggagaagagaattgttgtggcaaaggaacaaatgcgaggagtgacatgaagggaggagagcataaatatgggtttagcaacaataaacgtgagaagccagagaagtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtggatgtaagaagagtaggagagcgtatcatagccttaaaattggtagtgggacaggacacctttaatgttattagtgggtacgcacctcaggtggggttagcagaacactttaaggtaaaagtttgggaggatctagaaggggtacttcaggatataccccaaggagagaaagttttcctaggaggggatctcaatggacatgtaggtagcgtggctagaggttttgagggggtgcatgggggttttggcctatgggagatgaatgcggagggtaaatccatcttggagttttcggaggctttggatctttctatagccaatacatggtttaagaaaagagaggaacatcttatcacttacaaaagtggagggacatgttctcagatagatttcttccttatcaggaagtctgataggaagtattgcttgaact

SEQ ID NO: 85953 - DNA, 345 bp, Glycine max
  Peptide Sequence Number=SeqID_202731
atgactatttacagaaaagagccaagaggtgtagacaaatttgcccaggcaaatttcttgcttagtgttgaaggcaccaattcgcccaggcgagttgtacatgtttcacaaacacgtgtcgcaacgtgcccttttgcgggcgagcgaaggcgaggttcacgggtgcgctttccaaaggaggaaagatgcgcggagtcgccaccaacgtttatttgtggaaaacgtcggaaaaaccgaaggaaaccagtcaaaatgaaaattctaagttcgggagttgtatttacgcttgaggaaggtattaacacctctcacgtttgtctcaaaggacaacagcctattttttag

SEQ ID NO: 85954 - DNA, 315 bp, Glycine max
  Peptide Sequence Number=SeqID_202732
atgacatccactctcgcatctgctggtcaagtctctcaatacttgccatcgatgatacccacgtttgtgctatcgaggtgggtgatggcacgatgtggtgctggagaattggtgacacatttatgtgttgaactcaacttggtttttggaggaagtagtgttttgggcatcttgattatcctcaaggtggggtttgagtattttgggttagcacgaggagttgtgcctggttgtgcgattaaagggtcgaatggttcggttgtgtgttgggctaacaatgggcaattctcgatggcaccttgtatttcaaaatga

SEQ ID NO: 85955 - DNA, 189 bp, Glycine max
  Peptide Sequence Number=SeqID_202733
atggataatgaaagccaattcttttatcagtctgactttttgtgtggagcttatggcatgggggataataatgatgaaaatgtgggtggtgaagactctgatatgcagacacaacctagttatcttgatttttctagctatttcatgactgataagatttttcaagagcatgatgatttgttaaattag

SEQ ID NO: 85956 - DNA, 255 bp, Glycine max
  Peptide Sequence Number=SeqID_202734
atggagtcgccatatgtcgcaacctacccttcggcaggaaggcgacgcggggttcacatgtgcgtcttccaagggaggaaggcgcgcggagtcgccaccaacgtttatttgaggaaaacgtcggaaaaaccggaaaggtgtagtctacgaactttaattgcgaaaggttcgagagttgattttacacaaggggaagggtgtttccctcactcctacgtattcctcaattgcgatgaggaaatcagacctacatag

SEQ ID NO: 85957 - DNA, 155 bp, Glycine max
  Peptide Sequence Number=SeqID_202735
atggggacggagggagtacgctacatgaggaaattgaggttgaagagggtgatcagagtgccggctattagttccaagaatgctgatatcccacccgatgagtattcgtggagaaaatatggacagaaacctatcaaaggctctccacaccctag

SEQ ID NO: 85958 - DNA, 470 bp, Glycine max
  Peptide Sequence Number=SeqID_202736
aatatggatacagtttaaggatcacagagaagagtgatgtgtacagttttggtgtggttctcattgaagtcttaacggggatggagccaatagatagcaggattccagaaggttcgcacgttgtcccttgggttatcagggaaatcagagagaagaaaacagaatttgcatcaattctagaccagaaactaacactgcagtgtggaacacaaatccctgagatgcttcaagtgctaggtgtggctctcctctgtgtgaatccatccccagaagaaagaccaacaatgaaagatgtaacagcaatgctcaaggagatcagacatgaaagcgtggattttgattttgagaagtcacatcttctacataaaggtgctgtcaccaatccaaaagctgcagttcagtgtccaagcttctccagatcttgtaaacctctaactgaatcaccatcttcttcagtgtcaccacattaa

SEQ ID NO: 85959 - DNA, 285 bp, Glycine max
  Peptide Sequence Number=SeqID_202737
atgacagcaacgtcaacaatgaactcctcaaccgccaccaactccggcgaactcaataccaatttggagctacaaataattttggcatcaccagattcgaatcgaacttggacgcattggatgcaattggtgtggcaacaatcatcgggctccagcttctctggtagcagcggaatctcctgcgatggatccaaattcttgtcgttgagtatgttgggtttaggtaggatcgggagtcgtgcggtacggtgcagtgtgagtgtatttacagttcatgctccttag

SEQ ID NO: 85960 - DNA, 291 bp, Glycine max
  Peptide Sequence Number=SeqID_202738
atggcacatttgctggcaatggtggtggaaggtgttggaggcttcgtcaaaacgctttgggctcttcaagaacggcgttggtcctacaccttcgacgctgtggcctctgctgcggtgtccgtgaccatggcattggtgctctgcttgttgtctattcgtactagttatagacatagacgagactacttcctgctgttcaaacttcatttatcactagccaagaacctaaaaagcaacaaggttcaccaaaccacaagtacccctgttcaccatacgttggatgcaccttga

SEQ ID NO: 85961 - DNA, 509 bp, Glycine max
  Peptide Sequence Number=SeqID_202739
ttgttgatggaaaaactatagtgaaaccctttgaatcatggtctgtagaagaacttaaaagagtagaatatgactctaaagctatgaatatcattcacccgttcttgaattgtgatgaatttttcagggtgtcaacatgtacaacgatgaaggagatatggaatctcattcaagtgactcatgaaggtactctgaaagttagaagagcaaggaagaattatgtcattcaagagtacgagacattccggatgctacaaggagaaacaattggaaatgttcaaaagaggttcactcgtatagtgaatcatctcaaggaccttgggaaagtgtttgaggaaaaagagctaaatgtaaagatactaaagtccttcaataaaacacggcaactaaaggtcatgacaatctccgagtccaaagatcttacctccatcacacatgttgagctattcaaaaaattaagagaatctgaaatggacatgactaggatggccgaagaggaggctaagtaa

SEQ ID NO: 85962 - DNA, 261 bp, Glycine max
  Peptide Sequence Number=SeqID_202740
atgccgcacaacatggacggcctcaccggctccaaatccaactccctcccccgtctccgacgacgcccaccctgcccaatcctcaagttcaggggaggggtgcttcaagggagtcagagggtaatgaaactaagtggatctcagcgccacataactaaccattcttataagttattaagagcaataagagaacccataatggttttagcacagttgcttgtcatctcagagaaaacaaatcctacaactttagagaactaa

SEQ ID NO: 85963 - DNA, 189 bp, Glycine max
  Peptide Sequence Number=SeqID_202741
atgaggggtggaggttgcatagcagctcgcccaggtgagctgcttgcttcctccaaaagtaacctacctcgcccaggcgagctggaaaaggagactgtaatagtctcgaaaaaaatgaaagcagataacaatgattgtctccgcatgccaacggatttgattgtctctggaaggcaaatgcgactgtaa

SEQ ID NO: 85964 - DNA, 612 bp, Glycine max
  Peptide Sequence Number=SeqID_202742
atggcctttttaggagaaactagcagtcagacgattgtcaactcaaggttggctttcatttttccaaatggatcgattattcacaatgatactggggtttacttccaaactttgattccggtgcccattcgagtaccaaacaactatgattttgcaagcttaaaaatcagaatacacaatacccttcagctatccaacaaacaatttttggatgaaattcactaccggaagccattcacccatacaggtaaccaaattcgctttcagtgtatgaaattgataaatgatgacgatgtcaacacaatgttaatgtgtaatgatcaattttcttgtgttggtccgattaagttactatgcaccgttggaagaacaccagatggagtaataaacttacttcaatgcactatgccccgtactcatgacgcgatcctgtattacaacgggaaatggaacatgccaccgcagaacaaatttgttggatgcgtgttcacaggaaaaaatcctaagaaatttcaaattccttcaacatgtaccatcgatgaactgaagaatttaataaagcaagttgcacctaaagggattccccctcttggaattcacgaatcacaaacg

SEQ ID NO: 85965 - DNA, 165 bp, Glycine max
  Peptide Sequence Number=SeqID_202743
atggctatgatagaagtctctgttgaagccatggcgtccctcactaagatgcttcacttagtaccgattgtagaagagtttgaagagatcttgggatgtctgctaggaggaagaaagctatatctttttggtgggttctatccctccatggcgagaatagccaag

SEQ ID NO: 85966 - DNA, 282 bp, Glycine max
  Peptide Sequence Number=SeqID_202744
atgttgattgatgttggaaatgcattggcatgtgcatgttgtgtatgttcgtggggggcactgtgcactgaccttctaggggcactgtgcactgactttccagggtctttggcactagcttttggccacgatcatacgtcgtatggagtgtatgtcatgggggggggcttgtcacgtggtagggaacacctttgggctcccagactgatcacctatgggaagagggctgttacgttcacacccgggtggtttcgacaatctacagcacagttccctaagtga

SEQ ID NO: 85967 - DNA, 315 bp, Glycine max
  Peptide Sequence Number=SeqID_202745
atggcggttccaaagttagaaaagatgcaaagacaagctgaaactaacaagaaacagcgtagaaccatgtctaagggttcctctcagtgtggggttgcaacggcgaacaacgacggtttgtggtggctaatggtggttgtgggtgatggagaaagtgcttgggatgttagaaatggttttggaagaaagaaagaagaagaaatggtgtttttcctaagctacacgaaagcaagggctgaaaacgctcaagtgagaaatggtctcggacacggaaatatcacgcacactccagacatcttctcgaagatcccaacg

SEQ ID NO: 85968 - DNA, 441 bp, Glycine max
  Peptide Sequence Number=SeqID_202746
atgcgggttgtatgtcaaagaaaatcctcccgccttgttgccctaggaagactttatgaggggtcgacaaccgttcacaacatcctttttcacaatgatcaagtcaaggttggtgttgaggaagttagagatgcagatgctcccattcctacacccattcaagaggttcagttaggagttgtgggactgataaaacttgcagataggccaaatcatgatgtcgatgatcccctatatctgatgacattaaccatcccacagctttttctaaagtcgttgcagaattcaaagagggatgtgtacctaggagcctacttgaatgagccagacaactacctgaaaggaattactaacagtgctttgaaaggatttgacaatactccacaaagtaaatccaaggctactgctaggtggattgttgttaaagttaatttgggataa

SEQ ID NO: 85969 - DNA, 2433 bp, Glycine max
  Peptide Sequence Number=SeqID_202747
ccaacgaaacccgcgaagaaggtggcaattgtgatctccgtgggaattgttacacttggaatgttctctgcattaggcttcttcttgtacagacacagagtgagacacccggcagagacgcagaaactggtttctcggaaggttctagaagattctccgcgggccccaccaccgccgccaccctcgagcttcctctacattggcacggtggagcccaccagaacttcgctgagcgaacccaatggaataaccgttaacacttccccttatcggaaacttgattccattaagcttagctccaatcaccgttaccgccccagccccgagttgcagccgctgccgccgccgcacaagcctccggacgagagccattcgccggcggcggaattctccgactcctcatcctcttctgaggaggaaagctgcgagacggcgttccactcgccgcacggctcctcgctcggctgcgaagagaatttctttacgccggtctcgcgccacagttgtctctccgctgccgcggcggcaccggtggttcctcactcgaagagaacttctccgaaatcccggttttccgctcctactcccgagatcagaaacattgtcgttccgccggttaagccttctccggcaccggcgccggtgccggccgcttcaacaaaatatcatcacgtggagaaagaattaacattgggtccttctagaagacccaaattctcatcgcatcccccagcaccgaatttgactcatcttcattcaaatgagttcacaacttcacttaaacctcctcctcctccgccaccgccaccaccgccaccacagacactgccgttgagaaaggtctggtctctgtcaattagtacatcttcttcctcagtgtcaaggaagaacggagagtcatggtccccaaatgaaggagggtcttctggtaaccgtgttagtgtaaggaaaggttcttttgaggaagtttaccaaaggcgtgaaggtgatgatgtggatggagcaaaacccaagttgaaggctctgcattgggataaagtgtctactacttcggaccgtgccactgtgtgggaccagttaaaattcagctcctttcagttaaatgaggacatgatggagacactgtttggctgcaaatccacaggttctgcttctaaagagaatgttactagaagatcagttcttcctcctgctgaaccggagaatagggtgttggatccaaagaagtctcaaaacatagctatactgctaagggcactcaatgtgactagagatgaggtgtgcgaagctcttttagatgggaatcctgaaggtttaggaagtgagctattggagactctagtgaagatggctctaacaaaggaggaagaaataaaacttaaaaattatgatggtgacctctcaagacttggctctgcagaaagattccttaaagcagtgcttgatatccctttagcttttaaaagaattgaagctatgctgtacagagctaattttgaaactgaagttaactaccttaggaagtcctttcagaccctggacgtggcaagtgaggaattaaagaacagtcggttattcctcaaacttcttgaagctgttctaaggacaggaaacagaatgaatgttggcacaaatcgcggtggcgctatatctttcaaactggacacacttctaaaacttgtagacataaagggcacagatgggaagacaacactgctccactttgtggtccaagagatcattagatctgaaggaacaggcggtgaatctgcaaactgcaatgttcaaaaccaaacgaattcccaattcaacgaggatgagttcagaaagaaaggattgcaggttgtggctggactgagtagggaccttggaaatgtcaaaaaggccgcaggaatggactcggatgttttaagcagctatgtctcaaagcttgaaattggacttgacaaagtgagattagttttgcaatgtagaaagccggatatgcacgggaatttctttaactcaactgcactgtttctgaaagatgctgaagaggaaattgttaggatcaaggctgatgagagaaaggccttgttccttgtgaaagaagttacagaatactttcacggggatgcagcaaaggaagaagcgcaccctttccgaatttttatggttgtaagagactttctaaatagtttggatcaagtctgcaaagaagtgggaaggatgcaggataggactgtgattggttcagctagatccttcaggatagccgcaagtgcatcgttacctgttctcaacaagtaccatgcaagacaagatagaagtataaacttcaacaggatttctaccattaccaagagaatccaattcataagcaatagtgaaggaggacagcttttcttgagattgaacatcaaacacttgcaggcatggtgggggagagaataa

SEQ ID NO: 85970 - DNA, 3093 bp, Glycine max
  Peptide Sequence Number=SeqID_202748
atggagagttatttgcatgagaattttggaggagtgaagtccaaaaacactactgaagaggctcttcagaaatggaggaaggtatgtggggttgtaaagaaccccaaacgacgttttcgattcactgccaacatctccaagcgctccgaagctgctgctatgcgtcgtaccaatcagaccatgggtgtcccccaacccactggtcagaaactaaccccgttcatggagaagttaagggttgctgttttggtttccaaagctgcatttcagtttatccaaggtgttcaaccaagcgattacgttgtacctgatgaagtaaaagctgcaggtttccaaatctgtgctgaagaattggggtctattgttgaaggccatgacgtaaagaagctcaagtttcatggtggagtagatggcattgcaggaaagctttcaacatcaacaaccacggggcttagtggtgattctgaatcacggcacaggagacaagagctttttggagtgaataaattcactgaaagcgaagttcggagtttctggatttttgtttatgaagcccttcaagacatgactctcatgatcctaggagtgtgtgcttttgtttctctgatagttggcatagcaacagaaggatggcccaaaggtgctcatgatggactcggaatcgttgcaagtatcttactagtagtctttgtgacagcaacaagcgattatcgccaatcgttgcaattcaaggacttagacaaggagaagaaaaagatttccattcaagtcacaagaaacggttacaggcagaaaatgtcaatatatagtttactccctggtgatatcgtgcatctttcaattggagaccaagtccctgcagatggtttatttgtttcaggattttctgtgttgattgacgagtcaagtttaactggtgagagtgagccggtgatggtgacttcccagaatccttttcttctctccggaaccaaggtccaagatggatcttgcaccatgttgattaccactgttgggatgaggactcaatggggcaagttgatggcaactctgagtgaaggtggagatgatgaaaccccattgcaggtgaaactgaatggagtagcaacaattattgggaagataggactcgtctttgcggtaattacctttgcagttttggtgaaaggactaatgggccgcaaactccaagaaggaaggttctggtggtggtcagcagatgatgcaatggagatgttggaattctttgccattgctgttacaattgttgttgttgctgttccggaggggttaccattagctgtgacattgagccttgcattcgcaatgaagaagatgatgaatgacaaggccttggtgaggcatttggcagcatgtgaaactatgggatcagccacaactatatgcagtgacaagactgggacactaaccaccaaccgcatgaccgtggtgaaaacatgcatttttatgaatatcaaggaagtgactagtaatgattctagtttgtccactgaactcccagattctgctttgaaaatgttgcttcagtcaatctttaataacactggaggagaggttgtggttaacaaaaagggtaagcgcgagatcttggggacgccaactgagtcagcactattggagtttggtttatcactgggaggggattttcatgcagagagacaaacatgtaaagttgttaaagttgagccattcaactccgagaggaaaagaatgggtgtggttttggagatccctgatggaggtttaagggctcattgtaaaggcgcttctgaaatcattctggctgcttgtgacaaggtgatgaactcaaacggcgatgttgtctccattgacgaagaatcaagtaattatctgaatagtacaatcgaccagtttgctagtgaggcacttagaactctttgccttgcgtatatggaattggaaaatgggttttccgcagaagaccctattcctgtttctggctacacatgtgtaggaattgttggtatcaaagatcctgttcgtcccagtgttaaggaatcggttgaagtgtgtcgttcagcaggaatagtggtgagaatggttaccggagacaatattaatactgcaaaggccatagccagggaatgtgggattttaacagatgatggcatagccattgagggtccagactttagagagaagactcaggaggaattgtttgaactgattcccaaaattcaggttatggctcgatcctcacctctagacaaacatacactggtgaaacaccttcgtaccacatttggggaagttgtagctgtaactggtgatggaacaaatgatgccccggcccttcatgaagctgatatcggacttgcaatgggaattgctggaactgaggttgctaaagaaagtgcagatgtcataattctggatgataatttctccacgatagtgacagtagccaaatggggacgttcagtttacataaatattcaaaaattcgtacagttccagcttactgtaaatgtggttgcattactggtgaacttctcatcagcatgcatgacaggcagtgcacccctcacagctgttcaacttttgtgggtgaacatgataatggacactctaggagcacttgcacttgcaactgaaccaccaactgatgatttaatgaagcgcacaccagtggggaggaagggtgaattcatcagcaatgtcatgtggaggaatatcttaggacaagcgttgtatcagtttgtggtgatatggtttcttcagtcagtaggaaaatgggtcttttttctccgaggcccggatgctgaagtggtcttaaacacacttattttcaacacattcgtattctgtcaagttttcaatgaggtaaactctcgtgagatggaggaagttgatgtatttaaaggcatatgggataatcatgtgttcatagctgtcctcagtgcgacggttttctttcaaatcctaatagttgagtacttgggaacctttgccaacacaacacctctcagtctggtacaatggatcttttgcttaggggctggatatgtgggaatgccacttgcagttcgcttaaagcagatccccgtctga

SEQ ID NO: 85971 - DNA, 1008 bp, Glycine max
  Peptide Sequence Number=SeqID_202749
atgactcgctcagcgaggcaaatccaacgcaagtggcatccgcttagcgaggcatacagctcgcttagcgggttgggaaaccctagaagaggatcagtcaaagatgtgctcgcccagcgcgtaccagtctcgcttaacgagccagtctcgctaagcgagccaatctcgctaagcgagcctttggaagctgaaaagtccaagagcctttataacactgaggccaaagaagggaaggtaaaagttgttgatgactcgcttagcgaggcagattggctaagcgacatggatccgcttagtgaggcatccaacacacatagataccaaagtcaaagcaatgataaagcgagtaaagctgaaattcatactagattgttgaaggaagcactggcacagctaaaatccgagaaggaagctagtcaagttcagtacaatcagtgcctagaaagtatagctaaactagagactatgttatctcttgcccagctggatgccaaggaatttgatgagaaatcttctaaggctgaaattgaagccaaaattctaaggcaagaactaggccagttggaagctcagaaggatgctggttttcttagatacaagcagtatgttgaaaatatttcagttttggaggccaagataattcttgctgaggagaattccaggatgttaagcgagcaacttgaaaaagctaagctggaagttaaaacactaagaaaaaatcttgttgaactgaatgaagagaaagaatctttagttgtcctttaccatcaatgcttggagaagatatctaaaatggagaatgaaattttgcttgcacaagaaaattctgaaaaactaaatagagaaattgagaaaggggctgaaaaacttaagactgttgaagaacattgtgatatgttggagaaatcaaatcaatctcttcggctagaggctgaaaatatgttgcagaggatagctatgaaggatcaagcacttttagagaagcatgctgagatagagaggctctag

SEQ ID NO: 85972 - DNA, 978 bp, Glycine max
  Peptide Sequence Number=SeqID_202750
atgaagtttatgaaacttggatctaagccagattcttttcagaatgatggggataatatcaggtatgtggcaactgagttggcaactgacatagttgttaatgttggaaatgtaaaattttatctccataagtttcctcttttgtcaagaagcacgtgcttccaaaaactgattacaaacgctaatgaggagaacaatgatgaagttcacatccatgacattcctggtggacctgctgcttttgaaatatgtgctaagttctgctatggtatgacagtcactcttaatgcatacaatgtcgttgcagctcgctgtgcagcagaatatcttgagatgtatgaaactgttgagaaaggaaatcttatctacaagattgaagtcttcctcaactccagcattttcaggagttggaaagactcgatcatcgttcttcaaactaccaagtctcttcttccatggtctgaggaacttaagttagtgagccatggtattgactccattgctaccaaggcttcaattgatacatcaaaggtggagtggtcatacacctataacaggaaaaagctaccatctgaaaatagtaatgatcctcacttcaatagtgtgaggaaacaacaattggttccaaaggactggtgggtggaggacctttgtgagctccaacttgatctctatgaacgggttataacaacaattttaaccaaaggcaatgtttctggttctgtaattggagaagctctaaatgcttatgcctcaagaaggatgcctggcttcaacaagggtgtgatccaaggaggagacaatgtaaagaatagattattgttggagaccataatccgaatattacctttggatgtgggcagtgcctctttcagtttcttggggaagttattaagggtagctattcagttggaatgtgaagagttggagagatctaaactgattaggagaataggtatgtgccttgaggaggctaag

SEQ ID NO: 85973 - DNA, 399 bp, Glycine max
  Peptide Sequence Number=SeqID_202751
atgagggttgaaagggtccctatgtgtgatctacagacttctagagtgttggttaacgaggagattgaggattatctgggactttctcccaagttgttgaggttagtggagcaacaaactaaagagattcaacctcatgaagaattgactgaagtgattaattttgggtctaaagatgagaagaaggtcaaaattggcacactcatgaaaaaaccagagtggcctccagtcaaacaaaagttatggcagatgaaacttcagctatctttaaggattagagaagagattaaaaagcagttggacgtaggcctgcttgtcattgccaagtactcgcaatgggttgctatcgtagtcccatttccaaagaaagatgggaaagttcaaatgtatgttgattaa

SEQ ID NO: 85974 - DNA, 222 bp, Glycine max
  Peptide Sequence Number=SeqID_202752
atgcatggagtccaagcagtgggtcccataggcgttacggtggtacaagctctaaaggccaccattggatactcgtggagtaaaaatggctttcactcgaggaaggttatcgtgtggaagaaactcacactcgaggggagattgttagagttcaagtgtgaaggtgaagttgcacatcgagtagaaacacttgaagggatgattgttggaaaacaagtgtga

SEQ ID NO: 85975 - DNA, 672 bp, Glycine max
  Peptide Sequence Number=SeqID_202753
atgagaaacaagaagaaaaaagaggaaaaagtatttgatgaagaagcttgtgaattcttaacgctcataagacaaagtgagtatgccgtgatagacaagctaaatcgcacctcggctaaaatatctcatttgtcacttatgctgaatttagagcctcctaggaagttactattcaaaatattgaataagggagtagggcataataaagccttgcacatattagtgaagtgcatggatcatatattgtcaagagtttctgtagatgatggttcctcaatgaatgtgatgctaaggatgacacttgacaagttaccctccgatgaatcgcacatgaaaccaagtgctatggtggttagagcttttgatgggtcgcgtagaaagataattggggaaataagtctacctattcatattggccctgttacttttaaggtagtgtttcatgtgatggacattataccagattatattttctatcttggaagaccttggattcattgtgaaagggttgtgccttccacacttcaaccaaagatgaaatttattgttgatgacaagctggtcagcatctcaacaaaggagaacttatttgttagtaagcccttgtctactccttatattgaagctgctgagcaaaagaggaaaaggcaattgccaaatcccaaccattaa

SEQ ID NO: 85976 - DNA, 744 bp, Glycine max
  Peptide Sequence Number=SeqID_202754
atggtatcggaatcttcgaaggcaaaggttgcaaaactggtggatggataccttgctgagattgcacgtgatccaaatttacctctttcaaaatttgttaatcttgctgaattagtatcaagctttccaagagcatttcatgatggcctttatcgtgcgattgacatgtatttaaaggagcaccctggaatcagcaaaagcgaaaagaaaagaatatgcaggttgatgaactgcaggaagttgtcagcagaggcttgcatgcatgctgtgcagaacgagcggcttcccatgcgcgttgttgtgcaggtcctcttctttgaacagctgagagctacaacatcatcaggaggcaacggaacaccggatcattccggctctatcagggcctctcttcccggtggatctcatgggagttcaaggtcggaagaggaatgggaagccgtgggaacgatggaagacataaaatctctgaaaggggagcttattgctctgaaattatcaggaggaacaaggggagccagcagcagaagcaacaacaatgacagtagtaaaggcaattctgagagtgttgctgctagtaaaatgaaaggtctcgtgtcgaagaagataatctccaagatttggtcaagcaaagaaagaagtggtgagctaagtagctctgatacatcagagagccctgcttctacggttgtagaggaaacaaaatctactccatctagaagtaggaggcattcattgtcttag

SEQ ID NO: 85977 - DNA, 672 bp, Glycine max
  Peptide Sequence Number=SeqID_202755
atgggagttgctggtgtattgggcacggcactactatgcgctattcatggtgccaccgtagaaaatactttatttgaagatggtgatggcgcaaatacattccgtgcttttaacccaacccaagctgaagaaacttattcaatggttactgctaatcgcttttggtcccaaatctttggggttgctttttccaataaacgttggttacatttctttatgttatttgtaccagtaactggtttatggatgagtgctcttggggtagtcggtttggccctgaacctacgtgcctatgacttcgtttctcaagaaatccgcgcagcggaagatcctgaatttgagactttctacaccaaaaatattctcttaaacgaaggtattcgtgcgtggatggcggctcaagatcagcctcatgaaaaccttatattccctgaggaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccatgtatgaacaaggtttaattttacttccccatctagctactctaggttggggggtagtcctgggggggaagttatag

SEQ ID NO: 85978 - DNA, 357 bp, Glycine max
  Peptide Sequence Number=SeqID_202756
atgatcattacacaggccttatgcaacagatatgtgaagattcaatcttatgtacaatgtggtaccatatcagtgaaaaacctcgtcgatcccccagaagcacatgacaaggcaaatcacgagctagaagaccagtcagagtcacgctgttttgcaagaatgctccaaccatgtaggatcaatacatgcttaataaagcactcaaacgggttgtatttacccccaaggcctaaactccaaaaagtccgtcagggtctttccttcttgattcagatccaacccagaaaacattttagcacccaaactctatctatgaattgcacaaaacacacgattcatcaattgttctcaaaataa

SEQ ID NO: 85979 - DNA, 543 bp, Glycine max
  Peptide Sequence Number=SeqID_202757
atgaatatcttgacggcacacgatcaagggtggaaactggagttagaaagaggttccaatcaggataagttgttgatgcaattcatagaaacaactaaatcaactcaacaagcactccaaagtgtagaaatccaggttggtgagttggcaaaagcagtaactcaatttatgtccagacaagaaaaatcctttgtagaggctgaagctcaagagaaaagccctgtaaaagagcatgagtcaagagaaaaagatgaggagaaagatgaggaacaagcacaacaacaatgggagaagtactcaatagtagaaaaccaacaagaaaatattctccaaagcaataacctaactcatcaactgattgacatgaaaggaaggcaagaagagcatgaggaaaccttaagtgccattctttctttaataactaacacctttcttgaaatgatttggaatgtccttccagattatatgaagttcatggaatttctagctaaaaggcgaaacttcaaggaagatgtgtcctttgtgactttcatgccaccttga

SEQ ID NO: 85980 - DNA, 294 bp, Glycine max
  Peptide Sequence Number=SeqID_202758
atgactttccaatcacagtctattctcacatcattcaaatggttggactgggcacaaaatacattaagagtaaaaaatcgacaatggtcaaggctatttttggtcgatgccaaggccattttttggctgacatatgctaggttttttggtcgacatcaagctaggctttgtcatagcttagagggcaatgctagtgcactcacaaattttgaggtccttgatttcttacgagctaaaggagcttcaaaggatccaacaagagttattgccaaagtagcacagtctgaatacaag

SEQ ID NO: 85981 - DNA, 2358 bp, Glycine max
  Peptide Sequence Number=SeqID_202759
ataccgtgatggatctgtcgaccggccgctatatccatgaaacgcgcgagtggattttgcgcaacagtccggtgccgatcggcacggtgccaatctatcaggcgctggaaaaggtcaacggcatcgcagaagatcttaactgggacattttccgcgataccctgctggaacaggctgagcagggcgttgattacttcaccattcacgcgggcgtgctgctgcgctatgtgccgatgaccgcacaacgactgaccggcatcgtgtcgcgcggcggctccatcatggcgaagtggtgcctgtcacatcatcaggaaaacttcctctaccagcatttccgcgaaatctgtgaaatctgcgccgcctatgatgtcgcgctgtcgctcggtgatggtttacgtcccggctcgattcaggacgccaacgacgaagcccagtttgccgaactgcgtaccttaggcgagctgacgcaaatcgcctggcaatatgatgtgcaggtcatgattgaaggccccggtcacgtgccgatgcagatgatccgccgcaatatgaccgagcagctggaacattgccatgaagcgccgttttatacgctgggcccgctgacgaccgatatcgcgccgggctacgatcatttcacctccgggattggcgccgccatgatcggctggtttggctgcgcgatgctgtgctacgtcacgccgaaagagcaccttggcctgccgaataaagaggatgttaagcaggggctgattacctacaagatcgccgcgcacgctgccgatctggctaaaggccatcccggcgcgcagatccgcgacaacgccatgtcgaaagctcgctttgagttccgctgggaagatcagtttaatctggcgctcgatccgcataccgcgcgggcctatcacgacgaaaccctgccgcaggaatccggcaaagtggcccacttctgttccatgtgcggccccaaattctgttcaatgaaaatcacccaggaagtgcgcgaatttgccgcccgccagcaggctgaagcccagccgatagcgctgggcatggcgcaaatgtccgatgccttccgtagccgtagcggcgagctcgtgttgtggattgaacgcctgctggcagccggcgtgcgcaccctgcagttgcgcattaaagatggcgatgatcgccagattgaagccgcagtacgcgatgccatcgccctgggcaaacagtacggtgcgcggctgtttatcaacgattactggcgcttagcgattaagtacaacgcttatggtgtgcatcttggtcaggaggatctggatgtggccgacctggacgctatccgccacgccggcttacgcctgggtctgtcgacacacgatgacgccgagctggatcgcgcgctggcgctgcgtccgtcctatattgcgctcggccacatctttccgacacaaaccaaagagatgccctctgcgccacagggcatagccgagctgaagcgccatctggcgcggctgcagcatattcccaccgtggcgattggcggcatttcgctggcacgcgtgccggaggtgctggcgaccggtgtcggcagcattgccgtggtcagcgcgattacccaggcggaagactggcaggcggccacccgccagctgctggcgctgtcagggctggcgcgaccggggacaatcgctaaagtgagcctgcccgctgtcgcttgcagcgggccagggctggcttccccgactctctgtccggccctgcctttccaccgttattctgtcagggaggtgatatggcgcgtttccgcactgcaggcctgcatggcacgctccacagctgcgccgaggctggcaatcgcctgctcgctccgcattcagccgcaccgcatcgaaggcttccggcagctcaatccacatcaggaaactgccctgcggccgcgagacgcaaatgccgcagggaaaatagtggcgcacccagcagctgaacgtctcatagttacgctgatacacctgacgcatgcggcgcaaatgcggcagtacgcgatcgcgatagcgtcccggcgcgacccagcccacgcgcaagccgggcgccagggttttggaaaacgaactgcacagcagcacgcggccatccatatccagcgatttgatggtgatcggacgcggatactcccacgccagctcgccgtaaacatcatcttcaatgatcgccgcgtcaaagcgctgcgccagcgtcagcagcgcgcgcttacgcgcttccggcatgataaatccgagcgggttattgcagttgggtaccaccaccaccgctttgattggccactgctcaaacgccagctccagcgcctcaagactgatcccgctgaccgcatcg

SEQ ID NO: 85982 - DNA, 1515 bp, Glycine max
  Peptide Sequence Number=SeqID_202760
aacttcaccgaggtggaacccgcgctggcttacctgcgtgagaaaggcgcgccgatcgtcatcaaagcggacggtctggccgcgggtaaaggcgtcatcgtcgccatgacgctggccgaagccgaagcggcagtacaggacatgctggccggcaatgcatttggcgacgcaggtcaccgcatcgtcatcgaagagtttcttgatggtgaagaagccagcttcatcgtgatggtggacggcgataacgtcctgccgatggccaccagccaggatcacaaacgtgttggcgacggcgacaccggcccgaacaccggtggcatgggcgcttactcaccggcgccggtagtgaccgatgagatccaccagcgcgtgatggatcagatcatctggccaaccgtcaacggcatgaaagcggaaggtaatacctacaccggtttcctgtatgccggtctgatgatcgacaaagccggtcagccgaaggtgatcgaattcaactgccgcttcggcgatccggaaacgcaaccgatcatgctgcgcctgcagtcggatctggtcgcgctgtgcctcgccgccgtcgacggcacgctcgatcagcagcagtcacagtgggatccgcgcccgtcgctcggcgtggtgctggccgcaggcggttatccgggcgactataacacgggcgatcagatccacggtctgccgctggaagacgtaccggacgggaaggtattccatgccggcaccaccctgaaagatgatctggtggtgaccagcggcggtcgcgtactgtgcgtgactgcgctgggtgaagatgtggcggcagcgcagaagaatgcctacgcgctggcgcagcacatctcatggaacggcagcttctgccgtaatgatatcggttaccgcgcgattaaccgcaacctctttcggctgccagcggcactcatcttccggcgtggcacgcagcagctgaatcccctctggcgcttccagccacgacagggtaatcggctgttgctgcccctgctgctgtcgatacagcgtcgccagcgtgtctcgatcgaacgccacattcacctgctgcccctcacagtcacgaacctgcgtaccgccctgccagtgcccctgccgcaacagtacccggccattcagcagtgcattgctctgcgccagcatgcgctgcgcatcaaaccggtacagctcgacgctgtcggcgctgacggcttcacgccggccagccagctgtcgctgcataaaattaaggttgccctgatggtcgaaacgcagggttacgtcgtccggctgttggccagtgacgtgccgttccacgctcagcagtttatccgcctgccagatatagtcggtggtttcccggctatcgccattgaaaggggtgtagacagtacgcagatggacggcttcgtggtcgccgtttttacgccagattcgcaccgtgccacggtcagaaagatagccgctggcggtgaaagccggaagatcgggagtggcactgcagccggtgagtaa

SEQ ID NO: 85983 - DNA, 315 bp, Glycine max
  Peptide Sequence Number=SeqID_202761
atggacaacataagattcaccgcacccttcaaagttcagaagaaccttctccaagttcctttctcttatcacagacaatggctccggaactaccccaaatatgttttattccactgcgatggcgagatacatttcattcggacacttcctgcagcagcttccaaatttgtctatggctcaaaaaaaagtattaccatccaccacggacttccaaaatccaccaaatggccactcagcatccacaatgacatgccagctattacagaaccatggttcaacctgattcatgaaaaaaatttaagacccggagatgag

SEQ ID NO: 85984 - DNA, 723 bp, Glycine max
  Peptide Sequence Number=SeqID_202762
atgggtgaaatagaggaagggcaagagcggaggaaggctgacatgcaggccatgaaagagaaaatggccacaatgatggaggccatgatgagcattaagaggataatggaagtcaatgcggctgcagttgctgctaccagcgccattgttgaggtggacccgactcccccatctagccttaaccaaataaatcatttaacctcggatgtggtaggtcaggaaggcaaagaattgggaagtataggcgacccccattttgtgcaagttcagaacacgcatgctttcccaccatatggcttgcctccgaactatacaacaccgaatgttgcgcacactcccaatgagaatgtcaataactccactaccatactcgttgagagccgacaacctcaatctaatcacgcacatgtctctcaacccatgggggagacacatgagataccccaccacaatctagccgacttcgagccttgcattggatgcgccacagaggggcaagcaattggtggtgtacctttgtcaaacactttggagggccctcgattttgcccacaaccacaacccttttattttgcggtaggaagagtccctcctgctatggctgaaaatggaaagttggatcagatagaggaaaggctaagggccgttgaaggaggtgaagattatgcctttgctgacatggaagatttgtgcctagtacccgacaaggctaaagggctacac

SEQ ID NO: 85985 - DNA, 1011 bp, Glycine max
  Peptide Sequence Number=SeqID_202763
atgaaggttatgcagaaatcctctttagcgggaagacaatcacagaatctggagataggggacaacaacaaacactatcgccttaactggaggaacaatgccgacattacctccttttatttcacccatttccccgacgaagctaatgcagagttgctatggaggcacttcaaaaagtggggtgacgtacgtgaagtatacatcgctaaaaggctcaacaaggatggcaagagatacaggttcatgcggttcaagggagtctcggatgcaaaaggattggaggtgagactggacaacatcttcatcaacgattgtaaactatttgtcaaccttcctaggttcgacagaccagttcggaatacagagttgctgaaaaagaaccccattgggaggaagtacaccgacgaagcaagtaagccctgcggggtaactactggtgctcttcggagatcatatgtggacgtggtgactaaaggggggtgccaaggagacaaaaggacagacgaggcacaaacaccaactattctgatcaacccagatgaaggcggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttccgatacaggtgtgggaaatgaaaaatctcaggagggctgtagctgctattggggatgtcatcgagtcagacgatgacacagaggaccgccgacgattggaccgggctcgagtattggtgcagacaccgcttccgccgttgataaggtcagaggtcatcgtccgtgtgggggagcttgagtatcgg

SEQ ID NO: 85986 - DNA, 183 bp, Glycine max
  Peptide Sequence Number=SeqID_202764
atgccatattatattgtgtcagttggagatgtgaaaaagaggctaagttttgaattgcaaaaagtagcggttgggctaagctcagtagttgggctaagcgcatatccatcgctaagcgtagcttcagcatgcttagcacaaaggagaatctggcagagcatcagcatcaaagccgcgcgctaa

SEQ ID NO: 85987 - DNA, 308 bp, Glycine max
  Peptide Sequence Number=SeqID_202765
ggtacatggcacttatgcatggcagtgtgaaaaaatggcacgcagcgtgtccgcttcgtgcccctattcaagggacctgtatcatcctcttcgaagaacatattgcagcagtagggactactagcaacaatatgttatcaaagagaaaaactctagatgagggttcactgttgtcgcaacgtgcccttcgcaggcgagcgaaggcgaggctcaacgggaaggtcgacaaaagcggggctcttgctcctacgtaccttccatcgaagaggaaatcagacctacgtagttcttccttatgcgtgaatcaa

SEQ ID NO: 85988 - DNA, 285 bp, Glycine max
  Peptide Sequence Number=SeqID_202766
atgtgttggttgtgtgggattgcaggacaagctataggggatgtgagttttaacaagaagttttgtggtgcttcttggaacggggtagcatataaaaaggctgaacaagtgggaaagcttaagggtgtggaccagtctaatttttcagatgcaaattcagaagtatcagtatctgagtcagttgccaccaataggtccaatgtctcaatttctgaagagagtgaaactgtgggtgataagattaacatgccattcattgattttcttggagtaggagctacctag

SEQ ID NO: 85989 - DNA, 258 bp, Glycine max
  Peptide Sequence Number=SeqID_202767
atggcaagttcaacatgctttcaacaaatttcttcacaaataactatcatgaagcagaaacctagcaaaactacccatcatatctcccaaaacccaatacccacgaaaatcaaagatgcgcttcacgactccgaaaatgctttcctttcgcgatttggagcagaaatggctaccaaaggttggagctttgttggagcttcaatggtggaggaagaagaagagaatggcaacgtgagagagagaggaaaaggcttctga

SEQ ID NO: 85990 - DNA, 306 bp, Glycine max
  Peptide Sequence Number=SeqID_202768
atggttccaatccctttgatagcatggaatcaattatcaatagcaacaaaacacctaatggaactcaacatgattgaaatgataaagttgatgaagctagagacaaatcaaaggatcaaatcaagaatgtcctacagcttctttctagatcaaactgtattcatcataattgtaaagaagagcaatctggggattgctgattttggagttggttgtgaacacaacaaggttgatgttagggtcgacaataagcttggaaagactagtgaaatagtacttgggttgagtggaggctacataggctga

SEQ ID NO: 85991 - DNA, 153 bp, Glycine max
  Peptide Sequence Number=SeqID_202769
atgaggtattttgaggatatggtgacaaatggggagtgggatgaggtggagaagtacttgtttggttttaccaagttaaaaattgaatgggaaaaatattgtcgcaagcaagtatggagaaacaaaatctgcacaagacataatgctggttga

SEQ ID NO: 85992 - DNA, 843 bp, Glycine max
  Peptide Sequence Number=SeqID_202770
atggaagatcagggtcagcagcagcagcagcagcatcaagtggaggcaaagagtccaaggcaaggcaccgagaggagtgaagcggttcggtcaaggtggactccaaagccagaacaaatcctcatactcgagtccatcttcaacagtggcatggttaaccctccaaaggacgaaaccgtcagaataaggaagcttctcgagaaattcggcgccgtcggcgacgccaacgtcttctactggttccagaaccgccgctccagatcccgccgccgccagcgccagatgatgcaacagcaggctactgccaccgccaccgccaccgtcaccacctttgatcaccctcagcctcagactcagactcttgttaatgttggtggtgcaattccacatgatcaccacaccttgggaaaccttgttgttgcaactgaaagtagtgctacttcaaccatgggttttggttgttcttctcaatcttcttatggttttcttggttcctcttcttcttcttcttcttgtggtggtggtgtaattggtggccaacaacaaggcatggatggtttcttctcatcggtttcttctcatcaaatgggtttccctgatcaccaccacacttcacctgcttcatcagctttgtaccctcctcttgatccaaatttgacctaccaggctggatatgggggccctaatatttcaggattcattacagtgtttatcaatggaattgcaactgaacttccaaaggggccaatagacctcaaaaccgtgtttggagaagatgtaatgtatcaaagccaacataagtatgaaaacatcaacctagcatcaatggaagcttccgtttag

SEQ ID NO: 85993 - DNA, 804 bp, Glycine max
  Peptide Sequence Number=SeqID_202771
atggatgatgcaatgtatcaattctgttcaatactcagtaaaggtgtaagtgccctcattaggctggcgcaaatgcttaagacacttcacgatgaggtgaaggagcctcaaaatgtactacaggtttatgagatggcatcgggtcaatccatcaattttggtaaatctgaaactttctatagtgccaatacggatgaaccaaggaggaagatgatgccagatattataggtgtgcccgtgaggataggaggaggcatgaagtggatcaaatgggagaagttgacagtacgtaaagaagatggaggcttaaattttcgcaatcttctaggatttaatctagctatgcttgggaaacaagggtggaaatttatttctcaccccaatgctatggtttcgaggtttttcaaagctaaatactttcggacaatggttttcttgaactccaacactggtcatagtccaagctttatttggcgtagcatttattgttcttgggggctgattaaagatggattgaggtggcaaattggtgatggttctcggattaacatgtggcaacatcaatggttaaagggaataaataacaacagtataggagatgctcctcacctctcaatttcccaactcaatgtcaaagatctggttgtcccaaatactcgagcttgggatattaatttcacaacagcattggtgccacaacaagctactgacaagataatgaaaatcctgttgttagaggagatggaggatgattccaggatttggagacacacaaaggatggatgttatagcgtgaagagttga

SEQ ID NO: 85994 - DNA, 351 bp, Glycine max
  Peptide Sequence Number=SeqID_202772
atgccttcatttctgtgtgacttcgccatcagcataggtggcagtgattctggcggttcaattcaacaacccctgatggattgggaggtcatttccattgacggttcctcctcggaggatactcgccgtggagcctccaacaatgaatcctcttcctcagagaggttgggggcttcacattgtactggtggatgcacctttcgcctccacaggaaggtgcagcctttcgctgcttccttggctagggagtttgtctcgttcatggtggttctcccctctttttcttctgggggaccaaggagaagtggtggggacgttaagtcgtcactattagtcgatgaatacgactaa

SEQ ID NO: 85995 - DNA, 207 bp, Glycine max
  Peptide Sequence Number=SeqID_202773
atgtcagtgaaaaatctcgttaggcacctaagagtaaatggcaagacagaccacacactggaagttaagtcactctcactaggtaaaatcatagggaaaccagttagggtcatgctgttttccaagaatgctcataccatttgggatcggcacatgcttaatggagcactcaaaccggggaatttacccccaaggcctagattctga

SEQ ID NO: 85996 - DNA, 189 bp, Glycine max
  Peptide Sequence Number=SeqID_202774
atgcatggttccaaactcgagggtggaggatgcatgaacgaaaacgcaattcatggggctcctaaaaggggtaaagaatggagaattgcactaagcaatctttacccaaggctaccaactcgtgggcggaggatgcatgaacgaaaacgctcaagcttatgcatccaaccgacctatatgacggacccg

SEQ ID NO: 85997 - DNA, 204 bp, Glycine max
  Peptide Sequence Number=SeqID_202775
atgaccatgaatgagagatcagtaaatatacataatttattgccagggcgtgtgccagataacaatacaagtgcttatataatttgggtgaatcaaacatggcagaatatgagtaacgtggtcagaaagtatatgtttctcggatccacactagcacacgtaataggacatgcgatggagaaagagaaacacagagatgtgtga

SEQ ID NO: 85998 - DNA, 279 bp, Glycine max
  Peptide Sequence Number=SeqID_202776
atgtttcagtatagcaacaacaccgagtacacgatgaattcggttataacagtgttgtatttcaatggaagggtatatgaagacaatgatggtgtaatatttgaaggcagtaaaaaagcgattcagattaaacgtggaattagtttcaatgctttgaagaaaaaaattggagataaggaaaatatattgccttgcaaatttgtgatgacgaagacgttgaaacgatgctggaaagttttaaacaacaagaccaaatgtcagttctggaattgtacatag

SEQ ID NO: 85999 - DNA, 300 bp, Glycine max
  Peptide Sequence Number=SeqID_202777
atgactaaccgcctgagaattctttgtcccaacacattggagggtacatcctttgtggtacaagtagaggttcaagtggagggtacatccacttggttattcaaagagaataagggagggtacatcccttgtggatctttggcttgtaaaggattttacaaggttgaaaagaaatctcaagaaccgcaggttgcttggggactggatgaccttcgtaactcactcttcagatgggaagaagagaaactatatgtgacggcttggtatattgagaaccataacattcttatagcgtattaa

SEQ ID NO: 86000 - DNA, 231 bp, Glycine max
  Peptide Sequence Number=SeqID_202778
atgattgtcaaggccgtgtttgtttgcacgacaacaaaggagttaaaggaagctgacaacaaagaatttaagggaagctcaagaagtcggagccgaagccctattagtagcgatctgagcttcgatcactcaagatacgacgggagctacatagatggcacgacggtcagagctagggtcaacacaggagtggagatggcaccggcggagcttctgtcaacacaacagtga

SEQ ID NO: 86001 - DNA, 365 bp, Glycine max
  Peptide Sequence Number=SeqID_202779
gtcaatgtggctcttatggggtttctagtcgagaaaatttaagtgaaagtagattgatggatctccttcatggttcagaatatgttcttacctatgaagacaaggacggagattggatgctagttggtgatgttccgtgggagatgttcactgagtcttgcaagaggctgaggataatgaagagttttgaagcaattgggctaggtagttgtagaattgagaaaacaggaaactcatcaatcaaactggaaaacagaatcctgcacctagagccatggaaaagtgcaaaagtcgtaactagtgccaatgctgtatgcttttgtcttctaatccggaaagatggaagatcacatttaagcatataa

SEQ ID NO: 86002 - DNA, 720 bp, Glycine max
  Peptide Sequence Number=SeqID_202780
atgcattctttctctcactccattccatttccgggatttgcatttgcatacatacacttacctctctggtctctagctatagcacaagatatgggtagcagttattttggagaacctaactttggaaatgaaagagcaagttgttcttcttcgtcaagaaaagggaagaagagccacaactcagacaagccaaagcaaccacagagaggtcttggagttgctcaattggagaaaatcagattacatggctatcacccttctctgcacgctccttacccttctaatttttccaacgaagatccaagagtgcaaatagcatattcatcggtgccatcatcttctttttcttactcatcatcatacgcagcttcctatggattccaacccaacatcatgatgggcctatccgaatatcaaaaaacaaacatcagatatggagattctcagccaactaatacagcaagatgggaaactaccagcgtcatcttggagagccagtattctgctccatccaacatagctcgaccctttctaaacctaaatgttaggagattttttaaaagtgcatgcaactcgtttgatattccatgcagaaaatatgacacgcatcaagacatagatacaaggaagcataggaacggttctgtgggctcaagcagtcagaactccgaatcaagtgacactcaagaactagatttagagcttagattatctctttga

SEQ ID NO: 86003 - DNA, 657 bp, Glycine max
  Peptide Sequence Number=SeqID_202781
atggtaccggagcgagaagcgttagatacatgggtccaaattgccaaggttgtgaatggagggaatacgacaacatattcggatagcaaccttttggtcctccccaatgggcacctcttgctcattaatggtgcaaccaagggtacgtctgcatggtggaatgctgatttgcctaactacacgcccgtgttgtacagacccgaggaccctaaagggttgaggtttagggtgcttaaggcaagccaaattgcgagaatctaccactccacttccacggtgcttcctagtggcaagatttgggtttctggaagcaacacacacaatacatatagggacgtggataggttcccaactgagacaagagttgaagctttctctcctccttatttggacgccaactttgacaagtataggccgcaaattaacgaggatgcttcggagaaagagttgacatatggtggtttttttgagacaagtttctcgaggcttttgtttctcaagattgacgagttaatcgtagaagcccaagaagggttttacagggttagagtggaggcacctccatctaatgccattgctcctcctggatactacttgctcttcgtcgttccccgtggcttgcctgcagccaagggaatctgggtgcatattcaatag

SEQ ID NO: 86004 - DNA, 852 bp, Glycine max
  Peptide Sequence Number=SeqID_202782
atgtgggtagctttgttaatgattgcagtcgtacccaacactatccaagtggatgccaacatttacaagagcatgcacctcacttggggtgttcagcacgcgtcaattctgggcgaagaccttcatcttgtgttggataaaacctcaggatcagctgctcaatcaaagagatcattcttatttggaagcattgaaatgctaatcaagctggtacctggtaattctgccggaacagttacagcctactatttatcctctgcaggaagccaacatgacgagatagattttgagttcttaggcaacagtacaggacagccatacactgtccacactaacatatacacacaaggaaaaggaagcagagagcaacaattttacctctggtttgacccaactgctgattttcacaattacaccattcactggaatcccacagcaattgtgtggtatgttgatagtgtgccaattcgggtttttcgaaactacgaaaaagagggaattgcttacccaaccaagcaaggaatgagggtttacacaaccctatggaatgcagacgactgggcaaccagaggcggccttgttaagacggactggcacagcgcaccattcacggccagattccaccatttcagagcaagggcttgcaagtggggcggagcaaagagcatcaatcaatgtgcctccaatctcccagcaaattggtggacttcccggagatacaagcagctgagtcactcccagatggggcaactgaattgggtcaggaacaactacatgatctatgactactgcacagataccaaaagattcaacggacaaatccctccggaatgctttaaaccacaattctag

SEQ ID NO: 86005 - DNA, 234 bp, Glycine max
  Peptide Sequence Number=SeqID_202783
atgggtggaaatgtgaaggtagaaaatggcggaatgaaaattaatgcaaccctcattatatttcctccatttgtcatcttccaaaattttcagactaacacgaaggatgaagagaaaggaaatgatttggatcttgtgagactaagaaaggaagaaggacttcaaatggcagtgcgagaaggagaacaaagtagagaaacacaaagaaaggagaagaaacctaacctttcataa

SEQ ID NO: 86006 - DNA, 137 bp, Glycine max
  Peptide Sequence Number=SeqID_202784
gtgttagccctggcaaacagattgctgttggtgctggagaatttgaagatataaaatgcgggatggcacttaagagcattggttacagatcagtaccagttgatggcttaccttttgatcataagaaaggtgaatga

SEQ ID NO: 86007 - DNA, 911 bp, Glycine max
  Peptide Sequence Number=SeqID_202785
atgcaaaaactggaacttttgggagctagaaggtggctctgtaggagcatttcttcaaacccattgcgggtgtgtgttgttggaagtggccctgctggtttctacactgccgagaaggctcaccaacaagcacaagttgatatcattgacaggttgcccacgccttttgggttggttcgctccggtgttgcacccgatcaccctgaaaccaaggatctaccgtgtctgctgccaattttttcaaggatggattttgaggtttacttgaagaaatatttcaaaacttcaatttttacttttttgggtgccgggggtttcagtacattctttggtgagagtaacactgttgaacttagtttaccagaaaacttgcaacagattgtcatcaaccagttttcaagagtggcacatcatgaacgatgctcatttttggggaatgtgacccttggatccagcatttctctctctgaattacgcgagctgtatcacgtggtgaggctctctggttctggattttatgtgttaatggttgtccttgcatatggtgccgaaagtgatagaagtcttggtattccaggggagaacttgaaagggatacattcagctagagagtttgtttggtggtataatgggcacccggatggacgaaatcttgagccagacctaaagagtactgatacagctgtaatccttggccagggaaatgttgctttagatgttgcaaggattcttttacgacctactacagagttagcaacaactgatattgccagtcatgcattggctactttagaggagagctctatcagggtggtttatttggttggaagacgtggtccagcccaagcagcttgtactgcaaaagaactacgtgaaattcttggtaacttctgcatcaactcttataccaa

SEQ ID NO: 86008 - DNA, 185 bp, Glycine max
  Peptide Sequence Number=SeqID_202786
cattcttagcaagctcgaaatctaaagaaagtcttgctcagaatcttaaggaagtctccagctacttcaacaggaagaagaagaagaaccccccaagaaggaagtcgaatcatccgcgaataatgatgaccaagaagatgatccattctaccagaatgaggatgactgttttggtatatcgttag

SEQ ID NO: 86009 - DNA, 558 bp, Glycine max
  Peptide Sequence Number=SeqID_202787
atgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctccccccccccctaaaaagggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 86010 - DNA, 552 bp, Glycine max
  Peptide Sequence Number=SeqID_202788
atggtattggtgagagtggttcccatggcttcttcttcttcgattcgacccactctctcctcccttagattcttaacaccgtcatctctttcgctctccaacccttcttctcgtatctctttctcccatcttccctctccctctgtgtctcaatccaatagttttggcctcaaagcttccagagagttgagacaacatggcaactccacgagaatcatggcatcaggggacgtgtctcaatcgatttcagctgcttcaccagaaaatgtgcttgagtgggtcaaacaggacaagcgaagaatgcttcatgttgtatatcgtgttggggacttggacaggaccataaagttttatacagagtgcctaggaatgaagctcctcagaaagagggacataccagaggagaaatatactaatgcctttcttggatatgggcccgaagactcacactttgttattgaactgacatacagtaaggatctgactattatgttgacaatgacattcctcttgaaatgtgcaaaatcaaatctatttgatgacctttcctaa

SEQ ID NO: 86011 - DNA, 195 bp, Glycine max
  Peptide Sequence Number=SeqID_202789
atggctgaaaatgatatcatccatgattgtgagcgaaataagatttggagcagaaagcagagttttgtttccaaaggtgacccggtttacaaaggaattatccagcctcaaagtggaaagaacacagtcagacaagccactcagtctgtccctcctcgacaacttcctattggcattacggttgctgttggttaa

SEQ ID NO: 86012 - DNA, 897 bp, Glycine max
  Peptide Sequence Number=SeqID_202790
atgaaagcaatttattacatgacactagcatttcctctatttcaagtgaaggttgaggtgtcatatcccaatgaaaatagccatcaatctatgtatggggttactgaagttccttcacttacaaaactctatgaagttgaaaccacaaactcctatgctgatccagaacctcgcacaagcctcagtccaagtatgaccataccacactataatagccatgctgaaagcccctcgaaagctatgagtgaaagccatggaactgagcatataatggatagcagaagctgcagtgatggtctttctgcttcaatttcaggatctcatgcaacgctagatggtagtgacaattctactgatggcatggtggattctcattctgataagttgctagatgctttaggagatgtcagtccgccaccaaggtcagctgctccctctatgaaagcaattttgttactgttggaacaagctgttgagaaaggcagtgcacttgttttagataaggattctttggatgcagacaatatttatcaaaacacggttgcctttgccaaatcagcttcatccggaccagtttttaggaaaaacagaaaggttgaggctcaaaagagtcacaagcaagaaggttcaactttggagactgaagaaactaccactgttcccatgaaacggaaaaaggagaacagatcaaccagcgacgtccgagttgggaaagtggagggcttggaggaaggcgccagactggtggagggggctgttatagcggaggcacgtaatgttagaaatacaggggaaacgaaagctgtgttctgtctctattggatcaaacataggggagttccttctagagcgggttttggaggagttatgagagatgcgtttgggaattggatctaa

SEQ ID NO: 86013 - DNA, 1932 bp, Glycine max
  Peptide Sequence Number=SeqID_202791
atggggaaccggagattgctttttctgttgggggtacttgctgttaactttttactgtttcagtcaatattggttccatatggaaatggaaatgccccatggtcttcagtgccccaaaagtatgataatgttagactttcattacattcaacaccaaagtacttcactgttcggaatccaccaacaggtactgtttcagggttttctaactcctctgctttcattgctacggtgcaaaaagtgcatattcctattgttgttgatgaagttgggcacggtaagaaaaaggggatgcacaataatgtaaagggtggtttggtctctgaaagaaacggctctgatgataatgtttttgaacatggggcagatagaaatgatgttcgtagtttgtctgagaagaaagatgttggaaaaggtgacaggttggagttggagagtgtcggttccaaaaatttcatagcagattcggccaagggcagtaaggttgacttttcagtgaagcaatttttggagacaaaaaggggtgcctctaggttggtaaaagataataacatggattcaagggaacatgatggagttggtgttcatacctcagacagttcaactttctctactaatcttgaaaattctccccagaaaattgtcttttctgcctcggataacagtactgcagtgagtattcctaggagaaagatgaggtgtatgatgccgcctaagtcaagaacgttaattggggagatgaaccgtattctagtgcgcaagcgtgcttctgctcgtgctatgagaccaaggtggtcatccaaacgtgaccttgaaattcttgctgcgaggtcagagattgagcatgctcctacagtaacacacgacaaagaactttatgctcctctctttcgcaatctttccatgttcaaaaggagttatgaactcatggaacgcacactcaaggtttatatatacaaggatggaaataaacccatcttccatcaacctataatgaagggactgtatgcctccgagggttggtttatgaaactaatggaggaaaataagcattttgttttgaaggatcctgcaaaggcccatctattttatatgccattcagttcacgtatgttagagcacgccctttatgtacgtaactctcataatcgaacaaatctccgtcagtttttaaaggactatacagacaaaatttctgcaaaatatcgttacttcaacagaactggtggtgctgaccattttcttgttgcttgccacgattgggctccatatgaaacaagacaccatatggaatactgcataaaggccctctgcaatgctgatgtgactcaaggctttaaaataggaagggatgtttctcttccagaagcttatgtccggtcagttagagatcctcagagagatctgggaggaaagcctcctcaccaacgacccattcttgctttctatgctggaaatatgcatggttatttgcgtccaatattgctaaagcactggaaggacaaagaccctgatatgaagatatatggcccaatgcctcatggtgctgcaagcaaaatgaattatatcaatcacatgaagaacagcaaatactgcatatgccctaaagggtatgaggtcaacagcccacgggtggttgaagccatattttatgagtgtgtacctgtgattatatctgacaattttgtgccacctttttttgaggttttaaattgggatgcattctcaataatcctggcagagaaagatattcccaacttgaaacagatacttctttcggtgtcacaagagaagtatctcaagttgcaacttggggttagaaaggctcagaaacattttttttggcatgtaaaacccttgaagtatgacctcttccacatgacccttcattcaatttggtataatagagtgtttcaaataaaggtgagatga

SEQ ID NO: 86014 - DNA, 222 bp, Glycine max
  Peptide Sequence Number=SeqID_202792
atggctgggaaaaggtctgcgagaacaacaattaccttctatcatccaagaaatctttgtggaggtgtaaatgaagctgaggggagaatggtagaatgcaataccaatggtggggaggataatgggagaaccacaaatcgtgccactctaccccacgatagccaggcacagtgcgacttagttccagggagttggccatcccatgacatgatggtgctatag

SEQ ID NO: 86015 - DNA, 3288 bp, Glycine max
  Peptide Sequence Number=SeqID_202793
atgtcgaaggcagtttcagaatctactgatattagggtttacgatgttttcctcagttttagaggagaagacactagacgcagtttcacggggaatctctacaattgtttggagaaaaggggaatccataccttcattggcgactacgattttgagagtggagaggaaatcaaagcatcactttcggaggcgattgaacattcgagagttttcgttatagtgttctccgagaactatgcttcttcttcttggtgcttagatggacttgtacgtatccttgacttcactgaggataaccatcgaccggttattccagttttctttgacgttgaaccgtcccatgtgaggcatcagaaggggatctatggagaagcactggctatgcatgagagaagactcaaccccgagtcgtacaaagtcatgaaatggaggaacgcactgcgtcaagccgctaacttgtccggttatgctttcaaacatggggatggatatgaatacaagttgattgagaagattgtggaggacatttccaacaagattaagattagtcgacctgttgtggatcgcccagttggcctcgagtatcgaatgcttgaagtagactggcttctggatgccacatcccttgctggagtacatatgatagggatttgtggcataggtggcattggaaaaacaacacttgcccgtgctgtataccattccgctgctggccactttgatacctcgtgtttccttggtaacgtcagggaaaatgctatgaagcatggcttagtgcatctccagcaaaccctgcttgctgagatattccgtgagaacaatattcgtctgacaagtgtcgagcaaggaatttcactaataaagaagatgctccccaggaagaggcttcttttggttcttgacgatgtctgtgagctagatgacttgcgagctcttgttggaagtcctgattggtttggccctggcagcagagtcatcattaccactagagacagacatttgcttaaagcccatggggttgacaaggtatacgaggtggaagttttggccaatggtgaagctctcgaattgctttgttggaaggccttcagaaccgacagagttcatccagatttcattaataaattaaaccgtgcaatcacttttgcttccggcattcctttggctcttgaacttataggttcaagcttgtatggtagaggaatagaagaatgggaatctactttggatcagtatgaaaaaaatcctcctagagacatacacatggcacttaaaatatcctttgatgctctgggttacctcgagaaggaggtttttctagacattgcatgtttcttcaatggatttgaattagcagagatcgagcatatacttggtgcacatcacggttgttgtttgaaatttcatattggagcattggtggaaaaatctcttataatgattgacgagcatggccgtgttcagatgcacgatttgatacaacaaatgggtagagaaattgttcgacaggaatcaccggagcaccctggcaaacgcagtaggttatggtctactgaggatatagttcatgttttagaagataacacgggaacatgtaaaattcaaagtataattctggatttctccaaatctgaaaaagtggtacaatgggatggaatggccttcgtgaagatgataagcctcagaacacttattatcagaaaggagtgtttttccaaaggtccaaaaaaacttccaaatagcttaagagtgctggagtggtggggctgtccctcaaagtctttaccatccgattttaagccagagaaactagctatactgaagttaccctatagtggctttatgtcacttgagttgccaaactttttgcacatgagagttttgaattttgacaggtgtgaatttttaacacggacacctgatttatctggtttcccaattttaaaagaattatcttttgttttttgtgagaatttagttgaaattcatgattcggttggattcctagataaacttgaaatcatgaactttgagggttgtagcaagcttgagacttttccaccaatcaagttgacctctcttgaaagcatcaacctttcgcattgttcaagtcttgtgagttttcctgaaatattaggaaagatggaaaacataacgcatctttctttggagtacactgccataagtaaattgccaaattcaattagagaacttgtccgacttcaaagtttagaactgcacaactgtggaatggttcagttaccgagtagcattgtcacattgcgagaacttcaggtgttgagtattcgccaatgtgaacggttgcgattttcaaaacaggacgaagatgtgaaaaataagagcttactgatgccctcttcatatttgaaacaagtcaatttatggtcctgcagtatatctgatgaattcattgatacaggactcgcttggtttgccaatgtgaaaagcttagatctttcagcaaataattttacaattcttccttcatgcatccaagaatgtcgccttttgaggaaactatatttggactactgtacgcatcttcaagaaattagggggattccacccaatttagaaacattatctgcaattcggtgcacatccttgaaagatttagaccttgcagttcctcttgaatccaccaaagcaggttgctgtttgagagaacttattttggatgattgtgagaatcttcaagaaattagagggattccaccaagcatagagtttttgtctgcaacaaactgcagatccttgactgcctcatgtaggagaatgctactgaaacaggagttgcatgaggctggaaataagagatattctttgccaggaacaaggattccagaatggtttgagcactgcagcaggggacaatcaatttccttttggtttcgtaacaagttcccagtgatatctctctgtcttgctggactcatgcataagcacccttttggacttaaacctattgtgtccattaatggcaataaaatgaagaccgagtttcaaaggagatggttttatttcgagttcccagtattaactgatcatatacttacatttggtgaaggacagattaaatttgaagataatgtggatgaagtagtttcagaaaatggttggaatcatgtaggggtctttgttgatgttgatttcaaatggaacccaacagagccgcttgttgtgcggactggactccatgtaatcaaaccaaaaagtagagtggaagatattcgattcactgatccttataaacccaccatcttataa

SEQ ID NO: 86016 - DNA, 486 bp, Glycine max
  Peptide Sequence Number=SeqID_202794
atgggagatcgcttggaggatatgattcatgaccttggacaagagtgttttcagcaagcatatccccctatgtatgatacattgcaaaatgattcaaagaagcctttgtattctaggtgcaagaattccttgacactgttgtcaacggtgttaagtctggttaatgtgaaggccagatatgggtggagtgacaaaagctttagttcactgcttcaagcgaagaagatactgtgtccgatcggtatggagtatcagaagattcatgcttgcccgaatgatttcatattgtacatacatgaatttgaagaaatgtccaaatgccctaggtgtggggtatcatggtacaaagtcaaggattataaggagtgtagtattcatgaaaactcaaagaagggcctcgcagcgaaggtgttgtggtatctgccgatcgttccaaggtttaagcgtctttttgctaatggagatgatgctaaagaccttacatga

SEQ ID NO: 86017 - DNA, 156 bp, Glycine max
  Peptide Sequence Number=SeqID_202795
atgaaaaatgctgaattatcaaatgcttcccaggaaagccacatccttgaggtgcactttcagaatttgattagtagagtgctttgctggaatgccatctggataccagtagcatttatgttgaagaagggtgccaatgtttgcggccagagctaa

SEQ ID NO: 86018 - DNA, 420 bp, Glycine max
  Peptide Sequence Number=SeqID_202796
atggaaagcagaaaaaactcaaaggtgctgcacaccttttcttatgatcaacaagggcaatacacttctccctacctctccttcaccatgatccattccaacaacttggagtgcaatgtgctaaagaataattctaatacctttttaccagctgaggcctcatttgatgtcccttctattcctaaggaacattctattgagatgtcagaatcagactcttgtagtgaggaaggtggtgattcaactgatgaagaagtcatgagcttggatgagttgctgaatgatggaaaagcacagaagaaaattgagcaattggctgcactggttggagtggacactacggagccagcaattgtgctgacggaagtagtgagaattctcaaacacttgaaccactaccactatactactactacttaa

SEQ ID NO: 86019 - DNA, 219 bp, Glycine max
  Peptide Sequence Number=SeqID_202797
atgatgcaaggtaatatatggatatctccgaacacccttggtttggtgcaaggcatgacacttctcaagtttcagataagaccatctcttgaaaaatccatatttgcacctaaagattattcgagttcacagttcagaggccttaaggttgtgttagccaaggatgatggtataaacaggaccgtgaccaagaagctacttgagaagcttggttttcat

SEQ ID NO: 86020 - DNA, 123 bp, Glycine max
  Peptide Sequence Number=SeqID_202798
atggtggagacagggatgataaaaatattggaatctggagatcaagcagtacaaatgaaattatccaatgtggaattgtttatgatgtttgaaatgggtggtgaaactatcataacaagttag

SEQ ID NO: 86021 - DNA, 177 bp, Glycine max
  Peptide Sequence Number=SeqID_202799
atggagtctccaacaccaataatccttttcaacaatcaagccaaattcttcttcttcaaccaagtcgctcagctggtcgtttacttcttcaaatacatcagtcagctgctgctccaagtttcaggttatattgatcagatgcgaaatgtggagcagcaaccgcaggatcaggtgtag

SEQ ID NO: 86022 - DNA, 996 bp, Glycine max
  Peptide Sequence Number=SeqID_202800
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgtgcgtgcacgcaaagggtcgtcgatgggtccagaactgaccggctcgcacgtgattggtctcgagcgtggctcatccaccattttatcacggcgaagtcggccatgaacccagatttcaaccaaaccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 86023 - DNA, 4350 bp, Glycine max
  Peptide Sequence Number=SeqID_202801
atgggagatcaaccggtgacgaaaacagagtttgatggtgccatagcggctttaaccgcggccatcaccactctgacaacacaggtaacaacgttatccaacaacaacagaatcaatctgaacaggggaggaggtcgtggaaacaatcatacgattgatgattcggattcagaagaggaggaggtcgtgactgaaaaaagaaacgatcgtgacaatcaccatgattaccgcgtgaaagcagatattccattgttttacggaacgatgggagtagaggaatttttagattggcagattgatgttgacagatttttcgacgtcatggacgtccctgagcacaagcaggttaagatggtggcaatcaggctgaaaagtaccgccgctgtctggtgggacagactcgtcgttcagaggacgaggcagagaaagaatcccattcgaacttggcggaagatgaaacaattgatgcttgagagatttttacctgaagattatgaacaaattctgtataaaatgtatattgaatgtgttcaaggcaagcgatcagtgacagagtataccgctgaatttctgcgtttttctgaacgtaatgaattgggtgaatcagaaaatcagaaagtggctcgttatatcagtggattgaaaggatccttgcaggagaagatgggtttgcaaaccgtttggaccgttgctgaagcgtccaacctagctttgaaggcagaattgatggagaaatcgcccagaaatttctcctccttcagaaagtcttctccccagaataatactgaatcatcaggtgacaaagagaaaagtgcagcagccagggattctactcctggtaataaggcaactggtagttctagcagtgcaccacaaggcaaagccccagcccaaaaacaaaacaatccatatgtcaaacccactatggatacttgttttagatgtaatgggaaaggtcatcgatccaatgtctgtccatcaaggagagttgcagctgtggtgggagaaagggacgatgataacgagacagagcagcctgatgagggtgaatatgcagaggtagaatttgctgaagaagaatctgatgaaagggtgaattttgtgttgcagcggatgttactagcaactaaagaagaaggacagcgcaaaaacttattcaagactcattgttctgtcaagaataaagtatgtgatctcataatagataatgggagcacagagaacttagtgtcacaaaaattggtgaattattttaagttgcccgcagagcctcatgagaagccatatgcccttggctgggtcagcaagggatcccaggtacgagtgacgctgtcctgcagagttcccatctccattggtaaacactataaagaagaggtatcttgtgatgttattgatatggatgtttgtcatattttacttggtaggccttggcagtttgataatgatattacttaccggggacgggataatgtgatgatgtttacttggggcactcataaaattgctatggctcctatcctacattttgataagaatccgaaagacaagaaatctagtttcctagtgatgactcaggatgagaggaaacttgataaggctgtcagagaagctaattgtttttgtccagttgttttcaaaggggtgatgagcgctgtgaaagaagaggtcccaattccaagagaaatcttagaaattctaagggatttcaacgagttgatcgcagatgagctgccaaatgacttaccacccatgagggatattcagcaccagattgatttgattccaggttcaagcctaccaaaccttcctcattatcgcatgagtcctaaggagaatgagattttaagggagcaaattgaggatttactaagaaagggctttatccgtgaaagcatgagtccttgtgccgttccagtccttttggtgcctaagaaaggaaatcagtggaggatgtgtgttgatagcagagccatcaacaagatcactatcaagtatcgttttccaattccccgtttagaagacatgcttgatgaattggcaggatccaaggtgttctcaaagatagatctgcgaagtgggtaccatcagataagaattagacctggagatgaatggaagacagcttttaagagtaaggatggactttatgagtggttggtgatgccttttgggttgtctaacgcccctagcaccttcatgagattgatgaatcaggttctgcgtccttttattggttcctttgtggtggtttattttgatgatattctgatttatagcaagatcaaggaagaacacctggaacatgtgaggctagttttacaagtgttacaagagaatcagctgtacattaacctgaaaaagtgcacgttcagtaccaacaaattacttttcttggggtttgtagttggtgaagatggaattcaggtggatgaagagaaagtgagggctatcagagactggcctgcacctacatcagttactgaagtacgtagttttcatgggctggctactttctacagaagatttattagagatttcagcactatcactgcaccaatcactgaatgtttgaagaaaggaaaatacaattggggttttgagcaggagcagagttttgccttgattaaagaaaagttgtgtaccgcacctgtcttagctcttcctgattttgataaagtgttccaagttgagtgcgatgctagcggaattggaataggggctgtgttgtctcaggagaagaaaccaattgctttctttagtgaaaagttgagtgaagctcgtcgaaaatggagtacttatgatcaagaattttatgctgtttttagagctcttcgccagtgggagcactacttgattcatagagaattcattttattcactgatcaccaggctctgaaatttctccatagtcagaaactgatcaacaagatgcatgctcggtgggttagttttctgcaaaagttcccttttatcattcaacataaatctggagcccttaacaaagtagctgatgctttgagtaggagggattcgttgcttgtcactttagcacaggaggtagtaggttttgaatgtctgaaggagttgtatgagaatgatgttgagttccaagaattatgggctaaatgtcgtgagcatccttgtgacgattttcatgttcgtgaagggtttctttttaaggggaaccgactgtgcattccatgttcgtccttgagggagaaattaattagggatctacatggtggtggtctgagtgggcatatggggagggataaaaccattgctagtctggaagaaaggttttattggccacacctgcgaaaagatgctggaaccatagtcaagaagtgctatacttgccaagtttctaaaggccagtcacaaaatactggtctttacatgcctctacccattcctgatgacatctggcaggatttagctatggattttgtgttgggtctacctcgtacccagcgaggcgtggattccgtgtttgtggttgtagaccgattctccaagatgtcccattttattgcttgtaagaagacagctgatgcatccaacatagccaaactgtttttcagggaggttgtgcgtcttcacggagttccaaaatccattacttcagacagggacaccaaattcctcagtcatttctggatcaccttatggaagttatttgatacatcactgaaaaggagttctacagctcatccccaaactgatggacaaactgaggtcacaaacagaactctgggaaatatgattcgatgtgtttgtggtgacaaaccgaagcagtgggatttggctttgcctcaagttgagtttgcttataacagcactatgcattctgctactggaaaaacacctttctcacttgtttacacctctgttcctaggcacgtggttgatttgattaagctgcctaaggctcctggatttagtgtggctgctgaaaatatggctgaagagattatagctgtgaaagattctgtcaagtccaaattggaagctactggattgaaaaacaaaattgcggcagataaatgccgaagagtcaaagtgttcaatgtgggagatgaagtgatggtgtttctgcgaaaagaaagatttccagttggtacctacagcaagctgcagcctcgcaaatatggcccgttccaagtgactcgcaagatcaatgacaatgcttatgtcgtggcccttccagcatcaatgaacatttctaacactttcaatgtggcagatatatatgagtaccatgcagatgaagtcctttatcgagatgagaactcggggtcgagttcttttgaggtggaggagactgatgtaggggggtttatttag

SEQ ID NO: 86024 - DNA, 480 bp, Glycine max
  Peptide Sequence Number=SeqID_202802
atggcaacttggatgaaacacatgaagcctacattaaacaagtcaagaattcaagttcaaagggtgatgctccctgatccaccccaagtggctggcataacagatgacttcaaaatcatagttgaagcaggaatagctcctgtaagttccaactcatcaaggattataattgctgccaagatagcaatgcctacttcaaaaggagtgctagaactgaacaacacataccccaggctgaacccttctgtaaggttcaactatctatcaagtgaaaatgacatgaaagaatgtgtgaagatgataaaattgctcaatcgaatcgcaagatcaaagtccattgcatttttccttggtgagtcatggcaagaaaaactgataggtattggtgttgatctaagaaacttttgcaagaaaaatgtgagaacattctatcattatcatgggggttgcacgattggatcggttgtggatgagcactaa

SEQ ID NO: 86025 - DNA, 162 bp, Glycine max
  Peptide Sequence Number=SeqID_202803
atgggagctcactactctggtctggagcctgaaaagaagccaccatcaaatggagttcatcacaagacaaatagttcatttggtgatgaatctggggatgagttcttttgcaatgttgaagaggaagaagaagctaacaaacaaaaaggggagaagaagtaa

SEQ ID NO: 86026 - DNA, 483 bp, Glycine max
  Peptide Sequence Number=SeqID_202804
atggcacttgtgtggcaaggatattatgtgtacaatgtctacaataagagtctttttccctatgctgttaatgggacgcatgtggcccttaccccgaaatgtgagattttgaaagatcaatcaactttcatccatgggcattctatcttggacaatgctctcattgctaatgagattctccatcatatgaagtgtaaggtcaaggctttggtagaatgtgaccatattctgaatgcgttgaatgattatgctaaagcttctgaccaagtcatcaatctgcagaattcgaaagtgttctttagcagaaatgttgaccaaattctgaaacaaaacatcttatccaagcttggtgttaaagaagggcttctaatgggcgttatttgggggtcccctttattattgggcgaaacaagaagtcaaattccaagtttgttaaggataggctctagaacaagcttaacacttggaagggtagatatttaa

SEQ ID NO: 86027 - DNA, 210 bp, Glycine max
  Peptide Sequence Number=SeqID_202805
atggtgcgtgagtgcaatgtgcttggacataaagtgtcttctactagcattgaggtagaccccgccaagatggaggtgattacaaagttacctccacctaattgtgttaaggtggtaaggagttttctaggccatgttggcttttacaggaggggaagttctaggccaaatgagaggcaaggtgttccacaccatctactatgccagtag

SEQ ID NO: 86028 - DNA, 387 bp, Glycine max
  Peptide Sequence Number=SeqID_202806
atgggttcaggagttgtttacgcatgggaaaggcgagttggatacttcattatgaaattatctggtgacccaggcgagccagacgcctggggtcagaaaaagcttccaaatgacccttttgtcctcccttttaggtattttccgtgttcttttctgaaacatcgaaaaacctttcagattgcacgacagttggtgtcaagcagctcaattcggctacttattatcaccaatagggatattcccattcctagacctaaagctaaatggacaaatgacaatatagccattatggagctctacacaaaagccaagtatactctaacttgtgccctatcaaacaatgagtacaaaaatatttgcaaactaagaactactaaagagatctaa

SEQ ID NO: 86029 - DNA, 426 bp, Glycine max
  Peptide Sequence Number=SeqID_202807
atggtgatagagcctatctcttttgccacttgtaactttatacaagcgaaagatcccactaatactttggtggaagcctcactcccaagtgtaggaaatattgatgttcctccaagctccaaaggattccaaaacaatgagaaatcaaaggtttgtaggatgttgaagaagagaagcttgtatggatcttgcgagagaataaagaggcctttgggtggactatacataacatcaagggaacctaggcagctgcctcagaggaggcttaaccccgacatgatgaaggttgtaaagggagaggttctaaagttgttaaatatggatatcatctaccctatctctgatagtgagtggggaagcccagttcaatgtgtccccaagaagggggggggggggaccactgtaatggaaaatgagcagaaatag

SEQ ID NO: 86030 - DNA, 399 bp, Glycine max
  Peptide Sequence Number=SeqID_202808
ggtacatcctttgtggtacaagtagagggtacatctacttgggttgttgtaactgagaacaagagagggtacatctcttgtggatcagttcaagtggaggatacatctacttggttgttcaaagagaacaagggagggtacatcccttgtggatctttgcttgtaaaggtttttacaaggttgaaagaaatctcaaggaccgcaggtcgcttggggactggatgtaggcatagcgacgaggtcggtcgttacaccaagcatgacattgaagttagaaagggtcatgatgcaggtttgatcaaggaggtaaaaagaaaccatgcactccacaagaggcgccagctagtcccctatgtcatcatcagcctccgagccatggttgttgaaatcgcaatttaa

SEQ ID NO: 86031 - DNA, 720 bp, Glycine max
  Peptide Sequence Number=SeqID_202809
atgactctcgctgagctactcgcatcatggtggtcgtcgtcatcgctgtcgtgcttccgtgctggactattgagctactcatgtcgtggtggttacttgaaagccctcactcgtcgtggtgctccaagctttcaaggttgggtcatggaagaggctgtctttgaatgcgtcaggctgaaagagaggggacctagtgagttctttgaagaataccaattactggaagtgatagtctggcttcttcatgaaagccagtacaaagaaaccatgtgctatgcaggaggctccaactggtcctctgtgtcatcattggcctctaagatatcatttgcaccgcaaaaaatgcaccaaatagagaagaggtccttggaggctggctttacaaacgctaggctaaaacagaggggacctagtgagtttcttgaagaataccgcttattggaagcgacactttggctgcttcatgaaagccagtggatacttcaatgtctagactacctccttagtttcgaactcaagcatgacattaaagtcaagggtcatggtgctggtgtgattgaggaggccaagttctcagagaatccaatcctcgggggctctggttccctcttatggggaggtggtgatggtcaaggatgtgactatagaacactggataacgagatccacgaccatggtggaagtgataatggtagtgttgcaagacaaaggtgccaatga

SEQ ID NO: 86032 - DNA, 552 bp, Glycine max
  Peptide Sequence Number=SeqID_202810
atggtattttccataacttctcttcacaagaacagatcatcattaaaagatattacttcatatgctcttgtgtctgaaatagaacctaagaccatagaagaagctttgacagatgatgatcaaattattggcatagaagaagagcttcaccaatttacgaggaacaacgtctggactcttgtttccaaacctacaggcaagaacatcattggaacaagatgtgttttcaagaataaactagatgaacaaggaaaagtggaagtgtatgccaaacaaccttctggctttgaagaccatacacttccagaccatcttttcaaacttggaaaggctttggtattgtctaaattaggaacctcatccttgagtgagtttgaaataagcatgataggagaacttaagttctttgtagggattcagatcaagcaagacaaaaaaggtatctacatccaccaacagaaatacactaaggaactttttaagaagtttaaacgggaagatgctatgcctatgaaaactccaatgcatgtttccaagcctccaatgttttag

SEQ ID NO: 86033 - DNA, 987 bp, Glycine max
  Peptide Sequence Number=SeqID_202811
atgctctatggtttaaccacgagcaaagattgggagaaagagataacccaggagactgtggataagttgctctatggaaagcctcacctagacgaagttgacaagaaggcttttacaaaccttcttgaggacattgaactttacatacatgtcaaccccaaggtgaagaaaaaccttattccttatggaatgcttttcacccagattttgaggctagctagagtggaggtctctttgatggagccatcatctagagccacacagctaaaggaggctaccttcttgaagatgggaattgttgaaaaaatcccaaagtatgtgcaaaggcacataaagaagaaagtgaagaagaaggtgactgagactcctgtatctgatgttgatcagactaactctgaaccttttcaacctaaaccgaccacatcatcatctgaggtagaaatcttagaaacacctacccatgtaccatcaccttccttagcccttccttcccaaccattacccaagtcaacttcacctcttatcagcaagactgtagttgctaccattgccaaggccaagcaacactctcttgcatatgctgagagaaaatcaaaaggagagaaggccatgaaaaacaaggcaaaggaagaggagctaagacaggcaactgctaatgaccaagtacctaatgaagtggtgcttgaggttgtcaaagttacttctaaagaagagttgcagaaagcagaatttgatgcaagagttcaattagccttcaaacaagtgttgatacattttatgcaacgtttactaaaagagaccgcaaagctccaaccaactatgactcaacctaagccaatgcctattttagatagaaacatcagacgttaccatggcttcaagggatacaaactgtttgaagggaaaactagcaaccaagcatggaaaaagaatatcgatattggaacccaatgcttggacccacagatgcagaaggctgagctctag

SEQ ID NO: 86034 - DNA, 501 bp, Glycine max
  Peptide Sequence Number=SeqID_202812
atggaggctagaaagggaataccaattttacctatactagagatttttcccttacctatgcctacaaagacaattgttcctaattcatgtgactataggtctaggaacataaacgtttcccttgccatgtctcatgaagataggaagaaatcatcccagcaaccttcagtagagagaaaaactcagagagagccagcaagaagaaggagaaaaggaaaagtggagccgaggcactataaagttgtggtcgtgaatcacatccttagtcttgtgctttgcgcaatgatgaataaattgccatttgatccagaaattaccaagactgaaaggaagaatagaaagaaaaagaaacaagcaactactaaaacattgggtgagtcttcttcttcttattatgtttcaattgataagccacttgtagaaaataacatggctgatcgaggaggagaaggaaatagaccaccaaggaggactcttggtgactatgcttatcaacaatga

SEQ ID NO: 86035 - DNA, 846 bp, Glycine max
  Peptide Sequence Number=SeqID_202813
atgagcatgaagaagataatagaggtcaatgcggatgcagttgctgctaccagtgtttttgctgaggtggacccgactccctcatctagcctcaaccaaataaatcgtccaacctcagatagtgtaggtcacgggggcaaggaattgggaagtacggatgacccccattttgtgcaagtgcaaaacaagcatgccttcccgccatatggcttgcctcccaactatgcaccacccaatgtggtacacactcccgatgagaatgccaataactccaatcccatacctattgagagccaacaaccccaagctgatcatgcacatgtctctcaacccatcggggagacacatgaaataccccaccacaatctagccgacttcgagcctcgcctcggatacgcccctgaggggcaagcagttggtggtgtacccctgccaaacactttggagggccctcagtttttctcacaaccacaacccttgcattttgcggtgggaagagcccctcctgctatggctgaaaagggaaagttggatcagatagaggaaagactcagggtcgttgaaagaggtggagattatgcctttgctgacatggaagatttgtgcctagtacctgatgtggtcattcctctgaatttcacggtatcgaactttgataaatacaaagggacaaatttccccaagaatcacctaaaggtgtactgcaagaaaatgggagcatatgtgaaagatgaaaaattattgatgcatttcttccaagaaagtcttactggggtagtgtcataccctaatttcgtccggggacctttgcttgatgacatgcgacctttctttggtccttgtgag

SEQ ID NO: 86036 - DNA, 306 bp, Glycine max
  Peptide Sequence Number=SeqID_202814
aaacatattcccagattagggctgtttccaaagtatttctcagggggtgctttttttgcacgtacccagcatgggatgcgccagttctgctggcgacttcgtgcatggcggacacgtgtcgaacgggtgagggacgcgccagtagttctggcgacttcgtgcatgacggacaggtggctggacggacgcgccagcactgctggcgatttcaagcagggacgcgccactgctgttggcgctttctgccaattctgctgtgaagtcccgtcagccagtgcaggtgcagaggctaggtgcagcagctag

SEQ ID NO: 86037 - DNA, 231 bp, Glycine max
  Peptide Sequence Number=SeqID_202815
atggatgaaggtgagggaggttatggtgagagtggcgataagggtttcttgggtgaggaacgacatcgaagaaaaaaagcctctgccgccaccatcagaggttccgaatgttgtcgaggtttcaacgatataggagatctaaataccttcgacttcgatttcgaccttcttgataaactccactctaaccccaccgatgtcttgcccttgtttgaagctgcaacaacttag

SEQ ID NO: 86038 - DNA, 3138 bp, Glycine max
  Peptide Sequence Number=SeqID_202816
atggaggatgaagcggaagaaacgaagagcgcggcaagaatattcgtcggaggattggcagaagccggtggaaggctgaggctggagaaggccaaagaagactatcttgtgcgtttgaagagagaatgggaacaaggcactctagatgatgctactcaaaaaccacccactgctgcttctgaggaggaaatgcccaacaccgcacaatcttccaagtcaaataccaaacacctcaatattttctttcccagattgagaaagctatgcattttaatcttgtgggttggtcttgtgatggttgggtattgggagggtaaggatgatgtgaaatccatacctttcagtggaactggaaagcacaaatacagttttcagaatattaaagttcctcctctccctgtgcatttttgtgattgtgaggagcattgtaagccttttgtccctgaaagagaaaagctatctattgataggacagctgaaagtggtggaataaatgatgaggagattagcataatgaatgctgtgatgaacaagctatttgaaaaagaacaggtttccaatgccaagaaccttggagaggagaaggattcttttgaatcacctgatgctttacattctgatgaatgcgaagatagtgcaacagatgaagatgatctcattattaacgtggagacaaagaaaaataaaacatctttaacagaggacaaggaacttcaaaggatcttggaaaaccaggaatcatggtttaataaaagaaaaattgctaaggaagaacccaacaagagcacgcttctagtgcaaaaaaggagtaatagcaatcctgacaagaacaagaagagaaaatcacttcccaaattggaagtgtctactacccctggaagcaagagtaatatgcagacccttccagatgaggtgggatctgatgcacagcctactgaactagaagatgattttggggaaaaagtttcatggtctcagaagtcttcatggagagaacttcttggtgacaaaggcaatacttctttcagcgcttctctcatattgccaaagttggactctggtgagagtcaacaaagatctgacgatcaatccgcacctgtatctacaaacaacaaaactgaaaacatggaaagggatgggcacctagggagcaaacctgccgatgcacccgtgatagaggagcatgccgaagctcaacctaccaataaacaagtgatagaagatgttgccaataataagcataatgtggcacctaataagacaggcagaggagcttcatggctgcaaaaacaatcctggacacaaatggttggtcagaataacaattcatttagcatttcaaatattttgcctggcattactttcccagagccaatggccaaggaggccattatggaacctgccatttccaatgattgcaagcacaatggcgtagctaaggatactgttaatgttgtctgtgatgggtttaactcaagggagactataccaggaaagagtcagcataccagtgccaatgacattgcttctgcttcagtaggtgaggaaaaaggtgaaacaagtccaagggaaaaatccactgaaaatgttgaaataggcgaaacttgctcatttatgagaagtgctgcatctttgaaggaatgggcaaaagctaaggctgctatgagtggatcactcaaaagaaaacacggtgagaagggtgagaaggaagatcgaaagattcctgggagagatgtgagactttctagcagtgtgggcattggagctttggagtgtggtgggatggaagaggcggtacctgcgcacacaaacataggacgtgaaagggcgtctaccggagaacaagtaccaccgaaggaactggagggatgcctcggatattacctcgttctacttcaccaggttcctggaggaagtaactcaggtggagctatggaaccacttccgacagtggggggaggtgttgaagataagagaagagttgaaagggacctggacaacagcttcataaggggactcaaactacatgtcaacatccccaaatacgggcggggagagacagcgaaggaacaaacctttaacaagcgcgtgcataaggaggtggccatggtcgacaaaattcgtatggaagaagcttctcgcagagcagcagggaataagccaacccacaggacctatgcagaggtgttgtcttcgccgataaacaggggaaatcactcgagcaaggcagacaatcattttcctagcaatcggggatcatgctctacgctcacattggacatttccgatgatgacaaactgcgttacgaaaacgtatgggtgggaagattgaagaagttggagattttcgaaagactagaagaggaaatggcatggcacctaggcccaggtgtctcggccaagtacttgggggacgacatgacccttcttctcagaatctcctacacgagagcggcaacgattatacgagatgagacaaaacaaggattatccctgttctactccatggtgaaatggaatcctcagctacggaccggtaacaggctggtatggcttcgctgctggggtattccgctagtctcgtggaagatggagaactttcgcaagttagtggcgctggtgggggatcttgtcgacgttgacgacaatgtcgagcacatgcagaggcttgatagggctaggatccttatcaggacaccttggccaccattaataaaacatgaagttgttgtccatattgaaggcgagaaccatcgcgtattcatggtcgaagaaaacggtggtgcggagtcaaatggagaccggtatgggaggagtgcttggggatcctctgatgagattctttctgatgaagctgacacgacaaccttacagtcgtggtcgaacgtcgcgttttcgatactcgacgccggcattctcgctgttgacggagaacttgtcgccgactgccacgatactcccccagctctattacccactagtcacgcgagtgtagacgacccagtgggtaacgaccgtactgacaacgagcctgcttcaaatttaatctcgaacagcaaaaccagcccaaagaggaaagattttgaatttgtcaaaggtcaaacttcagcctaccctgccggttttgatgaaatcgca

SEQ ID NO: 86039 - DNA, 1491 bp, Glycine max
  Peptide Sequence Number=SeqID_202817
atggtatcagaggaggttcacgttcccctagccctcgcttgtgatgacgagcacccaccatttgttgttcacacatcaagctcaagaaggtttataatttcgaaagctgttgttcaaggtgtaacatgtggctcatttgcatacttgagagtggagctaggagattttgtggccttcatagctgctggaaacatccttctagagtatgtaataagttgtgccgcagtgtcaagatcatggacctcatattttgctactctttgcaacaaaaaccctgatgatttccgcatagtggttcacaacatgaaccctaattacaaccactttgaccctattgcagtcatagtccttgcagccatatgcatcctcgcgatttatagcaccaaaggctcctcaatcttcaactacattgcctcggtggtgcatgtggttatcattgcctttattgtcatagtgggtcttattcatgtcaagcctcaaaactatgtaccctttgcaccctttggtgtaagaggagtttttcaagcttcagctgttcttttctttgcttatgtagggtttgatgctgttgcaaccatggctgaagaaaccaagaacccttcaagggacattccaatagggttagtggggtcaatggttgttacaacaatagcatattgcttgctttcagctacactatgcctcatgcaaccttacactagcatcgatgtgaatgcacccttttcggttgcgtttagtgccatagggtgggattgggctaagtacattgtttctttgggggctttgaagggaatgaccacagtgttgttggtgagtgttgtgggccaagctaggtacttgactcacattgcacgcacccacatgatgcccccttggtttgccttagtggacgagcacactggaacgcctgtgaatgccacgatcgccatggttgtggtgtctgctgtgattgctttcttcaccgaccttcaaattctctccaaccttttatcaatctcgactctcttcatatttatgcttgtggccattgctctcattgtgagaaggtattactctagtggggtcactacaaagagaaaccaaatcacgctcattgtattcattgtgtttatcattgcatcttcatgtgggatttcatgttattgggctcttagtgaagggtggattggatatgctatttttgtgcctatttgggctttatctactggagggctttgcctttttgttccgaaggcaaaggagcctaaattttggggggtgcctttggttccatggataccttccatatctatttttattaacattttcctccttgggtctatagataaagactcgtttattaggtttgggttttggacagtgtttctcttggtttactatgttttctttgggttgcatgcttcttatgatacagctaaggagtttgaggcacaacgtagtatggaaaattctataaacaagatggaagatggagagatgtcttctacgtag

SEQ ID NO: 86040 - DNA, 284 bp, Glycine max
  Peptide Sequence Number=SeqID_202818
atggggttatttgtaaacattttccgccagggggctgttttgcacgtaaattgcatgcaagccccaagcaaaccggcagtcaaactggcaagttcgctggcagtgaagaagccgccatccccattggcgatttcgccatgcatgggggaaccgccagtcaaactggcggtggcaggagagggcagctagttgcagggctacgtgcaggagtgcaggttaacgttgcagggacgcaggaatcgccattggtgctggcgagatgcaggaagaactcgccagtttga

SEQ ID NO: 86041 - DNA, 306 bp, Glycine max
  Peptide Sequence Number=SeqID_202819
atggtgaaagttggaacctcttacgtgccgatcaacgtctcattttcgccaaaagttggcccagggcttcccggtatcaacagggacaccaggatttatttattctgcgaagtgatcttccgtcacaggtatctctactcccttcatcttatgcttgtggtcattgctctcattgtgaggaggtactactctagtggggtcactacaaagagaaaccaaatcatgctcattgtattcattgtgtttatcattgcatcttcatgtgggatttcatgttattggactcttagtgaagggtggatttga

SEQ ID NO: 86042 - DNA, 732 bp, Glycine max
  Peptide Sequence Number=SeqID_202820
atggagaccaacttagattattccaagatgctctttttactcctccttggatccacttcattgattttcctctcacacttgacttctgcagccacttccaagctcaacactcaggaggttgatttggttgaattgtgtgcaatgaaggcattaaaggaaataggaaccaagattgggaacaaagactggaactttggggtggatccttgcagtggaaaagggaattggaatgtgcctgatgctaggaaagcctttgtgatgagttctatgatatgtgattgttccttcaatcacaattcttcttgccatgttgagaagcaagttgatcttcttccgaagttgaaaaagaatgtaagcactctagagggggttccacgcctttttgatttagtgaaagttcaagatgaaagaatgaagcttgctttctttgcggcacttagaaacactgtggttactaaagatcttgaccagggaatcctcattatttacgcttgcatgatgggatttaaagaacagaaaccttgccattattacccattttacatcggtcatcagtcaaccgatgtagaaaccctaccattcaacatcggtttcaaccttagaactgatgtagaaaactcacattctacatcggttgagctacacaaccgaggtagaaaggtcgcctttcaaagacggtcctctaaccgatgtcggtattcaacgacactgtgttaccaccacgcgtcataa

SEQ ID NO: 86043 - DNA, 660 bp, Glycine max
  Peptide Sequence Number=SeqID_202821
atggctattattggggttattggaggcctactagtatcaatactttgtaggctctttattcaaccagcttacactttatattatcacttggcgtcgaaatcatcttcacaagaaagggaacatggtcaagatatagcttttatggagaggttgttgtggtggagtctgcattttgtgaatctttcagtcattggctctcttaatcatagttttgaatttcactacttcacaaagatgttggctgagctactaagaagagagaagcatgcaaagattaaaccggatcctgatattgatgcctatatgaaggatgtgaagaacgaagcagaagcatacatgcttaaggagttgtctctgttgaaatggcaagagaaagctacaaagttcgcccttgatgatacaggtggaaaaatggatgagttacaagggaatgttgctactctagaagaaaatctcaaggcagaaaggcaggatgtgaagtatcgagaggattttaagcacgtgaatcagaagatcaaaaagcttgaggataaagtagaaaaggtacttgtattttttttgcctttgttaatcctgtcattgactgatataacagttcaccctgaagattggattataggtttaatatcaggatatccgcttatttgggttggattatag

SEQ ID NO: 86044 - DNA, 861 bp, Glycine max
  Peptide Sequence Number=SeqID_202822
atggttagaaccggaggattgcgtcaggctttaggtagagttttaggaagagccttaggtaaatatgttactagtgatgaggaagaagtccctcggtgtcgaaagtcgacaacatcgatgcataggcaacgagtagttatagttgttgctaaggatgttgaacatgtggatcatgctgctgacgaggttcatgaggagcctcatgagccagttatggatcatgaacatactgagttgaaattgacctcttatgagaggaaggttgagaaatttgaaagacttgcacatgagattaaaggcataatggttgctacagtactaagttatttgatttcatgttcgttggagacaggtgacagaggacttttatttacttttgcggagaggtggcacaaggaaactagtagttttcatctaccgatagtagaactgactattaccctggatgatgtggcatccttattacatctacccattacaggtgtcttccatacctttgatgctattgatatagaggaagttgtcgacttgttagttgagttacttgagtattggatctacaagcatttccctacaattgtgtccattattgttaatgaggattaccatgagaggaaatcatgtgcatgtcagtggaagtgtgtgaaggcattaacagttatgacctatcatccacctgtgttgcccgttcactcagcaactatgccacaaccacctgcacttgtagctgctgatgctaacatacctcgacatgtagtgattagccagggttcactgagcaatacaatgtttatgttcgatctagacgaaggagggatacacaggataaagatggtggtggatgacgatgatgatagttag

SEQ ID NO: 86045 - DNA, 1246 bp, Glycine max
  Peptide Sequence Number=SeqID_202823
atggccaacacatacaagccaaagaacattctcataacaggagcagcaggcttcattgcatctcatgtatgcaacaggatagtgcaaaactaccctgactacaaaatcatagtccttgacaagctagattactgctcaaacttgaagaacctcattcacttgtgttcatctccgaatttcaagttcatcaagggagacattggaagtgctgatttagtgaattacatcctcctcactgagtcaattgacaccataatgcactttgcagcacaaactcatgtagacaattcctttggcaacagctttgagttcaccaagaacaacatctatggcacacatgtgctccttgaggcatgcaaggtctcaaagggtcaagtgaagaggttcattcatgttagcactgatgaggtttatggtgagacagatgaggatgctgtggttggaaaccatgagttgttacctaccaatccatattctgccacaaaagctggtgctgaaatgcttgtcatggcatatggtagatcgtatggattgccggttataacgacgagagggaacaatgtttatgggcctaatcagtttcctgagaagttgattccaaagttcttgatattggctatgaagggaaggagtcttccaattcatggggatggatctaatgttaggagttatctctattgtgaagatgttgctgaggcttttgagattattctccatagggataggcctttcaatgaccaaaggtacttcttggatgatgagaagctgaagaatttggggtggtgtgagggtactacttgggaagagggtctaaggaaaaccatggattggtatgttaagaatcctgattggtggggtgatgtttctggtgctttgcttcctcatccaagaatgctcactatgccaggagttgagaagtactgctatgatgacatcgataatgtgacccaaatcgcttccgatggcgatgtgaaccattctaatcagaacagaatggtggttgtttcagctacaaggaacaatgtgtcaccacataaggcttctttgaagttcttgatatatggtggtgcagggaacattaagcctactcatgttttcaatgcttctggcgtgactggagcattaaatgtgaaatggtttgaagatcatataccagaaagcatacgtgctgttgttgttggtgtgttaacattggcagatgtctgcagagatcatggtcttcctatgatgaattatgcattttgtg

SEQ ID NO: 86046 - DNA, 575 bp, Glycine max
  Peptide Sequence Number=SeqID_202824
caggctcacacagtagtactcctccatctcatggccatggaagctctccaccctcacatcatcacagtagtccaagtactccatcaacaccctcaggtggaaactgtggatcatcacctccacaacatcatgatccaacaacaccctcaactccatcaacaccatcaaaccctccctcaggtggatactatggaggtagccccccaacacctgtcactgtgagcccaccaactactccagttgaccctggaacccctagtatcccctcaccaccactcattccttccccatctcccttcactggcacatgcaactattggaggaatcatccagcaatcatctggggaatccttggctggtggggaaccctaggaagtgcatttggtgtgacaggagcactctacagagaaggcacagcttccttcctcaactccatggtgaacaacaagttcccttacacaaccaaccaagtcagggacaggtttgtggcctcactcaactccaacaaggcagcagaagcacaagcccagctcttcaagatggccaacgaaggaagaatgaagcctagaccatga

SEQ ID NO: 86047 - DNA, 249 bp, Glycine max
  Peptide Sequence Number=SeqID_202825
atggacgaagatcagtggatatatgagagcataatgtctgaagaaattaatatgaatgaagacaatggagaggaatttgatgtgtttgaaaatattcattgttctcatgtcttcaatacttctcaggtgtttgttacccgtgaggatgtattgcaatgggctcataatgctgcatatgatattggttttgtgattgtgataatgaggtcagacacagatactggaaaggaaggacctcatttattttaa

SEQ ID NO: 86048 - DNA, 201 bp, Glycine max
  Peptide Sequence Number=SeqID_202826
atggcttggaaacagctagcaaagttcataggagttttggtccatatagttacaattgttaaaccttttggtattggatgtctaaagttgcctaatgcaaacatccatattcttcaaaattgttacaaaactggaattgatgatgtaaatccgtcaacaaaacaagcacagtcgccgatggctctgacccaatgccaataa

SEQ ID NO: 86049 - DNA, 228 bp, Glycine max
  Peptide Sequence Number=SeqID_202827
atggagaaaaataaatcacatgatgacaatacaagtggaggcttcaatcccttctctgtctctttgacgtttgggaattctatcagagcagttagaggaaaaaaattggaggaatctcagggaaccgctagagatgctgctatcgctggcggaagacacatgagcccgcttagaggggttggacctgaatcaggagggagaggccctgacggactcttcggagtgtag

SEQ ID NO: 86050 - DNA, 474 bp, Glycine max
  Peptide Sequence Number=SeqID_202828
atggttagactattactacctcgagatagtctgacatcatctacctcatctctatcttttgtgtctatcccagttaggcctcccgatgttgcacctacaccatctccacctctgattgaagctagaccatcttcatctcatgttaatgcacgtggaccatctctggtacttgcatccacaccatctccatcttccgttgatgcacgtggaccgtccccagtacctacatccacaccttccccatccttgcctgtgggcaacatgcccgtagatgaagatgctataaatttggcggtggaagaccctccccttaatgattgtcctatggttatgctaattaatggagcgtttcatccatctaaggttacagcaaaggctatcactttgtccattaggcaacaatttggtcagccttggcctacatggggagcgattctaaaagaatcatggtgtgaggtcgtggatatcgtataa

SEQ ID NO: 86051 - DNA, 624 bp, Glycine max
  Peptide Sequence Number=SeqID_202829
atggcttttcatgtagtcctgatatattatgtcaacatcaaagcctccaaattggctatccttgttgattatatgaaaaaaagtattaatcccattgaccctaaggtccttaaccttatttccaagttgactaagtgtttactgtcttacaggagcatcctggaatcagcaagagcgaaaggaaaaaaatatctgagagctacaacatcttcaggagacaacagcacaccagatcatcctgggtctctcagggcctttcttcctggtggatctcatgggagctcaatgtctactataacaaacacagaagaggaatgggatgctgtgggaacaatggaagacataaaatctctgaaaggggaagttgatgcactaaaattatccggtggaaccggcagagccagcggcagaaaagacaataacggtgataaaggcaatgccgacaatgttgctgccagtaaaatgaaaggcttcatatcaaagaagatactctctaaaatttggtctagcaaagaaaaaagtggtgatctaagtagctctgatacttcagagagccctgcttctactgttgtagaggaaacaaaatctaccccatctagaagtaggaggcattcagtatcttag

SEQ ID NO: 86052 - DNA, 333 bp, Glycine max
  Peptide Sequence Number=SeqID_202830
atgaagcaccaaaatggtatgggctgcaaaacctattggacttcaaatttaccattcttgaaacccagatacggatggcagcaggacaggtcggggtggctattgtggccgaggtgcgtggagaaagagttggtggtgaggcagtgcgacaaggaggtggtggccggagaaaggggtagtttggctggatgggatcagggacgggggtgggaagtgacatgcccgcctccacccctgctgccccaagtcaggaaaaatcttgccccaaccacagtcaaagtcgggtggtgtcaaatgggtcccacatgtgagtggtctatgttcaaatcttag

SEQ ID NO: 86053 - DNA, 420 bp, Glycine max
  Peptide Sequence Number=SeqID_202831
atgcgaacacgcttgctaaagaaatcaaactcccaaactgatcggaacaacacacattttttttcaaaagagagcaggcataaagatttggctagtaacatagatgggcgaccatttcctatcccttcatgtcttgaccaagccactgataagggttacggtcctagcgatgctggtgcagtgtatactgatagaaacagtcattcaactgcatatggcccctatggttggttgcctgctggtcagccaaatgctacatgtatgcatgcatctggagctccatcctctgtatgtgagctgagatggactctagaggtggtggctgatgtggaggcggtggtggtgcttatgtggccggctgctgctactggtcttgccccaactgttgtgcctgccttggcatgcaatatttctcaatga

SEQ ID NO: 86054 - DNA, 1536 bp, Glycine max
  Peptide Sequence Number=SeqID_202832
atggaagtggagcgagtcatggaaagctggaagtggtgcggggagagagtgagtgtgattaaaaaaacgacaaaagaaaaagctgaaaagatcgatcagactctggttttatggaaggcttcccaagttttaagcttaggttacatactccatctcgaaaaagctgctgcaatttttgctcactctgataagctttatcgccccggtcccctctatataaaggaaagcttcacctacgcaattccctcacgccactctctcctattttcatccatagattttgatatcattattgttgttatgggagagtttgagtttgctccaacggtgcttgtgagtgtgagagagttcgacccaaataacgacagagagggagtggaagccgttgaaagaatatgtgaggttggacccaatggaaagctttccctcttcaccgacctccatggtgacccaatttgcagggtccgcaactcacctactttcctcatgctgatagccgaaattgggcaagagacagtaggaatgataagaggttgcatcaaaaccgttacttgcggaaaaaagctccataggcaaggaaaaagcaacacggaaaccgaaccaaaacaagtccctatttacacaaaactcgcatacatattaggcctccgtgtttctccacatcacaggagaatgggaataggttttaagcttgtacagagtatggaggaatggttcagggataacggagcggaatacgcgtacatggctacggagaaagacaacgtggcatcggttaagttgttcacggacaaatgcgggtattcaaagttccgtacaccgtgcattctcgcgaaccccgtttttgctcaccacgtgagaatctctaacaaagtcacaatcattgagctctcaccgaatgacgccgaattgctctaccgcagcaagctcgccacgacggagttcttcccgcgcgacgtggactccgtgctcggcaacaggcttagcctgggcaccttcctcgccgtcccgcgtgttggctcgtaccagcccgacacgtggtccggctcggcccggtttttattggacccaccaccttcttgggccattctcagcgtgtggaactgcaaggatgtgttcacgctcgaggtgaaaggcgtgtcgcgcgtgaagaagacgcttgccaagaccactcgcgtcctcgatcgcgtctttccctggctgcgcttgccgtcagtccccaatttctttgagcccttcgggtttctttttttgtatgggcttggtggggagggcccgcaggcccagcagatgttacgggctttgtgcgggtttgcccataacttagctaaggatcgtggctgcgaggtcgtggccaccgaagtttcaagccaagaacccttacggtgtgccatcccgcactggaagatgctctcatgtgaagaagatctgtggtgcattaagagattaggagaagattacagtgatggctctcttggtgattggacaaaatcgcctccaggattctcaatttttgttgatccaagagaggtttaa

SEQ ID NO: 86055 - DNA, 342 bp, Glycine max
  Peptide Sequence Number=SeqID_202833
atgggaggagaaaaaaaagaagtaaaaaagaagaaagttcttgatcaaagaactagaagaaatgtgcagaaaggtcttttgaccggacgatatctgaacaatacagaattgtcaccaaatgaacaaaaaagaaggaaaggaaaccacgacctaaaatggtcttctccctttaattaccaaccaaaatcccgtgcgctagcgacccttttttctcgccccgcactaaacaaaaaaacagaaaaaagaaaaatccagaaaaatcaaaagccaaaaacacacaaaagccgaaagaagaaaccaccaaaagaacccattcccaagggaagccctattgatccatga

SEQ ID NO: 86056 - DNA, 825 bp, Glycine max
  Peptide Sequence Number=SeqID_202834
atggagggaggtgacgttgggcattgggtgttggagttccttctccgggctcggtacccagtcgtttccagtaacctactcaagaaagtccttcgaatagtcccactttcagactttgattccaggcttcagaagacgcttcttctccgaacccttcaagaccacttgttcgctgtctctgtccccgaatccgttctcgaaaccctcgagctcctcgaggaacttcaccgccgcgacgacggcgctctgatcaccgccgccgccatgagcgccgcctactgcgccattgcggtggactgcactctcaagcacctgctggtggaactccacaacaaccctgcctacctcggcgccgtgaacaggatatggcgtggtagggttcggcacatgagcggttccagggagggcagccttcttctctcgctggagttggagcggtggagaaccgacatcgaaacttcccttctggactcgttggtgagggagaggttggcctccattgatacaagaagggacgccgtcgtcaagctccgggattatttgatggaagcatggaccgatttgggcccttcgtttctcgagctagcggcgttggcgcaaataaacaaaaatgccctagccgtgaattacttagaggattcccaacagccggagagagcgtgtccaacagaaattgagaagtgcactgctgctcctgctgaggaagtgcatacctcaacagatgccgaggtccaaaaggttggggaatgtggatctgtggagttgcaaaagttggccgaggattctctacttaattcgttggaagtgaatgagcagcacctatga

SEQ ID NO: 86057 - DNA, 300 bp, Glycine max
  Peptide Sequence Number=SeqID_202835
atgattttccggcagggggctgttttgcacgtaaagtgcatgcatgcctcaagcaaaccgccagtgggactggcgagttcgctgtctgtgaaggaatcgccactgggaatggcgatattcgcatgcaaggggaaccgccagtttgattggcgagttccatcacgtaggctcagggctaggagtcaagccatgcagaggtcagcagcaggtgcaggagggaatcgtcatttgcattggcgggttgcgttttgcgggaatcgccagcctggctggcgctttgtggcagaaaggactcactag

SEQ ID NO: 86058 - DNA, 288 bp, Glycine max
  Peptide Sequence Number=SeqID_202836
atggctctacatgttgtcactccatggcagttgtatagtgtacctgcttgctccacaggattgtcagttgagtggagctcacttcaacaatcttcttgggagctttatgaagcattttcaaagggcatgatgaaaaagttaaaacattccaaaatagtaacatctagagcaagatctccaaaagtgaaagatttaattcctaagtggaatccttcttttgaggtgaagatctgtattctatgtagtaaaacacatatcctcttttttgttggtgaggactggacgtag

SEQ ID NO: 86059 - DNA, 786 bp, Glycine max
  Peptide Sequence Number=SeqID_202837
atggaggtgtcgtcggagcaatccggcgaaggcgtgacgctggaaaagcttcagagttctctgaagaagaacgttccagaagcttcccgaagagctgcaaaaacggttgcggaacctggcggttcggtttctgcgaagaggagagtcgaaccgcgaaccggttcggtcacggctgcgacgaagagatcgggttcaatcggaggttcttcgagtgtggttactgcgccgagaaggaacagcaccgggggattgtctcagaaagcgtcgatctccgatggaagaagaaaaaccggcaccgaatctgccgccggagctaggagcggcgcttcgtcggtgggcgagcttgtgcggagttcactaccggagctccggctaatttcggtgaattcttcgcgagttgcggtgaagccggctgtggcctcgctggcgggttcggcttcgaggacttccggtgcgagtaaggcagaggtggcgaagaagccggtgacagtgagtaagccggcattgtcggcttcgagttcggcttcatctgtttcaagaaggattggttcttcgtcggtggatagcactgccagcagcggcggttctgctcggaggacggtttcgagggtttcgtcgccaacggtttcgagcgggttgaaggcggggtctctgtcgacgtcgcaggataggacgtcgtcgtccctttccggaaggaggaagggaggcactgctgatagcagggattcgcggtttattgttcttccgcaggttgagattaaggccaatgatgatttggtggaatga

SEQ ID NO: 86060 - DNA, 2732 bp, Glycine max
  Peptide Sequence Number=SeqID_202838
ggaacgcccccaacaacacttacttccacaaagccatgaacttccggttccaaaacctcttgggcgccccctacagagggggcaacgtggtcatttccagcaacaccgtgctactctccccggtcggtaaccgcgtagccgtcaccgacctcctcaagtccgaaaccaccacgctccccctccagtcctcctctaacgtcacccgcatcaccgtctcccccgacgccaccttcctcctcgccatcgacgaccgcaaccgctgcctcttcatcaacctccgccgacgcgccctcctccaccgcatcaccttcaagcaccgcgtcgccgcctcgaagttcagccccgacggcgccctcatcgccgtcgccgccgggaagctcgtccagatctggcgttcgccggcgtttcgccgcgagtacttcccctttgagctcgttcggacctttgcggacttcgacgcgaaggtcacctccctcgattggagccccgattcgaagtatcttatcgccgggtccaaggatttgaccgcgagaatcttgtgcttgaaaaaattgaacagtggtggtgttaagaaaagaccttttttgctattagggcatagggattctgttgtaggttcgtttttcggtgtcaattcgaagactaatagggtttgtaaggcttatacggttagtagggattgttatttgtttagctggggttttacttctgatgatgatggtgagggtgaggaagatggtggtgagggtttggaacctccctcgccggggacgccagagagggatgtggaagagaattttgagcttagtgagaatgatggtgtgaagaaaatgaagaaaattagtgagaatgatggtgtgaagaaaagaaagaaaattgatattgaggatggtgatgagggttacttgagtagagggaagtgggagttattgaggaaggatgggtttatgcagggatgggcgaaggtgacggcgtgtgattatcatagagggctggatatggtggttgttggattttctaatggtgtgtttgggttgtatcagatgccggattttgtgtgcattcatttgttgtctatttcgagggagaagattaccactgccgtgtttaatgagtttggcaactggttgacctttggctgtgccaaattgggacagctgcttgtgtgggagtggaggtctgagagctacattttgaagcagcagggtcactactttgatgtgaactgcgttgcgtattcaccggactcgcagctccttgcaactggagcagatgataataaagtgaaggtgtggactctttcctcaggcttttgctttgttacattttctgagcacactaatgctgttacggctctacattttatgccaagtaacaatgtcctgcttagtgcatctcttgatgggaccattcgtgcatgggacttattacgttaccggaattttaagacgtttacaaccccttctccaaggcagtttgtttctttgacagctgatataagtggtgaagtaatatgtgctggcacttcagattcctttgaggtttttgtttggtcaatgaaaacggggcgcttgatggatgtgcttagtggtcatgaagctcctgtccatggtctggctgtcttggcttcatcatcatatgacaaaactgttcggctgtggaatgtctttgatggaaaaggagcagttgaaacgtttcctcacacacacgatgttcttactgtagtttatcgtccagatggaaggcagttagcttgcagcacattagatgggcaaattcatttttgggacccaatagatggtttgctaatgtacaccatagaaggttctagagatatagctggtgggcgccttatgactgaccgcagatcagctgctaactcaacttcagggaagttctttacaaccttgtgtttttcagctgatggaagctatatattagctgggggaagtagcagatacatctgcatgtatgatgttgcagatcaggttttgcttcgacgtttccagataactcacaatctctcattagatggagtgcttgacattttaaactcaaagaatatgacagaagctggcccactagatttgattgatgatgacagcagtgacattgaagaaggtgttgacaaacaaacacgagggaagctaggattagacttgccaggatctatgcctaaccgtggaaggcctattattcagacaaaaagcctgagaattgcatctacagggcgtagttttgttgcagcaacaactgagggagttttggtttattctgttgatgaatcattcatatttgatccaactgacctagacataaatgttacaccagaggctgttgaagaggctctccgggaaaatcaaccaagtaaagccttgatccttagccttcgcctgaatgaggattctttcgttaaaaaatgtatatttgcggttagtccagcagatattccagccgttgccacatcaatcccctacaaatatatccagcgattagttgaggcacttgcagatcttttagaaaactgcccacatttggaatttatacttagatggtctcaggagctctgcaaagcccatgggaattctattcagcagaactctagaaatctgttaccatcattaaaatctttgcagaaagcaatcactagaattcatcaagatctagcagatacatgttcctccaatgaatatatgctgcgatatttatgttcttctggtgccaagaaatga

SEQ ID NO: 86061 - DNA, 1629 bp, Glycine max
  Peptide Sequence Number=SeqID_202839
atggttatcatcatgcctacaacgatgttaatacaatggttggttaacatcagtcaatactcaagccaggagagagaaacaggggatgggagagagttaggcacagaggtgagaaattcgagagggcaagggcgagattcaccacgggttttcataggacacaaaccaggacaacagcaactctataatcaaacaaactggagggatcggaatgagatatcaaccttctacttcacgcgtttttctgacggcatcaacgagaaggatttgtggtaccaattcaaaaaatggggagatgtcagagaagtattcatatccaggcaacaaaataaaagtggcagaaggtacgggtttgttcatttcaaaggaatagaggatgagcacaggatggagagacaactggacagtcttgtcatcgcaggcttgaagttatacgtcaatcttccacgcttcggacgacaggggggaggaaaggtaacttcaacagataaacaacatgagcaacagactatgaaggagcatgtagcgcatcgttatgtccccggaggagcaagaacaaaccaaacatcctacacggaggtagtagcgaggaaaaaaagtgcagcacacagctgcaaaggggggcgatcctcaatacacattgagccctcggaggaaatgctgaaatggctttccgacgcatgggttgggagattgacgaacccaacgacatttgatgaggtggaggatgaactgaggtgggatttcgaagtggacatctcaaccaattacctgggggacgacatgttcctactatttgggctagacgaagtaaaagcaggaaaactgattcaagaagctcgtcacggcaccgtccctctgttttattcaatgcaaaaatggacaccgagcctgcgtccaggctatagactagcctgggtccagtgttggggaattccgatcatagcttgggatgtggtgaccataaagaagattgcgggggtaatgagagaggtggtggaagttgacaacgaggccgacggacgacggtgtttggatagagctcgggtgttagtgaaaacaccatggcaacccgacatccagcataccatagaagttcatataggcgaagagatgtataacgtgcgcatactagaggagtgtggttacaacaccgacacagggcagaggagaagaagcagtggcacaccgtcctcggaggaagtcgactccgacggcagcttcatggggttgccgggctcgcaattactcaaggatccatcagacaaacaagaaccaatgggtaaaggcatggaccgccagacaaaaggggcgagtctggttctcaacgcaaagattaacgaagaaggtaaggaagcagaacgggcaacgggaaaatcgagggagtcaccaatcaagctcctctataaggaaagaacacaagagggggatgagatatgtgtcgggaacagtgaaaaggaaacagggcctgaaaaggggagagagtttgaaagtaggaatgggtatgaggaaggggaaagcagtaggcagcagggaaaatcacgtgaagataaagggggaaaagaaaatccaatggatacgggctttactagccacacccccctagaggcactataccccaagctgtaa

SEQ ID NO: 86062 - DNA, 207 bp, Glycine max
  Peptide Sequence Number=SeqID_202840
atggaagaagtacaggaagagaaagggaaaagaaattggaaaaatgataacataaaagtaggtaatgatggtgtggtgtgtgactcaaaatcacaaatggcacaaggtgtggtagttttgagagtggctgaaaacagagaggctgagaaatcaaagttgttgcagaaaaatagagagttcaatagagaaaaagagctaggagattga

SEQ ID NO: 86063 - DNA, 1455 bp, Glycine max
  Peptide Sequence Number=SeqID_202841
atggtgtctaagttgattaatatggaagaaagggataaggaagaggctcaaaggttgagaaatagggaggtgactaagaaggagcaattagataagactgtatgtcaagccttgtggggtgactcagatgttggttgggaattacagctagcatgcaatagtgctggaggattattatgcctctggagtgaacaaaccttcaaactggagaagaagttcaatggatgtggtttcatttatttagaaggcatttgggttgctgatggttcaaaagtaaatatagtgaacatctgtttgtcatgtgatgtggttctgaagagaaacttgtgggaacaaattagacagctgagaaatgcaaatttgggaggtttatggtgcatactaggtgactttaacaatatcagaagatcatcagaaagggtaggcctttgtcataggaggcaggatgagaggattgtgaaggaattcaatgactggattgcaggcgtagaggttgaagatgtgccttgtgtagggagaaaattcacctggtatagaccaaatgggacagctagaaaaaaaattaagagaattaagctgaggctgaaagcttggaacaaggaccagtttgaggacactcagaagatgttaagaagtattgagatggagttgaacaagctgaaaatggaaggggatgaaagacaactgaatgatcaagaattaaagttgcaaaaacaagtgcaggaggacttgtgggtagcgagatttgagaagtctgagtgggagagacctagattagatgagggaagctatgcttctttcttaacactgatccctaaggttcatgatccccagaacctcaatgagtatagacctatctcactaataggaggatggatttctgctctagatggattaattggaagccccttggctgagttcactcctcaaagaggacttagacaaggagatccactagccccacttctatttaatattgttgcaaaaggattaaatggtctgatgagagaagcaacagagaaaaatttgtttgaaggtttctcagttggaagaaataaggtggaactcagtctcttacagtatgtagatgatacgattttatttggggtagcatcgatgaaaaatgttagagcaatcaaggtgatattgaggagttttgagttggtatcagggctaaagattaactttgcaaaaagtagctttgggacgattgggatgtctgagcaatggatgaaaagtgttgcgagttatttaaattgtagattgttgtctgtacctttttcatacttgggtatcccgattggggaaaacctaagacatagtgcgacttgggatcctattggttccgaaaaaagtggtggacatgttggtgaggttacaatgatgattcttgtggggaggagacctggagcaaaagggtttgtgaatgagggacttgatgaaattcaactatga

SEQ ID NO: 86064 - DNA, 609 bp, Glycine max
  Peptide Sequence Number=SeqID_202842
atgctggagaagtggaatccgagcttgtggactggctacagattggtctgcatcctttgctggggaatcctattacacacatgggacctggagaacattaagagtatctcgtcggcggtaggggaagtggtggagctggatgataatgctgaagaacttaagcgtttggacagggcaagggtgttaatcaaaacaccatggcatcctacaattcaacatgcggtagcagttacaattaatggggaggagtacatggttcatatagtagaggagacatgctacaacccctgcaggtgcaaatgccttaaggggtgcctggtagggtcttcggataagatactctccgatgagagtgaatttctgacgagagctaagacagcagacgcagaaggacagcagaatggggctggttgcgagatgcaattgtctgatggacaatatctcttgtcaggacttgtgggtattacccttgggttattgacacgaggaccaaatcatctcaggtacagagatgaaagttatggccaaagcaaaatagacaagacagttttaggtggaaaacacaggcttacccaacagagacagggtggtggtatggtcacgaggtag

SEQ ID NO: 86065 - DNA, 303 bp, Glycine max
  Peptide Sequence Number=SeqID_202843
atgcagaccctgcaggatgtggttttgcatagacccattatgttagtggagcaatttttggagaaggtacctcaacaggtggaggatgcatcctctgaggccacagtcctcgagccatttgtttatgaggttgatgaggcaggcggaacacagatgagacaggagactgctactcttgagaggacaccacaggttacagcagatccaccctcactagtggtggatctatcttatcctcagcaggcagcagaccctcatactccagtgaatggatgccaaatgaccctgccacaccagttctga

SEQ ID NO: 86066 - DNA, 1884 bp, Glycine max
  Peptide Sequence Number=SeqID_202844
atgagagacagagagagacacagagagagaacgagagacacagaggcagaattaacgtgtgtgagagaaacactgagagtcacagtaagggaccgagagtggataacggtgaggaaccggaagagagagagacaacgtggatggcaacacccgaaggagggcctcggacaacgccatggcggacggcggcaacgcaggaccggagagcaacgtaactaccaccaagtaaactggcgtgacaaacctgatgtcacgacattttacttcaccagattcctggaggacgcatcggagcagcagctgtggtaccatttcaagcagatgggggacgtgagggaaatcttcatccctaaacaacgaaacaaagaaggaagaaggtatgggttcatgaggtataaaggaatctcaagcgtgagctacatggaaagaaaattagataacatgattgttgggggtctcaagttgcacgtgagcatcccaaagtatgggagaggaaagaaggaaaaagaatcaaccgcggccaaacaaaaggggtataaggtgggtgatattccgcggtgcaacatggcaccagagcaaaattcgaagagatcgtacgcgaaggtcgtcacctcacacgtagagaacaaggaaagaagaagcggtaccttccccttgacgatggcacgtgggagaacccattctcaccttagacttgagatttcggaggagacaaagaaaagatacgcacatacctgggtaggaagattgaagagaccgcaggtgttcgaacgggttgaggaagaactctcgtggacccttggcgcagaagtatcattgaaatactttggagatgacctggttctccttatcgggctctccgatacaaaggcccaggacctgatgaacgaagaatccaatcacggcacaactgcgttttacgaattgaagaaatggaacccgaaaaccaaaccaggcaacagattgatttgggtgcaatgctggggtatccctttagtggcatggagtattgaacaaatgcgcaaaatagtggctgaattgggtgacttggtcgatgtcgacgacaacttcgaagacatgcaaaggcttgacagagctcgggttctggtcagaaccccatggacgccgacagtagagcacaacgtcacagcccatatagatggtgtcgaccacacaatctcaatcgtggaggagcactgtaacgcgggagtagcttgtgcaaggcatcatcggagcgtgtgggggtcattggaggaaatcctttccgacgtggacgataccggcaccttgcaatcgtggccgaccgatagctcaccgctttccaccgccttcatcatgcatggcgacaactcattccggcaaagcttggcaaaacccaatggtcaaaccggcacggatagtccactgggtattacccgtagcagaaaggatcatggcctgggtaaagctattaccccctcaacggctgaaaatggaaaggagatatacctcgaagatggcaacctggacttaccagcagaagaaatcgtggaattggaaagtcaattcgtaggggcagaacgacaggttatgcaaaaagggaaagtttgccctcaacatctactggccaccacaggggagaatcaaaacggggagtttcataccttggaccaaggacttgtgggggagaattttcaaatatacagcaacgggtctctggagaagctttttaataagtcacgtgacactgtggatttatttgggcctaatcataatatgggccttcatagacctacaaccccaatgaaccaggaaatcactccgcagaaaaaacctgcaaatactttgcagaaaaacccagcaatcacaaccacaatgctgcctcatgcacttcgaaagaagtaa

SEQ ID NO: 86067 - DNA, 324 bp, Glycine max
  Peptide Sequence Number=SeqID_202845
atggagaccagttctgatggcacaaaaaaggaaattgtgggtgccaccactgcatcgtatatgccctcaattgatgacattggctcctttatttctgtttcatgcgagcctgtccgaagcgattgggctcgtggacccatggttttgtctgaaaaaattgggcctataatacctgattttttggacttgactctcgaggatgttggtgtgtgcattgaaataatctatactcctgtgcgcaaagatggaatcagaggaagcccgaagagcatagtgtctgatctgatttctcctggtaagatttttttcccccctcctccttaa

SEQ ID NO: 86068 - DNA, 438 bp, Glycine max
  Peptide Sequence Number=SeqID_202846
atggaacttgtaattcctgactgttgtgaagacagagagcttataccattgagaaaatattttggtggacatgaaggggttggagagtatatttggtatcagacaaagcataaacttgaaggatctgaactactagatatatctaatgcttctgatgttgtaatatgtgggacggagctaacatataaaccattacttaaagatgttggagattatttggctctgtattgggtgcctactcgtgcagatggaaaatgtggggagccattgattgcaatctgcagtaccccagtttcccctggtagctctatatgtgtgcacagcttggcacctatacatcttatgcagggtgtgctcactgtgaatattttggtggacatgaaggagaaagtctctttagctggtatagagaaaataatgaaggaaccattgaactga

SEQ ID NO: 86069 - DNA, 375 bp, Glycine max
  Peptide Sequence Number=SeqID_202847
atggtggtggcaagaaacaccaggaactcaaggcaaaggtggacacaagacaatgagccttacagtcgtgaaggttcactctcattggtacaccttgatatcccaatggacgagaagaagtggttcagcgatgcttgggtggggcgattgaagaacttggtgctgtttgatagagttgaagacgaactatcgtgggatataggagcagacatagcatcaaagtacataggggatgatttggttcttctacttggcctcactgatgcaatcaaatccagccacatagaagagatgattgggtctggaaagcaaacccaatgcttacaatctgttgatgggggaaacaatagaggagacaaaggatggaacttttga

SEQ ID NO: 86070 - DNA, 759 bp, Glycine max
  Peptide Sequence Number=SeqID_202848
atggaggaggtaattagcaaatatagaagtggctccatgtgcacccatattcttaagtgtcaaacattgaaagaaattatggggaaaatacatggtggtgtgttgcttcttctattggtgatcataggagtggcagattgccgaaaagtgaaagaagtatttgttgacattgaagaaggtgatgatcatggaggtgctagtattggatttagtggagtttttgaggaatgtggaggaggaggaagtaatggaggcagcaccacttgccatagccaaggtggtggtggtggtggtgtcgaagggggtgctggtcatgttggaggcaacaaaacaatcattggttttggaggagaagttgtttttggtggaggaaatggtggtggcattgggggaggagttgaaggtggagcagctatagggcatggaggtgctgatggagttggaggtggtgctgctttagggtttggaggtgctgatggagttggaggtggtgctgctttagggcatggaggtgctggtcatggagttggaggtggtgctgctttagggcatggaggtgctgatggagttggaggtggtgctgctttagggtttggaggtgctgatggagttggaggtggtgctgctttagggcatggaggtgctggtcatggagttggaggtggtgctgctttagggcatggaggtgctggtggagttggaggtgctgctgctttagggtttggaggtgctgctgctggctttggaggtcatccataa

SEQ ID NO: 86071 - DNA, 1496 bp, Glycine max
  Peptide Sequence Number=SeqID_202849
ttcttcaaccattcgagctttctgccatggacgatccatatgatccttacatcatgaacaatgctaatagtcctggtctgattctcgtatcaaagcctctcacattggagaattggaactcatggaaacgagcaatgctcatggctcttggtagaagaaacaaactcgaatttgttgatggaacaattcctccacctgatcctaaagatcctttgcatcatgcgtggctccgtaacaacaacattgttgcatcatggctcatgaattccatttcaaaagaagttgttgtgagtgtcacatattcctcaaatgcagcagcaatatggaaggatcttgaggatcgcttccagcaaaacaatggacctcgcatccttcaactcaaacaactcagtgagtacaagcctgtacatcactgtcactgtggtggtgttcaaccactcttagatcactttcattttgagtatgtcctcacatttctgctaggcctcaatgaaagttacaatccgattcgtggccagattctcaccatggatccattttcctccattcaacgtgctttctctctggtgattcaaaaagaaaagcagcgggaggtaggtaatgtgcaaactcccttggattcacaattggcatgtgttgttcaaggctctcagaattcaaaatctggcaacaagaaggacaaaggtcatccactctgcacacattgcggtctccttgggcacaccaaggacaagtgcttcaagattattaaatatcctccaggtcacaagaagcacaagagcacggttaatcttgtcaatgacaatcaaggagagtcttcaaactctttcaacatcgcccaatgccaacaactgctgaatttcatacagagtcagatggctcgggcaatgaattcagagacatcacagtcggatcagtcaaatcttggtatgatcttttcaactcatgccactatccctgctcaaagacataagttcactcctcgggccattaaatgtgtgttccttaggtatctgtttggttacaaaggatacaagctctatgatttagacaatcataaattccttatatctagagatgtgactttccaggaaaatagctttccttttgccacaagcacatatacaacatctgatatgtttccaaaccttgttgtactcagaccttttcttgacatgcttcctaatccaaaccccactcctcaaccaccacctgaacctaaaccacaacttgagatagaaccagaccttgcccaacctgatgttctacccaatgcacatgtgagcaggtcaaccaaagtcattagaccacctactcatcttcatgactatgtctctaatgtcacttaccccatccagaatcacctcacgtacaacaacctttctccaacttacagagactatgtgtttaaagtctcaaaaatttatgagcctcagttctatcatcaagcaattcgatttgctgaatggagtcaagccatgaatgaggagatttag

SEQ ID NO: 86072 - DNA, 348 bp, Glycine max
  Peptide Sequence Number=SeqID_202850
atgacattgctacttagcaatatttatgccaatgaccaatttgtcgatctcccctgcagaatatcagttggtctgtgccgtcatgacataggcctttgtcagttctacggagtgcccgtcgcccccagtaaggtcatcaggcctcctgctaaccaagctttcatcaagaagtattgcgcccccaggcaggcgcatggcgagacacaacagcagccagggaatggccaacagcgggcaacagatgcaccgtcgccacctccagagcccctcagcccatctacaaaggctggagcattgcctacgacccgtggccgactagcaggcgaccaagtccaaagccaaaggtaa

SEQ ID NO: 86073 - DNA, 279 bp, Glycine max
  Peptide Sequence Number=SeqID_202851
atgtacaaagataagtggacccaaccttggcccatgggctcagaaatctaccctgaggttcatgagaaccctcgggccttcttcagcagctctagcctaatcctcttggagcctcttgctcatggctctggtaactggtcccttcctagggaggattgcatcaggtcgatctctacacttggatgtcatgtgtccaatcttaccacaaaaataacagacaatggtgtcctcattatgaacatagatctcaccatcatatccatttccaaacttatctga

SEQ ID NO: 86074 - DNA, 225 bp, Glycine max
  Peptide Sequence Number=SeqID_202852
atggtgaagggcatggaaatggtgatgaagaagaagaggaagaggaggagggtggttttgatttggagtgcagctatgcaattgtacagaggaatccaaaacaataaggccaaaatgagacttcaggaactgagaaagaagctcaacagtgttagggaatctaagcaatcagcaatagaagctactaaagttgtgaaggaagaaaggagtacaaaacaacagtga

SEQ ID NO: 86075 - DNA, 800 bp, Glycine max
  Peptide Sequence Number=SeqID_202853
atggggacgacgaagaacaacaacaacaacttcaattctacctcaaaatctgataacagtgccaatgacaacaaaaacaacacacgtgtggtgttgaatgtctacgacctcacccctctcaacaattacctttattggtttgggtttggaatctttcactccggcattgaagtgcacggtaaggagtatggatttggagcccatgacttccccgccagtggagtatttgaagtggagccaaggaagtgccctggatttgtgtacagatgttctgttactttaggccaagtaaatatgcatccttctgagtttcggacatttattgagggtatagctaatgagtatcatggggatacctatcaccttatttctaagaactgcaatcattttacggatgatatgtctcatagattgagtggaaaacggattccaggttgggtgaatcggcttgctaaactagttgttgaagtaactaccgttaaacagctaccagaatatcatgaatgttcagaagatgaaattacagaatgtctttcgactgcctcgccgtgtggatctcaatcaacatcgggattggatgatgatcaagaaaagcgccttctgtcacctctggctaggatgcctcgtgcccgaaaatttctcatttttcaatggctttctgcattccttggttccattgtcttaagggtttttatttctggagggattgttggagctcttagccatgattggggaactcgtgttgacctaaggtacatttcattgccagtctcgctggcattgtcgctgttgggttcgag

SEQ ID NO: 86076 - DNA, 915 bp, Glycine max
  Peptide Sequence Number=SeqID_202854
atggcgaggacgtgtagtcctctgaaggcgaggacgtatagtcctctgaaggcgaggacatgtagtcctctaatggtgagggcgtgtagccctctgaaggtgaaggtgagggcgtgcagccctctgatggcgaggacgtgtagtcctctaaaggcgaggacgtgtagtcctctgaaggcgaggacatgtagtcctctaaaggcgagggcgtgtagccctctcaaggcgaggacatgtagtcctctaaaggtgagggcgtgcagccctctgatggtgaggacgtgtagtcctctgaaggtgaggacgtgcagccctctggaggtgaggatgtgtagtcctctgaaggcgagggtgtgtatccctctgaaggtgaggatgcgtagtcctctgaaggtgaagacttgtagtcctctggaggtgaggacatgtagtcctctgaaggcaagggcatgcagccctctaaaggcaagggcatgtagccctctgaaggtgaggttgcgtagtcctctgaaggcgaggacgtgtagtcctctagaggtgagggcgtgcaaccctctgatggcgaggacatgtagtcctctgaaggcgaggacatatagtcctctgaaggcgaggacatgtagtcctctaaaggtgagggcgtgtagccctctgaaggtgagggtactagtacccaaggcgagggcgtgtagccctctcaaggcgaggacgtgtagtcctctggaggtgagggcgtgcagccttctgatggcgaggacgtgtagtcatctcaaggtgaggacgtgtagtattctgatggtgagggcgtgcaaccctctgttggcgaggacgtgtagccctctgaaggtgagggtactagtactcgaggcgagggcatgtagccctctcaaggcgaggacgtgtagtcctctggag

SEQ ID NO: 86077 - DNA, 492 bp, Glycine max
  Peptide Sequence Number=SeqID_202855
atgtcttgtcgatattatcaatgggagtctaatttggatgacctgctaattcaattcaaagatactgtagattcaatgcaacaagcctttaaaagaactgaaactaagattggcaagttggtagatgacatgactaaagtcgtggtcagaagagaagaagagtatgcaaagattgaagcacatcaagaaagaattcttcaagttaccacaatccatcatcaattgatcaacgaagaagaaaaggatgaagtctccagtactccagaatatccttgcatggcaactgttggctatgttgtagggatagataaaggtcgattggaactcagtgtggaggataagaaaatctcttttgacctctttgaagccatgaaacactcatatatgggtgatgcctattttgaagaagaagaggtggagcaggaaataacatcatcagcttcaaccatgatactacagattcctttggaaaaagagctagttatgtggtag

SEQ ID NO: 86078 - DNA, 368 bp, Glycine max
  Peptide Sequence Number=SeqID_202856
ccaactccgagccttgcctcagatatgccactgaagggcaagcagttggtgatatacccctgcaaaacactttggagggccctcagtatcacccacaaccacacccctttcattccacagcgattaaaaatcctcatgctatggcggaaatgggaaaggtgccagactttgacgagtacaaggggactacttgccccaagaaccatctgaagatgtattgtcggaaggtgggggcatgcgcaaaagatgagaaagtgttgatacatttttcccaagaaagtcttactgggacaactgttacctggtatactaacttaggaaccttcccgagtccattcttggaaggacctaatggtttccttcgttag

SEQ ID NO: 86079 - DNA, 108 bp, Glycine max
  Peptide Sequence Number=SeqID_202857
atgtcaaaagggggaacttaccggttgaagactgaagatcggtttacaatctttgcgaaatcacccacggaaacgtctcggaagcattacggaagcgcctcggcttga

SEQ ID NO: 86080 - DNA, 168 bp, Glycine max
  Peptide Sequence Number=SeqID_202858
atggcttcagaggtgaggagctctacatcatcacttattgatcctaatgtgatagccaaggctatcaagaagcattttagggtctatttgatgcccaatgaccaacttgtctggaggaagccttatcccaaatggatagacaagatgacacctttgttaaggggttaa

SEQ ID NO: 86081 - DNA, 360 bp, Glycine max
  Peptide Sequence Number=SeqID_202859
atggttttggaaataaattttggcagagaagtggaaaaattgcaaaacacagtgttcaacaaagagaaaccatacattggtaggccatcctcaagaggagaattacaaattatagatggtattgacaatggtgatgatattggtagtggtgagggtattataggagatgaggaaggtatcgtggatgcaacaatcggggatggagaaaatgtgagtgcaagtataaaaatgagaatgggtgcaatatatggttgtctttgggaaggtattggtgcaatagttggtaggatttggaaaggtattggtgtaatagttggtttgggaaggtatcagggcaacacttggggatggggtagatga

SEQ ID NO: 86082 - DNA, 636 bp, Glycine max
  Peptide Sequence Number=SeqID_202860
atggccagagaaggtggcggcacgtggcagctccgatggcgccgaagaaaggtgggcttgaccgacgatgaagagacgagtctgatggtgctagcagtgacagcttctgcacagcgaaatatggttcaccggataagaacactcgccggaaaagttgctggaaaacagaaacagttcgccggaagaagggcaacgagtggaatggagagcgaggaggttggtcctggtgccgttgagctcctgaatccggcgcgcgtcgtggaccaaatcggcgtcgaggaggcgaatggtgtccttaaggtgtcgaatctgctcgcagccctggaggatcttcgcatcaagcttctcctgcagcgcgagattctccgccacgttggcgaaggggcatgcagcgcggaacgtggcgccgtcctcgaggcggaagtcctccttgaagtagagcgccgggacctcgcggaggcacgccaccagcgcctcgccctggccgccgccgccggagccggtggagttggtggcggcatcggcggaggcattgatctgttcgttggaggcgtggttgcggatgtcctcgaagcggtggaaggcgtcggagataggggagaggtaggggaggaagtcggatcgggagacatctga

SEQ ID NO: 86083 - DNA, 1110 bp, Glycine max
  Peptide Sequence Number=SeqID_202861
atggattccccaccttcccaacacacgtggggaaggtcaacaacctccctttcctcttctctttccaaatcgaattctgattcaatccaaagcttgtcttcgattttgaacaaccctcacgctgccgacgccgcctcctgggccggctggtggtcctcctcatcctccgccgtcgccgtcgccgtccccgaattcgccatcatccccgcctccaaggccgcctcagatgtctcccgatccgacttcctcccctacctctcccctatctccgacgccttccaccgcttcgaggacatccgcaaccacgcctccaacgaacagatcaatgcctccgccgatgccgccaccaactccaccggctccggcggcggcggccagggcgaggcgctggtggcgtgcctccgcgaggtcccggcgctctacttcaaggaggacttccgcctcgaggacggcgccacgttccgcgctgcatgccccttcgccaacgtggcggagaatctcgcgctgcaggagaagctctcgcactacctcgacgtcgtggagctccacctcgtgaaggagatctcgctccggtcatcgtcgttcttcgaggcgcaggggcagctgcaggaccttgatgcgaagatcctccagggctgcgagcagattcgacaccttaaggacaccattcgcctcctcgacgccgatttggtccacgacgcgcgccggattcaggagctcaacggcaccaggaccaacctcctcgctctcctgcagaaactcaggcttatattttacgtcaaccaggccctctccgctctcaaattgcttgttgcgtctgcagattgtgctggagcactagatgtgactgatgatttgcaacatttgctggatggagatgagctctctggtctgcattgctttcgtcatcttagagatcatgtaataggctttatagaatccataaacagcattctttccgcagagtttattcgagcttccttaaacgatgctgctgaaaaagatgtgataattttatccaaagctaaagcaagagcttcccttccaatgaatggaaaggatgatgaagctccagttacattttctgctttggacatggctcagagctag

SEQ ID NO: 86084 - DNA, 732 bp, Glycine max
  Peptide Sequence Number=SeqID_202862
atgacatggtttcccaccaaatgggttgtactttactgcagtgaaagaaaagatggaatgcatcctcttcttgggttctggaaagaggacatagtgtatctggttcctaagaaggtggtcgacaagctagctcgcattcagagaaagttcttatgggaaggagcgcttgaccataacaagatagcctgggtcaagtgggacatagtgtgtctcccaaaagacagaggggggctggggatcaaagacgtaaacaccttcaatctcgcactactcgcaaaatggaagtggcatcttttccagcaccaagggcaactgtgggctagggtattggaatccaaatacggcggctggaggggtctagatgtggtaaccacaggcagcaaagaatccatttggtggaaggatttgaagttggcatcccatcatccggagaacggagaagcattacagaggagcacagtctggagggtcggatgcggggacaaaattaagttctgggaaaataattggataggtgatagcggtgcattagcagcaaaataccctagattgtacctcatatctagtcagcaaaatcacactattcagcagatgcgggtccataacgactcagggtgggagtggcagttcacgtggagaagattgttgtttgataatgagatagacatggctactacatttctaaaagatatagaaacccagcaaattcagccacaaaggtcagatgggtag

SEQ ID NO: 86085 - DNA, 1167 bp, Glycine max
  Peptide Sequence Number=SeqID_202863
atgccaaacgctaaacctattgcgcaacagacactgctgacccacgaccagcgccacgaacagggtgccgtaacgccaccgatttatcagtcttcgctgtttaccttcagcgattacgacagcatgatcgcccgctttcgcggtgagagcgaccagccgctctattcccgcgttgataatccgacggtcaaagcgctacaggataaagttgccgcgctggaaggcggtgacgcctgcctcgcctttgccagcggcatggccgccatcagcaacgcgattttgagtgtggttcagccaggcgcgaaagtggtctgcgttaatcatgtctatcccgatacttaccgttttttgcgcggcttttgtcagcgtttcggcatcacgacgcagtttgttgatggcgatgatgaagcggcgatggccgccgcgctgcccggtgccagcctgctctatctggaaagtccctccagctgggtgatgagtgaacagaacctgcggcagctggccacgctggcgcgcgatgcgggcgtcgtcacgttgattgataacagctgggcttcgcccattttccagcagccgttactgtgtggtatcgacatcgtggtgcactccgcctcgaagtacatcagcggccacagcgatgtggtggccggcctggtgattgccagccaccagcacatcaacaacattgcccgtcacattagcccgttccttggcggcaaactgtctgcgaacgaagcgtctttgctgatgcgtggcctgcgcacgctgccgctgcgcatgaagcagcatcagcacagcgccctgcagctggcggaaaagctgcgtgatcatccgcaggtcagcgcggtttgccaccccgggctcaatccccctacatggtccacgctgcgcggttacagcgggctgttttcctttgccgtgaccgaacaggtcgacataccgcaattctgcaacgccctgcaactgttccacatgggcgtcagctggggaggtttcgagagcctggtgatgccggcgatttcggttattaatcaggccagtgaatttaattcagcccaggattttggtgtctcgccgcgcctgatccgtatctctgttggcctcgaagagaccgacgatctttggaccgatctgaatcaggcacttgctgccgccactcaccgttaa

SEQ ID NO: 86086 - DNA, 879 bp, Glycine max
  Peptide Sequence Number=SeqID_202864
atggctgtcgcgggcgcggatggcgttaaacagttcacgcggattaccggcggcgcggtaaatgctggtgtggaaagcccaatcctccggcccggcggaaccgatagccaggtgcacacgctccatctcttccagccgccgttcgatttccagcaggtcgtcggcgctggcgcgctgcgcggccagcacgcaggattcggactcaatgatgcggcgcacttccagcgcatgaagcatgttggcggagtcgtttttaaagcgcagagagagaaagctgtcatgcagaccgacctctgcctgcagaaaggtgccgctgccttttttgcgcacaatgatgccgagtgcttcccagcgcttgagcgcctcgcgcaccgtattacggctgacgcccagtttctccgccagctcgcgttccggcggcaggcgactgcccggctgcgcgccggcatgcgccatgtagcgcgtgagcgcatcaagaatcagcgtatcgctgcgcgtgggaataatgggatggagttcagccgggtcatgcatcgctttgccttaattgggtgcaccgtggtgtggcggtactcagccgttgcccagggaacgatagtggtgcgcgaccaggcaaatcagcagcaggatgttgctgcacttagccgcgacaccgagcacgctaatgacagcatcagcccgattttcgacaaagagaaggagcagaaacgcctgcagacggctcagctgctcggtgaatcaggcagccaggtcgctgatatcgcccggacgcaggggcagattgaggcgacggaagcaggtaagaaggaactggcaaaaaacaacataaaccagccggatgccgacgctcctgcggctaaaaagaaagcgtatcagtaa

SEQ ID NO: 86087 - DNA, 930 bp, Glycine max
  Peptide Sequence Number=SeqID_202865
atgtcctcactttcagatggctacacgtcctcgatttcagagagctacacgtccacaccttcaaaggactacacgtcctcgccttcagagggctacacgccctcgcctctagaggcttgcacgtcctcaccttcaaaggactacacgtcctccaccttcagagggctacacatcctcgccttcagaggactacacgtcctcaccttcaaaagaatacacgtcctcgccttcagagggctacacgccctcgatatcagaggactacaagtcctcaccttcagagggctgcacgccctcaccttcagaggactacaattcttcgcctttagaggactacacatcctcacctttagagggttgcacgccctcgccttcagaggactgcacatcctcgccttcagagggctacatgcccttgccttcagaggactacacgtcctcgcctttagagggctacacaccctcgccttcagagggctacacgtcttcgccttcagaggactacacgtcctcacctttagagggttacacaccctcgcctttagaggactacacgccctcgccataagaggactacacgtccccaccttcagtggactacaagtcctcaccttcagagggctgcacgccctcaccttcagaggactacacgtctttgccttcagagggctacatgcccttgccttcagaggactacacttcctcgcctttagagggctacacaccctcgccttcagagggctacacgtcctcggcttcagagagctacatgtcctcgcctttagaggactacacgtcctcgccttcagagggctacacaccctcgccataagaggactacacgtccccaccttcagtggactacaagtcctcacctttagagggttacacgccctcacctttagaggactacacgtcctcgccttcaga

SEQ ID NO: 86088 - DNA, 447 bp, Glycine max
  Peptide Sequence Number=SeqID_202866
atgcctaagttcataacctctgtctcctctaggtgtggcttcacctccctttcttcttgctccactattctcctcaaatctgggggaagcccccaatgctcgatagagtgccctagagcaaggatggtagcagttcctccttgggttagtatttgtattggggttgggatttacacttggtctgggctgtgtagggaagggattttgtgggtggtgttggggaggtctttgtggttgattgggcatgctcggtcagacgggcgtcgggcaagggggagacccgatgttgaccgagtaattgtattggtgtgggggatattgatacatgtggttgtgaggggtttgttgggaatttggccatgtgggtgctgtggttatagcatgggcgtctccctcctttttctttacgccacctgttctagtcctcttattgctagcacttgttga

SEQ ID NO: 86089 - DNA, 1419 bp, Glycine max
  Peptide Sequence Number=SeqID_202867
atgggagcagtgttaacgcatgaagggcatcccattgctttcttcagcaagaagttttgccccaaactgctaaattcgtccatatacgtttgcgaattagcagctatcaccaccgtcgtcaagaagtggcaccagtacttcctagggcaccacttcgtcatcttaactgatcatcaaagcttgcgtgaacttatgaatcaagcagtgcagaccctggaacaacaccgatacctggctcgtttgctaggttttgactacacaatacaatatcgctccggcaaaaccaacgtggtggcagatgcattgtctcgtgtccaagatgaccaaactacattcctataccttttgttaatgcctcaattcatctttctggaagacctttgtaaggaacttgcatccttactggcattcatagagttacgaaagcaaattcaagcgaagcccacagcctaccacgactacacgttgacacccgagttcatactgcacaaggggcgcatatggctgccatcgaactcttctttcatcaagttattacttgaagaatttcaccaatcacctaccggcgggcatatggggttgcagaaaaccttacaacgtttgcaggacaacttcaggtggagttcgataagagaatatgtatgtgctttcatcacaagttgtttaacttgccaacacactaaatatgataaccagagagcggcaagtttactttgccctcttccagttccagcacaaccgtgggaggacctatcaatggacttcatcatgggactactagcttatcgcggaaatacttgcatcttcatggtcgttgatcgcttttcaaagggattacacttgggcatgctacccactcatcatactgctcacgcggtggctgctcttttcatggaaatgacttcagccgtcggcaacacttattctaaactggccaaatgctactatggaccgttccaagtcacagagctcatgggcaaggtcgcttacaagctgcaattaccagaacattcgcgcattcatcatgtttttcattcatccctcctcaagccatatattgcccctacaaccccgacggacgtcgctgagcttccacccatggccattgataaccatcctgtcgtcacccctttagccatcgtggcatccaaaataattccctccgagtcaggaccaaaacatatggtactagtgcaatggagaggccttccgccgaaagaaaccttttgggaagaatggcagacctttaagacacttcaccaccttgaggacaaggtgttgtttgatgggcacgggagtgatatgaagacaactgaggagctacaattagcaagggaggtgcaggaagaaagtgaagcaaggcccaaaagaaagaaagcaataccgctatacctggaagactacgtacgcagcctataa

SEQ ID NO: 86090 - DNA, 570 bp, Glycine max
  Peptide Sequence Number=SeqID_202868
atgaatagcacaagttttcaaggtttagaaaaccagaaaactttggaaagcttttggttcactcacgctaagtcatgcttatggcttagcgagaaaagaagttctgggcaaagtgttctggaaaatttttggtacgaactcactaaaccaccatcacgcgctcagcctcaggagggggagcctgcgggggactcctctcggttctcctcagagattgtgtggcacatgtaccaggacaacgttcacctctggaacatccttccagagaggaacgtggagctcgcccccactatgtttgacgagttttatggggagctccagcaccaacagtggcatcacaagctcacatgccttctagaaaaaaggatcaacgtggctctagtatacgagttctacacaaacgcttacaacccagaggacggctcacccaaatattgcagggtccaggagcaggtcattcaattcgacgttgagacgttgaacgactttttggagacccccgtcatcatcctagagggggaggagtaccccacctactcccagtacctacatagctaccctaaccactag

SEQ ID NO: 86091 - DNA, 699 bp, Glycine max
  Peptide Sequence Number=SeqID_202869
atggaagggccagcccttgcatgctttcaatggatgcagtgcaaagcgcagctctcttcatggcccacatttcttcacgctatccattctcattttgcttcttctacatatgaagatcctacaagtttgctttgcaaattacatcaacgatcatcagtaagcgcttatttgtctgagtttgaatccctggcaaaccgtatcgtgggattgccgacaccatttatgctgagttgtttcatctcggggttaagtccggttattcggcgagaggaagaaaagctcatggatgctcgtcggccaccaccatattgccttccaacgaccaccgcgacaaccatagccactcgatcgccttcaccctaccctactctacctctgttacctacacctcaacgcactacaaccacttccattccttttaaatgccttacactggaagagctcgcggtccgccatgaaaagggactgtgtttccactacgacgagaaattctctcgaggtcacaagtgttcatcttcgttgtttctcttcgtaacaaaagatgaagagcttacaccgcaattagccccaccatgttcaccgtcaccaacacatgatttacttcctgaacctcctccggcacagctcagtttacacgccctgtctggccattcagcacctgaaactttacccgtgcaagggttcattggtgatttttcg

SEQ ID NO: 86092 - DNA, 411 bp, Glycine max
  Peptide Sequence Number=SeqID_202870
atgtacaaattcatgatactcatcttactgtaccggatttgtggaatcatggtcaatggaacttgcaacagctctacacgcctctacctgatacggtgcgaaactccattattgaggcacctataccaactcaacctactgggaacgatgttactgcttggttggggaacaatcaggggctttatacagcattctcaacctataaatggtatcttcatcaacctgaatcttcccatctcgtttggaagaaaatctggcgtcttgcaacgccggaaaagatccagttctttatttgccaaacctttcgacctgccttgccaaccaatagcaagcgttatgcttgtcatttatctcccactgctgcatgcccacggtgttatgcacaagaggagactatcttccatgctttga

SEQ ID NO: 86093 - DNA, 210 bp, Glycine max
  Peptide Sequence Number=SeqID_202871
atggaagctttcttgagaagcttatatggaggttggatctttgagcttcaccaaggtccttcaatagtgattttcagtcatggagttgcaatagaagataagaggagaagaggagagaagaggcgccatccactaaggaataagccgtggaagaagaagcttcaccaccaagagagtgtcttggataagaagcttagagaggaagcttaa

SEQ ID NO: 86094 - DNA, 450 bp, Glycine max
  Peptide Sequence Number=SeqID_202872
atggcttccactccttcgaatttcctttctcagtcatttccaaacttcatcactcagaagcttgatgactcaaactatctccattggcgacagcatgtagaatcggtcatcaaatcacataaattgcagcatttgatcatcaatcccgttcttctgcctcgttatctcatggaggatgatcgcattcctgatactggttcatatggtcgtggtggttttcctaaccgcagtgttagatgcggtggtggtggctccagcagaggtcgtggtggtgtcaccttctttgattctaccacacttcaaccaattccctactccactggttcaatcagagcttctaatacctggattaatcctaattctaaggttgttgttccagcatccaatcaacctagtgctctgatcacaaattcctcctctcatgggaatggtcctactagctccacctag

SEQ ID NO: 86095 - DNA, 1669 bp, Glycine max
  Peptide Sequence Number=SeqID_202873
atgacccccagcggcgtgcgtatcaacgacagcgcacagttgcccctgaatacgcactgggcggcacaggccgctggccgcgacgttatttacggcatccggccggaaaacatcagtctggcgcagccgggtgagcagcatgcgctgcctcttgaagtgtcgctggtggagccgaccggcctgtccgaactgattcacgcgaacgtgcgatgctgttcgacgccgcatcacagcgccgcctgtaattgcacgtttaagcggtcaaaacgaccagcgcaccccggcattgtagcgccagcctttgacgccgttgccggcaatctctttgcgataatccgcctcggcatacagcgccacgttgttgataagggtcgccgtgccgccgaggccgacgtcccacatctggccaaatttgccgctgctgaagctctggctcaggtcgctgtcgctggtgccgaccctgacctgcgccgtaccgccccagccgcgatagtagttagcgcgcagatacggcgtgtactggttctgactgctgtcctgccagctgcgcgccacgcgcgcgccgagccggccaatggcgcacatcacccgccagcatcagcggatagccagactcgactgacgccgtccagccgtgccctttgggtttggcgaccgctttctgccgcgcaatgtcggtttcgccacgctggtggagctgtaaccgtcagcggcatgcgggcgaatgcgcgtgttgccgcgcgtataggcgacgccgccacgtacgctatcttcagcgccatcggcgcgcagcaaattgccgccgagctgtacggcgctgtagttgaggtcgaaatcataaccccaggcgtccagcccgcgattgcttcgatactgcaaatccgaaccgaggtagcggataaacatctctgcgctgtccgccggctgctggcgcagttcgccgagacgcttatgcagatcgtcagtgactgccaacgagtagtacgccagcccgaccggtgcggagatccaggacggcacctgcggcgtgaccgccggacgcaccgccttaaccgcactgcccgcctgcggctggcacagcgagccatcgctgcagatgaagttgtttgccagacgatagtcccatgcgttgccgcctgcgctgctgcccggtgcaaagctgtacagaccatactgccacggcccggctgccacatagccattgctcagcctgaagctgtcggcgctggcgctgccggtggtaccgctggcgttaccgttaacaagcagcacgtcgctgtgggtggctgtcgaattgagtttcaggcggccctgcgcggaggccagactaccttcgatggtcagggtatttgccgccacattgccaccgttggtcaggtcgagcgtgccggcattattcactaccagcgaatcattgctggccccctgcagccgcgcgttgacgccatcgccggcgaacagcgtggatccggcatcgatattgatggtgctgtgcgccagtttaatgttgtcgctcagcgtccactgcgtatcgatgaagttcagcgtgctccagcccgcgccgaggttggtgcctttggtgagatcgtcctgccggaacgaaccgccgcgcgcattgagctggctgaggttcagcgtgctatccgcgccgccgctggtgatatggcgg

SEQ ID NO: 86096 - DNA, 1350 bp, Glycine max
  Peptide Sequence Number=SeqID_202874
atggcgataaaggaaaatggcaaattgcgcgcaatctatattaaagacaatgagattgctctgattaaccagtggttacaggagaagtacggcgatggcatccgcgtagtgaataaaggcgcgtcctcatcgcaggccatggacctgttaaatggaaaatatttctataagaataataaaagctggcgcgaagagatgaagaaatcgccggcaaaaatcattttgctgaatttcgccaccaacgatgcacgccatttccatttccgcgatatagaaaaggattaccaggagccgcacccgatttgtggccgcgcggagaaatggcacgttgcgccttacgtcaccaaactggacgcgctggctaaagcggagtcggtgccgctggcgcgtcagtatcagcgcatcctgcagatgaaagactggcagtcgctgatgtcacccgattgtattcatccgtccgaacagctgtaccgcatgaaagcagaggaaacgttttcggtgctggtctcccactttaataccgagctggctgctgccgggcatggcaaaaacccggatggcgagcagtgtccgcagttgctggatacggtggcaacaatgcttcatcaggagtggtccgggttttctcactggcgcgaccggagcgccattcgtcagcgcctgctgatgcgcaacgcgcagccggcaaaaacgtttacgctggtcgcgttgaatgcagaaaatgaagtgcttgccaccgccagcacgattcttcacgagcttgatgacatccatgaacgccagttctggatgggcgaagtactgactgtcgcggcacaccgcggtaaaggcgtggcctctgctctggtattgcgtttaattgaagaagctcgccagcgccacatgccagagttgtggctgtatacgccggatcagcaggcattttaccgtcgctatggctggcaggaaatcgagcagcgcatcgtgtcgtcagaacagatgttggtacgtaaaaactatccagaactgggcgaagtaaaagcgccttacgtgcacgccgtgaagcatggcgacacactttacgtttcgggtctgactgccttcgcaacaacggcgcagcaggcggatattactgcgcaggcagaagtgatttttcagcagctacatacactggctgcgcaggaaaacacatcactgaaaaacctgataaaagtgacaatctttgtcacctcattcaccgatataaatgctttgcgcgacgtgctttaccggcattatggcgaacacctgcccgccagttcactggtgcagattagccagctgttttgccccgatctgaaaatcgaaattgaagcaattattgctctgtga

SEQ ID NO: 86097 - DNA, 675 bp, Glycine max
  Peptide Sequence Number=SeqID_202875
tttgccgcacccgacgcgggattgattgtctcgttactgccacagtttattcatgtgcgtggcgcatcgcgcctgaccacgctggtgcagctggtcagggatgagtgccgtgcacagcgtccggcacggcagatcgtgctggaacgtttgctggaattactgctgatcgaggcgctgcgcgcaatgcccgcggcgaatgcatcgcctggtgtgatgcggggactggccgatgagcggctggccggggcgattcgcgctatccacgccaggccagcccatggctggacggtgccccagctggcgaaacacgcggcgctatcgcgctcggcgtttttcgtacgttttcgcgatgcagtgggcatggcgccgatggcgtatctgctgacgtggcgcatggcgctggcgaaaaatctgctgcgcagcagccgcctgtcagtagccgacgtggctgaacgggtgggttaccgctctgccagcgccttcagcatcgctttcacccgcttcaccggccagacgccgagcggcttcgctggcgcggaacggcgcagcggcaccgcagaagctgagccagcaatcacccggtttaaaaatcaccctgttaatgccggtgcgcatcaatgcgcaccctacaaaaccgtgctgtaccctgtcgggtcaccatttatggcgacctaa

SEQ ID NO: 86098 - DNA, 1623 bp, Glycine max
  Peptide Sequence Number=SeqID_202876
atggtgcacaccttcaggatggaagtgttcttctttctttcgggcatgttctccgcgctgattattttgcgcaaagggcagaaattctttacggataatcgccgtaagcgcgtcctgattccgctgatatcagcctatctgtttattccgccgctgatgtattttatcgcgggacagatgaataacaccccgctgagtctcgaaggctggctaaacagctataccatgatgcaccacctgtggttcctcgtgtcgctgtcggtgatgtcgctgctggtacctggcgcgttctatcaatggagcgcccgtcagctgggtaaaatgtcgttgccaatgctgatcgccacgctggtgattctgggtaacgcctgcttcgtgctgaagttcctggtgaaaggccgcggtgaatttgtcgagctcatcccggtgaccgcacgcttcctcgtctactacaccgccggttttgcgttatacgtcaaccgcgagaaaattgcccggtacgccaacagtaaactgatgaatggctggctggtggccgcgctggtgctggcggtgtgggccgcctgctatgttgtcgcgcacaaccacatcaccggggtgatgaaatatgtgccggtgatgctgggcagcgtgctgtcggtgatgctgtcctactggctggtgtttagcttcgaacgcatcaacgtgaaagagagtcgcattctgacggcgattgtggattccgcgctgattatctatttgctgcactatccggtggtgatcattttctcatggctgctggatgtctggttaccggataacctgtcagtcctgtatgtcctgatcgatttcgccctcggcattgcgctgagcgcggtgtgttacgctatagtcaaacgttcacgcttcgcctcattcatgtttggactcaagccgaaagataaaaaggtggcggtgccgggcttaatgctgcctgccacaccggtatcggcggtggtattaaaacctttcactcccgagcgcaacgacaataaagttggcgcttattgcttatgtaatggttccacccagacgctgagcggcgtgccgcgctttaccgctggagaaagtggcatgagcagcgtcacgctgggtgaactacaaaaggttgggcgtattattaatgacaatttaatcggcgagccccgcctgcaactcggcgcacaaaattacgctattggtattccggatgaagaaacaggcagttatcgtgtctatcaggtttataacagtgcggaaatgattgcgccggcggaaattaatggcgctacggtagtgccagattattatgatgtgaacgataagcaatatattgatgcgcgcgtggcgacagtcactaatggccggttaaatatcaatattggtcagcaaggcgcagccgctaacgccagcaccaatcgctggtcaatggctgccaaacagagtcagttatttgccagcagtaataacggccagattaactgggacagcaataaccgtatccgctttaccgccgccacgccgccgtacggtggcgatcggctggcatttgatgccggaggcgtggtgacctacgccggtctgtttgatgtcacgctcaaggatggcagcagcaacgcgtactac

SEQ ID NO: 86099 - DNA, 153 bp, Glycine max
  Peptide Sequence Number=SeqID_202877
catcctcttcaagcttcttatccaaggcaattcttggtggtgaagctccttcttccttggcttattccctagtagatgctcaaagatccagcctccatagaagccctacaagcaagcttccatcaagtggtaatcagagcacaagagcttcaa

SEQ ID NO: 86100 - DNA, 261 bp, Glycine max
  Peptide Sequence Number=SeqID_202878
atgtatcatgaaatcaactttagtctgcaggagttcaaccagaaattgtcgagcgctaagcttattcaaactaacccctcatttgtttgtcataagtctcgagaccttgttgacattgtctcaaaacaagccaatgaactgcaaaataatacttcttctaaggctatgaaagcaatcaatgagtgcattgaagttgatcaaattaacttagatgaagtgcatgcttttgttgttgccacaaattcaaagtttttgaattag

SEQ ID NO: 86101 - DNA, 543 bp, Glycine max
  Peptide Sequence Number=SeqID_202879
atggctactagtgatcatgctattttgcatgacggaacacatattcccaccaagcaaagtctattagagctttcatcacagaacactttgttggcacagaacaagctactgtccaagcaatttgaggccttaacggagacattaacttatgagtctggctgttgtattcccactgaagacatagcacatgaagtggatactcaggtttccaacatggccaaaactacatctagcaacaaggacaatggagaactcaccctgacaatcaattcaacaaagaccaaggtggtctattctgctggtgtcgcgctaagcgaggcttatgcgcttagtgaggatcacacgctaagcgaggaactcagccgcttagcgagtaagaagaatctagaggagaatttgagaagcgtctgcatgctcagcgcatcatcaacgagtcacctgtctcttccttcgctaagcgcgcctagctcacctagcggattttcacttactcgcgttaagtgtgatttcgaggacagaaagccctttttaagtctgaaatga

SEQ ID NO: 86102 - DNA, 150 bp, Glycine max
  Peptide Sequence Number=SeqID_202880
atgcactggatgtccacgataatcttaggatctttcaagaataattgggagacgtattttaatgaagttagaccattggatgcagagagattcaaggcacttcgcatacagtggacacagtattatctaaaagttagaaatcaaacatag

SEQ ID NO: 86103 - DNA, 645 bp, Glycine max
  Peptide Sequence Number=SeqID_202881
atggatatcgggcctcgttcacgacgagtgataatctcctccggcgacaggcgcttcaaggtgggcggtggacggggtggaggcgagcgtgaaattggaggagggagcaacgcaggcgagggagctgggcgtggctatggcacgagcaagatcggaggagcacggttgcggaaggggggtcgcgtgtccaagagcttttcttcctggagacgagcaagcccggtggcctgcaccaagcttgaagagggtgccggtggggtcgttgtagtgggaagacgcgaagcaggtttggagtgcctggatgaaagcgggccaagaagtaaactggccattgttggccatccactggaaccacgcgagggaataaggaagaaggtgggaatgggtggagttgcagcggaggatgagaaagaggatgggggaaggcggagcataagggcatcaaacttctgggccattgtgtggactgtctcaccaagggaggcatggaggtcagtgagtttgaggatggcagcttcaaggttattagaggaactggcggtggagggagggtcagacatggtaacgagagcaccaaatgataggaacaagcttgttatggatttcgaggaccagagcctcctagagaagaaggagaggaattag

SEQ ID NO: 86104 - DNA, 1755 bp, Glycine max
  Peptide Sequence Number=SeqID_202882
atgctccgtttgattgacacgatcgttggccactccgtggttgtccttgtggatgacttaggatacaagcccactgtgagttatggttggaaatggccaacacttagcttgcactcgctattgcacaaacatttctctcaccatccagcactttacttgtgtggtggatctgtatgtgctgcccattgccgtcgcgaacatcattctcggtgtacaatggctaaaattgcttgggccgaggccaagtcttcgaactccagtatacctcttcctcctcgtatccaagctttagtggattactttggttacttattccaaccgccatcctcgttgccactggagagggtggaatcaatgttgcaaaaggggcttattagtccgagtacaagtcatttctcgtcactagtgctgctcatcaggaaacatgatgactcttggcgattttgcgtggactatagagcactcaatgtggtgactgtctgtgactggtttcctatcctcaccatcgatgagcttctcgatgaattgggcaaagcttgttggatttcgaaattggatttattgcaaggctaccaccaaattcggatgcattcaccgaacattgccaaaacagcatttcggacgcaccatgggcactatgaattcaaggttatgccctttggcttgtgcaactccgtcatccttctaggcgactatgaatatgattttcaggaacatgtggcacacatggagcaagcctttcaggtccttttggataatcaatttgtccttaaattgtctaaatgctcattcgcacaacaacaggtggaataccttggacacgtggttttgcaaaagggggtggaaccagttgccgcaaaggtggaggtgggctatgccacgatagccgctctgttggtggcagcaaccacagtggatccttttagatggaccgttccggctcagatagcattcgaccgttggaagcaagctctgtccgaagctccggtcctcacattaccggacttccagttaccattcacagttgtgacagacgcttccggtgtaggcatggggtcgtatttggttgccgccgtaattgcccttgatcagaacactccttctggagtaccatgccacatcgacaggagttgccttgattgtcagcacgccaagtgtgagacaaagagggtggcagggttactttgccctcttccagttccacaccggccatgggaggatctctccctagatttcattatgggcttgccaccttttcagggaaacactgttattctcgtagttgtggatcacttttctaagggtatccatttgggcatgcttccatcttctcacacagcccatgaattattccatctcagtggaacgcagcttcgcataagctcagcataccacccgcaaagtgatgggcagacagaagttcttaatagggtaattgaacaataccttcaatcctttgttcatcgacgaccgagttcttggggtaagctaatattgtgggttgaatggtctcacaacatggcgtggaacgctgtgacaaggtccataccttacaagattacctttgggcggaaaccttttaactttccagagtacctcaccggaacttccaaggtggatgttgttgatgagatgctacctaatcgcgaggaaactttcctgctcatccgcaagaagctcattaaggcacaaggtcttatgaagaaacatgcagaccggaagtgtcgggatgtggtctaccagattggcgattag

SEQ ID NO: 86105 - DNA, 330 bp, Glycine max
  Peptide Sequence Number=SeqID_202883
atgagttcctatgcaccagtttatgcacattttctcaatgtcatgctacatagttctgagctagcatttgtgcatctcaccattgatcatgaaagaaggaaacagacgaatgaggttttgaagcacagaaaagatcagaaagaaaatataaagaaaatgctgatgcaacatgacatggcatgccagcacaaagcattaatagtcctagtattcatgcagagggggaagctctacaactgtactattgttgtcctttatctaagggaaaatgagaaaaaagatgagtattctggaggattcttattgctggatgtgactttgcatgggtga

SEQ ID NO: 86106 - DNA, 780 bp, Glycine max
  Peptide Sequence Number=SeqID_202884
atggaatttgatgggatgattattgtggttttgagagttgcattcaatgtgtttttcaggcagttgaggaacagggatgctgctgtgaggtcaagggagaggaagaagttgtatgtgaaaaaccttgagatgaagagtaggtacctagaaggggaatgcagaagactggggcatttgctccagtgctgctatgctgagaacaacgctttgcggctttgcttgcaattgcgtggtacatatggtgcttcaatgaccatgcaggagtctgctgtgctcttgttgggtaaggcttgcgattgcaagctaacctctgctgttgggttccctgctgtggtgcatgggcatcatatgccatctcagtctgcctctaatgctgtgggttgcagcagtacttccaagagaaaacatcgagcagaagggcctaagaagggtaactcaaaaaggatcagaaagggtgagcttagctactggaggggtgtgtgtttccatggggtgagcttagctattggagggatcttcttgatgcaagctccattggagcttgtaggcctaggatcttcttcatcaatggattcctttgcttcttggaagataaatggcagcggaatggagaaggaagagagagagaggagacgccacttcaaggagaagatgagtctagaagaagctcaccatcataggaggccatggataagagcttggaggaagaaggagatgaatgaagggagagggagagaagagcacgaaattttgtgctcaaaaagagctctgaaatctgaa

SEQ ID NO: 86107 - DNA, 1608 bp, Glycine max
  Peptide Sequence Number=SeqID_202885
atggcggccctcggtagatcctccgctgccgccaccacctccctctcctcctcctccgcccgattccgccgctccctccacctaccgccttcccaactctccttcccgcgcgcgcgcttttccgtcaacgccacgtgccccttcttctccgataacaatggcaataagatttcccttccccaagacgtcgtcgcttccaaaccctcccctctcgagttgctcaaaacttccgccgccgacagatatacgaaggaaaagagtagcattatttgcatagggctgaacattcacactgctcccgttgagatgcgtgagaagctttccattccagaatcgcattgggctcaggtcatcaaggacctttgcgctttgaatcacatcgaagaagccgcggttctcagcacgtgcaatcgcatggaaatctatgttgtggctctctctcagcaccgtggtgttaaggaggttactgattggatgtctaaggtgagtgggatttcaatacctgagcttcgggagcaccaagttttgctgtataacgcgtacgccgcgcagcatctatttgaagtggcgtcagggcttgactcacttgttcttggggaaggtcaaattcttgctcaggtgaagcaggttgtgaaagctggacagggagtgcctggttttgataagaaaatcagtggtttgttcaagcaggcgatatcggttgggaagcgggttagaaccgagactaacatttcatctggatcagtttctgtaagctcggctgctgtggagcttgcactgatgaagctaccggattcctcctttgctgattctggagtgttggtggttggtgctgggaagatggggaagcttgtgattaagcatttggctgccaaaggttgcagaaagatggttgttgttaacaggactgaagagaaagttaatgccattcggaaagagttgaaggatgttgagattctgtttagaccaatttcagatatgctggcgtgtgctgccgaagctgatgtgatcttcaccagcacgacgtctgaatcatcgttgttttctaaagagaatgtgcagatgcttcctctggttagtcatgggagaaggcggctttttgttgatatatctattcctaggaatgtggaaccgagtgtctcggatctggagactgcacttgtgtacaatgtggatgatctgaaggaagttgttgcagctaacaaggaggacaggcttcagaaagctgaggaagcccgaggaattatactagaggagttgaataaatttgaagcgtggaaagactctctggaaactgttcctactattaagaagtttagagcttatgttgagaggataagagcctctgagatggagaagtgtttgtcgaagatgggccctgatgtctcaaagcaacacaaagatgcaatttatgcccttagtatgggtattgtgaataagctacttcatggtcccatgcagcacctaaggtgtgatgggaaaaatgatagtagtctgagtgaagtacttgagaatatgcgcgcccttaacagaatgtatgatcttgagacagaaacttccttgatcgaagaaaagatcagagtcaagatggaacgggttcagaagtag

SEQ ID NO: 86108 - DNA, 468 bp, Glycine max
  Peptide Sequence Number=SeqID_202886
atgtttgcacattcgattaaaggctgccgtcccttgggacggacgtgtggggtgctaataccttccccgtgcgtaaatacaactcccgaactttttcacttaaaagttcgtagatcgcgtcttttccggtttttccgacgttttcctcaaataaacgttggtggcgactccgcgcgtattcctttcgtggaacacgcatcccgcgagtctcgcgtcgccctcccgccgaaggggtgtaaacagcaactaggcccactggggccttccaaattcttcctccagaaggcggttgcttctagaggaagcaacctggctcgcctgggtggcaagctcctcccttattttgctataaatagggggagaagtgaagaagaaaagggttcagctttcttggcacttcgtattcacttgaaattgctgaggaaaattgttttcgtgaagaaaatccaagccgagacgcttccgtaa

SEQ ID NO: 86109 - DNA, 310 bp, Glycine max
  Peptide Sequence Number=SeqID_202887
cattgttgagatagaagatgtgcaagagcaaatgaaggccgatatcgaggccttgaaggatcgaatggcctccatgatggaggacatgttaagcatgaagcgaatgatggaaagcaattcgaccgcagttgccgccaatagtacctccgccgaggcggatcttacccatccattcaccataaaccaagtgaaccagtcgatcccgaacatagtggatcaaggaggagaagtgctaggcagcacaagcggtccacacggccagcaacctcagcctatgggggagaaccgtgaagaccctcaagatcattga

SEQ ID NO: 86110 - DNA, 363 bp, Glycine max
  Peptide Sequence Number=SeqID_202888
atggcacaacaacaagaacatgaaggaaaaccagagtcttcttcctctcaacctgagtcttctttggaaccagacatgggcaccaagtccacaatgattccgtcaacttcatggtttacaccaaagaggttactggctatattttgtgtgatcaacttgttaaactatttggaccgaggagcgattgcaagcaatggggttaatggaagtcaacgaacttgtgaaggcggtacctgcaaatctggaacaggaatacagggggattttaacttgaacaattttgaggatggagttctatcatctgcttttatggttggacttcttgtggcttctccaatatttgcttctctagcaaagaggtaa

SEQ ID NO: 86111 - DNA, 243 bp, Glycine max
  Peptide Sequence Number=SeqID_202889
atggcgagtccgatgacgtgcgggggtaccttatggttatccgcaccttttttcatccagaggcagcgagtccgattacatgcgggggtaccttatggttatccgcaccttttttcatatagagatggcaagtccgatgatatgcaggaggcaagcaagcctgttgacacgaagagactaacgtcgtcatctgcaccttttatcaaccaggggcaagcgagcccgttgacacgcagagactaa

SEQ ID NO: 86112 - DNA, 204 bp, Glycine max
  Peptide Sequence Number=SeqID_202890
atggcacctacagcagcaatgctcttgctctcccacaatggcaaaacacccataccttcatcatcatcatcatcatctgcaacaacttattattttaggttgaaagactctgcactcaaatgggtttccaaatacaatcccgtgcccaaatcaggatcaaagaataagaggttcgaagaagcacttcaactttgcagctgctag

SEQ ID NO: 86113 - DNA, 1333 bp, Glycine max
  Peptide Sequence Number=SeqID_202891
cgtaaacccatttagactaattggagtgggattatcagtttggacccttgcaaccttatgttgtggtttctctttcaatttctggtccattgcagtctgtcgcatgctagttggtgttggtgaggcttcatttatgagtcttgcagcacctttcattgatgacaatgccccagtttcacagaaaacggcatggcttgctatattttacatgtgtataccagcaggatatgcaattggctacatctatggtggtttggttggaaaccattttggttggcgttatgcgttttgggtggaagctatattgatgtttccatttgctattttgggattttttatgaagcctttgcagttaaaaggtgcacattcttctcctgcattgatttcttgcagctccataacttcgtttcccatcactaaactacttgtgcatccaggttttgcccctactgattcagaaaaggcactgatactggagacagtggtatcagaagttccagatgtcggggtttcaaatggaaaagatgaagcgttgtccttgaaggaagagttcagagacaaaagctcacatgaaccttccaggtcaaaatgtgcaatattagatcagttctcaagatttctgaaagacatgaaagaacttttgcttgataaggtttttgttgtcaatgttctaggttacatagcatacaactttgtaataggtgcttactcatattggggccccaaagctggttatagtatatataacatgactaatgcagatatgatgtttggaggaattactgttgtatgtgggatattgggcaccttagcaggaggtcttgttcttgatttcatgactaacacaatatcaaatgcatttaagcttctctcattaacaacatttattggtggtgcatgctgttttggtgctttcttatttaaaagcgagtatggcttccttgccctttttgcttttggtgaactacttgtatttgccactcagggtcctgtgaattatgtatgtctccattgtgttaaaccaagtttgaggccgctgtctatggctatgtctactgttgctattcatatctttggagatgtgccttcctcacctctcgttggacttatccaggacaaaattaataactggagaacgactgcattgattctaacaactatattctttccagcagctgcaatatggtttataggaatatttttgcccagtgtggatagatttaatgaagatagtgagcatgaagtatcaagcgtggaaaggacaagcacagcaccattgcttgaagagggcactgctgaaacatcagcatctggtcaatcccaagaatgctga

SEQ ID NO: 86114 - DNA, 393 bp, Glycine max
  Peptide Sequence Number=SeqID_202892
atggcttcctcggagatcgaggtggtttcatcatcatcatcggtctccaaacccaacaacgaccagcctccaatcctcgacgttttcaccgcctctgctcacggcgacttcaacaaattgagaaccttcgtcgaacaagacggtgcctccgtctctcttcccgattttagcggctattacgctcttcagtgggcctcgctcaacaactttcacgacattgcgcactatctcattcagaaggactttgtgtttgattgttataatatttattattacatattatattgtgcatacttgaggacgagccctggtacagcggtaaagttgtgccttggtgacttgttggtcatgggttcgaatccggaaacagcctctttgcatatgcaagggtaa

SEQ ID NO: 86115 - DNA, 730 bp, Glycine max
  Peptide Sequence Number=SeqID_202893
gctggcgctgctggcggcgttgctcggctggttcaatggactggggcgcgtcgaccagatcctgtatgaccgcgccgtcgccttgacggggcgcgatatctcgcccgacatcgtaatcgtggcgatcgacgacagcagcatcgatgcgctggggcgctggccctggcgccgggcggtgcatgcggcgctgctggaccggctgcaaggcgcgcgcgcggtgggactggacctgatcttcgccgaacccgacaccacctaccccggcgacgacgtcatccttgccgacagtatccggcgcaatggccacacggtgctgccggtggtactggaccggctgatctatcccacgtcgatcagcgcccccatccccgccctggcccaggcggcagccggcagcggcttcatcaacgccaacctcgatgccgatggcgtgctgcgatcagcggtcctgactgcgcgtttcgccggccagcgctggcagcatttcgcgctgaccatgctggacgtgggcgggcaggcggacctggcgcaacgcctgctacggcgcgcccgcgcggacggcagcatcctgattccgtatgcgggcccggcggcgcatacccgcgccgtgtcgtatctatcagtcctgcgcggcgacgtgccagcggagcagctgcgcggcaaatacgtgctggtgggcgcttgggccaccggcctgggcgacgcgtacaccacgccggtatcccacgag

SEQ ID NO: 86116 - DNA, 928 bp, Glycine max
  Peptide Sequence Number=SeqID_202894
atggaagaaaacaaactgcgttttatgcatttttctagaaaacgcgatgaactcgctaagcgcgcctatcgcactaagcgagttcatcttgtgaggatgaacactcatcctcctgttgagatacctatggctaagcaagatgcatggagtcgatacacggataatgtattggggagaaacatcttgccagagaggaaggtggagctctaccacactgagtttgatgattttaagactgagttggagaggcgtaatctccataaacgcctcaccaatttggttgatgggagcatagatgtggctttggtgaaagagttctatgcaaacctatacagctctgagggttcttcactaaagcaagccagggtcagaggccatctagtgaagatcgatgctggcagcctcaacacattcctagagacacttgtggtgttggcagaggggccatcctgggaggatactgaggaaggacttgaagactttagcccagccggaagggttgtctcaaacaacctcacttttgagcgcttgagcccgagcattaatttgacctacatcaggaagaactgttggaatcctgataatctgacagtttctatccgaggggctaggaaggcgagggcgaggccaactgattttccttccacatttgcagctcctactctagcatccacttcagcagctcctttagtcctagctcagattgattctcagcgctttgaagccatgctccagagcattcatcagggacaaatcattttacttcagagtttacaggtggtggcgcctccaggatccatgctttccattgagcagtttttggagagggtagcctggcctggggcccaaccttctcttcatagggaagatgaaggtgaagagcaggctagaccagaaactgttgctactcttgagagatcacttgagg

SEQ ID NO: 86117 - DNA, 171 bp, Glycine max
  Peptide Sequence Number=SeqID_202895
atgaagttcgagtgcgagtgtgcgacaatgaagttcaagtgccactatgccgtctatgcgagttcaagaatcacacaagttcccacaagttctgtgtttcttccatttgatgtcattcactattttttgtcgtggatgccatggtttattggaaacaaatttgaccagtga

SEQ ID NO: 86118 - DNA, 1102 bp, Glycine max
  Peptide Sequence Number=SeqID_202896
atggacccgccggtgaccggcctgaagattgaaacgccgggttcggtcgatgccgggcagtacgaccaggccgtgcgggacatcaccaacttcctcgaatatgccggcgaaccggccgcgctcaagcgccagcagctgggcgtaaggaatactggaaggacgttcactgaatctgccgccggccatcgcacgggcctattggcttttgtgatggtcggttgcacactcggggaggagtcgatcgctggcacggtgccggcggcgccgatgcggcaggcggtctcctgtcgtgggagagcctttgatggcggcgagcgtacgcatgcgcaatacactgacgctgttttcctcgaacgacgatgtactgtgccaccgtgtacgcctggtcctggcggccaaggacctgatcgacctcaatccgtaccactcggtgccgacgctggtcgaacgcgaactggtgctttacgccgcgtcggtggtcagcgagtacctggacgagcgctacccgcatccgccgctgatgccggtcgacccgctgtcgcgtgcgcgcatccgcctggccatgctgcgcatcgagcacgactgggtgccgcaggtgcaggccatccagctgggcaacaagacccaggccgaggccggccgcaagcgcctgaaggagttgctgaccgcctcgctgccgctgttcaaggccagcaagttcttcctcaacccggaaatgagcctggccgactgcgcgatggcgccgatcatctggcgccagcagtcgctggacgtaccgctgccgaaggacggcaaggcgatcgaagactacggcaaccgcatcttccgccatcccggtttcgtccgcagcctgaccgaccaggaaaagaagctgcgcgatctgccggtctgatccgggcatgcgttacccgtctgcacgccgaccggcgtgcaggcgatccgccccggcagggcgccgggcgcgtacacttcacgcatgaccgaagacttcttccacatgaccagccaccgcccgtacctgctgcgggcgctggtggaatggatcaacgacaaccagctgaccccgcacatcctggtcgacgccggcgttcccggcgtgcag

SEQ ID NO: 86119 - DNA, 924 bp, Glycine max
  Peptide Sequence Number=SeqID_202897
atggcagttcatgttgctgcacaatttggacagacagctttcttaaatcatattgtagtaaagtaccatgctgattttgatgtgcctgataatgatggaaggagtcctcttcattgggctgcatataagggatttgctgacacagtaagattgcttctatttagagatgcaagtcaaggaagacaagataaagatggttgtacaccgttgcactgggctgcattaaggggaaatgcagaggcatgtgctgtgcttgtacatgcaggcacaaaagaagaactgatgatgaaggacaatgctgggaacacacctgtacagcttgcatatgataaaggtcatcggcatgtcgctcctttcctttcaaatcaacaacgggctcatagcaactactggaaagggaaactgtgtagtgggatagtgacagatattggttatgctcccatcttattctgtactataatctttctctcaatcctcttcatcaactcagttgttgcagctcctaaccttaaaaagattactgctgttgttggactttgggcatggacagcgctttcttcggctgttggttccctgattatgttctataagtgcagtagatggtggctcatgagtcagcaagcaaaagtctgccataaaagtatggtggatggaattgagacctatgatagaagcatgacggctatagtgaaaacgtatatgtacaaaaacataagttcagagacaaaagagaggaacagagtgactcaaaacacaggaataaagagattaagaaaacatagagaaacaaagagatcagcaaaggagatgcagatgaaaggaatgtatagaaacaaaaaaatggagaaagaaggaaaaacaaagaaacagggactcatgaacagagcttattgggataaccatatcagttgttcgcaacgatga

SEQ ID NO: 86120 - DNA, 294 bp, Glycine max
  Peptide Sequence Number=SeqID_202898
atggaccctagctcgcccagactagcctttggcttgcctgggccaccaaatagcttcatagtgaagaaaccagctcgcttgggcgagctcactacttcagggttaagtttcagcttgcctaggcgacctgggtgttttaaggggtttcaaggttcagaaggtgaaggaactgagagaagagagaaagaagaagaagaaagaagaggaagcgaggccgagacactaccgaatcacgattgtgatcattccttacttcgtttcttgtttcgtgttcttcgtgcgaccatgggttag

SEQ ID NO: 86121 - DNA, 387 bp, Glycine max
  Peptide Sequence Number=SeqID_202899
atggcaatgaattttgacagtgttggtattgaggtttacttttgccgcccctcgattttcagcattgttttgactcttaacagcactataagcctttccttgacaggtgggatttatacaactaggaaaagtgcaaatttgataacttgcccctggtttgttttttctccctgtgtcccttcttcttcttcctcccctttcaaatctgagatgtcctctatctttccacctgagttgctccaccattacatcaatggtccgatgaggaaatacttcaacactaagttgcggtgcgctcatgaaagtacccatagttgctgtgaagcacgtctcggaaatccaatcatacgaacagtgatgcaaaggagtagtatcgtctcgtcgtga

SEQ ID NO: 86122 - DNA, 294 bp, Glycine max
  Peptide Sequence Number=SeqID_202900
atgtttacaataagatctgaaagtagtgaatattctgcatgtcaagctgctgctacccattgtaaagaaaaaggaaaaaacatttcaaagttagcattgcagtacagcttgttaaataaggaaatcacatcagtgcttgtaggcatgaagtctgttgaacaggtggaggaaaatgttgctgccgcaagagaacttgcaacttctggaattgatgaagagactctgtctgaagtcgaagctattctgaagcctgttaaaaaccagtcgtggccaagtggaatccagcagagctga

SEQ ID NO: 86123 - DNA, 1765 bp, Glycine max
  Peptide Sequence Number=SeqID_202901
atggatggctcctccgccaaaccccctcaaatctccgaaatgtttcagaaattcgccctcgctttcaagaccaaaaccttcgaattcttctccgaggaagaaaacaacgcttcccctctcctcgacgacatcgacggtttctccctccttgactccaccgaagaaatcatcaccgaccagaaagttgtcgtcatcaaacccgaccccgatccctccctaaaatcccccccatctccgccgccggaatcccctcctcctccgcctccgccgccgccgccacagatcacccatcctcctccgcccccggaattccgcgagcccgaaacgccgcctccgccgccgctaaccgaagctcagatcagagaaacgacacacgccctgatctcctcggtcttcgccgcagtctccgctttcgaagcctcctacttccagctccagagcgcgcacgtgccgttcgtggaggagcacgtgacgagcgcggacaaggttttagtttcccacctccaaaggctctcggagctgaagaaattctactgcaaccccgagccacgaggttttcccttcgggtcacgtttgggggccgaagtggaagagaatcagagcaaattgagaaccctaggcaccgtctcgaaccgcttgcagtgggaactggagcagaagcacgacgaggttgtagccctaagagccaaactcgacgagattcatcggggtaacgtgaatttgtctaagaagctctgtgctcgcgctttgaacccttcttctgatgttttgttaaccgttaaggtgtttgattcgttgttgcacgacgcatctagagcgacccataggttcaccaagattttgattgggttgatgaggaaggcggggtgggatttaggtttagccgccaatgcggttcatcccaatgttgattacgccaagaaagggcacaaccaatacgcgctcttgtcatacgtttgtttggggatctttcacggttttgattcgatgaatttcggaatggaggatggggaggaactggtggtgtcgaatgggcacggtagtttggatttggaggatagggatggttgcttgaagcaactgcttgagcatgtgtctagcaatcccatggaattgctgggcattcacccgggctgcgagttttcgcggttttgcgagcacaagtatgagaggctcatccatccctcaatggagtcgtccattttcgtcaatttggaggagaaggaggcggtgttgaactcgtggcgctcattgagtatgttctacgaggcctttgttggaatggcgagtgctgtttggacactgcataagttgtcctacacgttcgatcccacggttgagatctttcaagtggaaagaggtgtggagttttctatgatatacatggaagatgtgacaaagaggttgacctggccgaacaagggcagggcgaaggttggattcactgtgcttcctggtttcagaattgggaggaaaaaagcatcccctcttccaatctctctcttaccgtttctgtttcttcttctcgctgccgctgccgccaccgcctccgcagcactcactcctctccctccaccgatgacaatcgatgacaaggtctcgagatcagacagcctcagcctgttccccatgactcaaccaaccacaactgacaacgactttccgcagactttgggtggggagtttatttgctttggttatcgtttaacactgcaaagtgacattcctggagctgtaatgctgggtatgtttggaactttgaatg

SEQ ID NO: 86124 - DNA, 201 bp, Glycine max
  Peptide Sequence Number=SeqID_202902
atgggggacttgggggctgttggattcgtgattcccgtaagccttagtgttcttggagttttagggaagaaatggggtgaagaaatggcttcaccccctccccttttaaaaaccaatgtcagacgtgctcgcctaagaattttaaagaacaagattaaagatactaggctgcctcctaggagtgcttctttatcgtcttga

SEQ ID NO: 86125 - DNA, 219 bp, Glycine max
  Peptide Sequence Number=SeqID_202903
atggttccaaggaagctccctgctaagagggcaaggaaagatgccaccggagaaggttccagtgtggccccacaggtggatgtggagttcgacagacatagggacgaagagtatgctgagttccaggaggaaattgccaagaggcaatggactcagcttgcagcacccatggttaagtatgatcccgagatagtcatggagttctccgccaatgcctga

SEQ ID NO: 86126 - DNA, 357 bp, Glycine max
  Peptide Sequence Number=SeqID_202904
atggagatttcatccatcagagggttacctgatatgacaactcctccagacagtatctctcaaggaaccttgctggggaatcataataactatgtcttcaaggcatgccaagaagccaaaaagactgggaaacgttataaacattctcaacctcaagaccacatcatagctgaaaggaagcggcgagagaagctcagccagcggttcattgctttatctgcccttgttcctggactacagaagacggataaagcttctgttcttggagatgctatcaaatacttgaagcagctgccggagaaagtaaaggctcttgaggaggaacaaatcatgaaggaaatacttgaactatgctaa

SEQ ID NO: 86127 - DNA, 363 bp, Glycine max
  Peptide Sequence Number=SeqID_202905
atgggaaattttggagcaaagaaggtcacagattcaagttcaatacatgtaaagagtaatgagtgtgcaaagacatcatcagaaggtggaatatgttcttcagatgaggatgcaggaagtgctgacatcatcattgtgggtgctggggttgctggtgcagctcttgcttacactcttggaaaggatggacggcgagtgcatgtaattgaaagggatttgagtgaacctgacaggatcgtgggtgaattgctacaacctgggggctatctgaggttaattgagttgggccttcaggtatgtatcttagttaacaactcccctgactctgctggtcaaattcatggcttggctcttaatagatga

SEQ ID NO: 86128 - DNA, 366 bp, Glycine max
  Peptide Sequence Number=SeqID_202906
atgcatgaatttcttcttcatgtcaaagcactcactgatgctctcgcctctgttggagagccaatcgcacttcatcgacacatcggtgttatcctagaaggtttagcggatgagtatagctctgtaattttggtgatacagagtctggtgaatcctaataccgctttgtcatattgttttgagggatacattgtgccaaacaagcctaaatttgataacttttcaaataactctactcgtggaggcttcaattgcggtggcggtggccattgtggcagcgatggccgtgactgtggaggtcatttctccaacttcaattgtcaagtgcgtcttaagttcaaacacacaacatccttgtgctactga

SEQ ID NO: 86129 - DNA, 282 bp, Glycine max
  Peptide Sequence Number=SeqID_202907
atggggtgtaaccgattcaatggtagtcctcgattgatgcagatgaacttgtatctatatatattcgaacggctaagacaagaaagagggcttcgaaccattgggcaaatcgagctggcgtatggtcgaatcgaagtcaaggcaacaagatttctggatttggcgcaatttctgacaaaacttcacaaaattagttcgacttcgagcaatgtgggtaaccgttctaaggagcagttatgtgcatgcaaggtgtacgtagcaggacacttggcattaggatag

SEQ ID NO: 86130 - DNA, 1740 bp, Glycine max
  Peptide Sequence Number=SeqID_202908
atggtgtgttataaactgggggaatctcatttcttgcttgttttaacatgcttgtggttgtggttgtggtggagtactcgtatccacgttattgctgcatatcacagtttgaggcccggtgatactctgaattccacaaccgaactgtgttctgaaaacgataaatattgcttgggtttttcccaatttagttctgctcataacagcacttatttgcggatatacgccaaaggaaaaggtgactggaacatgtggattggtaatagaaaccaaccacttgacatggattccgcagttctgtcgctgagccactctggagtactgaaaatagaatccaaagacatggaacctatcatcctttactcttcaacgcagccgtcgaacaacactgtggccacgttgatgaacacgagcaattttgtgttgcaacgccttcaacccggtgggactgagagtactgtgttgtggcaaagttttgattatcctactgataagttgctccctgggatgaagttaggagtcaatcacaaaactggtcgcaattggtctctagtttcgtcaatgggttatgctaacccagctcttggggcattcaggcttgaatgggaacccagaagaagagaattactcatcaagcaacgaggacaattgtgttggacaagtggagaactcggaaaaaacataggattcatgcacaacacgcattacatgattgtctcaaacgacgacgaaagctacttcacaattacaactttgaatgaagagttaacaagatgggagctattaaaaactgggcagttgattaataggaatggagatgacaatgttgcaagggctgatatgtgttatgggtacaacacagatggagggtgccaaaaatgggaggacatacccttctgcagaaatcctggtgatgcatttgaactcaaagaagtttacctcaatttaaacctgaaaaattttctggctaattcgagttatagcccgagtgattgccgggatacttgctggaaaaattgtagttgtgatggattcacagattattacgatgatggaactggctgtatattcgtgtatttaaatttaacagaaggtgctgattttgcaagtgggggcgaaaaattttacatattggtaaagaacacccatcacaaaggtaagtctactaattcaggaaaagaaagtacaaaaaagtggatatggataagtattctaatagtagctgctctattttcaatatgtgctttcattctgtatctggccttaaagaaaagaaaacttcggtttgaagataaaaacagaaaagaaatggaaattaataagatggaagatttagcaacttcaaatagattctacgatgccagagatcctgaagatgagttcaagaagagacaagatctaaaagtatttagctacacatcagttctgttagcatccaatgatttttcaactgaaaacaagttaggacaaggaggatttggacctgtttataagggaatccaaccaaatgggcaagaagttgccataaaaagactttctaaaacatcttcacaaggaactgcggaattcaaaaatgaactaatgcttataggtgagcttcagcacatgaatcttgtacaactacttggatactgcattcacggcgaagagaggattctaatttacgagtatatgcataacaaaagcttggatttctatttatttggtaaggaatattttaaagttgatttaattaggtga

SEQ ID NO: 86131 - DNA, 516 bp, Glycine max
  Peptide Sequence Number=SeqID_202909
atggagattataccccaatcagtttgttctcggtatggtttggctattggtgcatcagtggctccctttgtccgtgtgcttgtatgcatatgttttccagttgcctatccaattagtaagttattagattttttgctgggccatcgacatgaagccctattccgtagagctgagttgaaaacactcgtaaatttgcatggtaatgaggctggaaaagggggggaactgacacatgatgaaacaacgatcattgccggggcacttgaactcagtgagaagacggcgagtgatgccatgactcctatatctgaaacatttactgttgatattaattcaaagcttgatagggaactgatgaatgagatattggagaaagggcacagcagagtcccagtctattatgagcagcctacaaacattattggacttgtactgtgtatgcatgaacttttatgccttgctcctgttgtatggaatatagtaacaggaaggttttctgatgctttctggaattag

SEQ ID NO: 86132 - DNA, 405 bp, Glycine max
  Peptide Sequence Number=SeqID_202910
atgaccggaaggcttcttgccggctcattggcatttgattgtcgcatcctccactatcttaatgttcgcatttttcttccgagatcttcaaaccttgcacaggtttctgaagaagatctcattatcatgtgggcatttcttaccgatcgtcaaatcaactgggctcacttagtccgttatcgcatgaataaggcattgcgatcaaatgctcccttaccctatccttatcttatttctctttttcttcaccatttcgaggtaccttttgttcaaatcaagaaacctaatttggagagtcaagtagacattcgattcggagagatggattctaggatcacgaagattgaaggcgacattacttacatcaaagattgctttgaccttccaccgccaccatccccttag

SEQ ID NO: 86133 - DNA, 375 bp, Glycine max
  Peptide Sequence Number=SeqID_202911
atgacaccaatggacttggcggatatttctatgatacaacctacaagtggtcaagcctggcctattaacggagaattggaccaaaatgaggagttaacaatacatcttccatgtgggtgttcagagaaaagtgattctcaaattgttgtcacgtacacggttcagcggaatgatacacctgtatcaattgctgctctgctaaatgctacgttagatgacatggtgagtatgaacgaagttctggctcagaacccctcattcatagatgttacttgggtgttacaagaaacaaaagttggagataatcattggcatcttagcgggtgtgacattactttcaattattaccttgattattctcagtgtcgttcttag

SEQ ID NO: 86134 - DNA, 348 bp, Glycine max
  Peptide Sequence Number=SeqID_202912
atgggcagttcagatagaatcgaactttcgattgattcgggtacttggaatcctatggatgaagacatggtttctctggatcctattgaatttcattccgaagaggaaccttataaagatcgtattgattcttatcaaagaaaaacgggattaactgaggctgttcaaacagctattggaattatggattttcagtttatggggggcagtatgggatccgcagtaggtgagaaaatcacccgtttggtagaatatgctactaatcaacttttacctcttattctggtatgtgcgtccggaggagcgcgtatgcaagaaaggaagtttgagcttgatccaaatggctaa

SEQ ID NO: 86135 - DNA, 164 bp, Glycine max
  Peptide Sequence Number=SeqID_202913
atggagatcgattttgacaagattcagtcagtaccaacaaggaaagaaggacagattagctctaaaaccttaacttgcttgaatcttcggagatctgagtatcggcaactccctcaacagcttcactcgcttaaaggactacagcataaagtccttgcattgct

SEQ ID NO: 86136 - DNA, 297 bp, Glycine max
  Peptide Sequence Number=SeqID_202914
gattatgaagcaccttttgtgtttaaccgcaagcgattctggagtgacaatgtgggagtatatgaaagcttgagtttaagtctggaagtggtggagattaatgggttcagtggaactgagaatgaacttcttgtgctcatgtatttcattgctaatggagatatgctgaaaaggattagtataaacatgttggaggatgattctggtaggaccatggaacctcaaatccgtgaaaatgcagaatttttgttgacagttccaagggcttcaacaaacttagagatatcaatctgttaa

SEQ ID NO: 86137 - DNA, 441 bp, Glycine max
  Peptide Sequence Number=SeqID_202915
atgtcgatgcagctggccggtttcagcttcacgctgtacgccacggctgtcgccacgctgcgcctgtttggcgatcggctgattaatcactacggcagtcgccgcgttctcacctggggcggtctcgtcgccagcggagggctggctttagcgattttctccgtctggctgtggagcgccctgctcggctttgtgctggtgggtatcggtctggccaatatcgtgccgattctgttcaacgcggcgggtaaccagcgcaacgtcgccgcgcattacgccataccggccgtcacgctgtgcggttactccggactactgctgggcccggcgctgattggctttagcgcccagctcacgtccctgaccaccacgctcagcgccggcatcgtgatgttgctgctggtgactttcgcggcgcgtttcgctctggcagcgaaatag

SEQ ID NO: 86138 - DNA, 558 bp, Glycine max
  Peptide Sequence Number=SeqID_202916
ggtggaccattgggtactagtaccctcgcctttagagcactacacgtcctcgccttcagagggctacaggccagtgtcttcagaggactacacgtcctcgccttgagagggctacacgccctcgccttcagaggactacacgtcctcgatttcaaaggactgcacatcctcaccttcaaagaactacacgtcctcgccttcagagggctacgcgtccttgccttcagaggactacacattctcgccattagagggctgcatgcctttgccttcagaggacaacacgtcctcaccttcataggactacacgtcctcaccttcaaagggctgcacacccttgacttcatagggctacacaacctcaccttcagaggactacgcgtcctcgccttcagagggctacacgccctcgccttcaatgggctacatgcactcgccttcagaggactacacgtcttccccttcagaggactacacgtcctcgccttcagagggctgcacgccctcgccttcaacaggctacaagcactcgccttcagaggactacatgtcctttag

SEQ ID NO: 86139 - DNA, 1682 bp, Glycine max
  misc_feature (19)..(19): n is a, c, g, or t
  misc_feature (138)..(138): n is a, c, g, or t
  Peptide Sequence Number=SeqID_202917
ggcagtacgtccatcaggncgatgtgttgtttgagctggatgccagaagtgccgatgaagctgtgtccaaagctgaagtcgcggtggaattcgcccagaaaggcttcgagcgcaaagaggcactgtatgccaacaatnacacttcgctcaagttgtacaaagatgcagagcagcaacttgaaacggcgaaaaaagacttgtcgaatgcacgtacgcaacgtgaaatcctgcgtatcaaggcgccactcagtggcactatttcaaccatacattacaaaatcggcgaatcgatcagtgtcaatactgtcatggccgacttgatggatttaaagcgcctggatgttgcactcaaagtgccgacaactgaagtagcggccatccacaccgggcagcaggtggaggtatttgccgacgatagctcaagcgccaagccttataccggtaaggtggatccgacgacagatacggtccttgtgcgtgcttcattcgccagtgatgaccggattcggcctgggcagtttgtcagtgcgcgcattcagaccgtgcgcttgccggaccaacttgccgtgcctcaagccagtgtgcttcacggtgatagcggtgactatgtgatgttggtttccgggcaaatcgccaaacaatacccggtgaaaattggcatcaaggatcatggttgggttggcctggcaggtgcaaccttaaaacctggcatgcaagtggtcaccgaaggcttatatgctgcgctacaaatgccgtcatccatctttccgcaaaccaatttcccgcgggttgtcatcctgctggataatggcgtgatgccaagtaatgaaatgatggcgacaatcacacgcccggtggaagagtccatgaaggacatcccgggtgtggagaatgtgcgttcaaaaactgggcgcggcactgctgaggtgaatgtcttttttaactggcataccgatatgacacaggcggagttgtatgtgcgtggcaaaatggcgatggtgcaaaaaacattgccaccgaccgcaaactactctgtgtcgcggttaaccttttcagcatttccggtcatgggcttgagtttaaccagtgacaaacatgatgtgacccagctttgggaaactgcacgctatacgatacaacccaaaatactgcgtctcaaaaatgtggctaaagtgggcatcgtcggggggagagtgccggaatatcatatcgtggtcgatccacttaagctgcaagcattgcattttggtatttctcaggtagccgaccttgtcgcgcgcagcaacgtcatcgccccggctggcatgctggaagaggactataaactttatctgacggtcaccgatggccgtatacatggtacagaagaattagagaatctcgttattgctgcgcctaatccggcatcggcgccaggcagcctcggcggcaatccagctgccacaggcatcgccgaccatcctgtccgcattaaggattttgcccgtgtggagcgcaataaagagcctgctttctacgaggtgaccgccgacggcaagaatgcagtgttgatcaatgtctatagccagccggatggcagcacgctggatattgcacaagcagtcaaagctgaactgatctcgattaataaaagtttgccacccggcatgaaggtacagtttttctatgaccagtctgagctg

SEQ ID NO: 86140 - DNA, 578 bp, Glycine max
  Peptide Sequence Number=SeqID_202918
atctcttcgcgcaccaccggcgccagcccttccgtggcctcgtccaggatcagcaggcgcggattcgtcagcagcgcgcggccgatggccagcatctgctgctcgccgcccgacaggtggctgcccaggtggcgcgcgcgttcggccagccgcgggaacagcgcgtagacgcgttccagcgtccagggctgcgccagcccctggcgattgtgcgcggtggccaccaggttctcgcgcaccgacaggttggggaacacgtgccggccctcgggcaccaggccgatgccgcattgcgccaccttataggccggcagggcggcgacgtcgcggccgtcgaacgtgatggcgccgcggctggcgcggttcaggcccatgatggccttgaccgtggtcgacttgcccatgccgttgcggcccagcagcgtcacgaactcgcccgcggcgatatccaggtcgatgccgaacagcgcctggctggcgccgtaatgcgcggtcacgccgcgcagcgacagcagcgcgctcatgccggcgctccctgcgcgcggcggccggcgtggccgcgttcgctgcccagatag

SEQ ID NO: 86141 - DNA, 204 bp, Glycine max
  Peptide Sequence Number=SeqID_202919
atggtagatatggtggacaaagaaaactacatgtatctatacacaacaaatgaagggaatgtattgttggacacattggagaaggtgtgttatgagtacaaattggtggcaagccctgttggaggacatatcatcaagtccatagtaaaatactacactaaaggagatgcacaactcctagaagagtttttgaatgataactaa

SEQ ID NO: 86142 - DNA, 3318 bp, Glycine max
  Peptide Sequence Number=SeqID_202920
atggacttgttgattgcgaatagtgttcagcacaatgatggttcaaactcagaaggtggtccttcacatcaaacctcgccgctgaatgttgtttcattggtgaaagatatttcgcttggatttccctattttgatggttctactccagtgctagaatggatctttaaggctgagaagttcttttcgtatcacaatactccagacgctttgcatgttgatattgctattatgcattttgacaaggatgttgttccatggtttcagatgctacagaagttagctgcggtatctacttggtcagaattgactaaggctctggaatctcagtttggaccttcactatttgacaatcctatggctgagcttttcaaattgcaacaaacaggttatgtttctgagtattatttgcaatttatgtctcttgcaaatcgttccattggtctttcagaggatgcattttttaattgtttcatcagtggtttagatcctgatattagacgtgatgtgattgttatgactccttctactctattgagggctgttgctttagcgaaattgtatgaagagaagtataatcctactgttaagactatcaaaattaattttgttcaacgttattctcaactgtcctctaatacaaaatatcctactcaagcaaaatctgttactaagacacaacttccacctctgttgcctacaccacctggtccaccgttgaaaacttcaaatgaggaaagggttgataaccctggtgattcattacatcatgataattcggtcactgattcaattattcataaggatcatcatctttcttttaacgctctaaagggaggccttggtgttggtactattagattcttggcttatgtggacaaacttccagtgatagtattaattgatggtggcagctctgatagttttctacatccttgcattgctaaatttttaaagttgcctgttgaaccagctactaagttcaaagtaatggttggtcatggaaactatatgactgctgaaggattagttaaaaaattgagagtgcaagctcagggtaatgtgtttcacttaccgttgaaatttttgttagatggtaagttcaccacactgcaatgggagcataatttaggccctactcatgctcaattacatcatattcaaagaatgatttctactaaggctattgttgaaatctatagcatgcaagtgattgaagagaattcagttacttttcccttaccggatcttccagctgacatagagcctgagctagccttgttattacacagttatggtgaagtactttctactccttcgagtcttccccctcaaaggtctcatgaccattctattcctttgatagaaggatatcctcatagccaaaaggaggagattgaaaagttagtggctggaatgattgatgagggaattatccagcctagtaaaagtcctttttccttaccaattattttggtaaagaagaaagatggttcttggagattttgtacggactatagagctttgaatgccataaccattaaggatacttttcctatacctactgttgatgagttgattgatgagttgtatggtgcatcttatttttccaagttggacttaagatctggatatcaccagattttacttaaaccagaagatagatgtaaaactgcctttagaactcatcatggccattatgaatggctagtaatgccctttggttttaccaatgctccagccacttttcaaagtttgatgaatgatatttttgctggcttacttcgtagatttgttttagtattctttgacgatatcttaatctatagttctaattggaaggaccatttacatcatctggaagttgtggtgcatattcttaagaaacaaaaactctacgctagattttctaaatgctgttttggtgtcactaagattgaatatttaggtcatacattatctggtgatagagtatctatggatttgagcaagctggagactgttaaaaactggctagaacctactaatttgaagcagctacgaggatttcttggcctcattggttattataggaggtttattagatcttatgctaatatagcagcaccacttactgatctattgaagaaggactcttttaagtggaatacttttgcagctagtgcctttctgaaattgaaggaggttatgacttctgctcctgtgttagctattcccaattttcagtttcctttcaccttggagactgatgcttctggaatagggataggtgcagttttgaggcaaaacaaccatcctattgcgtatttttcaaagaaattgtctcctaggatgcagaaacaatctgcctatactagagagttctttgctattactaaagctatggctaaatttcgacattaccttttggggcataaatttgttataaaaactgatcaaagaagtttgaaagagtttcttgatcagaaattgcaaacacctgagcaacaacaatggttaccaaagtttcttggttatgatttcattattcaatataagcctgggaaggacaacatacttgctgatgccttgtccaggagtttttttatggctatttctggtcatgtacctgcctggaaggaaaaagtggctgatcttattcaaaatgattataagttagctaagttgtataagtcttgccttatagggacaccaccatcttctgattatactattcaacatggcttacttttctttagaaataaaatttttctacctgccaatcttgagctgttaaatctgattatgcaggagttccatgcttcaaaattgggtggtcatgctggacaagcaaaagttgatcacctgttacctaccgggttattacagcccttaccaattcctcaacaaatttgggaagacttagctatagatttcatcgtggcattacccttgtctcagggatattctattatctttgtggtgattgaccggttatctaagtttggatactttatacccttgaagagtggctttactagtaaggtggttgctgatgttttcatttccaacattgttaaggtgcatggtatgcctaaaacaattgtttctgacaaagatcgtgttttcatagctacattttggcaaaatttgttcaaagctcaaggtactacattagcaatgacctcttcataccatcctcaatcagatggtcaaactgaaaatttgaataaaactctagagatgtatttgagcatgaccccatttcaagcagtttttggtaggcatcctcctattgtgcttcgttatgagattaacccttccgatccagtggatttatag

SEQ ID NO: 86143 - DNA, 303 bp, Glycine max
  Peptide Sequence Number=SeqID_202921
atgggtcttaaatttcatgatgatccaacggtgaatgagtctgagatcatcgttttattgagacaggtttggtggccccaaaaaagtcttggcaaccttgacctctatacaaaggaagtttttatggaatggataaaacgaaacacacaagatagcttgaatttcttgggacatcctcatagacaacctatccaaatggttgggttgggaacaacattgggaagaaaattggaactaggacataaacccttttctggttgcataaatggtgtggtcagatcacccttaaggatacattcctaa

SEQ ID NO: 86144 - DNA, 693 bp, Glycine max
  Peptide Sequence Number=SeqID_202922
atgggaccaactatcatggaagaagacttgtatttccaactatcgcagaagaagacttggaatttccaggaacacaagcgggctgcattgatgcttgcttattgggtacaatacttgaatgagttgaatctaaaatgtgttcttatgatcatattgatgatgatattacccatcctagggttgcttttctcgctagaaaacaagttatcccttaattccaaatggaacgaagatgtgcagatcagtgatgaaataaatagcctattctatgaacaagaggagaacatcactagtactgcacactgtgcttgtgcttgctgcttctgtggccgattaagcatcatagtcacaagatgctcactctgcaaagctgctatatattgctcaaatgcatgccgtgttaagcattggacgatttcccataaatatgaatgcgttgagatagaagggtcagaaaatcagcatgaatcaccttctaatggaacccatttccttctcacggagcctgaaaatgataaatactcattctgtgaagttgagccgagaaaatatgagggacatgtttactatattgaaggaggagaaaacattgttgagatcagtgatgaaacagctctaaaggatggctgtgcagtgtgtggcaatccaagctctaaagtgtgctcaaggtgcaaagccataaaatattggtaa

SEQ ID NO: 86145 - DNA, 225 bp, Glycine max
  Peptide Sequence Number=SeqID_202923
atggagaagaagaagaaagaagaaaagcaacgtggaagggaggaaaaacttctgaaatttctgaagaaggagagagaagatttggctttttgtacaaaagggccacaaaggagaaaaaattggacctttttggatgctgaaatcctacctcagtttgcgtgccacctctctggttccagttcctcacgtttctctgcacccgtcgggacctgttttcgaaagtag

SEQ ID NO: 86146 - DNA, 228 bp, Glycine max
  Peptide Sequence Number=SeqID_202924
atggaaacgaaacgacaacgatggaagagtgcttacatcgacaatggtgacgtgttgaagaagaagaagaagaagaagaaacgaacaatggcgccgcgaagggagaagacaacgatggagaaaggagagttgcggatcaacttgctgggttgcacacggtcgcagaagaaggaggaagaaggagtcgcgggaagaagaaaagccaattgttgggtgcaaatgttttaa

SEQ ID NO: 86147 - DNA, 825 bp, Glycine max
  Peptide Sequence Number=SeqID_202925
atgtttccagaactcaagatcttgaaaatatgccctgcatattcacttcttcaaacattttttgtgtgtcagtgtgggtgggtgggggcttactacctactacagttggggtggaattacactcgcagaaatgtgaaatttactgatttgctgattttggggcatgttgttcccatctgccagattgtggaaaatgaaattgtatacacaatttcattgaagggccagaagacgggattctatgcagatcagcgtgagaaccgccagtttatatcaagaatttcagatggtcaaaaggttcttgatatttgctgctatagtggcggttttgctctaaatgctgtgcgtggaggtgctctaaatgtcaccggtattgacacatcaccgctagctttggagcttgctaaagaaaatgttgtactcaacaacattgatcctggaagaatatcctttttgagggaagatgctactgaatttatgaagggtgctctcttgagaaatgaatcctgggatattgtcatcattgatcctcctaaactggcaccaacaaaaaagccaggcccaagaggacctagaagaggcccatgtaccttagtgattactcgtagaacagaatcagaagaagacaaagttatggatatgctcaccgcaatatcagcaaggctgtttgcaaccaatttagattccttgctctccaattctgttattatttctgttatttccctgctagccaatgattggcatcgttatcccatatgtatccattataaataccatagtgaggaatgcaaaaaggatagaatattttacctgaaacttccatag

SEQ ID NO: 86148 - DNA, 471 bp, Glycine max
  Peptide Sequence Number=SeqID_202926
atggatttcataaaggaaaggttgttggacatgaggcaaatcaaggaattacttcttgaattcaagaaaggaaagacgccttcagatggtagggaaaacttggtcaacagatacaagaagacagaagaggagaacaatgacagtaacaggtcgagcgaggagtgtgaggaagaggaacccaattcttgtggcatggaggaggaggaggagcccatcaagaaaaccattgatggaattaaagaggtcaaacagatgctacaattgctgatcaagaaaaagggcatcagacttgaatttgaaaagggggataaacaacccatgcaaacagtatcgactttgcagttgggtatgtgggcaacaacgtcacagcaagacagtgtttccgtaaaaaccattgaggacaaagactcgaaaaccattgaggccaaggtggtagaggagatcagggtggaagaggatgagaatttgtag

SEQ ID NO: 86149 - DNA, 219 bp, Glycine max
  Peptide Sequence Number=SeqID_202927
atgacactatgtggccaaggtaagtcatttgaaaaccatgaagctttgcctaattcatcaagaatcgtcagttgtggacctgggaaatctatctttgagtgtgattgcattcagagccctatagttgacgcagcagcgccagctgtcatctttcgttttgacgagaagcaccaacgagaaaaatgggctgtgactgtgccgaatgaggccggagtctag

SEQ ID NO: 86150 - DNA, 348 bp, Glycine max
  Peptide Sequence Number=SeqID_202928
atggcttttcttctatccaacctgaaaccctcactgctaccccaaaccaaatcaaaacccattcctcaaacgccttcaccatcatcagcaaaacccacttctcaaagtccttcattgttcttcttcacttcatctgctccactttccgcactccaaagttccactgcacaggttgctcaggggcacacaccaacaacaggtgccagagacgagcttcagcagcagaaggatgagttttacctcaatcttggccttgctgtcaggaccctccgtgaggacatgcccttcatcttcgtcaaagacctcaattatgacatttacaggtcaatttctcatctgggtatttga

SEQ ID NO: 86151 - DNA, 318 bp, Glycine max
  Peptide Sequence Number=SeqID_202929
atggaggccaatcagttaatgccacaaaggacaggtttacaaggaagcctattgctacaaggtttttttatattccattttgttgattcaactaaggcaaccacaaacagaagagatagttcccaactgattaactcaagaagccatttatggaagtatcgagtgagtgatggttttgttcaaatggttcaacctaatgttttacatgcatcctcaaggaagtccaccaaggcgatgtgggacttcctaacagattggtgcacaatgttgttaatggcggatgacggttcatggcggaaagccaaaaatccgccataa

SEQ ID NO: 86152 - DNA, 1464 bp, Glycine max
  Peptide Sequence Number=SeqID_202930
atggctatggcggccgccatccgcaacccacaacgccaccgctatttggtggcgttttttccgaaaatttgcgacgccagaccgccatggcgccgccataaccgctatttgataacactgttgcctattgttaagaccacaatcaaggctgtcactgctcaaaggactttaaaatctaaatccagattgtctcagaacaaattagaatcaacgacagcaacatcatctcagaacaaatccctatcagctcagaaaaatctagaatcaactactgtgacatcatctcaggacaaggaatcagtttctctgtctcttcctgagaaaagtttgacagtttctgatgatacaaatcaaagttgtcttccatctggagagagcaatctgacaacaaatttgttagagttaattccaaggaaaaaatccttccgccggaaatcatatacaacttcattaattgaaggatctaagattctcaaggaaagtggtgatgttcgagagcaggataacctaccaaatatagataatgaatgcaatcaacttgaagtttctgaatacattgatgacatatatctgtactattgggttactgaggcacataatccacttctagcaaattacatgtcaattcagacagacatttcacctcatttgcggggcattttgatcaactggcttattgaagtacacttcaaatttgatttgatgccagagacactgtatctcactgttacgttgttggatcaatatctttccctagtgactatcaaaaagaccgatatgcagttagttggccttacagcacttttacttgcctcaaagtatgaggatttttggcatcctagggtcaaagatttaattagcatctcagcggagtcatataccagagatcaaatgcttggaatggaaaaacttattcttagaaaattaaagttccgtcttaatgctcctactccttatgtttttatggtgaggtttctaaaggctgcgcaatcagataaaaagcttgagcacatggcattctttctggtcgacctatgcttagttgaatacgaagctttggcattcaagccttcattactttgtgcatcagctctctatgttgcacgatgtactttgcaaataactccaccatggaccccactacttcacaaacatgcacgttatgaagtttcacagatcagggattgtgcggatatgatactgaagttccacaaagctgccggggttggaaagttgaaggttatatatgaaaaatactctagacaggaactcagtagggttgcagcagtgaaaccgttggataaacttccatggactcccactacttcacaaacaagcacggattgtgcggatatgatactgaagttccacaaagctgccggggttacatacgaaaaatactctagactggaactcagtaagggggttgcagcagtgaaaccgttggatagacttaccctgtga

SEQ ID NO: 86153 - DNA, 552 bp, Glycine max
  Peptide Sequence Number=SeqID_202931
atggtttctctcacgggaaaatctagggtgggctcaactcgagcctctgttggcggtggccaatctcgtccaagtgtgggtggtaggaacttcaaggttttttcagaaattgaccggactaaagttggtgatgggaatatgacatatgcaagaggagcaggtgcaagtgcaactgcaaggagtactgtggtagctaacaaaagggttattcttaatagcaccagtagtccaaagggcggtctcaaaaaaagtatggataaaagtagtggcaaatatggtacttctggaagtacaaatgtgagaaaggcattagctgatgtaagcaatgctcaagaaaaattcacaacagccgtggtagctaacaaaggggttattcttaatagcaccagtaatccaaagggcggtctcaaaaaaagtatggatagaagtagtggcaaatatggtacttctggacctggaaatacaaatgtgagaaagacattggctgatgtaagcaatgttcaagaaaacttcacaacagctgttggcattgccagctcaaaaatgaagtaa

SEQ ID NO: 86154 - DNA, 495 bp, Glycine max
  Peptide Sequence Number=SeqID_202932
atgaggggtgtggatgatataacattcaaagaccctttgaatacatttactggtattgagaagtacaaattgatcttctgggcattgaggtttcatggtaaaattttgttccgtgagattgctctagatgtgtataggatatggcagccttcggagaacgtgatattgatcaggtggaacctgaggggtgtgccccgggttccatgggaggctaagggtgaatttcagggtacatctcggtacaaattggaccgaaatgggaaaatttatgaacacaaagtagataatttagcattcaactttccacagaccctcaaaccagtttcagttttggatttggttactgcttgccctgcaagtccaaatctaacattttcatggggtcctttggattccaactcttcttcatggttagagttttatcatgctgttaaggacactgtggatcaagaagagaggttgctaccacaagattgtatggctacatgttcatag

SEQ ID NO: 86155 - DNA, 402 bp, Glycine max
  Peptide Sequence Number=SeqID_202933
atgggcctttcagcagagtggacaaacagtggttgtctcttggctagaaaccagtgttcattcaagaagctcatatgggttttatcctccatctatgcctcccctaatcctgctgctataaagctgttatggaaccaacttagggatattagtcatttgtgtactggtccgtggttgatgttaggggccttcaatgaaattcttggccctcaagaggtctctggaggaacattttcgatgtctagagctctcacgtttgctaatatgattgataagtgtaacatgttggagattgagatgaaaggtggccgctttacatggagaaagaatattcagaatggaattcacgtcaggaaaaaattggataggtgtttgtccaatccagattggcgtatgcattag

SEQ ID NO: 86156 - DNA, 294 bp, Glycine max
  Peptide Sequence Number=SeqID_202934
atgaccaccggtggtcgcagcaagccgtcgttgtgtgccgttgaaccctcgcaccaagaggaacactttaatcggagcagaatcctcaaaaatccttctcaaggattcagtggagaatgttcccccaatcctccatttcgtagcttttctgaggggtatttgactccgaatattgttgttaactttacttctgaaatctatgctaaatttccttcaatttggtatatagaaacttgtgtttggacttacgagcgtgaacaagagagacctttgagtaacgtaaagaggaaatga

SEQ ID NO: 86157 - DNA, 879 bp, Glycine max
  Peptide Sequence Number=SeqID_202935
atggttacagggaaacacaacggcggagttaccaacaaagccgcattggaagccacacgaataacggtgtcgttttttgtcaatgagctcaggggaaatggaaatggaaatggaaaggaaaacaatgataatgttaacattcctttgagtgttgtagacacaaatggcgttgtttacgagcttcaggtgttggtaaagacgggttcagatagtcgatcctgtatagccaaagcgggagcaattttgctactagatcggttccttaatgcagaggagaatttgagcctacaggctaacatcgtgatgacgacgacgatgaaggtgtttagcttgtcagagggggcaaggagggacgcgttggcggcgatgttgaatttggtggcagataaggagacagtggcaaggttggtggagaggggtgtggtggggatatcagcaatgtcggaagaagggttgacgattctagaggcggtggtgaaaagggggatgggagagagtgagggagagcgtggcggcgatgctagtgactcggttgaggattccacggcggcaaggcttaatggcggggagaaggaaaggttcacgacaactactaccatggtttcttcgtcaactatattgaagagcattctctactcacggtaccatgttgttatcatgttccgcaacacgcgattcgggattagactattgataaagccacttaatgaggaagaggtatccaccatgcaagagatgcttctaagagctaatgtaagagattatggaagatttgatcctccaccaggtcacgttcaaccccctagcaaaggaataccagcagctgctccagacccaaatcatccacctcctcctcctggtaacggtggatgcaaatga

SEQ ID NO: 86158 - DNA, 597 bp, Glycine max
  Peptide Sequence Number=SeqID_202936
atgagtcaaggaaataggaattatttttcatgtcccatctgcaggaatcaacgaaggcgtcacgatgataattgtgagtttgggcaatactttcttggtagatcaacagactttgagagtgcttgtaggctctttggattcgcaaacttggttagactgatgcgttctgtggaaccatctgaaaggcaagctactgccgattccattttaatggaggcaaacatttgggatcgtgaccctattaacggtgcctatggtcatgtgtttaatttggtttcccaaatccagtcatttgaaagcgaattagaaactataaataattggctggcgcatattcgagatcaacaaaggcaaccaagttcattttcccctaacatcccaaaccaaagtatccaagatgaaggttccaacaccccgattccaagcttgattggagcagatatctctacaaggtcttctgaaaaaggagaatcaagtattgttgcgcctaaggaggatgcgaatattgtcgttagagagagagattcaaaagttgatgacaatgaggaaggcactattcctgataaagaacaagtagattatttccgtgacgactaa

SEQ ID NO: 86159 - DNA, 405 bp, Glycine max
  Peptide Sequence Number=SeqID_202937
atgactaagacaagtatgcgagctgagaatatcgatgtgtatggatttttcgagccacagtctatccagagatctggccaatcacaatttgaatcagaaagttacattaagaactggatgcaaaattcaaaacgggatgtgtacctaggagcctacctgaatggtgcacattggcaaatggtcgtcattttgcctaaggaaaatgttgtcatttggttttgttcgttgcataataagccaaacaactatctcaaaggcataattaatagtgctttgaaaggacttgagatactcaacaaatatttcactgattctagaccattggaaccagaaagattgaaggcgcttcgcaaccagtgggcaaagtactatttgaaagttaaaaatgaaacttacgatgtttag

SEQ ID NO: 86160 - DNA, 129 bp, Glycine max
  Peptide Sequence Number=SeqID_202938
atgtcagtcaaaaacctcgtcggacgcctaggagtacatgacaagacagaccacacacttgtaagccaagtcactttcgctaggcttaaaggaggactcaaatcgggtgtatttaaccccaaggcctag

SEQ ID NO: 86161 - DNA, 276 bp, Glycine max
  Peptide Sequence Number=SeqID_202939
atggcggaagtgacgaatcgaattagccatgaagggcaatgtggttctcagcaaaaggaaatgaaatacagtgctgatgaggcagctcaatggggcatctttagttgggtaaccacaaccaatggtggcacccctttacttgatgcctttaatcatgcaagttctgacatggacgatacattaactggggacatgccttcgatagacttggccacggagaagaatttgaatgatctcgtcaaagttggggaatcattgttaaagaaaccagtttaa

SEQ ID NO: 86162 - DNA, 231 bp, Glycine max
  Peptide Sequence Number=SeqID_202940
atgtcatcatcaccagaaattagcgtgtgcgtgtggaaatcatatcttgcaaagagggaaataggaaggggaaatttgaacactgaaaaccctaacatgtttggattgggattgagattgggaatgggagaggtgaggctaaggaggaagatgataggaagaaatatggttggcaccccgcgtctttatgcactttttcaattcttcttcctttttttatattttaaataa

SEQ ID NO: 86163 - DNA, 852 bp, Glycine max
  Peptide Sequence Number=SeqID_202941
aaatcacttgataagaaagaactacgtaggtctgatttcctcatcgcaattgaggaatacgtaggagcaaagggaaacacccttgcatcccgcgagtctcgcgtcgccctcccgccgaaggacatccgtgctcctgtagcagggctaacgtggagggtggaatgtgtctctaagtgccacatgggatttgtcgatcctggacaggtgacgagtttgtcaagcccccaagcttggacatgtgttgtccgagctgcttctgtcaagtggtttatgatggacgtgtcaggggacttgattgagcaacccatcatggattgggaggtcatctcgataggtgattcctcatctaaggatactcaccgaggtgccttcgctagcgagtcgtctgccgggagccaccaaactgccagtcctagtaattgtgatcctccccctttctccttctggggtgtgaggaaagctggtggcggtggagatgtgaggtcgtctccctgcattcgacctagcatgagtgttgggtcactattgtccgcccccgtcgttgctggctttgaacggacaagggatgatgtgctgaagtataggtcaaccttgacaatcagtgtcattgtgcttcaacgccaggaccattttttcaaggtcttggctactgatgtcatggttgatggcaggttcaagtcgtatgacgaggatctattgaccattgtgggaagggtcgacaaagcaatttcggagcagctgtcaaccttgttggatgcgcaggccattttttctcttctgtcagcgagcgatcctctcactgccttggatgaaataatgggcgacttcgcttggaggccactcgtgaagtag

SEQ ID NO: 86164 - DNA, 312 bp, Glycine max
  Peptide Sequence Number=SeqID_202942
atgaagttacttcagaccgtgggggagagatggaggcagtttaaatcagacctcacgaggaaatggacccttgcagccgatcaggacggtgtcgaggacactgtctgtgacaaatacggcatcagcaaggaaaagtggacccagttttgccagactcgcagagacccttcttgggaggcacaggccatccaaaagcagaatactgccccccacgttttgtctcgtgggggttatgattatttggagcagaagctcctggcggagaagaccaagaagaagatgcaggaagctgcacagtcagggaagcgttaa

SEQ ID NO: 86165 - DNA, 1011 bp, Glycine max
  Peptide Sequence Number=SeqID_202943
atggtttcacactattcatcttcggattttgctcaacttcatggcaaaactatttatgttcaatattctaagagacaggaatttgtcgttaacaaattcactgaaggaaatatcttgattgtatccatggaaggcatccaagctggagatataagcattgatgccattcatttggtcttttctgcatttggctacgttcacaaaatttctacatttgaaaagagtgcaggtttccaggtgcatccagatcttaatatcaagtttcagtctaatcgtagcagggactacacaaatcctactcttccggttaatcaagcttctattgttaggacattacagccaatacctcgacctactgaaaatcatgtcctttgggcttcatttgaaaatatgcagtatgatgtcactgtggatgttcttcatgcgataagggtcccttcttcacttggcatactcgagacaaagccaaacgtgaacaccttaaatgtagccacagcaacaactaccaaaaaagctcttgaggggcattgcatatatgatggtggctattgtaagcttcgtctatcatactctcgtcatactgatatcaatgtaaagggtttcagcaagaaaagtagatactatacaaggcctaatcacagtgtgtctgtagaacaagttccagcaatagctttggagaatccccatgcaacctctatgtatggtagtagtagtgcccgtgctttacaggatcaagtacatgcaggacaaataccatcatggaatccaatctacagttacatgcctgcacctggtacttttcctaatcaaacttatgtagttcctccatatcctgcctatgctcttggtcaaagcaataatatggttcataatgaaagttacgtggaaatcactccacccggggttcctggttactcacctcatatgcatgcatgctggttttgtgggttttttagctcctggtgtacaaccttattattatggttactaggttatatgtcagttgaatga

SEQ ID NO: 86166 - DNA, 447 bp, Glycine max
  Peptide Sequence Number=SeqID_202944
atggcagcggaatggagaaggaagagagagaggagacgccacttcaaggagaagatgagtctagaagaagctcaccaccataggaggccatggataagagtttggagggagaaagagatgaatgaagggagaggaagagaagagcacgaaattttgtgctctaaaagagctctgaaatataaaggtagaaactccaattattgtgacctaatgttgaattcaactcagtttcaggccaaagaagaaaaggttaaagctgctgatgactcgcttaacgagacagatccgctcagcgagatgaatccgcttagtgaaacatccaactcgcttagaggattggaaaccctagaagaggataagtcaaagatctgtacgcccagcgtgcagccagcccgcctagcgaggacgtttgtctcttctcatgctcagtgtgcccttactcgctaa

SEQ ID NO: 86167 - DNA, 435 bp, Glycine max
  Peptide Sequence Number=SeqID_202945
atggacagggcgaggttggtatatgggctcgtcgtgaagatggacatggacatgggcttgatcatttctggtcaaatctcacagatggcccagcccaactcctctcggctcggatttcctacactgatcacaaccttgtgcatcgccagaggagtggtccctagttcgctgacctttgagtccctgagcccgaccattaacttggcctacatcaggaagaactactggaacccagatgatccgatgatcacttttcctgggtcctgcaaggctagggctcagggtccctcagatgcttctacttccactccagctcccacaccagcacctgcacctgcaccagttcctcctccagcacccatagcaccctccggcccctccacttcgagcacaaacatgatagtgtcgatgctgcaaagcctccaccatggctaa

SEQ ID NO: 86168 - DNA, 246 bp, Glycine max
  Peptide Sequence Number=SeqID_202946
atgcagtacaacgagtttcgtcaggaacttaagagatgcaggtggcacaaggccttgaccaggcagtcggataaccatattgatgtggggttggtcaagaagttctacgctaatttgttctgtcacactcacttggacccacatgagcttacatcaaagctctgtattccagggcgagggttcatgttgaacgctgagggagccccttggaagcttctgaggaaggacctcactaccttggcttag

SEQ ID NO: 86169 - DNA, 447 bp, Glycine max
  Peptide Sequence Number=SeqID_202947
atgaaagtaagcaagaaattaaagggaaaaagtaccagtttaggctccatttgcaaactatttaccaataagggtctgttttcaaacattttaccggaggggtctgtttttatttgcattgcaccaaaggcaggggcgcaatacaacggggagctgacatgtggcattgagctgttgtgccaacagatatgcacaatgggttgctacagttgtagtggcgcaaccacttttggacaggcttttggtagcgtgtgcagtgttgaccagctggaaaggggttggatcatgcgggcaacttcttcatttgtgtcagatatatcatcgatatcagtagaagcaaagcttcatgatgatgacaaaggtgatgacaaaaagctcaaagatcaatcaaagaacaactcaagtgaatcaaagatcaatcaagaacaattcaagagttcaagataa

SEQ ID NO: 86170 - DNA, 1305 bp, Glycine max
  Peptide Sequence Number=SeqID_202948
cacagccacggtgcggataccagcactgcgctctccaatctgctgctggtgaccagcaactacggccagcccggcacaggcggctatctgatgcgcggtcacaataatgtgcagggtgccagcgattttggctgcttacgcaatgtctatcccggctacgaaaaagtgaccgatgcgcaggtacgggaaaagtgggcgcgcgcctggggcgtggcgccggaagcgctttcctcagaggccgggctggataacttcatgatggtggaagacgcgcataaacagcgggtgcgcgccatgtacatcatcggcgaagagaccgccttttctgatgcggactcgaccaaagtgcacgaagccttcagccggctggatttcatggtggtgcaggacatcttcatgagtcgcaccgcgcagttcgcggatgtgttgctgcctggctgtccgagcctggagaaagagggcaccttcgtgaataccgaacggcgcattcagcacttctcgcctgcgtttgcgccgctcggcgacagccggcctgactggcagatactgacggaggtcgcggcgcgtctcggccatcactggcactacccgaatcccggcgccattatggcagaagctgcgggtatcgccacgctgtttgccggggtcagctatgagaacctcgtcggctggcagtcacagctgtggccggtaaacgccgacggcagcagcacgccgctgctgtataccgaggcgttcgcctttcctgatggcaaagcgcgtctgtatccactgacgtggcagccaccgatggaagcgcccgatgcgcagtacgacctgctgctgaacaatggccgcatgctggagcatttccagtcgactaatcagaccgggcagggcgggcgcatcaaatcgctgtcgcccaactggtttgttgagatttcgccgcagctggcgcaggagcggcaactacagcagggcgactgggtggagctgcgttcgcgccggggcagcgtagaggtgccagtggtggtgaccgaacggatggccggcaatgtgctgttcattcctatccaccatggcaaaccgggggtgaacgggctgaccggtgaacaccacgatcccgacgtcaacaccccggcctataaagagattgcggtgatgatgcgtaaactggcgcatgcgccacagccgcacccgattccgctgcacaacttccgccacggccagcgcacgccgctggatcatctgcccgttgaacaaaaatggcagcagcctgaataccggttgccgcctgaacacgtttcgcatccggagaaaagctaa

SEQ ID NO: 86171 - DNA, 339 bp, Glycine max
  Peptide Sequence Number=SeqID_202949
atgtcacgccaagatgactttgtgcgttactcattcacaggaaaaactccaaaaagatttgatattccttcgggatgtagcattgacagactcaaggatgtgatcaagcaagttgtacctcaagggattcccccttatggtcattctgagtattcagaaaaagatatcaaatttgaaataattgagctgaaaactgacgatgacatgctgaagatcttagtacagtctaactactggaaacgatttggcccaataaaaattttagttgcttttagtaaactgataaccaaaatggaagatgatatgtcttggtcgcaacatgattcaatgcaaaattag

SEQ ID NO: 86172 - DNA, 390 bp, Glycine max
  Peptide Sequence Number=SeqID_202950
atggacacgtgctctaataccaatgttgtgcatgacgacaacttcataagtaatcttggaaggacttttagtgagtcattacacattcaagatgctcagaaatctttacttgcttctgaggggagtgacatctataatgtgaatgaggaaaaaatatgtaaagcaatgaaagatcaagcgacaaaagtaaatatggcgtgcttgaaaaaatctgcaacctttccaattcctaataccatgttgccttcaagctcgtctgataaggaggctgatacttcagtcacagaaccactctatgagcattctgctcatcaaacttactcacgctctgtatctctgcctggcaatttggttcttgaggctcccacctatgtatcacatatgcagtaa

SEQ ID NO: 86173 - DNA, 114 bp, Glycine max
  Peptide Sequence Number=SeqID_202951
atgagtaggagtcatagtgacataaaatgttttgatgtgaacctgactaggagtggatcgtttgatacaggctacggagatttggatgacaccacttccagtgaaggaagataa

SEQ ID NO: 86174 - DNA, 512 bp, Glycine max
  Peptide Sequence Number=SeqID_202952
gtctttctagactgacaaaagatgaaaaccttaaggaagcattttcttcttttgggcagctggttgaagctaaggtgataactgatagagcctctggaagatcaaagggattcgcttttgtaacttatacaaccatagaagaagctgaaagggcaagagaaggaatgaatgctaaatttttggatggatgggttatatttgttgatcctgccaaaccaagagagcctagacctcctcagcaatcacagtctcagccctctgaaataggtttcactgtcaacaaaacggttggctggtgcattaacagcaccttgatggcaaaacaaaggagaggcatctccacggaggaggtgtggcccatgataccatcggacacatggtttggcagcacgaggccatcacaggatcacgatgatggcggcgacggcatggcaatacaatgcagcctttgcggagttagcaaaaaaaaaaaacatagcaacaaggagaaggatgacgatgagaatatttga

SEQ ID NO: 86175 - DNA, 1626 bp, Glycine max
  Peptide Sequence Number=SeqID_202953
atgacgtcgttcttgaagcctgagaatgctctgaaaagggcggaagaattaatcaatgttgggcagaagcaggatgctttgcagactctccatgatctcatcacctcaaagcgatacagagcgtggcagaagacacttgaaaggattatgttcaagtatgtggagctttgcgtcgacatgcgaaaaggccgttttgcaaaagatggtcttattcagtatagaattatatgtcaacaagtgaacgttagttcactggaggaggtcataaagcattttatgcagctttctaccgagaaagctgaacaagcccgtagccaggcgcaggcactagaagaagcccttgatgttgatgatttagaggccgataaaaggccagaggacctgatgttgagctatgtcagtggcgagaaaggaaaagacagatctgatcgggagactgtgaccccatggtttaagtttctttgggaaacttataggacagtgctggaaatattgaggaacaactcaaagctagaagccttatatgctgtaatctttcttcttatgttcttgtacaacttcttgatgctatacatgattcatatgtatttgcttaatatgacagctcatcgagctttccagttctgtaagcaatataagcggacaacagagttccgcagactgtgcgaaatcattagaaatcatttggctaatcttaataaatatcgtgaccaacgagaccgacctgatctttcagctcctgaaagcttgcaactgtatcttgatacaagatttgagcagctgaaaattgctactgaacttggactctggcaggaagccttcagatcagtggaggatatacatggactgatgtgcttagtcaagaaaacacccaagccatccttgatggttgtttattatgtgaagctgacagaaatattttggatatcatcgagtcatctgtatcatgcatatgcatggttcaagctctttttattgcaaaaaagcttcaataagaatctgagtcagaaagatttgcaattaatagcttcatctgttgttctggctgcactttcagtgcctcctcatgatcacacccacggtgcatctcatttggaactggagcatgaaaaagagagaaatttgagaatggctaatctcattggctttaatcttgaaactaaacctgaaagcagagaaatgctatcaaggtcatcacttcttgctgaactggcatccaagggtgtgatgtcttgtgtgactcaggaagtgaaggacatttaccatcttttggaacatgagttttatccctctgatcttgcattaaaagcgctgcccttaataactaaaatctctaagttagggggtaagctttctactgcatcatctgttccagaggtgcaattagctcagtatgttccagcacttgaaagactggctaccatgaggttgctgcagcaggtgtctaatgtgtaccaatctatgaagattgaaaccttatcggggatgatccccttctttgatttctctcaagtggaaaaggtttcggtagatgctgttaagcagaagtttgtatcgatgagagttgaccacatgaaaaatgctgtgattttttgcaaaaagtatcgttatacaaatgtaatataa

SEQ ID NO: 86176 - DNA, 303 bp, Glycine max
  Peptide Sequence Number=SeqID_202954
atggaggagtcattagaaatgtcatttcagggattggaaattgtgaacaatgcttatgtggagtctcctctgatacaactgagtttgtctgatgcctctatggtggtggctcgagtcatactaaaagatggcttgttggagattgctgaaaatcatgggaggtctggtttgggttacaagcctacaagtgctgataaaaggaggattcctttggaaagaaaagagaaatgctttgctcgtttacaagggctagaaccgcaggtggagagggttcctatttgtcacatcaatgagagcttttga

SEQ ID NO: 86177 - DNA, 678 bp, Glycine max
  Peptide Sequence Number=SeqID_202955
atgaaacaggtgcctccaccagggaaagggtcactatatattaggccattgctcatgggaaccggagcttctttgaacttgtctccagcacctgagtacacattacttatttattgttctcctgtcactaattaccacaagggttcactgaacttaaaagtggagagtaagttctaccgagcaatatctggcactggtggaaccggagggatcaagagtgttaccaactatgcccctgtttatgctgcaagcattgaagcaaaggccagtggattctctgatgttttgttcttggactcagcaactggaaaaaatatagaggaggtttctgcatgcaatgtgtttgttgtgaagggtaatgctatctgcaccccggcaacaaatggagccatcctccctgggatcacacgaaaatccatcattgagattgccttagatatgggttatcaggtcacggaacgtgccatatcagtggaggaaatgctagatgctgatgaagtgttctgcacaggaactgcagttgttgtcaactctgtttcatctgtaacctacaaagaaacaagaactgagtataaaacaggaccagaaacattgtcccaaaaactgcgcaaaacactggttggaattcaaactgggtgtattgaggacacaaagggctggacagttcgaatagattga

SEQ ID NO: 86178 - DNA, 621 bp, Glycine max
  Peptide Sequence Number=SeqID_202956
atgtctctcccttctgttttggggaattctgaagacaattcaaaaagcagtgttgctgttgaaaactgtgctggcataaactgggatgagcttggatttaacccagttcccacagatttcatgtatgtcatgaaatgtgcaaaaggagaaaagttttctgaaggatccctcattccctatggtaacatagagatcagcccttttgctgtgatactaaactatggacagggaatctttgagggactaaaggcatatagaactgaagatgggtgcatccttctgtttagaccagaagagaatgctcaacgaatgaagataggagcagacagattgtgcatgccatccccatccattgaccagtttgttgctgctgtgaagcagacagttcttgccaacaaacgttgggtacttatttcttcctgtctatctttaaagtttaatttctatgtaccacccattcttctttctcttcttcaagaaatatcgtttgagcttgtggaacatcgatcggatgtgggcgtaaggggatacgtagaactgcacccgtcagttagcagttgtcgctatccatcacgcagtggaggtgctcgtcagagtggaggtcatgccttacgtcgttga

SEQ ID NO: 86179 - DNA, 288 bp, Glycine max
  Peptide Sequence Number=SeqID_202957
atggtggagctccgaggcattccatcaaacattgaagacaatcccaatgtgcgaactaactcgcttgaaatccatgggagttctttaataagtgttctagaggatgaagatacctgggaattgaagaaaagggtggaggatgtcttaacttctaagaggtttatcttgaaagtgttgtgcaaagccagtatggttgattgtgagggtaatgaggaggatcggtgcccgctgcatccaaagacacttcatgatatggaagaatgcttattgtttaaggagcttttatag

SEQ ID NO: 86180 - DNA, 558 bp, Glycine max
  Peptide Sequence Number=SeqID_202958
atgggaactggagcattgttaggtgcactaaacttgaaagttgaggataaactatataaagcaatatctggcagtggaggaaccggaggaatcaaaagtgtcaccaattatgcccctgtttatactgcaataactgatgcaaaggccaacggattctccgatgtgttgttcttggactcagcaactggaaaatatatagaggaggcctcagcatgcaatgtatttgttgtgaagggcaacgctagcttcactcctgcaatagatggaaccatccttccaggaatcatgggaaaatccatcattgagattgccattgacttgggttatcgggtattggaacgtgctgtatcagtggaggaaatgctgggtgctgatgaaatgttctgcacaggaactgcaatggttgtcaactctattgcatctgtaacctataagaaaacaagaatggattacaaaacaggaccagaagcattgtctgcaaaactacgcacaacacttgttggaattcaaacagggtgcgttgaggacaaaaagtcatggacagtcctagtagattga

SEQ ID NO: 86181 - DNA, 334 bp, Glycine max
  Peptide Sequence Number=SeqID_202959
atgtctcccccttctattttaggcaactgcaagacggttctgaaatgtaatactgctggggaaaactatgctgacattaattgggatgagcttggatttagtctagttccaacagattacatgtatgtcatgaaatgtgcaaagggagataagttttcacaaggatccatccttccctatggaaacttagagattaacccttctgctggaatcttaaattatgggcagggaatctttgaggggctaaaggcacatagaactgaggatgggtgcatacttctatttcgaccagatgagaatgctcaacgcatgaagagaagtgcagatagattgt

SEQ ID NO: 86182 - DNA, 249 bp, Glycine max
  Peptide Sequence Number=SeqID_202960
atggtgtcattcaagttcatggccgaggaacgcaaattttcggttgatgaatttctagaagctgatgaggttttctgtactggaactgctgttgggatctctgcggttggaagtgcaacctataagaatacaagggttgagttcaaaacaggagccgacactgtgacccagaagttgtttgatatgattacaggaatccatacgggtcttttagaggataataacggatggatggtgaagattgattga

SEQ ID NO: 86183 - DNA, 213 bp, Glycine max
  Peptide Sequence Number=SeqID_202961
gttttccaagtgacgaaagaagcaaaagccaaaggattttttgacgtcctcttcctagatgcagaggaacataaatatattgaagaggtatcttcgtgcaatgttttcatggtcaagggtgacgtgatttcaacttcacctacactcggaactattcttcctggaataacaaggaatagcatcattcaacttgctcgtgatttgggttaccag

SEQ ID NO: 86184 - DNA, 399 bp, Glycine max
  Peptide Sequence Number=SeqID_202962
atgaaggcctacagaagagcagatggtgaggtgcagatatttcgaccagaacaaaatgctatgcgcatgcagatgggagcagagaggttgctaatggtggcaccttctgttgagcagtacgttgatgctgtcaaacaagttgttcatgcaaataagcgttgggtgcctcctcatggaaaaggagcgttgtacattaggcctttattatttggaagtggatctgttatgggtattgcacctgcaccacattgcaccttcctaatatacactaatccaatttccaacgcttacaaaggacgacatactaattcaaccttgagcttgttgattgaagatacacttcctcgtgcatttcccggtgggactggaggagtgaaaaatataggcaattatgcacca

SEQ ID NO: 86185 - DNA, 372 bp, Glycine max
  Peptide Sequence Number=SeqID_202963
atggcactttcccatcaaccagcagccaacggggaggcagaagatagctataacaagatggactgggataagcttggatttcaagtgattccaactgattttatgtacataatgaaatctaatgaagaagggaccttctcaaatggagatctcgtaccatttggaaccgttcaaatcgaaccacattctactgttttaaattacggacagtggaatgaaaaggaaaaaattggaaagagagaggaagagatggagaaagagttttttatttatttatttgaagttttgtttaaagttaaagcaagaaaaggagacaaaacacctaacaaaagaaaagggcacaaaacttcctccccacatggaaaatgctaa

SEQ ID NO: 86186 - DNA, 342 bp, Glycine max
  Peptide Sequence Number=SeqID_202964
atgaagttcaacaaagtcagagatgcaactgattgcttttccatagacaatgccatttggaataatgtacaagggaagaatgtgtccaccttgtcgtcaagcacagttattatatggttgaaatttgaaatgtttaatcaacaatccacggtttttattgtgtgtttaaattggattatagggcattacacgtgtaagcgtgtgagagaaatggaaatgaaaaaaagtagcgtgcagaaagaaagtggaggaggagtggaattcaagatcactttagccatttcagtgggggaaaaccaggcgcaatcaaaggtgatatgtagaaagtatagcccacgttaa

SEQ ID NO: 86187 - DNA, 867 bp, Glycine max
  Peptide Sequence Number=SeqID_202965
atggaaagaatgaagtccacgatgagtttgaccgaaatcaaagatgcaacagactgcttttcattagaaaatgccattgggatggggaaaattggaataatgtatgagggaaggctaactgatggttcgaaccttgccattaagaggctttttggttctaaacaatttaagaaggaatttcttttggaaataagaattctggaaagaaatgagaggattctggtataccaacacatgccaaatggaaggctttcaaaatggttgcatcctttagaaagtgaagttacaagattgaattggcctcagaggatcaaaatagctcttggggtagcaagaggcttatcctggctccattatacctgcaatttgcatgttgtgcatcgtaatataagttcggagtgtgtcttgctagacaagaattttgaacccaaaatatccaattttggaaaggccaagtttatgaatcccaacattgaggatggtgcaagcacgatattttatgcaagtgatgggaagaaggatgtctatgattttggtagtttgatttttgagctaatcacagggaaaacatttaacgagttgtcgcgttcatcatacaatgctactaacctgtctggcaacccatcgaatttttatgatgcaattgaggaatctctcattggggaaggttttgaaaatgaggtctacactctcatcaaagttgcatgtaagtgtgttaagcctttcccagatgaaagaccaacgatgcttgaagtttataactatatgatcgatatatggggagagcgacatagaataagtgatggttctgacacactcaacgtatctagttcttctactagtgtagatgaaattgttgagctataa

SEQ ID NO: 86188 - DNA, 1842 bp, Glycine max
  Peptide Sequence Number=SeqID_202966
atggtttttcaaataaaaagggatattctcatgcatgccttctggtgttcttccttactcagtttctacatggtagtagtagctcatggcgttgaaagcgatatatcctgcttaaaatcaattaagaacaccttagaagacccacataacaaattatcaagttggaagaacttcaacaacaaaaccaacggtttcatatgcgatttcgttggcgttgaatgctggcaccctggcgagaataaagtgctacatctcaacctcacaaacatgggtctgaagggtgagtttccacgtgatcttcgggattgcccttcattgacatccttaaacctttcacacaacgagctcacaggacccatcccatctgatatatccacattactcccttatgctacttccattgacctctcaaataacaagtttaatggggaaattccaccaagtttgggtaactgcagttacctgacttctcttagacttgataacaacatgttaagcggtcatatcccacaagaacttgggcagcttcaaaggattagaaacatctcttttgccaacaataatttatcagggccggttcctctgttccaacctgggttaacttgtgttgattgttatgccaataacagagaactttgtggagggcctttgccaccatgtgggtcaagcgatgatttcactgaaacattcaagaagggccttgctattggctatgctttttcggtgacttctgttattgtcatttatatctcctactttgcaccttgggaacaatcagaatcaaagcataaaacaaattacaaggctaaagaattccgcaaatatatttgctccatcgcagggaggaagacaccaactgaacctcataccgaacaagaattgcaacctctgcagttgcaagagaaagctatcaaagagatttctgtagtgacagacagaatgaagtcaacaatgaggctcaacgaagtcagagatgcaactgattgcttttccatagacaatgccattgggatggggaaaattggaataatgtacaagggaaggttaccaaatggttggaaccttgcgatcaagagactattcgattctaaactatttaagaggcaatttcttttagaaataagaattttgggcaagtacagacacaaaaatatagttcccctgcttgggttctgtgtggaaggaaaggaaaggattctggtataccaatacatgtcaaatggaaggctttcaaaatggttgcatcctttagaaagtgaagttacattgaaatggcctcagaggatcaaaatagctcttggggtagcaagaggcttatcctggctccatcatatctgtgatttgcatgttgtgcatcgtaatataagttcgggatgtgtcttgctagataagaattttgaacccaaaatatccaattttggaaatgccaagtttatcaatcccaacattgaggacagtgcaagcacaacattttatgtaagcgacgggaagaaggatgtctatgactttggtagtttgatttttgagctaatcacagggaaaacatttaacgagttgtcgcgttcatcatacaatgctactaacctgtctggcaacccatcgaatttttatgatgcaattgaggaatctctcattggggaaggttttgaaaatgaggtctacactctcatcaaagtagcatgtaagtgtgttaagcctttcccagatgaaagaccaacgatgcttgaagtttataactatatgatcgatatatggggagagcgacatagaataagtgatggttctgacacactcaacgtatctagttcttctactagtgtagatgaaattgttgagctatga

SEQ ID NO: 86189 - DNA, 984 bp, Glycine max
  Peptide Sequence Number=SeqID_202967
atggtaatctgttgtcgcatgcattttcatgaacagaaacgaaagagagcaagacagatagacagagatcttcctgtggagttgctagagagaagaataaagatcaatgacattggatggttgacatgtagaacgagcttcgcagaactgtatgaagcaaccgaacacttcagtgaggacagtgtcattggtgagggaaggactgggacaatgtacaaggcaacacttcccaacggttggttcttgctggcagttaagaaactctatgattctgagttgtgtatcagaagtttcgatttagaaataatgatggggaggtacagtcacagaaacataatggtccccatcagtttctgcatagaagaagaaaaaaatgaaagaattttggtgtatcattacatgtcaaatggaagagtttctgattggttgaatgataccaccacattaggatggcctgcagttataaggattgcattaggtgttgcaagagggttatgctgccttcatcatagcttgcatatggttcatctcagtattggtcccgagagtatcttgttaggaaacaattttgagccaagaatatccaattttggaatggccattttcatagactatgatctagacaaaaacattggatttgataagaaggatgtgtatgactttggaactttgctttttgaggtgattagggggaaggcattcggccaaacaagtaaatgttttagcaatgctaatactaatggtccttttacaacttacacatatgctactaatctgttcgaggacccttttggcttctatgatgccgtggataaatgtctaaatgagatagaatttgaagatgaggtttctgctttactcagagttgcatgtgactgtgttcatcctttacctcctaaaaggcccacgatgcttgaagtgtatagtaagatgagcaacatatgggagagagatggcctttttgaagattcttccacgttctag

SEQ ID NO: 86190 - DNA, 216 bp, Glycine max
  Peptide Sequence Number=SeqID_202968
atggcattagcgtgtgacttttgtaaggagacaacccatgggatattttggtttagaataggtagcaaaatacctttggcaatttacactttgggtatgatagcgaaatacttggatgtattagaaataccaagaggtgcacatgtgcaatttttggtaccccaaaatgctttgagtatgcatgtatgtgaatttagccaaggagatgtgtgtgat

SEQ ID NO: 86191 - DNA, 702 bp, Glycine max
  Peptide Sequence Number=SeqID_202969
atggcgtctacactacctgctggggacgaagaaacgccacttgtgcccgatgataattcggccatcgaagctcgcaagagccaccactccacggatattcacatcctgagcttggcctttctcttggtctttctcgccttcggtgccgctcagaatttgcagagcactctcaacactgaggatgacttgggtaccaccacactcgggatcttgtatttgtctttcacattcttctccgtggttgcttctttggtggtgcgagttctcggctccaagaacgctttgcttattgggactactggatatgtgctttatgtcgctgccaacttgaaaccaaattggtatacattggttcctgcttctgtgtatcttgggttttgtgcttccataatatgggttggagagggaacatatctcacttctgctgcacgcagccattctacagataacaacttgcatgaaggtgcagtaattggtgactttaatggggaattctgggctgtgtatgcactccaccagtttattggaaatcttattacatttgctctactgagtgataatcaacagttcatgatattgcccatgcttatccctaccttgttagctactaaaaatgaagaattgccacttgtgactcttcagaaaaaagaaaaaaattcaactaactttacaattgatggaaccctaggtccaaattgttga

SEQ ID NO: 86192 - DNA, 697 bp, Glycine max
  Peptide Sequence Number=SeqID_202970
tggtgagaggatggtgggtgttatttcgttggtaacaggaatggctggtccaagtgggtttggatcagcttcaactgcagaacaggttactgaaggagttgatgccagcaacctcactgcaattatcacagtccgtcttgtctgtgtatgcggaagtttttggtctgagactcgtggaccacctgcagctcattttgaagtgcagggaggagcaagtggtataggattggagacagcacgagtgttggctcttcgaaaggtccatgtcatcattgcagtacgaaacatggtgtctgcaaaagaggctaaacaacaaatactagaggagaatgagtctgcacgagtggacataatgaagctcgacctttgctcagtgaattctattagatcatttgtggacaacttcatagctcttgatcttcctctcaacattttaataaacaatgctggagtgatgttctgcccattcaagctctcagaggatggcattgagatgcaatttgcaacaaaccatattggtcatttccacttatcaaacctacttcttgacaaaatgaaacaaactgcaaaagccactggaatagagggcaggatcataaatctgtcatcaattgcccataactacacttacagaaaggggattagatttaataagatcaatgaacggaaagggtattttcactttgactccaattga

SEQ ID NO: 86193 - DNA, 1194 bp, Glycine max
  Peptide Sequence Number=SeqID_202971
gagggaagtaccaagggcacaactttattgtttattgtattccttttcattatgacctttggtgcaatactaatgtgcttcttgcgcaaacggggtgctaatagcaagggacaacaagagctttcaggtgcagatgctggcgcatgtgcatccttgaagtctctatctaaatcacttgccagtgcgttgtctgatgtaaagatgttgttgatcataccccttattgcatattcaggtctacaacaagcatttgtgtgggctgaatttaccaagtatgttgtaactcctgcaattggtatttctggtgtgggtagttcaatggcagcatacggggcttttgatggaatattttctctgcttgctggtcgtctcacctctggtctcacatctattacaacaatagtttctgctggactttttgctcaggcagtcgtattagtcttacttctgctaaatttcagcataagtagtggattgcttggtactgtttacatactcttcttggctggtttattgggcatcggtgatggagttttaatgacacaacttaatgcattgattggaatactatttaagcatgacacggaaggggcttttgctcagctaaaaatatggcaatgcgctacaattgctatcgtgttctttttcgccccgctcgtctcgttcaaagccgtgcttgtgattatgcttgctctcctttgcttctcattctgcattttcctattgcttgctctgaaggtcgggaagacatcatcaccctccaccaacaaattgcccacccgaaacacccacgatttcaactacctcatagagcttcccaagatgtcttttttctggttctcaaacatggtccgtatgcacctctcatggcctgtactaacctatgccgccacgtggataacgctgctaatgttgatggtggcagcggcgtctatgtcgccgcaggtggcgtttgtctccgccataacgccttcctctaaattctctcagaagtgcagcagtggtgggtccattagaatgcccttggatgttccaggtgacatcctgtgtttccctgctcatatgttcgtgaggtccaaggttgatctaatcgttccacccgtctttgcagcggtgattgtagcggcttctgcttgcgtggttcgtgctgtgggcttgtgggagcatgatcaaactccttcagatgcaaattaa

SEQ ID NO: 86194 - DNA, 733 bp, Glycine max
  Peptide Sequence Number=SeqID_202972
atgcacgaggacatatgccacgttgcagaaaagaaaggtgtggcaatgattatattgcccttccacaaaaggtggggaggggaagatgaagaggtgacagaagacttagggcagggtttgagggaagtcaatcaaagggtgcttcaaaatgcagcctgctctgtcgcagtgctagtcaatcgtggggttgccagaaggtacgaacaagaacctgagacaagtgttgctgcaaggaaaagagtgtgcatatttttcattggtggaccacatgatcgcaaggttttggagttaggtagcagaatggcagagcatccagcaattaggttgcttttagtgagattcacttcatacacagaagttggggacgagggacccaaatataactcaccaacatcaaccaccaactgggaaaaagaaaagccaataactagaagcaacttaagaatggatatcttatcaagggccagccattctcacaaatttaactctcatgaccaggagttggatgaggaagcagtaaacgagttcaaggttaaatggcaggagactgtggagtacattgaaaagaacgcaaccaacataacagaggaggtgttatcaattgggaaagctaaggatcacgacctagtaattgtggggaagcaacaacttgagacaaccatgttgacaaacatagattttcgtcacgggaatgaagagctgggacccattggagatctctttgtctcttcgg

SEQ ID NO: 86195 - DNA, 222 bp, Glycine max
  Peptide Sequence Number=SeqID_202973
atgacattgattcataaagagaagtcgatcgattcctactggaagtctctcgggaacgccgtcgttgacgatcacgtccgcgtcagcggtggcaacaaggattgggatcgttggcgccgacattttgaggaaatcgacaagcaagagcgtctcctctcgattttcaaagtatacggatttcaatttgcgtcttctcgcatgcttttaccgatgtttttgtga

SEQ ID NO: 86196 - DNA, 1357 bp, Glycine max
  Peptide Sequence Number=SeqID_202974
ttccctcagcattgaccatgtcctccagaaaatatatgaatggggaaatggtgcacaagggttgcaagaggcacatattcaaatttctggccctatagtggtggcaggagtgttatgtttcatagcttcttcaatatctagtgctggtggaattggtggtggtggacttttcataccaatattaaccattgtggctagcctagacctcaaaacagcttcaagtttgtcagctttcatggtcacaggagggtcaattgcaaatgtcatgtgcaaccttcgtgccacaaatcctaaacttggtggcaagtcattgattgactatgacatagcacttttatcagaaccttgtatgctgctaggagtgagtgttggagtcatatgcaaccttgtgttcccagaatggttgattaccatgctatttgctgtttttctaacttggtctacctcaaagacctgcaacagtggagtggtgttttggaagattgagtcagaggagagaaggaaaaatgatggatttgaagggctagaaaaaggactattggaagatgagagttctgaagaaagggaagagggagttcaggtagagaaagaaaaagaaaaggtgaaaagtattgaagaacaggttatggttcctgaagaaaatataagggtgaggattccttggttgaaattagtggtcttactcttggtctggttctctttcttctccctctatcttcttcgtggaaacaaatatggacagaaagctggtgaagggtggtataagagtatcattccaatggagccatgtggtgtgggatactggattatttcatcagctcaagtccctcttgctttatttttcactgcttggattgtatatagaaaagaaagccatcaagaccaaaatctcatgcaagaggactcatgcctatcctcaaatggaccatcaaacaagcttatttttccaatgatggcactgctagcagggatattgggtggtgtctttggaattggtggtggaatgctgataagtccacttcttctacatgttggaatagctcccgaggtcacagcagcaacatgttctttcatggttttcttctcatccaccatgtcagccttgcaatacctattgttgggcatggatcacatagagactgccctcatcttggccctaatatgttttgttgcatcactaattgggttattagtggtgcagaaagcaattcaaagctatggaagaccatctttaatagtattttcggttagcatagtgatgactttaagtattgttctaatgactagcttcggagccattcgaacttggaaagactatacatcagggagatacatgggattcaaactaccctgttga

SEQ ID NO: 86197 - DNA, 372 bp, Glycine max
  Peptide Sequence Number=SeqID_202975
atggccaaaaactatgggttccttgtctgcatttttgtcttggtcttggacattgtagctggcatacttggaattcaagcagaaatggctcaaaacaaggttaaggacttgaaagtgtgggtacttgagtgtagggatccaagctatgaagctttcaagctaggacttgctgcttccatttgcttggtctttgctcatgcaattgctcacttgcttggtcggtgcatttgcatgcaatccaaagaagaatgccaaggagccacagctaatgggcgattagcagtggcttttctcattttatcttggttacccattctcatagatattcagatatattcaccggtggtactcaaaactccacttacccagtaa

SEQ ID NO: 86198 - DNA, 363 bp, Glycine max
  Peptide Sequence Number=SeqID_202976
atggcagcgttccgatggaagagcttcgaggagaatgaggatcgcccagccaagcctcgtcattttggcgtcaccgagattcaaagcccccactgcactctcttctcccacaaccttcttcaggatatttttgaatctatgggagactatgtagatgggttaaagttttctggaggttctcacagcatgatgccaaaggctactatcaagcaaatcattgacatggcccatcagcatgacgtgtatgttagcacgggtgattgggctgagcacatgattagcaaaagtccatcaggtttcaaggaatatgtagaggtctctctctgcccacctgattcaatattaatgttagtactactataa

SEQ ID NO: 86199 - DNA, 576 bp, Glycine max
  Peptide Sequence Number=SeqID_202977
atgtctcgaaacgacgacgtagtggaacagaacgcggccaccaccaccaccacgtcgtcgaccactataagaaacagagcagacccgttcctggtagcgtgcagatgcttcagcttcctcacctctctcgccgccattctctgcatcgccgtcaatgtcctctccgccgtccgttccttcaaacacgcatctgacattttcgacggcatattccggtgctacgccgttcttatagcggctttcgtggtcctcgccgagaccgaatggagtttcatcataaagttctcgaaggttttggagtattgggctgccaggggtatgctgcagatctttgctgcagtcatgacaagggcatttcctggctatattggggaccggagggacctttttcttctacagagcatagcaagttatttgctacttgcctgtggtgttgtttatgttgtttcaggtatcctttgcattggttttcttaaacgtgcccgccagaagcaagagattacaagagagcaagccaccaaggatctagagcatgctttgcatgattggaaaaactcacatattgacgagctatag

SEQ ID NO: 86200 - DNA, 1149 bp, Glycine max
  Peptide Sequence Number=SeqID_202978
atggatagaaatgactactatggaggggcttctacatctctcaatcttacacagctatggaagcgatttaggggagatgacacaccggcagagaacttgggatccagcagagaatacaatgttgatatgatacctaagtttatgatggccaatggagctttggtccgtgttctgattcacacaaatgttacaaagtatttgaactttaaagctgtagatggaagctttgtgtataacaagggaaagatttacaaagttccagcaacagatgttgaagcactgaagtcaccattaatgggactgtttgagaagcgccgtgctcgaaagttcttcatttatgtccaagattatgaaacaaatgatcccaaatctcacgaaggactagatttaaaccaagttacagcaaggcagctgatttcgaaatatggattggaagatgatacagttgactttattggtcatgccttggcacttcatcgtgatgataattacttggatgagccagccaaggattttgtagacagagttaagatttatgcggagtccctagcacgctttcaaggaggttcaccttacatatatccactctatggactgggagagttgcctcaggcatttgcacgtctgagtgctgtgtatggtggaacttacatgctgaacaaaccagaatgcaaggtggaatttgacgaaaatgggaaagccattggtgtgacttcagaaggagaaacagccaaatgcaagaaaattgtgtgtgatccatcgtatctgtctgataaggttcagaaggttggaaaggttgctcgtgcaatatgtattatgagtcatcctattccagacaccaaagactctcactcagcgcaagtcattctgccacagaagcagcttggtcgcaagtcagatatgtatctcttctgctgctcttatgctcacaatgtagcagccaaaggaaaatatattgcttttgttacaacagaagcagagactgacaaccctgaggtggaattgaagcctggtattgaccttcttggacctgtagatgagatattctatgacacttatgacaggtttgaaccctgcaatgatcatgaagctgatggttgcttcatctctacatctatcactaatgaacaggggcaggatatgaggtaa

SEQ ID NO: 86201 - DNA, 1017 bp, Glycine max
  Peptide Sequence Number=SeqID_202979
atggccaatatcaagcaaatcggaaagaagcaggcttgtgtgatcggtggcagtggatttattgcttctttgttgatcaagcagttgcttcagaagggttatgctgttaataccactgttagagatttaggtagtatcaataaaatagctcaccttttggtactgaaaaatctgggcgaattgaaaatatttagagcagatttgacagttgaaggagattttgaagcccctatatcaggctgtgaacttgtattccaatttgctacacctatgaactttggttctgaagatcctgagaatgacatgatcaagccagcaatcagcggcgtattgaatgtgctgaaaacatgtgctcaaacgaaagaagtcaaacgagtcatcttgacatcttcaactgatgctgtaactattaaccaactcaatggaaaaggtcatgttatggatgaaagcaattggactgatgtggagtacttgaccactgcaaagccacatggatggggatatcctgcctccaaaacactagcagagaaggctgcatggaaatttgctgaagaaaatcacattgatctcatcactgtgataccttccctcactgctggtccttctatcactgcagacatcccattcagtgttgtgttggctgcgtccctaatgaaagggaatgatttctacattaagtctttgagagagatgcaattgctgtcaggttcaatatctatcactcatgttgaggatatttgccgagcacatatatttgtggcagagaaagaatcagcttctggtcgatacattgtctgtgctcacaatactagtgttcctgagcttgcaaagtttcttagcgaaagataccctcgatatgaaattccaactgaattccatgatatcccctccaaggcaaagttagtcatctcttcagagaagcttatcaaagaagggttcagtttcaagtatggcattgaagaaattattaaccagagtgtggagtacttaaggagtgagggggccctgctcaactaa

SEQ ID NO: 86202 - DNA, 1111 bp, Glycine max
  Peptide Sequence Number=SeqID_202980
tgacacagctgggtttagacgacattgtgattgacgaattcgccacggtgacagcggtcaaaaaaggcaacgtccccggtgcgccgcgcatcggctttattacccatattgatactgtcgacgtgggattatcaccggatattcatccacaaatattaacgtttaccggtgaagacctctgtctgaataaagagaaagggatttggctgcgggtaaaagagcaccccgaaattctcgcctacccgaatgaagagattatttttagcgacggaaccagcgtactgggcgccgataataaagcggcggttaccgtcgtgatgacggtgctggaaaacctgacggcagaacatcagcatggggatatcgtcgtggcgttcgtgcctgacgaagagatcggtctgaacggtgccaaggcgctggatctgaaacgcttcgatgtcgacttcgcctggaccatcgactgctgcgagctgggcgaaattgtttacgagaatttcaatgcggccgccgccgagatccgctttaccggtgtgacggcgcacccgatgtccgcgaaaggcgtgctggtcaatcccctgctgatggcgactgactacatcagccattttgatcgccagcaaacgccagagtgtaccgaaggccgcgaaggctatatctggtttaacggcctccaggccgggcagaacgaggccgtactgaaggccaatatccgggatttcgataaagagaactttgctgcccgcaaacagcagattgccgacgtcgccgcgcggattgccgcccactatccgacggccaaagtggactatcgcattgaagatacttacagcaatatcagcaatgcgattggcgaagacaggcgcgctatcgatctgatgtttgaggcgatggaatcgctcggcatcacgccaaaaccgacgccatgcgcggcggtacggacggggcggcgctctcggcaaaaggcttactcacgccgaacttctttaccggcgcgcataacttccactcgaagtttgaattcctgccgctgtcgtcgttcgaggcctcttaccacaccgccctgcagctgtgtctgctggccgcccgttaaacgggcttgcgcgccagcaga

SEQ ID NO: 86203 - DNA, 894 bp, Glycine max
  Peptide Sequence Number=SeqID_202981
atggatacaggtgagacagttgctgttaaagttcttggcactaattcaaggcaaggggaacaggagtttttaactgaggttttattacttggaagattacatcacaaaagccttgtggatttggtgggatatgtggcagaaagaggaaaacatatgcttctttacatttacatgagcaatggcagtcttgattcccatttatatgctgatttgggaaaaaatcacaagccattgagctgggatttgaggcttagcatagcgctagatgttgcaagaggactggaatatctacatcatggggcttctccacctgttgtgcaccgtgacatcaaatcttgcaatatactgttggaccagtctatgagagccaaggtcactgattttgggctttccagaccagagatgatcaaacctcgcacatcaaatgtcagaggaacttttggatatgttgatcccgagtatttgtctacaagaaccttcactaagaaaagcgatgtttatagttttggtgtgctactgtttgaacttatcactggcaggaatccacagcaagggctcatggaatatgtaaaactagcagtcatggaaagcgagggtaaggttggatgggaagaaattgtggacccacaattaaatggaaaatatgatgtgcataatcttcatgacatggcttcacttgcattcaaatgtgttaatgaagtctccaaaagccgaccttcgatgtgcgaaattgttcaagaattatctcagatttgtaagaggcaaattaaagatcatggtggaacatctcctgctgcattgaaggaagtgtccattgaagtgggccagactgaaattcaggacttctcatcaattgagagttcaaagatggtgcgcagattgcatagccgatga

SEQ ID NO: 86204 - DNA, 147 bp, Glycine max
  Peptide Sequence Number=SeqID_202982
atgtcaatgaaacagagacacgacagaaggtgcaagggaagtggaagtgaagcgaaatcaggagagaaaaagaaagagaatgatgagaaaaatggagaatttaagcgtggcgagatagcatcgattgcggtgcatactgataaatga

SEQ ID NO: 86205 - DNA, 312 bp, Glycine max
  Peptide Sequence Number=SeqID_202983
atggaggaaaaccaaagactgaaacaggtggtaccgagccttatccatgtacataggcaatcatcggaatccattcttagcaattcatctaaccttcctgaagatggtggtagcgacacatctctcaagttggggttagtttactgtaactatcacttgaagcttatgtgtgagtggcagtatgccctatatattgagggtttgggctttaatttattacgtaatttttatgaagatcttaaagttcttctaagcaggaggactgtagaggattttagatatctaagcaatgaaagaaagttcatgccttaa

SEQ ID NO: 86206 - DNA, 1317 bp, Glycine max
  Peptide Sequence Number=SeqID_202984
atgtcgaagaagaaagttagcggcaacaccatgacgctgaaggacttccatggcggttcaattccctctgatctccctctaccttctgctcccggcgtgactgtgaggacttcagatcgtgctggttttgatcggccgtcggcgtgggggacaccgatgggccggtcggatcattggtctcggccgcacacgtcgccggcaactaggcattatgatgacaaaaccccgtttttgtcacacactgccccaattggcaggaattttgatgaggatgagaggaagccccttgatggtggttcgatgccacgtaggacaatcagtgatgagagcatccgtggtggtccgcctcctcgtgttgaggtaaggccacctgagtttggactgggaggaagttcattgggcaggcaagtggctccagtgtctcaaactcctgttggggcaggtaattcatactcggggaggctcaccgatgcggtgcatgtggggatgaatcctccgagtttaggaggtagtaaggagcagggaactgcagcaggtggtggtggttatccgaacgcgtggtcaatgcggaaagaagtggcaagtgctgtcgagccagagcaaccagcttggtctagtgctggtgctgcttccaagttggctcacgccagtgcccttgagaaggtgtcttctggtagatggcagtctaaggctgtaaattatcagactgatgctgaggtggttagatctcctgaagtggagaatagaccacatgttaatgttaatggcgttggtgcctataataggacggaggcagtgggtgaaaaggagtattatgatgcaatgctagctagacacgctgaaaggggcttaggcattgataatccgatgcaaggtggtaggaatgagttaccaaattatgaaaggtctggggtttcccgatattcagatgtacggccaacaagtgcacctcatcactctggtggggttcagctggctcgaaatgatggaaaaattgttgggtctgatttgcagcaccctatgccttctgaactaactgagcgacctaaactgaagttgctaccaagggcaaagccagtggaaagttcagaacctgctgtcatggattatgcacagggtaatcgtcaggttaatgattctggccatgttgaaaccgtttatcaagcacatggccatgctaattttgtgaagcctgtatcagctggaaatgacaatgggaaagacgcaggacagcgtccgaagctgaatttgaagcctcggtctcagcccactgaaaagctggatggaaacagtgaaagagacaggtcagttgcgtga

SEQ ID NO: 86207 - DNA, 354 bp, Glycine max
  Peptide Sequence Number=SeqID_202985
atggcactgcatttcaaattgtgcattctttctttcaaacctcaaattattattacaacaaaggctcagctttctcatagcttcaaccctgctaaacttgattctcttcacattgccatcaaatggaaaattgttcaagaagaaagatctacagcattattgacaaaaattcgcctaaatattgattaccacttccaagaggaaattgaagcattcctacggaggcaatatgtgaattctagtactattccgggtggttattatggtaatgatattcatgagattgcactttgcttcaggctattgagacaacaaggtttctttgtgcctgaaggtttgtttctaataccctga

SEQ ID NO: 86208 - DNA, 3711 bp, Glycine max
  Peptide Sequence Number=SeqID_202986
atggttttacgcggacaaggtgattcacctgtgcgtatttgtgaaccttgtaagaagctagaagaggcagcacggtttgaattgcgacatggacgcagacctgggagaggaagcttgaaatcagcacctagagatgaagatgaagttttgaaccagattcttggtcaaaccagtgacaaagttcctagtggacagagatctgttggcgttgcatcttcttcgagtaattccaattttgatgaagacatacaaaaaattgtctcaaatgacaagcctaatgttttgggaattgatttgggatccaccactcctgatgagttacgtaagcaagctttggaggagaaaaagaagcataaaattctgaaaggagaggggaaatctgacgaggcattgagagcttttaagagagggaaggagcttgagaggcaggctgatgctttggaaattcagttaagaaagtctcataagaagagtttgccttctggaaacttgtctgacgtgcttaacaaaggcattcctgcagagtctgacagaaaaacaaagtcactttctcatgttggtagagaaaagaatgatcttacttccgaacttagagatctgggatggtctgatatggatctacataaggaagacaaaaagtcatcaaacttgagtttggagggtgaactctcatcaataattggagaagtctttacaaaatctggtgaacaaaagggcagcaagattgataagtcccaagttgttgctctgaaaaaaaatgctctaatgctgaagcgtgagggtaagcttgcagaagccaaagaggaattaaaaagagctaaaattttagaaaagcaactggaagaacaggaactccttgctgaagctgaagattctgaggatgagctatcagcattaattcgtggcatggatgatggtaaagaattaccaaatctgcatgatcgtgggcatgattttgattttgaacgccttttggccatttctgatgaccttgatggtaattttgaagtgaccgaagaggatatgatggatcctgaaatagctggtgctttggaatcattaggttggactgaacctgaaaatacatcttccaagtctcaaacatttgacaaagaacatttgcttagtgaaattcgatttcttaaaagagaggctcttaatcaaaagcgagcaggtaatactgaagaagcaatggcattcctgaaaaaggcaaagttattagaaaggagtcttaacagctctgaacctgaagactataattccgtgtcacaaaaatccactgctataaggaaaagtgtgagttctgaagttgctggtaagggatcagattccattcatgagagaaatactagtgccactaataatgtttcttccacagtggctccaaaaagcagattgatgattcagagagaacttttgagtttgaaaaagaaggctctcacattgagaagggaagggaaaatgaatgaagcagaagaagaaacacagaagggtgcagctcttgaacaacagctgatggagatggataaggcttcaaatcttaaaacatcacgaacgaataccactgataatgtccctcatcataaccaagctgatttccatagaaatctgtcacttgaggaaggaagtgaagatgacgtaacagatcgagatatgtctgatccaacatatctttcactccttagggagttgggttggaatgatgacaataatgataattctccaagcaagtctttgaagaaagatgataatcattttgctccagtcaatgacgcttctctaagtaagcattccactaatatccgggttcaagctccaagaagtaaaactgaaattcagagggaacttttgggtttaaagagaaaggcccttgctttcaggcgagaagggaaagctgaggatgcagaggaagttcttaaaatggcaaaagcattagaagcccagatggaagagatggaagctgcaaagaataaacctcaggttgaggctactgtgacgaaagatggacttttcaatcctccagttgatgaagaaaggtacatggctgtttcagaagaggatttgcatgaccctacattgaattcaatgcttactaatttagggtggaaggatgatgaatttgaatctgtggccataaaagaagatccagttaaggaagctactgctacacacactgtggatctatctgcacatgattcttcttcaggcattcctgctacagcttcaagaagtaagggagagattcaaagagaacttttaacattgaaaaggaaggcacttgcttttaggcgcaagggagagatagaagaggctgaggaaattttaaggcaagccaaaactttggaagaccaaatggaagcttttgggaactggaacaaggacttgtcacttaatgtttctaaggatcaacaatctgttctgtctgaatcatctgactaccaggaaagacatggaagtttgggggttgctactgaagttgataatgcttcagcctcatctgtgatttggtcaagtaagaatagttctgaatcaacatttggtttagaaagaatcaacaatgagacaaatattcccatcttaaggatgtctgataatttaattcatgcaacctctcactttgcagatggtaagcattcattatctgccgaagggagtacttcaagtgaaaatctttcaaagaagatgaaagcagaaaaaaacattggtcgtagctcctcagctggccactcaacggatatggtagatttacttactggtgatggtagtaacatgtctgaaatattgactaaaaaacatacagaatataaacttggttcagccaattcatctcatgctgatcctgctattcatttgaactcttcagtgaattttaaccaagatcggggatttaaaaacagtgatacaactcaaaaaagagaagtgactgatgcaattgaaaagccaaacataaacgagtcaaatgctgttcaggataatgtttttcagcatcaccttcccttgcgtcaggaaattttggctcataaaaggaaggcagttactttgaaaagagaagggaaactaacagaagctaaggaggaacttcggcaggccaagctgttggagaagggcttggaggatggaaatatgctgccagacactgcctcttcctctgcctctgccactgtgaactatgcttcccatgcatcaaatgttgtacaaaagaaacaagaatcgtcaaatgttagtgcaaagccattgagtagtcgtgatcgatttaaattgcaacaggagtctctagggcacaaacgtcaagccctaaagctacggagggaaggccaaatagaggaagctgaagctttgtttgaactagcaaaggcaattgaaacccagctggaggagttgacagctcaagattccaataagtcagagggtgtagatgatgtggctgttgaggattttcttgatcctcaactcttgtctgctctgaaagctgttggacttgatgatgtaagtgttgtgtcaaaaccccacccagaaagacaagagactgtgaaatccaatgctaaagttgagaactctaaccaagagagaattcagctagaagaaagaatcaaagaagaaaaagtcaaggcacttaatttgaaacgttctgggaaacaagccgaagccttagatgctcttcgacgtgccaaattgtatgaaaagaagctaaattcattaacatctggttga

SEQ ID NO: 86209 - DNA, 636 bp, Glycine max
  Peptide Sequence Number=SeqID_202987
atgccaaatgcagcaactggcattactttctttccttttctccgtgcttggcttgttttcatcttgataatgctgccaattttcccacaggtattgaaggagcgagggattgatgatgtttcaatcaatgtggtggagcattcaaacagggttgaaaacaatattttgagggttcagaaacatcctgaccattcaacccagactcgatatggtgaaaagaccgaggatgctcatcttgatcaaaagacaggcagaaaacctgaaaggaaggagcaaagggcagatggtgatagggctcatgcgcagaggagaaattggcggggtgatactcggagaaatgggaaggagaccgataggcagccgcatgccccggagaggcaaccttcacctgagacatggcgtaagcctgtggagcagcagctaaaatcagctccaggtgctgctagcacacggtacagtagagcagcttcggcggttgaacttgcacaagcattctccagatctgtatcagatccaaaagtgaatgataggttttcaggtcaaaggggtctgaacactggcaacagcagcaggacacaagttccattttcacggcttgttggtcctacatcaaggcctcagatcaatggttattaa

SEQ ID NO: 86210 - DNA, 147 bp, Glycine max
  Peptide Sequence Number=SeqID_202988
atggatgtaaacataatcctgaatcaagctcttaggcggggtagtgaatcagcaaacatgcatgaaatggaaggagcaacctcctgggcaccttctagtcctccttcaatgaaaactcacaaactaaactatcctaaaagtaactaa

SEQ ID NO: 86211 - DNA, 243 bp, Glycine max
  Peptide Sequence Number=SeqID_202989
atggaaaaatacaaaaagaaaattgagaatgactccaatgaaatcctgcgcaagaaagtagaagataagaaccgtgagctgaggcagatgaatggggaagatctgcaaggattgacattacaagaactgcataaactagaggaacaccttaaaagaggtttgatcaatgtttcaaaagtaaaggatgaaaaacttatgcaagagatcagcacgcttaagagaaaggaaagaaagagagattaa

SEQ ID NO: 86212 - DNA, 504 bp, Glycine max
  Peptide Sequence Number=SeqID_202990
atggtttgcctctgggagaggagcttgcccagtgctgaggaatacttaaagaatggaatagtaagctctggagtgcatattgtgatggttcatgctttctctcttttggggcatggattaaccgaggaaaatgttcaaatcatagacagaaaccctgtcatcatttcttccccggcaacaattcttcgactttgggatgacttgggaaatgcagaggctataaccaaggaaaatgtgactataatggatgaattcccaaacattatatctacgacagcaacaattctaaggctgtgtgatgaccttgaaggggaccgggatgttaatggtgatggtaattatgggttgtatatgaagtgctacatgaaggagcacccacatgtttctattgaacagacacgggagcatgtcactcgaatgatttcggatgcatggaaacgactcaaccaagaatgtctcatgagtcatgacagatgcaaatcctttaccatcatctttcactaa

SEQ ID NO: 86213 - DNA, 435 bp, Glycine max
  Peptide Sequence Number=SeqID_202991
atgcttcaaccatatgagatcaacataggcttaaaggagcactcaaacccggtgacccccaaggcctacactccgaagagtccgtcagggcctctccctcctgatttagtggatcccatcacaatactcgtcgcccttaaagggtcttacaattgtgtgattgcacagttcatagttcacaactcgatacacacatctcatctcaatacacatattacaaaaattgggatgctacaggatgcgtggggtgcttataccttccccgcatgtaaacaactcccgaaccctttatcctttaagtttgtagacaactttttggtttttctaacgttttcctcaaataaacgttggtggcgactccgcgcgttttccttccttggaagatgcacccgtgagtctcgcgtcgccctcccgccgaagggtaggttgcgatag

SEQ ID NO: 86214 - DNA, 531 bp, Glycine max
  Peptide Sequence Number=SeqID_202992
atgttgtctctgacacccaaatcttctgttgttccaacacaccttcttcttcttcttattctcctttctctcgcagggtcagcagtagcagcagcagaaaaagagtattcctattcttctgatcttcacagggtgctccacaaacatggcttgcctgcagggctattccctcggactgtcaagtcttacaatttggaccaaacgggtcgcttggacgtgcacttgaccgacagcgtttggctcacttcggacacagctcaaggtgttggaagggatgtcaagggaagagcttttcttgtggctacctgtgaaagatatcatagtcaccgatccttcgtcggcctctccttgtctcggtttgaagatcctccaatttgtagatcccattcagaaaaggttaataaacttgactatatattgcgtgggcagagattggctgagacccttgagagcgagtcttatgctcaaggttggtggaaggaagggtgttggatttacagctcagagatgaaaggttgttcgcttggctga

SEQ ID NO: 86215 - DNA, 294 bp, Glycine max
  Peptide Sequence Number=SeqID_202993
atggcaagcctctcgcgatcatatatgatttttaagggaaggttattctgttccaagacatccaattcttcgagccctgatgcttcctccaatccttctcttctaactcgccttccagatccaacaaaaaacacaagaagagaaaggcgacagggggagagagtgagcgcggcggccaccgctgcagtgatgaccttcggtggctttgacgaggcccctcttcaaggcttaaggagcaccaaactcaacgatgacatcaacggttttatttcagatgagggtggttctgattga

SEQ ID NO: 86216 - DNA, 714 bp, Glycine max
  Peptide Sequence Number=SeqID_202994
atgagtgcattcccgaacggttccaactcgagcctcgacaacctcctcctccaaactatgatgggcaggctccagctgcgagctccgataaacaaccccttggtcacacagtccctcgaggactttttattcaacgacctcggcgacgacgacgacgacggcggtgacaacgaggacagcgagaaagccttcgaagggaaatcggagcttgcgagagaggaggccaagctggaaagagaagtcatcaagatcgtcctaagcggaaacggcgagtccgtcctcaagcccaattcgggccaggccgtgtcggttcgcgaccaccacatatgtgtcgggtttcaagacgaagaggattctgggtatcgcgtgtgggagtggcatggccacatcatgtcttttgatgaggaatttgggtataaccctgagtatatatacggcaattactttcagtggtttaaggctagaccttctcctgttgctgctgttgctgatgccgttgttgagaaagaggaagaagaagaggaggatgaagagaaacaggagaatcagggtttgagggagttgattgataacaaggattccgcggatgctcgcattcttcacaggaacatcaacgctgcttgtccaagtaaattttatggcatatcactctttaatggtgactttgctaatatgaagatgacatggcattttgcaaaatcaatgacagtatga

SEQ ID NO: 86217 - DNA, 582 bp, Glycine max
  Peptide Sequence Number=SeqID_202995
atggttgaaaccgatatggatgccgaaactgttgcaaatgtggttccaccaaaggagactccaaacagtgttcccatctcttatcattcctcacactcacaccctcctcttaatgagaggattatttcatccatgaccagaagatctgttgctgcacacccgtggcacgaccttgagatagggcctggtgctccaacgatcttcaattgtgtgattgagattgggaaagggagcaaggtgaaatatgaactggacaaaaaatcgggtcttatcaagatcgaccgtgttctttactcatcagttgtgtatcctcacaattatgggtttatcccacgtactatttgtgaggacagtgatcccctggatgtcttgattattatgcaggagccggttcttccaggttgctttcttcgggccaaagcaattggtctcatgcccatgattgatcaggatttagacaagaagaatgaaaacaaggaagtcgcagtaaacgactttttgcctgcctcagctgctttcgaagcggttaatagatccatgagcttgtatgcggactacatagtggagagcttgagacggtag

SEQ ID NO: 86218 - DNA, 2462 bp, Glycine max
  Peptide Sequence Number=SeqID_202996
atgacatagggattgaaggtggttctcacaagacaagtgatacaattaaggctgttggcattatagttggcgttgcagcttttatactattggcattggccatctttatcttgtggaagaagaggaaattgcagtgtatattgaaatggaagacagataaaagaggtttttcagaaagaagtcaggatttgttaatgaatgagggagtgttttcaagtaacagagaacagacaggtgaaagtaacatggatgacctagagttaccattgtttgattttaacacaataacaatggctacaaacaacttctctgatgaaaacaaacttggacaaggaggctttggtattgtttacaaaggcaggttgatggaaggtcagaacattgctgtgaagagattatcaaaaaattccgggcaaggaattgacgagtttaagaacgaggtcaagttaattgtcaagcttcaacatcgaaatcttgttcggcttcttggttgcagcattcagatggatgagaagatgctagtgtatgagtacatggaaaatagaagccttgatgccattttgtttgggctcctttatttgcaccaagattccagatttaggatcatccatagggatctcaaggcaagcaacattctacttgacaaagagatgaacccaaagatatcagactttgggatggctagaatttttggcaccgatcagacagaagcaaataccatgagagttgttggaacatatggttacatgtcccctgaatacgctatggatgggatcttctcagtaaaatctgatgtttttagttttggggttcttgtgctggagatcataagtggaaaaaagaacagaggattctattccgcgaacaaagaattgaatcttctagggcatgcgtggaagctgtggaaagaagaaaatgctttggaactgattgatccgtcgatcgacaattcatattcagaatctgaagttcttagatgcatacaagtcggtctcttatgcgtgcaagagcgtgcggaagataggccaacaatggcttctgtggtcttgatgctgagtagtgacactgcatcaatgtcacaacccaaaaaccctggattttgtctaggaaggaatcctatggaaactgattcttcttcaagtaaacaagaagaatcatgcactgtgaaccaagtcactgtcacaatgctagatgccagtccaagcaagtccaacacacgctatgtgggaatatggtacaacaatttgcctgaaaaaccgtggtttgggttgcaaacagaaacagtcccatcaataacacttctggggttctctcaatcgacccaaagggaaaccaactatagcaccattcccatttggtctaccaatgtttcagccaccaaatcaaacaccaccaccatcaacgtcatagctcaactctcagacgtagcaaaccttgttttgattctaaacaacaccaaaaccaaaactctcatctggcaaagctttgatcatcccacagacaccttgattccatatttaagaattggttttgacagaagagctaatcagagttggttcctccaatcatggaagacagatgatgaccctggctggaacagaactctcccttgtggagtggttggatcgtggaatggtgagttactaatgggtatacccaacatgaaaagagatatgttaacttttaaccaatctggtttctttcaagtattcacttgggataaccaaaagagtgaatggaaaaggtactggtctgaaccaacaaatcagtgtgataactatggaacctgtggatcaaacggtaactgtgactctttgaactttgaggactttaggtgcacttgtctacctggttttgagcctaaatttccacatgattggtatgagaacagagatggatcaggagggtgtgtgaggaagccaggagtatccctttgtgggaatggagaaggctttgccaaagttgaaggcttgaagattcctgatacctctgtggcaattcccacaaggggtttgagtttggaagagtgtgagaaggaatgcttgagaaattgttcttgccctgcatattcagttcttgaggtgaggaatggtgggagtgggtgcttggcatggcatgggaatttgatagacatacaaaaacttagtgatcaaggccaagatttatttgtccgtgttgatgttgttgaactagggttcttattgactcaatatgcaacaactatgctttcagcccttgttctgaggtgcattcaaattggtctattgtgtgtgcaagaaaatgccatcaatagaccatccatgttagaagttgttttcatgctaggcaatgaaacaactcttcccccacccaaaaagccagcatttttattcaatgagaaccaagatttgcctgagtcatcaacatcaggaggaggatcttcaatcaatgaagtaacaactactatcatcagtgctcgctaa

SEQ ID NO: 86219 - DNA, 2517 bp, Glycine max
  Peptide Sequence Number=SeqID_202997
atgaagtttttttcagcaatagagtttctaagttcatttcttgtgctgatgttcttctaccctttttgccactcactcgacaacaccataaccataaaccaccccattagagacggcgacgttttggtctccaacggtttaggaaactttgcgctcggtttcttcagcccgcgaaactccacaaaccgttacgttgggatttggtacaacaaaatctcggaacaaacggttgtgtgggttgccaacagagacactcctcttaacgacacttccggtgttctcaaaataagcaacaacggaaaccttgtactccacgacaacagcacccgaagcctcaacccggtttggtcctccaacgtttccattgaatccacaaataacatttcagccaagcttttggatacaggaaacctagttttgatccaaaccaacaacaacaacattctatggcagagttttgattatcccgggaacactatgcttccgttcatgaaactcgggttgaaccggaaaaccggcctggaccggttcctagtatcttggaaatctccaaacgacccgggaactgggaacatgacttataagatcgacccaaccgggtttccgcaattgtttctctacaaagacaaaatccctttatggagggtcgggtcgtggacgggtcagagatggagcggggtgcccgagatgacaccgaatttcatcttcaccgttaactacgtcaacaacgagagcgaggtctccataatgtatggagtgaaagaccccagcgttttctcgagaatggtgctggacgagagcggccatgtggcaaggtccacgtggcaggctcatgaacataggtggtttcaaatatgggatgcgccgaaggaggagtgcgacaacttccgacggtgcgggtcgaacgcgaactgcgatccataccacgcggacaagttcgagtgtgagtgtttgcccggcttcgaaccgaaattcgaaagggaatggttccttagagacgggtcgggtgggtgcgtgaggaagagtaatgtgtccacgtgtcggagcggggaggggtttgtggaggtgacacgtgtgaaggtacccgacacgtcgaaggcgcgcgtggcagcaacgattgggatgagagagtgcaaagagagatgcttgagggattgttcgtgtgtggcttacacgagtgccaacgagagctctggaagtgggtgtgttacttggcatggaaatatggaagacactaggacttacatgcaagtgggacaaagtttgttcgtgcgagtcgacaagcttgagttagctaaatatgcaaaacatccgtatggttctctaggcaagaaggggatggtagcagttttaaccgctgctattttcttgtttttgttgttggcgatcactttcgtgtattggtttgttaaaacaaggagacaaggaataagaagggatcgcaagtattcctttcgtcttaccttcgacgactcaaccgatctacaagaatttgacactacaaaaaattcagatttaccattctttgaacttagctccatagctgctgcaacagacaatttctctgatgctaacaagcttggccaaggaggttttggttctgtttataagggtctattgattaatggaatggagatagcagtgaagagactgtcaaagtactctggacaaggcatagaagagtttaaaaatgaggttgttttgatctcaaagctccaacacagaaatcttgtgaggatcctaggttgctgcattcaaggagaggagaagatgctaatctatgagtatttgccaaacaaaagtttggactccttaatttttgatgaatcgaaaaggtcgcaactagactggaaaaaacgatttgatatcatctgtggggttgctagagggatgttatacctccatcaagattcgcgattgagaatcattcatcgagacctaaaagccagcaatgtcttgatggactcttcattgaaccccaaaattgcagattttggtatggctagaatatttggtggggaccaaattgcagcaaacacaaaccgcgttgttggaacctatggctatatgtcaccagaatatgccatggaaggacaattttctgtaaagtctgatgtatacagcttcggagttttacttctagagatcgttacaggcagaaagaatagtggtctatatgaagacattaccgccacaaatttagttggacatatatgggatctatggagagaagggaaaaccatggagattgttgatcaatcattaggagagtcatgctctgaccatgaagtccaaagatgcatccaaattggtcttttatgtgtgcaagattatgctgctgacagaccatctatgtcagcagttgttttcatgttgggtaatgactcaactcttcctgatccaaaacaaccagcatttgtttttaagaaaactaattatgagagttcaaatccttcaaccagtgaaggaatttattcagtaaatgatgtaagtataactatgattgaagctcgttga

SEQ ID NO: 86220 - DNA, 1506 bp, Glycine max
  Peptide Sequence Number=SeqID_202998
atggctgaggagtttcaagctaggatttgtggtgaaaacttgtggagtagtactactattgattcaacaagaagtagtgtgttgttccctctgagttcatcatcatcatcatctatatcttcttctccttgttctgtggcagctaataataatgatgcaggaaactatagcactaggggaactagtgacacggatttgaaggcaacaaaatgttgtgctgaagacactaatggcaacaatttggtttctgacactacttacctgggtttcgttgatttacagaagccacataataagagtgaatcagcagccagtggaagtggtggcatgttgatcgattccaccttacagatgatgggttttggcctcacatcttcaacatcatcttcagagaattggaatcagcctctgttatttcgatgtaacggaagggcagagagcaatttccactccttgattcaggaagaaacgggaatggattcttctaattcacaaatccatagggattggatcccaaagagcttctcctctggcggtggaaaccaacaaattgattataataatttcaagccattattattgaacaaacaagaattttcattagatcaccatagtctaagttctttaaccactactgggttatcatcaaaccatggattcccaattggatcagcctcatcatatggtaacccttcaacgttgcaaagcctatatgaccctaattataatcctcatccacagcataactcacttttcaccaaccgtcccatgttctattcatcaaaagcatgttatgggacaccctgcaccgaactaccacaaacatggtctaaagtctccacttttttgaagcccacgaccacaacaattgcaaagcaacaacaccctaatattggacttcacttttctaacaacactcctttctggaatgcttccgccgaggcacttcacgacataagagttggtacgtttgcttcatcacaatcacaatatcataggccaaccttcgatggagagaaacccaattgcccaagtactctattaaacaagttcaatagtgaaaaaactctagagtcggcatcaatgatgactaagaaaaatgtttgtgaaccagcattaaagaggccaagaattgaaacttcatctccattgccaacttttaaggttcggaaagagaagctaggggaccgggtcactgctcttcagcaattggtttcacctttcggaaagaccgacacagcatccgttcttcacgaagccatcgaatacattaagttccttcatgatcaagtcaatgttttgagtacttcatatatgaaaaatggagctcccattcaacatcagcagggctgtgatgatctgaaagactcagaaggaccacaacaagatttgaaaagcaaagggctgtgtctggtaccgatttcaagcacatttccagtggcaacagaagccactagtgctgaattgtggacgcctacattcagatcaggcgcactcttgcggtag

SEQ ID NO: 86221 - DNA, 978 bp, Glycine max
  Peptide Sequence Number=SeqID_202999
atgaaacatggattactgggtctggctgcgctgctgctcagcacgcacgcatttgctgagaactatcgcatcgtgcagtccccggcacagaaactggatgtctggattgatgacgtgaaagataaccagctggcgagctggtgtaagcgcaatgttgatctgcgcatcgtcacccacggcgctaaaaacgtcgcggcgctggaggattttctgccgcgcgtcgccgggctgatggcatcgcagtgtaaagcgctgcagcagctcaactggacgctcaatgatgatgacggcaacccgatcgccagcggcagcgctgccaaagcgcagcagtggcaaacggtggtaacgccgccgcccgcgcccgtgcagcagccagagaccgctgcggttgcccctgccgcgccggtgctcaactcgccgcaggccgataccacgccgtggctgcagttcagcctgctcgacggctgtcacttccgcacctggtggcagcatccggcgcagaccagtgcgctgttcgtgccgtccagacagggtctgagctgcggtcaggatggctggctgagcggccgcagcagcctgacgcagatgggcaacggtgcggcgaaaagcgtggtggtgacgttcctgcagggcttcccgattgccggcctgaataacaaacagcagagcgctgagctgagcatcactaccgtcaacagcgaacgcatggtgctgagcaacgagaagtcgccagacagctggctggtgctgccgttcagcagccagttcaacggctggcaggcaccggatcaggtggtggtgcagatgcccgccagcgatgccgccgatgagagcgcactgcgcgcacggctgcaggaagtgcgcaaagtgtggtcgccgtggctgagcgccagcgcaccgctgaaagtccagctggtagagcagctgcatccggagctgaaagatcccgccgccgcggtttaccgcaccatcaactaa

SEQ ID NO: 86222 - DNA, 105 bp, Glycine max
  Peptide Sequence Number=SeqID_203000
atgaaggagcggattgggatggcaagcacagacacagctccacccaaggttgattttgactcccacaaagctcagatgtgcgcaaatctgatttcaacgaagtga

SEQ ID NO: 86223 - DNA, 252 bp, Glycine max
  Peptide Sequence Number=SeqID_203001
atggagataggttggtgtgattcaattgaagagatagtgtcttcaacagaggaaggggatgaatcagatgagaatgagataatatttcagcagctcaattgtttgaaacttataagattaggaaagctgagaaggttctacaaagggagtttaagtttcccgtccttggaggaattcacattaaaggattgcgagaggatggaaagtttatgtgcaggcaatgactccaacattagagttagaggagattga

SEQ ID NO: 86224 - DNA, 351 bp, Glycine max
  Peptide Sequence Number=SeqID_203002
atgctcgtccactgccgcgccgtggcgcgtggagccaagacgccgcttctcgttggggacttggcttttgggacctacgagtccagctccaatcaggcggtggatactgcggttcgtatgttgaaagaagggggaatggatgccataaaactggagggagggtcgccttcgagaattgttgcagcaaaggctattgttgaggctggaattgctgtcatgggccatgtaggccttactccccaggccattagtgttttaggggggtttagacctcaaggaaagaatgttgctagtgctgtcaagagacagcgttggctttacaagaagcagggtgcttttccgttgttctag

SEQ ID NO: 86225 - DNA, 243 bp, Glycine max
  Peptide Sequence Number=SeqID_203003
atgagtttgatgcgtaggtggcctcgccaggagcctagccttctccttatggaggggccagcagcaacagcagaaggggaggatgagctcacccttcctgagcccttttattttgatgtagatgcacacatggctcaagaggaagggacttccacagatcagatacatgagccatcttctgcacctgttcctgaggagacccagccatctacaccaatcatggagacagagcagcctatctag

SEQ ID NO: 86226 - DNA, 219 bp, Glycine max
  Peptide Sequence Number=SeqID_203004
atgtttgatactttgcacctaagtaacgtgggaaatgcttttcaatggaaatggccccgaggaagcttgcctgaaagagatccaagaaggataaagtggctgaaggaaccagttccgcccccgaatatgacagccaccgttttaggagcgctgagcaccagtagcgcttcgaggccatcaagggatggtcatttctccgggagcgacgcgtccagctaa

SEQ ID NO: 86227 - DNA, 177 bp, Glycine max
  Peptide Sequence Number=SeqID_203005
atggcttcagaatcatccactgacttaacgaatacaagtaccagttctgattcatcaacaactacaagcaaggctttgtttcgtgcatgcactatgtgttttgcagggattgttgtttcaacatggatttgccaagatacccgcaggctacaaacgcataacaaattccatgactaa

SEQ ID NO: 86228 - DNA, 693 bp, Glycine max
  Peptide Sequence Number=SeqID_203006
atggcttcacatccatcctcggctacaagcaaggaccgatcaaacaggttgacgacaatacgattttcggtcgcattccgtgtttccaagaacatcattaaggttccactatcttaccatagacagtggaggccacattatgcgacgtatgttttgtttcagcataatggaaccacacattttattaggcttcacagatatggtagccgatacttttattctgatggcctcaaagagtttagaagaactcatggaattgacgatagtgtcatcctgcggttttttggtggtgacaaaaataccaccttcgaggtggatgtcattggacctatctttgggcagcgtcgcccaaggtcggttctgacaaccaggagacacatctttacagtcgatgtcaccgaacacatgatgcaacagagtcttcctttggtccttccaccaacagcttctagttttttgtttggatcacaaaaaattattcctgttcagagaggctatggaaaatgtcaacaatggaaaatcaccatgcatgatgctgtcccatctgttgcccagccatggtcccaatatctctctgaaaataatttaatgcctggagatgaggtaatgttcttcttcagatttgacaaacatgtatgggaagttgtatttagaaaggaagttatatgggatgatgaggaccttttccgctga

SEQ ID NO: 86229 - DNA, 684 bp, Glycine max
  Peptide Sequence Number=SeqID_203007
atgaagatggaaaaccatagatttataggcaagtctgattcagcaaaagccaggagcaagagaaagcgtgttagacaacaaaaagtccatcttgatgttcagcatagtgtccatgcaagtttcaatccaacttcatcccatactgaagatgattataaccaaccaaagacaccacctcatagtgttcatgcaactgccaatcgagctccacacgatgctaaagatcattttaatatctgcgattcatctgagaatgagacttctggatcagcagaagaatctgagactatttcttcagttggatatccaaactgtgaatcctcgcatcatgattcttcaatggacacaggagccattcctataaaaaaaattctcaatggttacggttatggtctaatatctaatgttattattccaaaatattttgatcttggtgaccaactcatacaatgtagacattgtaatgctaaaatgtgccactataatgaaatagaggcacatattgtctcaaatttgcaaaaaatgctggatgaaaacaatgctcatgcaaaaagtttcaggatggcaagggatagattgacaaacactcaagtgatattgatgcaaattcgaacagagatattattgttgaaactcaaaatgggcaattacagaggatacatgaattacattgtagttatctag

SEQ ID NO: 86230 - DNA, 1524 bp, Glycine max
  Peptide Sequence Number=SeqID_203008
atgaaagctgaattgcaagctctgcaattgaacgagacttggcagctcactcctcttcctcctcataagaccgccattgggtgcagatgggtatacaaggttaagcataaagcggatggctccatagaaaggtacaaagcacgtcttgtagcgaaaggctacacacaaatggaagggcttgattatctggacacgttctctccagtggcgaagctaaccactgttcgtctcctccttgctgttgctgccatgaaccattggcatctgagacagttagatgttaataacgcctttttgcatggcgagctcgaagaagaagtctatatgcaggttccacctggtttaacggttacaaatccgaatctggtctgtcgtttgcagcgttcgctttatgggctcaagcaggcaagccgtcaatggttcatgaaactttccgattttctaacagtgcatgggttccaacagtctcactcagaccattctctttttctccgctttaatggttcagtcaccacgatactcttagtctatgtagacgacattattttaacaggtaacagcaacactgccatacaggaggtgctcacattgcttgatcaagcttttaaaatcaaggatctcggaaacttaaagtacttccttggcctggaaatcgcgcgttcctctgagggaattcatttgtcccaaagaaagtacactttggacatattgtctgactcaggaatgttgggttgtcggccaaacacaaccccgatggattcctctaccaagcttcacgccacgacaggaactccgttatcggcagaggcttcttcttcttaccggagactcattggccgactcatatacctcaataacactcgtcccgacatcgcgtacgcagtacaacagcttagccaatacatgtctagtcccacgaatgcccatcttcaagcagcctaccgcatattacgatacctcaagggcacaccaggctccggcatcttcttttccgccaccggaacccctcagctccgagctttcagtgactcagattgggccggatgccaggattccaggagatccaccactggtttcgtcgtttatttcggttcttcccttatttcatggcaatctaagaagcagtctaccgtttcacgaagctcgtcggaggcagaatatcgagccctagcatcaaccacatgtgaacttcagtggttaacttaccttcttcatgattttcgaatgacattcgttgaaccagctaccatttactgtgacaaccattcagcaattcggattgccaccaatcctgtctttcacgaacgaacaaagcatatcgagattgattgccatgttgtccgtcaacaggtcacctcgggtcatctcaaattgctcccagtatcatcctccttgcaactcgcggatattttcaccaaagctctaccttccactatctttcagcctctttgtaacaagctaggaatgttaaatatccattcccagcttgagggggggatattaacagcatctaacaagaagtag

SEQ ID NO: 86231 - DNA, 1098 bp, Glycine max
  Peptide Sequence Number=SeqID_203009
atgaacgaagctgcattcaacaatgtcgagagttatttgtaccttcatcctagcgaaaatccagctgctgctcttgtctccccagtgctggactcaaccaactaccattcatggagtcactccatgatcactgcacttagtgctaagaacaagctagaattcgtggacggaagcgcgccggaaccacttaaaacggacagaacctacggtgcttggcgacgatgcaataatatggtggtatcctggatagtacactcagttgctgcttctataagacaaagcgtgctctggatggacaaagccgaagacatctggagagacctgaagtcgagatactcacagggagatcttctaagaatctccgatttgcagcaagaagcatcgacattaaagcaaggagccctctcggtgacagaatatttcactaagttacgcgtaatttgggacgagattgagaacttcagacctgatccagcttgcacctgtaacagcaggtgttcctgctcagctttcgccattatcgcgcaaaggaagcttgaggaccgagctatgcaattcttgcgtggcttgaatgaacagtatacaaacatccgatcccacgtattgcttatggatcctataccagccatatcaaagatcttttcgtatgtggcacaacaagaacggcaactgctgggtaattcttcttctcccaattttaattttgagtctaaagaaatctccattaatgctacgaagtccatttgtgattactgtggtcgaatggggctgaaagtgataggacacactgttgatgtgtgttaccggaagcacggatacccgccgggatataaacccttcaatggaagatccacagtcaataacatggtgacgatggataacaaaaccatggatgatcagactcagcatcacgaatcccaggatctcgttcaattttccccagagcaatataaggctttacttgctttaatccagcggccatcaatcggaaacacggcgtcggagcaaaccaaacaagttgcttcaatatcgtcttgcaccactgataagcttcctaacccaggacacgaaccttcgtatgaagattggtatagttga

SEQ ID NO: 86232 - DNA, 105 bp, Glycine max
  Peptide Sequence Number=SeqID_203010
atggatgcacgcacgtttagccgggagatagcagcagggacaatagcagacccaggatcattgaaggcaaaggacaagacaatgggggatgtggctgcatgttaa

SEQ ID NO: 86233 - DNA, 369 bp, Glycine max
  Peptide Sequence Number=SeqID_203011
atgaaagtttggatgaccaagtctagcatgccacagattgctggacttggtttccacacaaaatcactggatttacaacaaaacactgaagatgatctcaagcttcgggagggagtgcatatatattctgctaatgatataactccttccaactttattgaagcagcagctcaagttactaattctgaatatgaagatggtactttctggggtaaacaaatgggggaaaccacatacccggagcaaatgacctccacgctggttctaacgagatgttggacagattggagaaagccacggagaagcggaagaggaggcaagcgagacaactcttccaaattttttagaggaaagggggaaaacatataa

SEQ ID NO: 86234 - DNA, 1560 bp, Glycine max
  Peptide Sequence Number=SeqID_203012
atggcttccgaccaagcagcagcagcagtccgttgggatctttgtcaggacaatgagaaaaaacgtgtagtcttggcggaagcaagtggagacttcatagatgttctctttagtttcctcactcttccattgggaactatcgtccggctgcttgggaactcagtagagatgggtaacatcaagaaactgtacgacagtgtgaaaagattgggctctgatgttttctggaacgacatctgcaagcaaatgttgcttaatccccgcaatccgttagaagcctcatgccagagactaaaagtgaaggtggatgatacaaaacccacagagtatttcatgtgtcacagctgttcagcggaaaagaatttgttgctgagtacctttgatgggggaaggtgctactgtgggaaattgatgagaaaaaacatggatctgctggtagaatccaaggaagaaactgctgcagaaaatggtgtttttgttaaaggggatgccaagttcttgatctttgatgacttgacagtgctccgaagcactccaagtaaatccgtccaaaaattcctcgaacatcgacgcaaagacttaaagattcctacaatttctaaagatgttgacatgaaggagatattgagcatactaaagcaagcattaatctccaaatctcctctaagtgaagtattattcgaaaaagaaggatctaagtcatgctcttgcccatactcttgcccttgctcacgaaataccaacccaattcattggaaagattctataaaaatcaaggtaatggtgaacaaatcaaataataagattctgttggccgaagcagatggagattttgttgattttcttttcagcttcctcacaacaccccttggatctattctgaaccttacgaacggcaaatttcccttgggaagcattggtaacttgtacagaagtgtgaagcgtctcgatccatcatggttcaaagggtcatctaaggaatccttactgaatctgagggtggctcctcattttggttgcaagagcagcccatttcaagaagaccacactcctaattattggtatggcactgtagcagggaatgataataatgaggggcgtacaatgatttcaaagaaaaaggatatgttacaaacagcaaaagaactgaaactttttgacccaagatgttctgatggagcaaaagaacctggtgtgggatttgtgaagaggccgtgtctatttgttgtgatggatgatctggaagtgaaacaaatgacaactacttctagcattgagtatctgaacaatctgggggatgatgtcaagttgggtgatttggaggagcatttggtggaaatcaggtcaaatgaggtaatgaacctgttgagggcttctttgacatccaatgaagctactttgacacggagcctaggctgcctattgatgaagtggaaatgccaaagatgcattccattttggggtacattgcaatggatgaaaaagagacacaggaagaaaaaagaaaacggacagaattcctgcaatatattatgttgttgctctgtgtgtgataagtga

SEQ ID NO: 86235 - DNA, 165 bp, Glycine max
  Peptide Sequence Number=SeqID_203013
atgaaggatggttacttccaaagtctgatgagggggaccgcttgtcacggaggtgatgttgctcttacggcattatctccggttgtcaacgcgtggaactatggaagactgcaaagtgcatggcagcgaaggcgtagggagagggcattttggagtgatgcttga

SEQ ID NO: 86236 - DNA, 333 bp, Glycine max
  Peptide Sequence Number=SeqID_203014
atggcgaatcatgcgttaagtgatggtgaagacgagagatacagcagcgtcgatgacggacgtcatagaggagcagggaaacatggctctgtgaaatgcccaggaagagagaatcttcatttccataagaataggatatttggggagaagtgctataaaaagaaggtttatgaacaagggattaaggaagttgatctctcagtagttaggggtatcaactcaggaagtaagcgtgcttctcaagcaatgacaacagacacaacattgagagaaggtagccacataaattgcagtttactaagccttggaactataattagaaaactaaggtag

SEQ ID NO: 86237 - DNA, 432 bp, Glycine max
  Peptide Sequence Number=SeqID_203015
atgcgcattgataaaccgatcggcacgctgttgctgctgtggccgacgctgtgggcgctgtggctggccgggaaaggcgtgccgccgctgtcgattttgctggtgttcgtgctcggcgtgttcctgatgcgcgccgccggttgcgtggtgaatgattacgccgatcgcgcggtggacggctacgtgaaacgcaccgccgggcggccgatgccgagcggccgggtgagcgcgaaagaggccaaggtgctgttcgtggtgctggtgctggtctcattctgcctggtgttgacgctcaatgcgatgaccatttggctgtcgctggcggcgctggcgctggcctgggcgtacccgttcatgaagcgggtgaccaacctgccgcagttcgtgctgggcgccgcgttcggctggggcattccgatgggctatgcggcg

SEQ ID NO: 86238 - DNA, 1675 bp, Glycine max
  Peptide Sequence Number=SeqID_203016
cgtgccttcgaggcgatcggagacatcgcccccggcggctgatacgggaatagctgctcgggtaatacgccgccgggcgcagatgctcatccagcaccagcacgctcggcgcgtacagcgaattgtttttggcgaggctgctcagcgtcacttccagcgaaccgcgatcggccggcagcgtataggcggcgatcgccccctgaatttcgccctgattgagctgcgggctgacggcgtcgagcttcacctcttgcgacaccggcggctgcagcggctgccacggcaggctttgcagcgtggcggcgctgatggccggcgcgacggaaacgttggccggcgtgtcggcgttggccgccaaaggcgcgccgacggtcagcgccagcgacaggcagacgccgcggcggatcaggcaagagatccggccgcggcgaatgcggttgggggagagccgatagccctccccgccctgtcgtcgttaccaccaaatttccatctgggcgccgaaggtgacttcgtcatccttgccgcggctgaaggtatgcatgctggtgtcgttgtaagcggtgccggtgttatacccggtgtcgtcaccggtggcgtagccccacttctcatcccacttggcgtaggtggcgaacagacggatggccggacgcgaccagatgctgttgcccgcctgccactgctgcgccagggtcactttatactggccgttgcgatcgccggtgcgctgggatttgacgttgtcatagccggcttccagcagggtgctcatgattggcgtccatttgtacatcgggcgcacgcccacggtgtaccaggtggtgccgttgttgttatcgcggtcgatgtcctggaacatggcgacgtacatcagcgcccattgatcgttgaagtcgatggcgccgtgatccagcacgcggatcatcttgccgttgttatcgatggtggcgccttcgttgcggccgttgttctgcgaggtcatcgagtcggtggcgtactgcagcacgaatttgttgtagccgttcaggatgctctgcgtgtgttccgcagtgaacatccagccgtctttgctggcgccgtcggccaggcgatagttatcctgcgcattggcgcggccgtagtccacgcccagctccagggtgccgcccgggttcagctccaggccggccagacgcaggtcgaaggtgtcgttgacggttgggcgctgtttccattcgttatccaggtagccgtaagagccgccggattcggagttgcgggtcacggcggcggacagcttgccgaagcccagatcgatgttttccagaccggcgcccgggccggagatatcccagtagtagaagtcgatcatgtgaacgtcatgacgctgatagaagcgcttaccggcccacagcgtggagcccggcagccagtcgatcaggtttttaccctgcacgttgacttcgcggaagcccggggtcacgtcttcccagtcggaacgttgcgagaccgaataggccaggttggtgtcgaaatagaagctcttgtcgccttctttccacacttcctgccccagtttcagttcggcgtaggtttcgcattcgttgccgagacggtatttgctcgcggcaccggtggccttgaagcactgttgctcaccgccgctgccggtccagccgatgccggaacgggc

SEQ ID NO: 86239 - DNA, 405 bp, Glycine max
  Peptide Sequence Number=SeqID_203017
atggccgaatcatccaagaagcgcaagggttcatccacctccgctgcgacaactagaacaccacgtcccggagccaccggagcatccccggcaccaattccaccatccttgtcatcctctacactattttcatctgatgaacaacctatccgaattctgatgcctcgttcttctaatctcgctcaagcctctgaggaggacttgattctgatgtgggctttcttaaccggtcgtccaatcgactgggcccatttgatttgttactgcatgcataaggcattgtggtctggtgcacctctcccttaccctcagcttgtgactttatttcttcgacattttgaaattcctttggatttggagccttttctgctagttaaacgctcctttgctattggtgccggtgca

SEQ ID NO: 86240 - DNA, 1086 bp, Glycine max
  Peptide Sequence Number=SeqID_203018
atgtacacagtggaattccaaaaacgagggcttcctcatgtccatttattgttatttttacacgccaacaacaaatatccatctccaaacgatattgatcatattatatcagtagaaataccttcacaaaaagatgatccagaactctatatattagtgcaaaatcacatgattcatggtccatgcgaaattttgaggcctgcatctccatgcatgaaggaaggaaaatgcagtcgattttatccaaaaaagtttcaggccacaactcttacagatggagatggttatcctgtatatcatagaagaaatactggtcggacaataaccaagaatggtattataattgataatagatgtattgtaccctataatccaaaattgctgaaaaaataccaagcacatataaatattgaatggtgtaaccaaagcacttctatcaaatatttattcaagtacatcaataaaggatacgatagagttaccacagtgatggtacatgatgacaatgaaacagtttcgtatgcaaacactccaaatgatgaaatcaaggaatatctggattgcagatacatttctccatgtgaatctgcatggaggatctttggctttccaatacatggtagaaaatcttctgtagagaggctacagttccatcttccaggccaacatatcgttctctaccaagaccatgatgatattgatgatctgctctctaacccaagcatttctgaatcaaaatttatagcttggatgaatacaaaccaagtttttgttgaaggtaaaaacctgacttattctgaatttgtgactaagttcgtgtatcaccagaaacagagatgttggcaacttaggaaaaagggttatactattggcagacttcaatgggttcctccaactacgggggaattattttatttaaggatgatgttgactgtctgtagaggaccaatctcatttgaagatatcagaacagttaatagtgttgaatattctacatatagaaaagcatgttttgctaacaagatgatagagaattcattgctgcaatccaggaagcaaaagactggggctcagcaccttatctaa

SEQ ID NO: 86241 - DNA, 558 bp, Glycine max
  Peptide Sequence Number=SeqID_203019
atggataaccatgagcatgcaaatcatcgtgatacaacacaagccaggataaagaataaagttaatattcgtgattcatcagaggatgagagttctgaatcaacacaaggctgtgtttcagtttcttcacctgaaaaccaaaattatatgtcctcagctaatgaccccgtaattaatagagaagtctcaaaagatattagaactacaaattcaagattcagtttatgttgtggaaatggcaaagttgaacttccattgttacagaatccacctaaatatctctaccaacttttgtatgatcatggtacatctgatagtaaaaattaccaacaaaacataaggacatataacatgatgtttgcctttacttctgctggtattaagtttgacaaatcaattaatcattcaagaggacctcctacaataagaattcaaggtcaaccatgtcatagaataggtagcatgttaccaatgcctgggaaagaaccaaaatttgcacaattgtatatctttgacacagaaaatgaagtgcataataggattaatgcaataaggtag

SEQ ID NO: 86242 - DNA, 431 bp, Glycine max
  Peptide Sequence Number=SeqID_203020
tctctgctgctttctccgaacaacaaccaccgccacccgttcgcgttcgtttcgctccttctcccaccggaaacctccacgtcggcggtgcccgaacggccctcttcaactacttgttcgcaaggtccaaaggtgggaaatttgtgctgagaattgaggacactgacttggagaggtccacaagggagtctgaggaggccatgctcaaagatctttcttggcttggacttgattgggatgaagccgcaaaaaacgccattgtagccgctttgctcctcacggccgtcacgtgcgttgtggatcttgtggaggggcaaagtttctcagtctgcagtcttggaggcagtttcagatttaaggttgggaaggagatgactgatttgggcttacgggtcaaaggcaaattgggctcacatgctttgttaaactga

SEQ ID NO: 86243 - DNA, 558 bp, Glycine max
  Peptide Sequence Number=SeqID_203021
atgcagcttcgagggaaaatagttgcacctgcgaaagatgcttgggtaggaggatataagtatacttggattttgatctcaaacataaacggtcttacaattgaaggaaatggaggattacttgatggcgatggttccacatggtgggcatgcaaaaattgtccacgaccagcggtcctttctttccaatcatgcaatcgtcttagtgttagttacttgaacatcattaatagtccaagagctcacataggcataaatcaatgtcagggagccatattctctaatattaatattcatgctcctggtaatagtcccaacactgatggaattgatattaattcttcccaaaatatcatgataagagattcctttatagcatctggtgatgattgtattgccatcactggtagctcctcttacatcaatgttactgggattgattgtggaccaggccatggaataagcctgggtagaaattatgatacaatccaagaagttcatgtacaaaactgcaagttcacgagcactacaaatggagcaagaatcaagacatttgca

SEQ ID NO: 86244 - DNA, 336 bp, Glycine max
  Peptide Sequence Number=SeqID_203022
atgacagatgggaatcatggcaaaaaggataaggaagagaaagtattagagcacgaacagttgcactttgcactttacacaggtaaggagtggaggcaaaggcaaataaggaagataacagatcgagtttttgacaaagtaaagaatcaaatggaaactgataagttgaattttgaagatctgtatattgctgttttacttgtgtacaatgatattaacaagtatatacctggtccccattttgaccctccatcaaaagacaaagtcagagaagtcaaacaggaaaaattaggggatctagaatttggagatgaggatgatatcaatatggcatga

SEQ ID NO: 86245 - DNA, 507 bp, Glycine max
  Peptide Sequence Number=SeqID_203023
atgaatgaagaattgagaagggaaataaggaaataccctctaacttgtcaaagacttgtcccatcgtatggacatcaaccaactgaaacaagtattatgacacgttctccagacaagataaagagcatcgatggctcaaaagaaactcttaaacttagtgtgaggatcagtgatctatggtttattggcacgcctaacaaatctgagcaagctgaaatggtgtttgtggactccgatgggacatcccttttagaaaatacaggtttgctggatgttgtggctggccaatttgaacctggactattggttgatgttattggtgttgtggaggaggttgtctttcgccaagtttcaggaaaagccagcaattgctatcttgcactttgtgggatgattattgcttgcagtttttttaagttcttagatgattatgaaggtgatggcccaattacagttctattgagccattgtaggatcaaggaagcgcagggtatatcctcatcttga

SEQ ID NO: 86246 - DNA, 324 bp, Glycine max
  Peptide Sequence Number=SeqID_203024
atggtcggggtacactgcaccagagatccttcattggagagattcgtcttccacctcgttgtgtcctgtgttcccttcagagagtgctctgcacaaactcaccctagccaccttcgcaacattgcccccgtcccctacgatgaccttggcgatagcccttgtcctcgcgagctgctcatggaacaagaagaggaggaagttgaaggagacaagctcaagcaatgtttgggaaagaatgcactagagccgtcaaaacaggcccaaacctgtgggctatcccgacccaccacgggttcaggtcaagcccaaaaaagacaacactaa

SEQ ID NO: 86247 - DNA, 222 bp, Glycine max
  Peptide Sequence Number=SeqID_203025
atggcaatgttctttttttttccttggaaatttaattggattgtagatgggttgtggggttggtcatgcaaatcaacggtgatagcaagggagaattgtgctctaagatgcctttcacccgcttgttacgagctcatctacgagagtgacccgctcgaagagggagaaaaggactttattcgaagccaagagtacaaatactgcatgcacaagtatgtatag

SEQ ID NO: 86248 - DNA, 873 bp, Glycine max
  Peptide Sequence Number=SeqID_203026
atggagaatgaagttcactgcgaacaacaagcttttattcaaaaactgtcggtgttggtgaagttgcacttcaagcaacttgtcgccccccaccgtgcccatagaacttactcattaccggtgatagcaagttcaagatctccaactttagcctctttacggcaggcgcaaggcgaaacaccacaacagcctggggatggccaacaacaggcaacaaatgcaccgccgccacctccagagccccttagctcatccacaaaatggaacaacaagttgggtggtaaacgcgcagagacagattctgcgccctttatcattcaggagcagcgagtcgagtggaacaacaagttgggtggtaaacgcgtagagacagattttgcgccctttatcattcaggagcagcgagtcaagtggaacagcaagttgagtgataaacgcacagagacagattctgcgccctttgtcattcagatttcgcaagtcgagctcgatcatgtccaacaaaacgcaaagacaaattatggccattctgcgtcttgtatcaaccaagaggaacaaattcgacagtatcaggatgatgtgtcggtactgatcattttcaaatttttgcaggttccgctggcagggaggttcactggccaaatggtgtttcgcttgaacgaaattagtgtcttatctttacttccctttatctccaataaaagacaagtaaagaggggcaactgtcataccctaatttcgtctggggaccatccgttgttgggatgtgaccctcgtttgaccacttcaaggcagttgcttggaggaagcaacctaactcgcctgggcgagttgagctcgcctggacgagctgagcatgcctgggcgagctag

SEQ ID NO: 86249 - DNA, 243 bp, Glycine max
  Peptide Sequence Number=SeqID_203027
atgttcaacgaatggggatttgataaaggttggggcaacgctgcaagaagggttaaagagacaatgaaattgttctctaaggtactagaatcagcagatccagtgaaatcagaatcacttttcagcaggcttccaaatatgttcaacatagttatcctctctattcatggatactttgggcaagcagatgtcctaggattgtcagacactggaggccaggtgggaatttctcctattcaatga

SEQ ID NO: 86250 - DNA, 417 bp, Glycine max
  Peptide Sequence Number=SeqID_203028
atggaacggtggaagaggctccttataaaggttagaagtgtgaatgttggagatggagaagatgaatcgacaaaagaagactcggcgagaagcatctatagggtagaaatgttcatattatcgttgaacatgaaggggtgcaatagccagaggggaccttcaacggcgcaatacagaggtacaaaagaaagacatggtcaacatcccatcaacaactggagacaagacaaggaaattcaaaatagaaaggggaaatatggagaagacgaaggggatggtccacatatggtaacaatcaacatagaaaaggttgaagagacaaaggatcaagctggatgttttgatgatgacaaaggttcacatgcgtctcaaagctttattcaagacaaagaaattaaagatattcaagatggatga

SEQ ID NO: 86251 - DNA, 252 bp, Glycine max
  Peptide Sequence Number=SeqID_203029
atggttctgatgaaatgcacaattgccctaggtgtggggtttcacgatgggagaaattgtgatggaatgcttcgccatctagctgactcctcttactggaagaagattaatagtctgtatttggaattcagcaaagagccaagaaatattagtcttggacttgccagtgatggaatgaatccatatggcagtttaagcactcagcatagttcgtggcatattttgctagtaatttacaacttgcctccttag

SEQ ID NO: 86252 - DNA, 354 bp, Glycine max
  Peptide Sequence Number=SeqID_203030
atggcttctccacctgcctcgcctccccttcctcctcctccttctcctcctcctcatcctccttcttctgatgcatcagtttcaccatctaccgtgaagcggacacgcaaagcctcattggtcaatgttgatcctgctactagcaaggtcgacggtccccacaggaagaaattaagaacatatttggggattgtggcgcgtgataaggttgacgtgatgtacgagaactggaaggaggtccctactgctcagaaggacttgatttgggaggatattcaggcggaatttgaaatcccaaaggcttctgaaagtaggacgaagaagaagttacttaagactgttggtgagagatga

SEQ ID NO: 86253 - DNA, 378 bp, Glycine max
  Peptide Sequence Number=SeqID_203031
atgggtgttaaacattttgaggtggattcgttggaggagcagggacttgcactgccttcgaagcctgaggttagtccctcagctgcttatgtcagcacaaagaagagttgtgttgatccctcagggaatgatctagagacggctgactcagacaaatgcgagttgcacatcaaagaaaatcctccccgcctagttgccctaggaagagtttatgagggattcacaaccgttcacaacatccttttgttgcatgatcaagtgaaggtcgatgttgaggaggttaaagatgcagctgctcctattcctgtacccactgacgaggttaacttgtgggacaggcacttaacaccttccttgcttggccgacacatctggtga

SEQ ID NO: 86254 - DNA, 782 bp, Glycine max
  Peptide Sequence Number=SeqID_203032
aggactacacgtcctcaccttcagaggactacatgccctcaccttcgtaggactgcatgtcctcgccatcagaggacttcacgtcctcgccttcatagggctacatgtcctcacctttagaggacttcacatcctcaccttcagaggactacacgtcctcgccttcatagggctacatgtcgtcaccttcaaaggactacacgtcctcgccttcagaagaggacaacaaatcctctccttgaaaggacttcacgtcctcgccttcagatggctacatgtcctcgactttagaggactgcacgtccttgcctttagagaactgcacgtcctcgccttcagagggctgcatgcccttgccttcagaggactacacgtcctcgcttttagagggctccacatatgcgccttcggtggacttaagggaggctatcgtgcaaccactatgcatactagggcaagattgcacccagctgctacaaagagacgagtaagtatgcacgtggctcaactaatttctgatgccatccactatttccagggattgtgtccacacgacacccagtggacccggaggatcccaacagggccctggggtcccagcaaggtcatcaggccccctactaaccgagctttcatcaagaagtactacgccctcaggcaggcgcagggcaagacaccacagcagcctgtggatggccggcagcgagcaacagacgcaccaccgccacctccaaagcccctcagctcatctacaaaagctagagcattgcctacgacccgtg

SEQ ID NO: 86255 - DNA, 342 bp, Glycine max
  Peptide Sequence Number=SeqID_203033
atggagcatgaaacattccttgcaacttggttggcagagattgatttctctcccaatggcttggatggtggaagcagtcaatactgtatcatcatcgtgattttgcaaagaatattactcggtgaaagagcagtctatgcaatgatgctggtgtttccacctgaattttctcctttgaaaactattttatttggaaatccttcccaagacaccgttgaaccactgatggaggctttggaggaagattataaagatggaaatgagataaatgaatcaaggcagtttattgaaggagtattggatcttgaaaagagaatcaatagactagatacattgacttag

SEQ ID NO: 86256 - DNA, 231 bp, Glycine max
  Peptide Sequence Number=SeqID_203034
atggctggacttttgggatataggagccttccacctaaggcaaagaatttggtagttgctgggggtttgacagcttttgtctttggtgcctacttctacaccatgagggctgttggaggcactgatgaactgcaggtagcaattgataagtttgaagctgacaagaacaagaatgcgggcgatgccaacatgccatcaaaggtgtttcttgaggataacacaaatctgtga

SEQ ID NO: 86257 - DNA, 183 bp, Glycine max
  Peptide Sequence Number=SeqID_203035
tcaccagaaaccaccgatgcagtcaccagaaaccaccgatgcagtcaccagaaaccaccgccggcagctgaacaagtgtggaggtttccggcagaagctgttgcaagagagagaacgaaggattttgaaagaagttgttgcaagagaatgaaagagccagagaatgaaggagccacagaatga

SEQ ID NO: 86258 - DNA, 624 bp, Glycine max
  Peptide Sequence Number=SeqID_203036
atgccaggttttactgcttatgcaggattttatgaggtctgcaccccaagcaaaggagaatatgtttttgtatctgcagcatctgatgccgtaggtcagcttgtaggccaacttgctaagttgcatggttgctatgtagttggaagtgctggatcaaaggaaaagattgaccttctacagaacaagcttggattcgatgaagcttttaattacaaggaagaattagacttgaatgcagctctacaaaggtatttccggcaaggcatagatatctactttgacaatgtgggcgaggatatgctcaatgctgcactccttaacatgaggattcatggtagaattgcagtttgtggaatgggttttttgcgaagtgattacttgcacctatacccgcactttgtggaagatgtttcaagttactacaagcaaggaaagattgtgtatattgaagacatgaatgaaggcttggaaaatgctccagctgcattcgttgggcttttccatggcaagaacgttgataataatttcaccataacagatgatcaagataaagaaaggttaaatgtggttacagccacgataattgataattcgctggccattttgaatgcacttctgaggtga

SEQ ID NO: 86259 - DNA, 1089 bp, Glycine max
  Peptide Sequence Number=SeqID_203037
atggcatcacacagacttaaggagaattcgaattttcactcttctcaatatctttacatggctgccatttcactcaggcacaaccctcaagcaaacaacactaaccagcaacgtgaaatcatcactgaagaaatccaaggactcataagagtccacagagatggacgtgtagaaaggccatcgattgtgcctagtgtctccagcacagtggcatcagaacgtggtgtcactgccaaagatgttatgatcaacaaagagaccaatttgtgggcacgtgtttatgtgccaataagtgcttgtcactactcaaagcttcttcctttgcttgtttacttccacggtggtggattctgtgttggttctgcagcttggagctgttaccatgagttcttgaccaaccttgcttccaaagcaaactgtgtcattctctctgtggattaccacttagcccctgagaaccgtcttccaatggcatatgatgatggttgtaatgctctcatgtgggtgaaaagagaagctttaaatggctcttgtgtgcaaaagtggtggctgagtcattgcaacatgtcttcccttttcctagctggtgatagtgcaggtgccaacatagcctacaatgtggccacacgcatgcatatgggatcaacatcaaacacaccattattatctctcaagggtgttatattgatccaacctttctttggaggagaagaaagaactttctctgagaaacattcccttcagccacccaattcagcactcactttatccgtttctgacacttattggcgcttggcacttcctcttggggctacacgtgaccactcttattgcaaccttcttgcagatggctcggtcaagttgagagatttgaggcttccatccactatggtgtgtgtcgcagaaatggatatactgagagataggaacttggagttctcaaacgctttggccaaagcagggaaaagggttgagacggttgtttacaaaggagttggccatgcgttccatgtgctgcataattaccagctttcccattcccgaacccaagacatgatatctcatatcaggaactttcttaaccagtaa

SEQ ID NO: 86260 - DNA, 1347 bp, Glycine max
  Peptide Sequence Number=SeqID_203038
atggtctctgcagattctgtcagggctgagacagcccagtgtcgtggaccgtacgtacgcctgcaatgggtacgtgatatatatgagcgccgaagccaggcaggtcattggacagctgcgactcgcacatatcttcttcatcttttgggttgcactctatttgctaacaagagtgcaaccaatgtccatgttgtctacttggaggcccttcgtgacctcagtatgacagagaggtatgcctggggagtgactgctttgtgctggatttacgagcactttccgtcagtcgcggactccactgctgatcaggagtacgacgagtgtcataccctaatttcgtccggggacctttgcttgatgacatgcgacctttctttggtccttgtgaggtgcttggcacccatcattaggcaatttgtgaaatttcaggacatgccggaaaaccaaaaaatattgatgcacaatccaaaaatcgagtcgaagtgcttctgtaacgcttccgtaagcgattctgtggaaaatcttcatcgttcttcgtcgttcttcaccgttcttcatccgttcttcgttcgttcttcgttcttcaacgggctgccgtcccttgtgacggacgtgtggggtgctaataccttccccgcgcgtaaatacaactcccgaacctttcacttaaaagttcgtagatcgcgtcttttccggtttttccgacgttttcctcaaataaacgttggtggcgactccgcgcgtattcctttcgtggaacacgcatcccacgagtcatgcgtcgccctcccgccgaaggataggttgcgacaacgaggattctccgtggagtgcctgaaccgactccggattccggatgtttgttggatcccgtatggggagcaccgatcggtccgggacttccacgtcagatcatgctattccggtctcttgcgttgggggcctgttgctgtttattatcaaccagagagggtcgtgcgacagtttggatacacgcagaccattcctgctcctcctgtcgattcatgggtgtcgtatgatgatatacatgacaggtggatgcactactcggatcatatcgttccaacaggtgaggtgtgtgttgatgtaagctccattggagcttctaggcctaggatcttcttcatcaatggattcctttgcttcttggaagatgaatggcagcggaatggagaaaggaagagagagaggagacgccacttcaaggagaagatgagtttagaagaagctcaccaccataggaggccatggataagagcttggaggaaaatggagatgaatgaggggagagggagagaagagcacgaaattttgtactccaaatga

SEQ ID NO: 86261 - DNA, 1266 bp, Glycine max
  Peptide Sequence Number=SeqID_203039
atggcggcaacctcaacgaagaagaagaagaagaaaagctctgaggcgcaaagaatgaagaagaagcaggaagaagaatcaggaagaagaagcagaagcggaaacgcgggggagagagagagtccagcactcaaggcaaggcaagcggaaacgacgtcattcgtagttgggaagaagatgagttcgcagcaaatgcagatgcaaatgcaaaacagcggtggcagcagcagtatcagcagcaacatcccagtgagcgaggttttctggactctcgtcgacaaagccgacaagaagttctccaaaatcagagaccttcccttctaccaacgcagcaggcatgatacttacttttataaggtgttcaaggtctacacacaattatggaagtttcagcaggagaatcggcagaagctgattgaggctgggctcaggagatgggagattggtgagattgcatctcgcattgggcaactgtattttgggcagtacatgcgcacaagtgatgcaaattatctatcagagtcgtatatattctacgaggccatattgactcgggagtattttaaggagggggaaatggtgcagcaattggttaatcagcttaaagtattagttgatgaatgcaagagaacattccaggaaagtgactttaaagaatggaagctggtggttcaggaaattgtcagatttttaaaagcggacactgcttttataaatatcaggcccttgagatacagtctagttttggactctcatcctgatactttaccccatgtagctgcagccatcacaaagagacatttgaaactacaagatgctgtattaagtagcttccatccaaatgaggtaaagtattcagagctcaccattgacacttttaggatgcttcaatgtctggagtgggaacctagtggctcatttttccagtctagtagttcaaaacttagtcaaaatggggctactggaactagtcgtatcagttacatccaagacattgctgatcctaccttacctgcaaacccacggaaagctgtgctatatcgtccttcactgacacattttatagctgttcttgccacaatatgtgaggagcttccttctgatggtattctccttgtgtatttgtcggcttcaggatattgtggttctgcccagaatgaatctggttgcatacactttggtcctcgtggagatagaggtgggaaagagaaaaacagaaagatagagaaagagggaaagagagaagaaacggaattgacaggatag

SEQ ID NO: 86262 - DNA, 327 bp, Glycine max
  Peptide Sequence Number=SeqID_203040
atggacttactgccagatgtggaggatttagttgaagatcaggatacaactagacatcaggttcctttgtccaacaatgaagatgattcctttcaatatgaaacccaatcactcttttggacatcagatcataatccagaggttacaatggctgcaactccaaccaagaaagttgtggatgaagtacctaagcatgatttacaagctgaaatgcctgttactctagccaagcatgattcagttgaggtcttttcatatgataatttgtctaaacaatttctttctgctcaactctcagctactaagaagcatttcaagaatgaatga

SEQ ID NO: 86263 - DNA, 180 bp, Glycine max
  Peptide Sequence Number=SeqID_203041
atgcaggtcgtcaatggcaccgaaagcaggagaagaagaagagtggaggagagcaccagcgcggaagaagaaaaagtgttcgcaacagcgcaaaagaagaagaagcgaagaacatcctctgagaagataaaatgcttagttgcaccaaacatgctggctagattcagaatgacactctga

SEQ ID NO: 86264 - DNA, 1581 bp, Glycine max
  Peptide Sequence Number=SeqID_203042
atgggtgctgtttggtttgtcaaggaaagagcgcatgaaactcctgatggggaagcggttgccagaaacatgcagattggcaaccggccggacgagggtggtggccgaaaaagaagaaaaaagcgttggataagatacaacgagaataaatgtccacctgaagaagggtggcgagcaaaagggctcaccagggacaggcctggtgttggaggggattatggtccttataggcagtctgataggaattctttatacaagcaatttgcggataacctacaccaatccggtcatgtttatcgctgcttctgttctaatgaggaactagagaaaatgaaggaggatgctaaactaaagcaactgcctccagtgtacacaggtaaatgggccagtgcaacaaatgaggaagtagaagaagagctagcaaaaggaactccttacacttaccgggagggatgttgtacgcagccttacccttgcatatgcaaagaggctgtttccggattcgaacccatgaccaataagtcaccaaggcacaactttaccgctgcaccagggcttaggtggaaaatagacttaggtggtttgggcatgagtaatggtcagcctgtttataacttctgtgtaacggtggatgatgctaccatggcaatttcccatgttatcagggcagaagagcatttaccaaacactctaaggcaggcattgatatataaggcactaggatttcccatgccttattttgcacatgtttctttgattttagctcctgataggagtaaattatcaaaacgacatggggcaacatcagttggtcagttccgggagatgggatacctaccggaagcaatggtgaattacctagcattattaggttggggcgatgggactgaaaatgagttttttacacttgatcaacttgttgaaaaattcactatcgaacgtgttaacaaaagtggtgctatttttgactcaacgaaattaaggtggatgaatggtcagcatttaagagcacgtccgtcagaggagttgaccaaacttattggagagtactggaagacatctggcttactcacagtatcagatgggtcctttattgatgaagcagttcaactacttaaggatgggattgacttgataaatgatgcagacaaggccctagctaacttactttcttatcctgtgtattctactttacagagtgatgaagcagaatctgtcttgcaagataatctttctgaatttgctgctagcctcttggctgcctatgatagtggtgatctggtagcagcacttgaagaaggccatgccggctggcaaaagtgggtgaaaggctttggaaaattgctaaagcgcaagggaaaatcgcttttcatgcccctccgacttctgttgaccggaaaaatccatggacctgacatgggggcaagtgttgtattgctctataaagctgggactagcaatgcagtagctcctgatgctggttttgtgacactggatgaaaggtttaaaatactcgggcaaattaactgggaaacattgtccaaggaccaaactgtcaaagagactgctgatcctgtctaa

SEQ ID NO: 86265 - DNA, 4149 bp, Glycine max
  Peptide Sequence Number=SeqID_203043
atgagagacagagcgagagggagagggagagggagtgagagagagagagaacgaaacattgggtgggagagagtgaggtacagacaccaaccagcagagaacaacagagagagatctaaggggaatttccgacgggtagacccaggcaactcagggagaaaccagcaaaacagcatttcaaattggagggataaaaaggacataacatccttttacttcactcgattttccgacgatatcacgaagaaggaactatggcatcactttagaaagtggggggatgtgcgggaagttttcatacctaatagaaggaataataatggaaggaggtatggcttcgttagattcaaaggggtcaaagatgcttatcacttggccaaacaacttgacagcctcatcattggggggttgaagctatatgtcaacatccctagatataacagggaaaggccaggacagagggcttcaggaaacaagttacaggatcaagacgaaaacatccaagctgcagctgttcgactcgagaaaccgcaacacacaaatcagggatcatatgctgaggtattgagaaggaatattggtcctaaggggccacgattgccttacaacagtcaatcccaagcgcacccaactcccatatcttcgatttaccttagcatagaacctgatgacaccaactggttgaaggacgcgtgggtagggcgcctaacaaaccccgcaatgttcaatagagtggaggaagagctgctatgggaaacgggattggatgtctcacccaagtacattggtgatgatctaattctattgcttggactcacggacagtggagctgagcaactcatgaacagcggacaacacggaggggaatcaatgttttactccatggagaaatggaacccaagcatacgtaccggattcaggctgacatgggtccaagtttggggcattccgcttcaggcttggcacacgaagcatcttaggcaaatattggcagcattgggggatatggtggatgtggatgatgatacagaggagaagaggaggctagatagggctagggtgctcctaaagacaccatcgagaccgacaatcaactgcacagttgatgtctatataagcggcgagtgtttcaaggtggttgttgtcgaggaaactggtggaggtagccacgactgccgacgtcgatgctgtagctttaatgggtcgtcggacgaggtcgcgtccgatgctagctctcttggaaatgtcacgccgagaaccaccgtctccggcgaccacgaagacaatgcgtggctattaccggcgcaggcatgcggcaccgatggccatgacagggccggcacaacggagccggaaacgaggggtacatgcgctgatgaccgtcagacactccttttacccagtgggcatcgagaatgcagttacccactggataaagccgctatcctgcgtgtgacaggtctggacacagcagcgagtgcagagccatacccaacggctattgacgaccacgacacgcaaactagaaatggagtggtgcagtgtctcggggacggtactgctgcaggagaaggcaaggattatcctagcaaaggaaagtgtggggagggagaaaacatagggacagcaaacgtaatgaaggagaaagcaaaagtttttgctgaggtggcagtaataagcaacgtggcatcagctcaacagcttgacataacaaatattaaagaggcccatatggcagtgactgaaatagagggtcatcaggagatggacatgtataatataaaggaaggagggcccaataataaagagagatttactaactgcacccccctaaagcagaaccaaattacgggccctttgctgcacaataacaagggtgaatatgatactagctgcaaggtatattcaagaaaaaagtggcaccaaaagaaaggcgtagtgggccagcccgtacctatcacggcatcacccataaggctggatacctctcaaacccagcactcacaaggaacgttacaagaggagcatgctactagtaaccaaaaggaatccacagcagagaaagcattactcaatgaaggcacagacaaaattctggaactcctcaatgcccaagaggcagttgacatctggaatcgggcaacaaaattagggactacaggaggagatgtatcgtatccagttatagcaaaactaaaggaaatggaggttagggacaagaaggaagcagagaggttgggagacagtagagggggtttagggaggggcgtcaaatgggcatctattcgcagactgatcaagaaggagaacgtggatatgatttgtatacaagagacaaagcgggagttaattgataaaacaatgtgtcagtcactgtggggggatacggatgttggctgggaggctcaacctgctgtcaacacggcaggcggtattttatgcttatggagtgaacaaaatttcagactacaaatgaggattgttggtagtggatttattttcctgagaggagaatggctaagggaggcacaacaggtcagcatacttacaatatactccccctgcgaaatacaacataagaggatactgtgggaacaagttaggcagctgaagcagtctctctcaggggatctgtggtgcatcttgggtgattttaatagcatcagggaacctgctgagagattcggaatatgccaaaggggtgtaggattaaatgacatcaaggagtttaatgattggattgacgatttggagctggtagaggcgtcatggctggggagaaattttacttggttcagaccaaacggaacagccaggagtaagcttgatagattcttgctctctcctgagtggctccatagatggcctgcaagcattcgatttactttaccccgaaatttctcagaccattgccccgttatgcttaggtcttcatcaatcgattggggtcctaaaccttttaggatcttagattgctggctgtcagaaaagtcttttaaagaaacagtcatcagctgctggacttctaatcagcaaccaggatggggaagctatgtcctcaaagaaaagataaagaggctgaagcaaaagctgaaaacgtggaatatggagcagttcggagacaccctaaggaaggtcaagacaattgaagaacaactaaacaaattagaggaggatacaagccaaagacagccatctattcaggaaaagcagaaactgaaacaattgcaagaagctttgtggacagcagcccaagctcatgaatcattactacggcaaaaggccagaatcaagtggatcaagcaaggggactgcaactctcgatacttccacctaatgctgaatgctaatcgccgaaataattatttaaagggtgtcatggttggtggaacttggtgtcacgacccacctaaggtgaaggaggaagtcagggaatttttctcacaaaggttccaggaatcagattatcacaggcctagattggatgggatctgttttcagaaaataggtcagcaccacaataataggctgaatagtcgcttccaagagggggaaattaaacaggccgtatgggattgtgggagtgacaaaagtccggggcccgatggtttgaatttcaatttcatcaaacagttttggcagcttctcaaacctgatatcttgcgcttcctagatgaattttatgttcatggtgtttttccgaggggttgcaacgcttccttcatagctctgatacctaaggtggctgatcctcaattcttgaatgattatagacctatttccttaatcggatgcatgtataaaatcgtagctaagttgctagccaacagaatgaaaaaggtgatggctgctattgttgacgaaacccaatctgcttttattgaggggagacacttattacatagtgtcctcatcgcaaacgaggtgattgaggaggctaaaaggaccagcaaatcatgcctcatattcaaagttgattttgagaaggcatatgactcggtatcttgggatttcttgctgtacatgttggacagaacaggattcagccccatttggattaaatggattgagggatgcttgaaatcggcgtccatctcggttctagtcaatggtagcccacggcagagttcttccctaaaagagggctaa

SEQ ID NO: 86266 - DNA, 703 bp, Glycine max
  Peptide Sequence Number=SeqID_203044
atggcagattggaatggctttctgaacaaaagcagcggttttggtggggggtcaatgaggaacgaagattttgatgaaggagatgtgtggggtgtggccatggagagggagaggaactttttaagcccaaaactgagggtatctaaggagtcctctggttcttcctctgcatggctcctaccaacctctccaagaaagatcccaaggactaatagtaccacaccaaactccttggaatctgattcttcaaatgtggttcaaaggtcctcagcacctatggacattcctgattggtctaaaatatatgggaaaaggggtgttgaggagggtgtaagcaacaagaagcttgattgtggttatggagatcattatggtgatgatgatgatgatgatgatgatggcgaggatgaggatgacatgatacctcctcatgaatggattgctaggaaactcgcaaggagccagatttcatctttctctgtatgtgaagggatagggaggacactgaaagggagagatcttagcaaagtgagaaatgctattttgaccaaaacaggtcctgctgctgcggaactcataatagagcatggaaaaggaggagtggcagcctctgaagttttgtctggatttgtattagacttaggcgaatggagtgcactctctgttgttactgagtttaatagtcttcaagttttcacttctg

SEQ ID NO: 86267 - DNA, 507 bp, Glycine max
  Peptide Sequence Number=SeqID_203045
atggcgaagaagagaaaatccatagccacaagcctccacgagctggatcgaaccatctactcttccttctccagtgccgccaattccaagagggtggatcaagagttgcaactgttgatatactcagctacattcaggctgaatgagctggattactgtggagaggagccatgcatgtcacctagagctccacagcatcaacaacagtcacaaccagtaatgcaagtcactggttcaggttttccagtaacttcaggattttctggccaaacaattgtggggcagggactcaggtctgagcattgtgataagcaatctaagaattatgtgttttcaaatgcttcgtcaaaccctgttcgtcaaattggcgagggagggtaccacccaagtggtctctccatggggaatgttaaccggagcattgaacccaaccttcttcatcagcaaagcagggactctgctgcattcagttccaatgattctgccatggacatgcatgcagactag

SEQ ID NO: 86268 - DNA, 216 bp, Glycine max
  Peptide Sequence Number=SeqID_203046
cgccgaatgcttaagcttaaatcaaaatctatatcacctgcaagtagctatctaaattttgcgaaaaggaaaaatttacataggaaacttcagatagaagcaatccctacaatgaaaaagtggtctttgagaaagaggagtgaggagacaatcaaggatgcaacgagcaaaaccagatatgcccttccattggttattcacttcttctgcaggtaa

SEQ ID NO: 86269 - DNA, 1161 bp, Glycine max
  Peptide Sequence Number=SeqID_203047
atgacagccaaggtattttctatggtgaacaaggctggaactgggaccattatggttcgacttgtccttcttctagattcctatcgagttatagttatcacactcattcattccctccgaatgcagggttgcccaactatcccagggaagaagttggatgtcatccactgccatgattggtcgagtgcgccagttgcatggctatctaaagaacagtatagacattgcgatttaagcaaagcaggggtagtgtttacaattcataaccttgaatttggagctcatttcattggaaaagcaatggaatacacagacaaggccacaactgtctccccatcttattctagggaggttgctgggaatcctgcaattgctcctcatcttcacaagtttcagggtattattaatggaattgatccagatatatgggacccatttaacgatgagttcattcctgtatcatacacatcggaatatgttgttgaaggtaaaaaagctgccaaggaagccttgcaacaaaggcttggtttgagaaaagctgatcttcctttattgggagttatttctcgattgactcatcagaaaggaattcatctcatcaagcatgctataagtcgcaccctagagcgtggcggacaggttgtattgcttggctcagctccagattctagtatccaaaatgattttgtaaatttggccaatcaattgcattctcttcatcatgaccgtgttagactctgtcttgtgtatgatgagcctctatcacacttgatatatgctggtgctgatttcattctagttccttcaatctttgagccatgtggtctaactcaactgatagcaatgagatatggttcagtacctattgttcgaaaaactggaggactatacgatactgtatttgacgttgagcatgatagggatagagcacaagcacaaggtcttgaaccaaatgggttcagttttgatggagctgatgctttaggtgttgattatgccctcaatagggcaatatcagcatggtatgagaatcgtcattggtttaacactttatgcaagacagtgatggagcaagactggtcttggaatcgccctgcacttgattatctggagctttaccatgctgcacaaaagatatgcaagctcgtgtttgacaattga

SEQ ID NO: 86270 - DNA, 2373 bp, Glycine max
  Peptide Sequence Number=SeqID_203048
atgccttccaacaaaccatcttcaatgccttcaaaccctaatccaagaagttccgaaatcggtaaccctatgagaaggagtttcactggaaaccccttctccaaaccctcaattgtcccaaaccatggagccaaaacccccgccaacagcccttcagcagatttttcgagaagaggctctgttggggttcgggaaagcggagggtcgctgagggactcctttgatgacaaagaaaacgggaaagatcacattttgaaaccagcaaaggttcgatcaccagctgtttcttcaaagggctcaaagaatttcatgtctccgaccatttctgcttcctgcaagatcaatgagtctcccagaaagaaagtcctgattgagaggaatgaggcggtttcgagtcctgcagacccgaaaagccacgttcgcaaggtaacttttgctgagcccttggaggagaatatgatttatgggatcatccccaattttgaggaaggtcccagatcttccctgagtagtgaagatttgagtggtgagagtgaaactagtgaaattcattatatgaatgttcctttgatttcaaagaatgatacagatttgtcgtttgaatctgtcaatgatgtgaatgtgaatgttcctttggttctagagaatgacatttactacactgaaccatcatttgaaactgagcctgattatgataaccttgaccctacttttaagcttagccccacttccactcatcccgtttttaagcttagccccactgccactcctccggtttcattgaaagccaccgttgtggctcctctggatgcggatcccttgatgcccccttatgaccccaaaaccaactacctctcccccagaccacagtttcttcactacaaaccaaaatctcgaatggaactctgcagggaaagggaattagaggacagcttcatatctggaagcttttcagatacagaagtcactgaggattcccagtctgaagtctcacagaaggaatcggaggatgcttcttcggatgaaactgttaaggaagaagagggtgaaatttctgaactaagtcctgctaggaggactctcatgccagaggaatctgttgaagaaaaagaagttccaaaaccacgcttcacagtgagagcaaaggctgtttctcttaccttgcttcttgcagttgcttttgtatcaatctcagtcacagtcacagatttacctgtgattgatcgaactgtgtttgaagacttctacaaggtttatgaatcatcagagttttcaggggctaattttgatctattcaaccagtttgcaaaaacaaattttgatgagatagctcgaaacttacaaatttggtttaccaagttgttgtcttcaacttctgagttcatttcagatgttagaggagcacacaatttggccaagttgcaatattataacttgaccattcagcacgattactccatggtggatcagtaccctatatttggtcgtggtgaaaatgaaataggtgagactcacgtaccagtatgggacgctgatgagagtgatgctgcctcagatattgacagtgatgaggttgttgagggggatattctggaggagcattatgaagtgtatgaagaacaagttcagcaagatattgcaacaattactggagttgaaaatattatggatgctccagaatctgaggaagtactcaatatgatcgaatcagagcaactggctgaagcaggaaatttagaagcaacgattgcacaagaagctgaggctaacttaaatgttgaaaatcagccaagcttgaattcagaggttgctgaaatctgtgttgaagcgtatgagtcagatacaaagcaggcacaagaaaaggatgctaaactcaatgtcaatgagcaaagtgacataagtttagattcagatgttgctgccgtgaacgatgatgtagcaaaggaaaaatcagtaagcatagatgctgcaattaaagggaatgaagggcgattaggagcaattgacattcctccacatgtgatgctatgtttgctactcggtgcagagaagtcatctgggcccgtagaaatggacgtgcttgaagattcatcatgcccttcagaagcgagcagcattcagcaaagctcattctacagtgaaaaagaagtgaatgaaggtcacaggctaggccctgagaagaagcgcaagaataactaccggagagaatctttggcctcttctgcatcagactattccatgggttccccatcctatggaagcttaactgtgtatgagaaaattccaatcaagcagggacatggggaggaggagatcatcactcctgttaggcgttcaagtagaattagaaaccaagccacttctccttcataa

SEQ ID NO: 86271 - DNA, 3501 bp, Glycine max
  Peptide Sequence Number=SeqID_203049
atgcctttgggtcaggacttcatgaggcccatgacccgagtccagcaaaatcatcttcatcttgaggagaggttttgggtgggtttagagaagaaaaggatggagttcgaaaagagaaaagctgcgacgttagcctcactgagctcaacggaatcagacaaatcgccgaaggggtcattggacgcagccatcgtccctctcttaaacactctgaaccaaaacccttcttacttcaccaccagctcctgctccggccgaatctccatcctcgcccaacccctctccctctctgattcccccaaccctaagaagaaagccagaggcggcacgtggctcttcgtttctcacgaccccgccgatcccgactcggtcctctccctcctcttcccctccgagtcaactccctccccctttgctccctccgaactcgttttccgattcgagcccctcattatcgccctcgagtgcagggacctctcctccgctcactccctcgtttctctcgccatctcctgcggcttccgagaaagtggcattaccaatgccaaaaagcgcttcatcatcgccattcgctgctccattcgcatggaggtcccgttgggggacacgcgcaacgtcatggtcacgccccactatgttcgttacctcgttcaggtggcaaatgacaaaatggaagctaataggaaaagaactcagaggtttttccaagttttgctgtccaatggatctgtgcttgccgataacagtaaccacttgtcgggaactaatgaagtttgtgatcatcttgaactagagggtgaatctcagctagaaaacgggaatgttggaacctcttcagggactgtgggttctcctggttgtggtctgtcaattggccatttcgaaattgttggtgaaccagtggagaagctttaccgttggggtcactccgcttgtggattgggtgatgctgaccacaagaaagttattgtatttggtggctttggaggcatggggagacatgcaaggagaaatgatttgttgctgcttgatccatattctggtaatcttgacatggttagcactgttggctgtgcttctccatctccacgtttgggccatacagcttccttggttggaaatcgcatgtttgtgattggaggtcggaccggtcccgataaaattttgagtgatgtctggatcctcgatacaactaagaattcttggaacttactgcaatgtggtgacagtggatttcctcccaggcatcgtcatgctgcagctgtcatgggttcaaacatttatgtatttgggggccttgataatgatattatcttttcttccttttatgtttttgacacaaacaatttacactggaaagaaataccagtttctgggtactggccatgtgcacgccactcacatgctatggtggcatctgattctcagattttcatgtttggtggatacaatggtggtaaagcacttggggatttgcacagctttgatgttcagaagggtcaatggacgaaggaaaggacagctggaaggaatccacatgctaggttctcccactcaatttttctctataagaattatcttggagttcttggtggttgtcctgttagacaacattgtcaagagctggctttacttgatttgaagcttcgtttatggaagcatgttaccctcaattctgtaggtaaagatttgtttgtgcgcagtacagccaatgtcgtgggtgatgatcttgctatagttggtgggggtgcatcatgctatgcatttggaaccaagttcagtgagccagcaaaagtaagcttgctccatttaatgcattcacatgatgagccagtaaaaacccaaagaaagcgtacaagtaaccaaaatgaagggactaacaggaataacattgaaaattcttgtggacctcaacttgaacatgcaccaaatatatctgaagatgaaagttcacattctgatgacaacataccttgcttgaatgatcaaagtcagatgattgcattgcattatgttttgcaactagaaaagaaatatgcaaaattgggaaaggatatattgaaaaaatttggatggttagacttggggaggaaagcatactctgacgagggtggagtacatatcggttttcctgtccatcaagaattttttgctgtgtttcatgaaaggaatcataatttgggagatgcatttgatagacaaaatgaaggtctcttttcaaaaccacttaaacgagacaaattcttattaaatgagttatcctgttctgaagcattgatacttctccatgaatatggtgcgattgtgctgggagacaaggttgttgaagaaagaaaagctgccaaatctcctttgaaagtgatgactgaagcaataacgtctttgattgagcataagggcctaccagcacggcttctagaggaactgccaacaagatgggatcagcttggagatattgttttacttccaagtacttcttttaaggattctatgtgggactcaattgcagaagagctttggtccattgttgccaaatcactcaaggctcaccgtctagctcgccaaggcccagttgctgcaactggtacaagagatagcacattgcagattcttgttggagataatggctgggtcaatcatcgagaaaatggaattctctattcttttgatgctacaaaatgcatgttctcatggggtaatctttctgagaagatccggatggccaggcttgattgtaaagatgaggttgtagtagacctgtttgcaggcattggctactttgtgctgcctttccttgtcagagcccaggcaaagcttgtatatgcttgtgagtggaatccccatgctgtagaagcactccaacataatctagaagcaaattctgtggctgaccgttgtatcatacttgaaggagataatcgaattacagctcccaagagtgtggctgatagagtttgtcttggtctcattccatctagtgagcttagctgggtcacagctgtaagggctttaaggagagagggtggaatattacatgttcatgggaatacaagagactcagaggagagtcaatggattgatcatgtatcaaaatcaatatatgacattgctagatctgaaggttatacttgggaggtttctatagaacatgttgagagggtaaaatggtatgctccacatattcgccatgttgtagcagattacaaggaaggagggcttcaatttttattacataaagctatccagatgacaataaatgctagcaatttaaaacaagcaaacttgaacagttttgtctggacttacaagacactattatatatttatatgtggatgatgggtcatgggatatggggtttccaccttggcgtttatggagtcaatccattactgattctgagtgtcggtggtgacagaggcttgcatgaacccacacggagccagcttcagcagcctcagccatcaagctttcttcaagatgatactaaatcacgtaattaa

SEQ ID NO: 86272 - DNA, 513 bp, Glycine max
  Peptide Sequence Number=SeqID_203050
atggtcattgcatctaatagtgagactgaaaagcatgttctgagggaaaaattggcaacccagtttgaaatgaaggagttttccatgtactttcttgggatagaggttgcctattccagaaaagttccaattgaacagaaccacaagattggaagtgaggagaaaagcccaacagtagagaagtctcaataccaagatcggtgggaaatctcatctatttataccacactagaccaaacattgcttatgttgaaaaggattgttattcagaagagaatgtacattatccgtggaagtgtatatacatgcacactaagtccggtcattcttgatgacctcaagataaagtatgaagaccctataaggttgttttgtgataatccggctattagcattgcccacaatcccgtacaacatgagaaaaccaagcatatagagattgacaagcactttatcaaggaaaagttggacaacgatcatatagccacagcctacatccctttgtggctttaa

SEQ ID NO: 86273 - DNA, 273 bp, Glycine max
  Peptide Sequence Number=SeqID_203051
atgtatagatctcccacaggcaatttagtgcctctggacttggagattgaagctacgttaagaaggaacacaaccaagaggagaagaaaattactgcaagacaagacagtagcttccattctagaggaagaagctcattcttctgattctacatcatctgactcaccatcatcaagggaatccatgacatatttaccagaagttgttatcatggctgatgaacaccagcaaagggttacccttgaggactactcaagcagttcagtaccataa

SEQ ID NO: 86274 - DNA, 354 bp, Glycine max
  Peptide Sequence Number=SeqID_203052
atgaagacacttagatttgaacacagatctctggtgaaacatctcaaatacaaatccattgtcgctcttgtcatgggttatgatgagggtggatggtggaggttgggtcatcggcagttgcacgagcgattatggatgacaagtggtgtggtgggcgctaaggtggtgaggcggcatgcggcaatgctggtaggggttgcaccgaatttgttgaaggcgcaaaggtgcatgtgtttagaggtggaatcagatctggaggtggaggcagcgtgcaacgtccgaggagggtggtggggttggtgcgtgatgtcaatggagtggggcaagctacatcaccagctaacagaaaaataa

SEQ ID NO: 86275 - DNA, 1189 bp, Glycine max
  Peptide Sequence Number=SeqID_203053
tggcgtctcctctctctcttccttctccattccgctgccatttatcttccaagaagcaaaggaatccattgatgaagaagatcctaggcctacaagctccaatggagcttgcatcagttctgaggaccatccaccaaagcaatccagagtcagaggtcatttggtgaagattgatgttgacagtctcaacacattcctggagacacttatggtattagcagagggggagaccttacccgcatactccagatactgcaggttgcctacagactacagagagatagaggctgccttatgcatacctggccgagggttcatcttgaactctgagggccatcttgggaatattctcaggaaggatctgactgcactagctcaggtgtggagtgtcctctcatactccaacttggcctcaacatcacacacttttgacttgacagtggatagagctaggctgatctttggcctagtctctcgcatggatatgaacataggagcgctgatctctggccagatgacctctatagcccagtcttacacttctagacttgggttccctgctctgatcaccgcattatgtagagccagaggggttgtctctgatagcctcacttttgagcgcctgagcccggtcattaacttggtctatattaggaagaactattggaaccctgaggatctaatagtttctatccgtggggctaggagggtgagggctaggccaactgagcttccttccactttagtagctcctgctccagcatccacgtcagcagctccctctgtggcggcgcttccaggatctattccctcattcgagcagtttagagagttggtagcctggcttgggactcaatgttctcttcacagggaagatgaatgtcccatagctcaggtaccacatcatatggaggatgagtcctctgaggccactatcccaaagctatttactgcagaggaggaggtaggcgacacacagaaagcacaggtagctactgccactcctaagagatctagtgaggccatttcagagcccccaacactagcagtggatccatcttcacctcagcacgcagcagacccttccactactgtcttagagatacctaaggaccagaccacaccagtcctgactctggacacttctccttcagctactctagtgcttcatctgacagatgaggaggat

SEQ ID NO: 86276 - DNA, 1513 bp, Glycine max
  Peptide Sequence Number=SeqID_203054
atggaaagcgtttgggcgcaggcggaagaaagcctggatcgcaccgtcgatacccacatcaaaacactgcgcgccaagctgcgtgcggttgaacccgcggtggccgggtacttcgtgctgagcattttcgtccaggaagtgaagcccggcgtgcggcgcgctaccgaaggcacgctggtggacaccgccaacctgctggcgcagatcgcccgtcaggacatgcagcgcggcgatgcggcgcatggccaactggcgcaggcgtttacgcagctgaatcagcggccgatcggcgccaacatttccggcatccgcaaggaccgcagtgaataccacgtctatcttaccgatgcccagggccgggtcatcttcgattccgccggccgcgcgcaggggcaggattattcgcgctggaatgacgtttatcgaacgctgcgcggccagtacggcgcccgcagcacccgcagcgacccgcaggatgaaaacagttcggtgatgtatgtggccgcgccggtgatagaacaagggcgcattatcggcgtgctcaccgtgggtaaacccaacagcaccatggcgccggtgatcaagcgcagcgaacggcgcattctgtgggccggcgcgttgctgctggggatcgctctgctgatcggggcggtgttcgtctggtggatcaaccggtcgataggccggctggtgcgttatgccgatggggtggcgcagggcgaaaatgcgccattgcccaaagtgggcggccgggaactgacccagctggcgcaggcgctggagagcatgcgcctgaagctggaaggcaaagcctatatcgaacaatatgcgcatgccctgacgcatgagctgaaaagcccgctggcggcgatcaggggcgcggcggagctgttgcaggagctgccgccgccggaaaccgctcggcgttttctcaccaacattgagcagcaaagcgcgcgcatccaacaactggtggataaactgctggtgcaggcgcggctggagagccggccagaaatggagacggcgcccatcgcgatcgcggcgttgatcgaccagacggtggcgggcaaagaggcgcaggcgacgcagcgcggcgtcaggttgcggctggaggcgctggcggaggtgacgctgaacggcgatgcgttgctgatcagccaggcgctgaccaacctgctggacaacgcgatcgactttaccccgccgggcggttgcgtcagcgtgcgaggcgaacggcgggaacagcattactgcatcagcgtttgcgacgacggcagcggcattcctgactatgcgttcgataaggtgttcgagcgcttttattcgttgccgcgcgccgaacggccaaaaagcagcgggctggggctgaacttcgtgcaggaggtcgcccgtctgcatcatggcggcattcacctgcgcaaccgccggccgcacggggtggaagcgacgagcgagcatgatgaaatcggtacttttctggaaaataaccacgctgctgggattgatggtg

SEQ ID NO: 86277 - DNA, 134 bp, Glycine max
  Peptide Sequence Number=SeqID_203055
tttctcatgaggaggaatacttgtacttaagggcatgtcactcggtttggaactcccttgagactcaggctgatcaccctggggggggggagttgcctatgcacgacagggtgacctcgacacttactgcctag

SEQ ID NO: 86278 - DNA, 507 bp, Glycine max
  Peptide Sequence Number=SeqID_203056
atgttgcaaaggatatacggtactgcatgggagaatgcagagcagttgaaggcttaccttcacttcaaaggggaagctaagcatcgagatcacagatgcctagggcaagatcttgatttgttttctatgcaggatgatgctggtaggggtttagttttctggcacccaaagggtgctatggatgatgcacatatattttgtttagatgaccagattaaagacgagattaggggtgtcctagatcttatagaagaaatattattgcaatttggttttgacaaatatgaagtaaatttatctacaaggcttgaaaaggctatgggagatgatgatatatgggaaaaagctaccactgctttaaaagatgctttggatgataaaggttggacctatccaaatgatgatggaggaggtgccttttatgggccaaagattgatatcaagattgaggatgctcttggtatgaagtggcaatgctcaaccatacagacaattctttactcataa

SEQ ID NO: 86279 - DNA, 342 bp, Glycine max
  Peptide Sequence Number=SeqID_203057
atggggctgacggatcatgctgcggtctcggcgacgaaatcgcgcatggatcgtccgcgagccacggagctgcaggtttcgatccttgccgatcgcgcggtttccgccttccagtcgaaacgttatgccgaaacgcttctgctcctcgaccaacgggcccggctggctgacgagcgtgctgatctgatggtgctgcgcggttactcctatctcgccatgcgccgttatggggaagccgcccagatattcgaaagcctcgcctccatcggcaatcgcgatggcatcagggggctcgcggcagtgcgcgccgcccggccgagcaacggtccgcaaggcggttga

SEQ ID NO: 86280 - DNA, 1134 bp, Glycine max
  Peptide Sequence Number=SeqID_203058
atgctcgatctcatcgagcttcgccacgatttgcatcgccatccggaaatttccggagaggagaaagaaaccgcccgccgcgtccgtgcctttcttgagcaggcaccacctgaccggcttcttgccggcctcggcggccatggcgtggcggccgtttatgacagcggaagaagcggcccctcggttctgatccgctcggaaatcgacgcgctgcctatccgcgaaaagggtgaagttgaataccgttcgagcgtcgatggaaaaggccatctgtgcggtcacgacggccactccaccattctgacggcactggcgcttggccttgcccgccagcggccggagacaggacgggtcattctactctttcagccggcggaagaaaccggtgccggcgcagccgccgttattgccgatccacgctttgcggagataaaaccggactattcattttcacttcacaacctccccggcctgcccttcggccatgtcagcgtggtggaagggccggtcaattgcgcatcgcgcggcatcaaaatcacgttagcgggcaagacggcacatgcttcctcaccggaacacggcatttcccccatgcgggcgattgccaggctgatgccgtccctgagcgatctcggttccggttttccgccggcaccggatttttcgatggtgacgatcacccacgcgatcatgggggaagcggccttcggcatttccccggctgacgcggaaatctgggcgacactcagaacgctgaccgacgaccggatggaaaacctgtgcaacgccgcggagacgctcgcaaaaagggtggcagacgaagaggggctaacgctcgatatcacctatgacgatattttcctgcattgcgaaaacgccccggacgccgtcgatcatatccggcaggcgctggacgacgagaaaatctcccacggttctgaaggtctgcccatgcgcgcttccgaggatttcggccgtttccgcggcgtctcgtcgtcggcgatgttctttctcggcgcaggccgggactatcccaatctgcacaaccccgattacgactttccggacgcactgatcggtatcggtgcgcgcatcttcatgcgcctcattcgtaatctcactgacgggaaataa

SEQ ID NO: 86281 - DNA, 909 bp, Glycine max
  Peptide Sequence Number=SeqID_203059
atgacgagggtaagagaacaagaagtgaggggagatagtgccaatgttgttgctgagatttcagctgagttagaaagggaaaggaagaagaatgaggagctcatggagagaatatcaatgctcgaagctcagttaagagaaagaaacaaggaatctcaagaaaatcatcagtatgcagttgtgagaagcatcaagaatttcaaaagacagaagatacaaatggtagatgatgagaaaaatactgtgaaaagtgaaccggcctccgagtacaagcctggtactaaaggcattgttcctaaggagattgatccaccaaagcacttagttaattggatgagcatggacgatggccaaaatttgtatgctgaaaaatttaaagactgcgattctgttgcagatttcaatgaaacatatggtgatgatgtatgtgatgataattttgatgatgatacgaataataatcgaagacatgaggaaaatgatttcacaaatgaaacggttagtgcacaaaaagattaccttgctgatcatgttgacgaggaatcaaatgcaacatgcatgggaacattttcgggtgatccagcgagtaatgtgagacaagaagatcatgaaaatcaaaagacaggttgcatattacttgctccactatccaagaagagtgaagtgaaagcacaccaagaccaagggaaagaaattaaggagactgcaacatttacagcaccacttgatgtcccttcttcaggatctgtacgtatatcacagaatagaaagcctctgaaggtagctttctgcccaaaagaagttaaaaggataattgaatctgaagcccttttgcaaaaaaaatgctcagtcccacactataaggaaaatcatagtttttgcatcacttggcataaggcacggatgtga

SEQ ID NO: 86282 - DNA, 222 bp, Glycine max
  Peptide Sequence Number=SeqID_203060
atgcaaagaagacctgaaggaagaagggtttgttgcaaggagcccttggcaagagaagaggaaattgtagaagcaaaaaggacaagaaagaaaaacaggtttagcttcatatccatggacatggacgatgaaatggatgacatcgggctcagacaactcaggcatcaggctaaggttgtgtgttttgctccgttttatcggtattcgatgacactcacgtga

SEQ ID NO: 86283 - DNA, 1524 bp, Glycine max
  Peptide Sequence Number=SeqID_203061
atgacagagttcacacttcactcctccctaccatgtcaaaatgctgctattcccatagtgaatattccttttagccaccattctgtcaacatgatgtctagggccttatggccatacttctacatggctaacggtgctaacccgagaaggagctctatgtgggagcctattttcagaaagtttgaggccaaactaaacatttggaaccagaggaaagtttctatggcaggcagaactaccttaataaactctgtcttgacagccttgcctttgttttacttgtcattcttcagggcccctccagcagtgataaaaagattaacttccattcaaaggaacttcctgtggggaggaggagcagaaaggaaaaaaatcgcttgggtggcatgggaccaagtctgtatgcctagagataaaggaggtttgggtattaaagctatcaaggactttaatagagcacttctcatcaaatggaagtggcatttgtttcagcaatcagaccaattctggaataggattcttctgtccaagtataatgggtggagaggtctggaagaggctactcacaaacagcaccactccttttggtggtctgatttgaaatctgttatgcttcacagcagcatggctggggtcctaaaccagttccagtggagattgggcaggggtgaccaaattcttttttgggaagattcttggttaagagatggaagaacccttcgagataaatatccagacctgtaccaaataacttctcacaagtctcagctagtgggaaatatgggcttctttggagaagaaggatggcagtggcaattctcttggaggaggaacttgtttgacaatgaattgggaagcgcatcggagtttattgaccagatttctgctataagccctatagcagatatgaaggactgctgggtgtggggagcggacccaaaaggcaccttcactacatcctcagcgtatctttgcattaaaggtgaccaaccatctctagccttaaatcatgactttaatcagctgtgggaagtaaaagctcctccgagggccttgaccttggtttggagacttctttgggataggttaccgactaaggaaaatcttcttaaaaggcaagttcctctcgataatgacctctgccccttctgtcaaaaccatgtggaatcagcttctcatctcttcttcacttgtataaaaattatgccactttggtgggaatttaactcttgggtcaaggaggcaagagtcttgcactgtagacctgtggacaacttcactcagcatttctctttagctgtttctaaggcttctaacagaaagtggagggtttggtggatagcagcaatagtttctatttggtactataggaacgacatgatttttaacaatcaacagttctctatttcaaagctggtggatatcgctattcttagatcttggtcctggttgaggggatgggagaagggcttcgctgttccttttcaacaatggtcatcatccatgtctcttgctttcacctag

SEQ ID NO: 86284 - DNA, 390 bp, Glycine max
  Peptide Sequence Number=SeqID_203062
atgaaaaaggccggctttgggaggggacttcctattctttggagatacaacaaaatgagcatgcttaatcttgtggcaagcctggtgaagacaggagtgcatggaagaatatattcttcaggcgatggaaggccattaccaggctctataactgtcagcggaataaattacacagttagagctggaaaaacttttggtgactatcatcgcatactcgccccaagagataaatatgaagtagtggcaaccatgccgggctacaaatcaaagaatacaactatttggttggacgaaggacctgtgacattggattttgttcttgaccccgaaaagagcaaaagtcaaaatttccacaagcagacagtcagcgggggcaaaaagaactgttga

SEQ ID NO: 86285 - DNA, 288 bp, Glycine max
  Peptide Sequence Number=SeqID_203063
atgggaccgctaagagcttctcctgatgccaatggtaaggcaacagatgtaaggatttcaaagaaagagttggcagaattgttggagaagcaacaagtacatgttaataacaagaagcaagtagggagagcttcttcagaacaagttttgctacgcttaataaaggctagaagacatcatgattctcgtcatggattctggcgtcccgacctagagagtattcctgaggatttattgcgtataagtgtaaatagattgagaaggtcttttgcaccagtaattgtatag

SEQ ID NO: 86286 - DNA, 243 bp, Glycine max
  Peptide Sequence Number=SeqID_203064
atggagaatgaagcacaagatatgctgatactcaccctaaaaataggacaacttgcttatccagacaagtgcataatgctcattagaaatattgtagaactcctcaaggcgcgcaagaccaaccaacttaccccaaatgtttggaggtctttcttaagttatccttttgttaacttaaattcctttgtgaatattatttctaagaggaacttagaatttgccaatgacaaaggcgggtcgtaa

SEQ ID NO: 86287 - DNA, 1293 bp, Glycine max
  Peptide Sequence Number=SeqID_203065
atgaaccaacagaatcaaggatcaggccctccatccaatgttccaatgaaacgaaaacgtggccgaccacgaaaagaagaaagtgtagttcaacggacgaatgtgcctgtaatgcctggttataacaatgtgttgaactccaaccaaacagcgggtacaactgatgatgaaatggttgggaaggaagtcactggtgtcattgatggcacttttaaaactggatatcttcttagtgttaaggtggcagacactgatgctttcttaaaaggccttgtgtttctaccagaacaagttcctccacttactgtagaaaatgatgtggctccacatgtcaaaatgatcgaaaggaaagaaattccaattccagttgttaacccacaggcagagatacatggttctgttccctcaacagtacaatgcaacaagcaatcttttgagccagaattacagcaggtgcctatgtctgaagaacaagtgctaccaactgagatccattctggcatctcaagtttacttgagaatcaatccgcctctactttgataccaaattccatttccagtgaagaaattccacagggtacacaagagcctgggcatgtgaatcagtctactatcatgtcagagttggatcatgacaaaactgttaaacaaagtgaaacattgcatgaactcgatgcctccacacaggtaaaagaatctagtgctgatgggggagaaacaaaagtctcagaagcaacatctgaactcatcaacctggttccaccaattgataacgccaataaggagctcggaactggacagcaggctgtgccttatgcgcatcagctgaatgaaccaaatacatcaaatattgaatccaacctgatccctgtatctgctgaaccagaagccttgccatgtgagcagactgctaaaactgtttttgtggagaagcaggaattgccaaaaactgatgtgctagaagatacaaagacaaagcttgcaagtgagacttcaagcaatgttgacacctcaaactcaaatggaaaaccaagtagtgttgttaacattcctgttgtgggatcgaaccataaactagagaccagccaaccggaagccatgccatctgaacagattggtaaatctgttccttctgagtccaagttctcatctgatggacatgatttgtgggggaagagtgaagatccccagaactgtagctcttttggtgacattaataaggtggatttcaatcaacctactgaatctttagctaagtcaatggaatctgagcagattggatcagacacttga

SEQ ID NO: 86288 - DNA, 450 bp, Glycine max
  Peptide Sequence Number=SeqID_203066
atttttgtcggcaatttggatcctaacgtcacggatgaccatttgagacaagtttttgggcattatggagagttagttcatgtgaagattccagctggcaagcgatgtggatttgtccaatttgcggaccgtgtccttttattgtaccatgaggtttcgttttcatgcatcaggagctgtgcggaagaggcactgcgggttttgaatggcacacttctaggcggacaaaatgttaggctttcatgggggcgaagtccttcaaacaaacaggctcaaccagatgcaaaccagtggaatggtagtggtggtggatactacggatatgctcaggggggctatgaaaattatggttatgcccctgctggacaggaccccaatatgtatggcagttatcctgggtatgcgaattaccaacctccccagcaacagcagcaaataggatatagctaa

SEQ ID NO: 86289 - DNA, 333 bp, Glycine max
  Peptide Sequence Number=SeqID_203067
atggtttttatgggttttctgtctgcatttgattcagatgcatctctagatgttttggatcatcctattttggacttgatttatttcatggaaaaacagataaagaaaaaggatccagataaaagtctcatggcagcagttcctatgtgtgtgatactcagcagttgctacctgggaaggaaaatttggattcaggttttgtacggtatacatgcaatgacaagtctcaagaacttgagttattctctgcagtttggatgctgtagtgtttcaggcacaagcttgtcaatgacgcatctacttcaacgtcatacaaagttgattgtctcctaa

SEQ ID NO: 86290 - DNA, 4464 bp, Glycine max
  Peptide Sequence Number=SeqID_203068
atgggttgcaacgaacctccctctccctaccccgattcttcgtcgcttctcaaagacatttccaacttcaccacccccagacgcccccctttctctctcacctccgccaaatctcccgccacccaattcttcaccgcctccaaacacagcacctcttcctcctcctcctccttccaccgccgtcccaacaaatcatccgccgccgccgccaagaagctcaaggccttccaattggagcagtcccagtcctcccgcaaggcccaaatcaagagagaacactccctcaaatccctcgccaagtccctctccgtctggctcaacttcctcctccaaaaccctacctcctgcggctgccacctctcattctccaatgcagcccccgctcccgccaccaatggcaagcgagacggccccccgggaacctccgtcgtcggcgtcgattccacctggcgaactcccaagcgccagaggaagacctggtccactaaggaaaatgcggccactgcggaggaggttcatgattcctcgttttcgcaactcagagattctctcaaggatgtatgcagtttcgacgatttgaagcagcgaatgagagtttatctcagcctcacagtttgtaaagagatcttccaacaaattaatcgcgtcaccaagacaattgacgaaggaaggctgaatatgaaggcgcattgccctattgtaactgatgtaggcttgaaggaaaaggccacgagaattctcatgtgttataatccaatttggctgcgaattggattgcatatactttttggtggtgaatccttggtgttgaatggtgatgctgattctgatcaagatgttgtgttcttgaaaatggtcattaacaagctatttttttcacatgagaatttagctaaagcctatgcttataataagatgattgaaggtgtttatcggttgggttactataagaatttggggaatgtgattttgaagagaattttgttacttgtgcttgtcctggataaagctaaatgccagagttacctcccactggagtacggtattgatgggttggatgggggttcccctttgttattcaaaccagaatcctggattaaatcaagtagtcagctgattcatgaatttctgtcgtctgatgtaatgcacggagaaggcaatcttctaacacatttagtgattttaggttacaaattatctcatcaacaggaacctattgttgagtatgattttagggtcaaagatttatttgtagatctccaagatggattgaaattgtgtagagcaattcagctcttgcagcacaattcttcgatcctcatgaaaattgtagttccctctgatactccaaagaaaaaattggcaaactgtggtcttgtcctacaatatattaggcatgctggtggatcattacttgatgaagatggcatcatgattgtggcagatgatattgttaatggagacaaagaacttacactttccttgctgtggaatatgtttgttcatttgcagctacctcttttggttgataaaacaagtttagttggggaaatttcgaaaattcgagggtttggcacggatctcataaacagtacgaattctagttctatggaattgcttttgaattggattcaggtagtttgtaacaattatgattttgcaattgtcaattttcattcccttgttgatggcaaagccatctggtgcttacttgattattacttccagaaagaacttcataattccagttcattgaaggaagttaataagaaaagtggcaaggcatcaattatgtcggtgaatgaatattcagatgcactatataattttatattatcccaaaagttgacaaggttactggggaacttcccagaggtgcttcaagttagtgagctacttcaatataatggtgcttgcagtgatcgaagtgtggtgattttgttggttttcctagcaaaccaattatttgttaagaaaaatttggatcacttaaatttccataagctcttgggttatgacttccaaagtccaaaccatagacatttgaggatgctgcagtgcctttcaaattctgaatcaatacaaaagcctgatgcttccgatgtgcatggaaatgaagatgctgcaagtaaattcaaggccatccaagcttggtggcaagatatggctgaaagaaactgtatcaacaaacctgctgtttctaatttgcagcgatccactaccactgaatgcagcaccaacattagaagagaaaatgctgcaataacaatacaactgcatttcagaggattggttgcacggcgcaagtttctgaagatggtaaatgctgttacccttttgcaaactggtttcagagcttggctaaaagtgaagcaagggtcagtctgcatgatattatctactgttcaagtctgtgactcttcatgtgaaatattgaagcaatcagaaacatataagagatatgccatgcttttcattcatagacattcttttttgaagttgaagaggtcagcacagcttatccagcaagcagttaggagttggctctatcggaggcatcagcaagaatgtagtacaagtcctgatcttatgatttcagatatggtggcagctgctattactgttcagaaatttgtccatggttggctggcacgatctagatatattcatcagctagatcagaaagagaaagctttaaattattcccaacagaaagtcacttttgatcttcaaacaaatgcagcaattatcattcagcttgcatggaaaaagttcatatgctgcaagtctactcagaagcaacacctgtttgcaactaaaattcaacaaaatttccgaaggtggttgttgagaaaaagttttttaaatcagattcaagctgtcatcaaaattcaatcttattttcgaatgtggagaagtgtaaatgcttttcagcacttcaaaattgagtataaggcagctgttgccattcaatcttacttacggggatggtttgcacgaaagaatgcttgtgtgcgtatgaatcacctgtttgcaactaaaattcaacgaaatttccgtacgtggttgttgagaaaaagttttttgaatcagattcaagctatcataaaaattcaatcatactttcgaatgcggagatgtgtaattgcttttaagcacttcaaaattgagtttaaggcagctgttgtcattcaatctttcttacggtgctggtttgcacgaaaggatgcttgtgcgcgtagaaatcacattgttgaaattcaagcattgccgtggttggctagtgaagcgggacttcttgttccgaagagatgctgtagtaaagatccagtgtgccattcaaagcttgaagtgccagaaggccctcaattgccagaaagatgccgctttggagattcaacgctttataagggggcatttaactcggaatcagctattagcctctcaactgccatttgccaggaagatgctgcattggtgattcaacgctatattagggggcatttaattcgaaatcggaatttaggtggtgcttctaacctaagtgaagtcgttcctgctgactacatttcaagaccttttggctgtcgtagttttcaactggaactatttttgctttcagttgtgaaattgcaacgatggtggaagggtctcttgttacagaaattgatgacaaagtctgccattgttattcagtcttgtactcgtgggtggatagccaggcgaaaggcaactgttcagaaacatcgtattattgtcatccaatcctactggaaaggttaccttgcacgtaaagagccaaaggaacagttattggatttgcgcttgagaatgcaaaagtctgccagaaatgtggatgacagcaagcgtctcataaaccgactcttggcagcgctttcagagctacttaatatgaagagtcttagtaacatccttcatacttgttcaacattggacatggctacaggacattctcagaaatgttgtgaagaacttgtggctgcaggggctatcgacaccttgttgcagctaattcaaacaatcagccggagtatacctgatcaggaggttctaaagcatgctttgtcaactctccgaaatctcgcccgctatcctcatctactacaagtattgatccaaagtcgtagttctgtacagataattgtcttggagttattgaggaataaaaacgagggctacttcgttgcttctgaacttttgaagaagatatgttcaactcgtataggcattgagaggatattcaagtcccctgccctgctaaaacgattgcacggtcttgttgaggaccttacacggaagggaatttacgagaaaagaaatcctagggctcctagcctggctatcagaaaagacagagagagaagattgaaggaggctgctgagattctgaagctgataacaacgcctgattttttttcatcaagttctgatgtgaaattgtag

SEQ ID NO: 86291 - DNA, 899 bp, Glycine max
  Peptide Sequence Number=SeqID_203069
gtatattcccaccattgcgctgctccagcaaatttgggaattgcagtgagggagattcagagaaagagccctttgtggcagcccataatatgatcctatcacatgcagctgcagttgatctttatagaaacaaataccagactgagcaggggggggaaatcggcattgtcctacactgtgactcatttgagccgttgagcaattccacagcagataaattggctactgaaagagcacaatcattcagcattaattggatcttggatccaatcttatttggtaagtacccaaaagagatggagatgattctaggaaccaccttacctaaattttccagtaatgacaaagcaaaactgaggcaaggactggatttcattggcataaatcactatgcaagttattatactccgtttgattggctcagtgtttacccactaggcatgaagagtattcttatgtatctaaaagacagatataataacactccaatgttcattaccgaaaatggatatggcaatttgtatgatccagatcttaccgaggaagaatatcttaatgattttaagagaatagagttcatgtctggtcacttagataatctaatggctgcaataagggaaggagcagatgtgagaggttactttgcctggtctttgctcgacaactttgagtggctatatgggttttcagtgagatttggacttcaccacgtagatttttccacgctgaagagaactccaaaattatcagcaatttggtacgagcatttcattgaaaactataaactaactgatagcattgtgcccgaacatggcagagaaaagggaatctggaacaagccaactacccaactcagaaccttagtaagtccagagcctagaatgaataacttggattaa

SEQ ID NO: 86292 - DNA, 516 bp, Glycine max
  Peptide Sequence Number=SeqID_203070
atgctgcaaagtaaaagtgggccacagacacattctgttgtggactgtctgactcagcatggacgctgttttctacttcctatgcgctgcttatgctctcgtctcttccatcgctttgattcattggtcagaattgaagttagagtacctgagtatggctggactacgcagaaaatttttcatctcatgaacttcattgtcaacggagttcgtgctgtggtgtttggattgcacaagctagtttttcttttgcatcctaaggcaaggggtttaccaactgataagctcaagatagtctatatttcagtaaatgctgccctgtatcttatccaggtttgtatttggatatacctctggataaatgacaacagtgttgtggagttcattggagagtcatttattgcagttgtgtcttttatggctgcactaggcttcttgatatatggaggaagattatttttcatgctgaggcgcttcccaattgaatctaaaggaagaaggaagaaactcaatgag

SEQ ID NO: 86293 - DNA, 291 bp, Glycine max
  Peptide Sequence Number=SeqID_203071
atgccttttccggccattttcttcaccgcgactccgttagaccacgacctcgtgatgaagaacggtggacaagttacttcctcccccattgagtcgttcgatacggattacatgtttctccggggttttggatatgatccatcaacagatgactacttggtgattcaagcgtactgcgatgataatgatgatgatacagttcgtgcagagattttctcactcagagcaaatgcgtggaaagaaattgagacaaacattttgtcttatacgaacaccgataaatttttctga

SEQ ID NO: 86294 - DNA, 1299 bp, Glycine max
  Peptide Sequence Number=SeqID_203072
atgcagatgggtcagcgcacgttgataatcgtgagcagcgcggagctcatccacgaggcgctgatccagcgaggcccattattcgcgagcaggcccaaagactcccccatccggctgatcttcagcgtggggaagtgcgccatcaactccgccgagtacggccctctctggcgcaccctaaggaagaacttcgtgaccgagatgatcacccctctgaggataaaacagtgcagctggatacgaaaatgggccatggaggcccacatgagaaggatccaacaagaggcccgcgagcaagggtttgttcaagttatgagcaactgcaggctcaccatctgcagcatcctcatctgcatctgcttcggcgccaagatcgaggagaaaagaatcaaaagcatagagagcattttgaaagatgtcatgctcatcacgcttcccaagcttccagatttcttaccggttttcactccgttgttccgccgtcaggtgaaggaagctgaggagttaaggaggaggcaggtggagctgttggcgccgttgataaggagcagaaaggcttacgtggagggaaataacagtgacatggcgagtcctgttggtgctgcttacgtggactccttgtttggtttggaggtgcctggacgaggacgcttgggggaggaggagctcgtgacgctagtgtcggagattatcagcgccggcacggacacaagcgccaccgcgctggagtgggcgctgcttcatttggttatggatcaagagattcaagagaggctgtacagggagattgtggggtgcgtggggaaggatggtgtggttacggagagtcacgtggagaagatgccttacctgagcgccgtcgtcaaggagactttccggagacatccgccgagccacttcgtgctgtcgcacgccgccacggaggagacgaagctgggagggtatacggtgccgaaggaggcgagcgtggagttttacacggcgtggttgacggaggatccgagtatgtgggaggatccgaatgagttccgacccgagaggtttatgagtggggatggggttgacgtggacgtgacggggacgaaaggggtgaggatgatgccgttcggtgttgggaggaggatttgcccagcgtggacaatggggattttgcatataaatatgctgctggctaagatggtgcatgctttccactggctgcccaatcccaactctccacccgacccgactgagaccttcgctttcactgttgtcatgaacaaccctctcaagccacttattgtgccacgatccatttaa

SEQ ID NO: 86295 - DNA, 4221 bp, Glycine max
  Peptide Sequence Number=SeqID_203073
atgtcttggggattgggttggaagagaccttcggagatcttccacctcactctcagctatggcatcgacgatccgccggagaatctcgcccgcacttcaacctcctcccgctcttcctcttcttcttcgtcctcgtcgtcttcgtcgggttctatttcctcaatcctctcgcaggatcaggacctcgggtttcgcattgaattggattggtcggcgtcggacgacgaggatcaggtggcgttgaagcttcagtcccagctgatggtggcgttgccgatgccgcaggacacggtcgtggttgagttgaggccgagggacgatgatgaaagcgtggtggacttgggaatgaaggttgttaagcgaagggagcctctcagggcggtcacaatggccaaggccgttgcctccggtcagcagagcgacggcactggtattttgatacgcttgttgcgctccgatttgccgtcctcgatgccgccaaacgttggagatgccgttgccggttccggccaccactggactagtcttgctgcgctcagcctctgcggctgtggcttgtcggtattaccagtagagcttacacaattgccacaccttgagaaactctatctagataacaacaggctaactgttttgccacctgagcttggtgagctaagaagcttaaaagtgctcaggattgacaacaatatgcttgtctcggtgcctgcggaactgagacagtgtatgcagttggtggagttgtcattggaacataacaagcttgttaggccacttcttgacttcagggctatggctgaattacgggttcttaggctatttggaaatcctcttgagtttcttcctgaaattttgcccctccacaaacttcgacacctttctcttgcaaatattaggatcgtggcagatgaaaatttgagatcagtgaatgtgcaaatagagatggaaaacagttcttatttcggtgcatctaggcataaactcagtgccgtcttctctcttatattccgattttcttcttgtcatcaccctttactagcatctgcactaggaaagataatgcaagaccaaggaaatagagtgtttgtaggtaaagacgagaatgcagtgcgacagcttataagcatgataagtagtgacaactgtcatgtggttgaacaagcctgctctgctctttcatcccttgcctctgatgattccgtagcattgcatctgatgaaagcagacatcatgcaaccaattggaacagttctaaaatctgcaggtctggaagaggtacaaaggctagctctgttagctgttgggaatttggccttcagtctggaaaatcgtcgcatacttgtttcttctgaaagcttacgagaacttctcttacgtctagctgttgcaactgagccacgtgtgtataaagctgcagctcgtgctttggcaattcttggagaaaatgaaaacctgaggcgtgcaataaaaggaagacaagtgggtaagcaaggacttcgcatactctcaatggatggaggaggaatgaaaggtctagcaactgtacaaatgctaaaggaaattgaaaaaggaactggaaaacgaatacatgagttgtttgatttaatatgcggcacatcaacaggaggaatgctagctgttgcacttgggattaagttaatgactttggaagaatgtgaagatatatacaaaaatcttgggaagcttgtttttgctgatcctgttcccaaggacaacgaagctgctacttggagagaaaaattagatcaactttataaaagttcatcacagagttttagggttgttgttcatggatcaaaacatagtgcagaacagtttgaaaggctattgaaggaaatgtgtgctgatgaagatggagatctaatgatagattctgctgtgaaaaatgtgcccaaagtttttgttgtatcaaccttggtgagcatgatgcctgcacaaccatttgtatttcgcaattatcagtaccctgctggaacacctgaggtggctcttgttgcaacatcagatggctctgggatcaatgtattagcttcacctataggtgaacaggttggctataagcgtagtgctttcattggaagctgtaagcatcaagtatggaaggctatcagagcatcatctgctgctccttattatcttgatgatttctcagatgatgtcaaccgctggcaagatggtgcgatagtggctaacaatcctacaatttttgccataagagaagcacaacttctgtggccagatacaaaaattgactgtctggtttcagtaggatgtggttctgttcgaaccagggtacgaaaaggaggttggcggtatctggatacggggcaggtgttgattgagagttcatgctctgttgatcgggtggaggaagctttaagtacattgctacccatgcttcctgagatacaatattttcgtttcaatccagttgatgaacgctgtgatatggaacttgatgagacagatccgactatctggctaaagttggaatctgcgattgaagaatatatacaaaagaatcatcacgcatttgaaaatgtgtgtgatagattgcttcttcctttccagcatgaggagaagtggtcagaaaatctgagatctaaattacccaagacaaaggaatcacttgagggtgctgatggccccaccttagggtggaggcgtaatgtactacttgttgaagcttcacataatccagattctggaagagtgatccaccatgcccgggaacttgagtcattttgtgctcgtaatggcatacgtttatccctaatgcagggtttgtctgggattgtaaaaacagtgccatcaacaacattcccaactccatttcaatcacctctgtttacaggaagcttcccttcgagtccccgcatgtttagtcctgatcttggtcagaggattggacgaattgatctggtcccacctttaagtttagatggtcaattagggaaaacaattgcatcacctccaatgtctcctcgaggacttagacagctctcttttcccgtgaaatcattgcatgagaaattgcagaattcaccgcaagtgggtgttatacatttggctcttcaaaatgactcggatggcttaattgtgagttatttttgtccgtgtggatggaagcctgatgctattgtccttttatttagttggcacaatgatgtatttgttgtggctgaacctggagaactcgctgagaaatttctgcaaaatgttaaattcagtttgttgtcaacaatgaggagccatcgcagaaggggcgcatctctcctggccaatatttctactatttctgatttagttgcctttaaaccttatttccaaattggaggcattgtccaccgttatctaggccgtcaaacccttgttatggaagatgatcaagaaattgcttcatatatgtttcgtaggactgtcccttctatgcacttatcccctgaggatgtacgatggatggttggagcttggagagacaggatcataatatgcacagggacatatggacctactcatgctcttatcaaggcctttctggactctggtgccaaagctattgtttgttcttcaagtgaacctccagagtctctgtcgaccactgttgatggttacatagagttgaatgtgatggaaaatgggaagtttgaaattggggaagatgaagcagatgatgagaatatacccgccagtccagtaagcgactgggaagatagtgacgctgagagaaatgtggaccacactttttctttttgggacgatgatgaagaggaactgtcacattttgtttgtcaattatatgattcattattcagggaaggtgctagtatcaatgttgctttgcaacatgctcttgcctcatatcgaagaatgagtctcacgacgcctcggtctctccaagtccaacaagtctacaccaccactacattatcgtgctacactgtcaaggtcgccctcacaacctcccattctacctttgcccccgttgcatcgtcatgccacaccaacatcaagttgtccttgcataacgccgtcaaggtcaccctcacgacctcaccttctacctttgtctcaatgagtcttccccgctgctaccgttgtggcgtcaggtcatccttgcacaatgccgtcgaggtcggcctcaccttcactcgcactgaacgtcaccaatcaccctcaccctttacctctccattctag

SEQ ID NO: 86296 - DNA, 1056 bp, Glycine max
  Peptide Sequence Number=SeqID_203074
atgatgtccttagtgaagtacacaccattgcctctgacatccctgcttcctctagtcatgttccaaggcctcaactctgcacgttaccttctatccacaataagaaggagggttccagagtgccgggcctatgaagcagataggtcacagccacttgagcttaacattgatgaacaagcagggatagaagcgactcagaggatcaaaattggtttgtattttgctacctggtgggctttgaatgtggccttcaacatatacaacaagaaggttctcaatgcctttccttacccatggcttacttccactttgtcccttgctgctggctctctcatcatgttaatctcatgggccaacaaggttgctgagctcccaaaacttgatttcgagttctggaaggccctctttcctgtcgcggtgttacatacaattgggcatgttgcagctacggtgagtatgtccaaagttgcagtttcatttacccacatcatcaagagtgcagaacctgcatttagtgtcctggtatcaaggttcttgctaggggaagcattccctgtgcaagtttacctttcactggtgccaattataggaggttgtgcgcttgctgctgtgacggagctcaatttcaatatgatcgggtttgtgggggctatgatttccaatttggcctttgtccttcggaatatattctcaaagaagggaatgaaagggatgtctgttagtggaatgaattactatgcttgtcttcctatattgtctctattgattctcacgccttttgccattgctgtggagggcccaaagatgtgggctgcaggctggcaaacagccttgtctgaaattggtcccaattttgtttggtgggtagctgcccagagtgtcttctaccacttgtacaatcaagtctcttacatgtctcttgatcagatttctcccttaacattcagcatagggaacacaatgaagagaattcgcccatcaatgctcttggagccgccattgcaattcttggtagcttcctctgttcacagtgtattgaaggagtgtcgtaaatag

SEQ ID NO: 86297 - DNA, 1476 bp, Glycine max
  Peptide Sequence Number=SeqID_203075
atggcagcctctgccggcggccagataactctctcgtcaaccgtccagttacatggagtgacttgtaataggaattggaagcttgtgaagttctgtaatggggaagtcatgggacgtaagcttttgttaaaaaatggtggtggcagcactaaggattttaagcgccaacaacaacatatatgcatgtctctcaccgctgatgtgtccactgaatctaagtgtatgcaacgttttccacctgatgaatgggaatatggggtagtgcagttgagagacctagatatggaaagaaggaacccaaggacagtgttggcagttatactaggtggaggagctggaacccgtctcttccctcttactaagcgacgagccaaacctgctgttcctattggaggagcttacaggctcattgatgtgccaatgagtaactgcatcaacagtggtatcaacaaggtgtatatcctcacccagtttaactctgcctcactcaacaggcacattgcacgcgcttacaactctggtaatggagtcacctttggagatggctatgtagaggttcttgcagcaacccaaactccaggggaggcaggtaaaaagtggtttcaaggtactgctgatgctgtgaggcagttccactggctctttgaggatccaagaagtaaggatattgaggatgtcttgattctttccggggatcacctctaccgaatggactatatggactttgttcaaaatcatcgggagagtggtgcagatatcactctttcttgtcttccaatggatgacagccgtgcctctgattttggtctaatgaagatagacaataaaggaagggtcctttcgtttagtgaaaaacccaaaggagaagagctgaaagcaatggacgaggctcaaaagaaaccatacattgcttccatgggagtgtacgtcttcaagaaggagatacttcttaatctattgagatggcgctttccaacggctaatgactttggatcagaggttattcctgcctcagccagagaattttacatgaaggcttatctattcaatgattactgggaagacataggtactatcagatcattctttgaggcaaatcttgccctcactgagcatccacccaggtttagcttttatgatgcagccaaaccaatgtatacatcacggagaaacttaccaccatcaaagattgacaatagcaagattgttgattcaattatatcacatggaagcttcttgaataattccttcatagagcacagtgttgttggaatcagatccagaataaactcaaatattcacttaaaggatacagtgatgcttggtgctgattattatgaaaccgatgcagaagtggcagcactcttagctgaaggaagagttccaattggaataggagaaaatacaaaaatcaaggactgtattattgacaaaaacgctagaatcggaaagaatgttgtaatagcaaactcagag

SEQ ID NO: 86298 - DNA, 162 bp, Glycine max
  Peptide Sequence Number=SeqID_203076
atgtggagtacaacgagtgtagcgaggaagggaaatgaagatgaagcagtggcgagggaaaagaggttggttaccttggagttggaagatatgttaaggagtgagaatagtgaaaaggaatgtgagaataacaacggccagatgtctgatgttgagaattag

SEQ ID NO: 86299 - DNA, 930 bp, Glycine max
  Peptide Sequence Number=SeqID_203077
gattaggtccatttttcacaggtcagtggaatctttatgctcaaaaccccgattccaatagtcatatatttggtacccctcaaggagcaggaactgctattctaacacttctcgggggatttcatccgcagaggcgaagtttatggctgaccgatattgcacaccatcatttagctattgcatttctttttctagttgctggccatatgtatagaaccaacttcgggattggtcacggtcttgctctagcctctttaggggttattacttccttggtagctcaacacatgtactctttacccgcttatgcatttatagcgcaagactttactactcaagctgcattatatactcatcatcaatatatagcgggcttcattatgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggaaacacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgaggcg

SEQ ID NO: 86300 - DNA, 294 bp, Glycine max
  Peptide Sequence Number=SeqID_203078
atgccccatgggttgtttccttacaaaagtcacacgctaatgccattgaggcatttcaccgaacacttggtgggtgcgcgtttaggcgtcaatagcaagagaacagggacaatgtggcatagcaccaaaaggagatcaaaatacaccaatgaaaagctagaaagcttagggatagaacacttacttggtggtgatgaacaaaagcgcaaaacggaatcaaaaaatgcgaaaaaggatgaccctagggctgcaaattcgtcaatcccgtgggggtggctcgcccaggcgagctaa

SEQ ID NO: 86301 - DNA, 353 bp, Glycine max
  Peptide Sequence Number=SeqID_203079
ataaccacttgggtatctccgcctgccacctaacttcacaggttaggattaacagaaatcgtttgtgcagacaatcacttgtgtatctccgcacgccacctaacttcacggaaagcgcaaaagacgacgtaaatatccgcgtgtcaacgggctcattggccgcaattgacgaagggtgcagaagacaacaaatcatttgtgcggataaccacttgggtatcttcgcctgtcacttgacttcatgggtcaggatggcaaaaagttctccaccggaagatgctgacatctccggaaaggatgcagatgaccacgttggtctctacttgtcaatcggacttggggtctccgaatga

SEQ ID NO: 86302 - DNA, 596 bp, Glycine max
  Peptide Sequence Number=SeqID_203080
ccttcagagcaccacacgtcctcgccttcagagggctacacgccttcaccttcagaggactacatgtcctctcctttagaggactgcaggtcctcgctttcagaggactacacgtcctcacctttagaggaccgcatgtcgtcaccttcagagggctacacgtcctcgctttcagagggctacacgtcctcgctttcagagggctagatgtccttaccttcagaggactacacgtccttgccttcagagggctgcacgccctcgccttcatagggctacacgtcctcgccttcagaggactacatgtcatcgccttcagagggctgcacgtcctcgcttttagagggctccacatctgtgccttcagagaactcaaggcaggtgcaggacgagacaccacaacagcctggggatggccgacagcgggcaacagacgcaccgccgccacccccagagcccctcagctcatctacaaaagctggagcgttgcctacgatccgtggccgactagcacgcgaccaagtccaaagccaaagttaagcaaaagtactaggcctgtgaccgacaagtcatcacacgtccggctcaagacgtaa

SEQ ID NO: 86303 - DNA, 145 bp, Glycine max
  Peptide Sequence Number=SeqID_203081
atggcatgccctcatgttgctggtgttgcagcattgttgagaggagcacaccctgaatggagtgttgcagccattaggtcagcaattatgacaacatcggacatgtttgacaacaccatgggactcatcaaagacattggtgatg

SEQ ID NO: 86304 - DNA, 226 bp, Glycine max
  Peptide Sequence Number=SeqID_203082
atgacccgtgcctacatccagtcctcaagcaacctcttgagatttcctttccatgtaaaaatccttaacaagcaaagagccacaaaggatgtaccctcccatgttctctttgaacaaccaagtagatgtaccctctacttgaagcgaaccacaaaggatgtaccctcccttgtgttcactattacaaccaagaagctacccgtttcttacacaaaattctcagacg

SEQ ID NO: 86305 - DNA, 408 bp, Glycine max
  Peptide Sequence Number=SeqID_203083
atgaagaagtattttgagcaatttggtgagatcttagaggctgttgtcatcactgacaaagccactggaagatgtaaaggctatggatttgttacttttcgtgaaccagaagcttccatgagagcttgtgtggatcctgctcctataatcaacggtaggagcgctaactgcaaccttgcttctttgggtgtccagagatctaagccttcaaccccaaaacatgcttaccttgaacccaacaccgacagtggcagcaagactcagctattcaatagatcaacacatgtagacgaaacaaagcgtacctgtcacggtcttcagcgcaatagagaacaacaagctttgatgttaacggagaaggagagcgcgatagaatacatgaagaagaagagagcgcgaacaaaatag

SEQ ID NO: 86306 - DNA, 369 bp, Glycine max
  Peptide Sequence Number=SeqID_203084
atgctcaaaacacttgaaaggtaccaaaagtgcagctatggtgcagttgaagtcagcaaacctggcaaagagcttgagagcagctaccgtgagtacttgaagctgaaagcaagatttgaatctcttcaaaggacccaaaggaaccttcttggtgaagacttgggcccactaaataccaaagatcttgagcagcttgagcggcaactggattcatctctcaagcaagtgaggtccacaaagactcagttcatgctggaccagttagctgatcttcagaataaggagcatatgctggtagaagcaaacagatctttgaccatgaaggtaacaaacatcataccatttcccacgaagttcatcccacaataa

SEQ ID NO: 86307 - DNA, 222 bp, Glycine max
  Peptide Sequence Number=SeqID_203085
atgactgccgaagtagagcaggaaatgcgtcgtttgtttggcagtgaggtgttgatcagcaaagtctatgaacatcccgtcctggcggacagcgcccgcatgggtcagcacgtgtttgagtatgatgcggatagcgcggctgcacaagattacatggctttgtattttgagttgcaggatgtcatcaagcaattgccacgacctgaactgatcgcggcttga

SEQ ID NO: 86308 - DNA, 648 bp, Glycine max
  Peptide Sequence Number=SeqID_203086
atggcttctggtagtttgagccagtgcgcgaacgactgcgccaagtccaggcatattacgccaaagtgggccagattattatgctacgccttactggatagtttgatggaacgctactttcaggtctttgaagccatcaatgaagatgccgagcaacttgaaaatcacctgctagaccgtacaagtccagaagacttgcaaaacatacaccgcctcaaacatgtcaccatacaactgcggcgcgcagtatggcctttgcgtgaagtactcaacagcctgatccgtaatgaacatggctttttcaacccccaaactgtgccatatttacgtgacttatacgaccatacggtgcatttcacagaatccctggaagccatccgcgacacgctaagcggcctgatggatatctacatgaccagcctcagtcaacgcgtcaacctcgaagtgcgcgcactgaccgtcgtcgccatgctttttatgcctgcgacattaatcgcagggatttttgggatgaactttgagcagatgccttggctaaaagaccctgatggcttctggtgggcgatattgatgatggcaatgattgccttggcaatgttgttggtcttttggcgccgacaatggctgagtagccgaggggaatcttaa

SEQ ID NO: 86309 - DNA, 1341 bp, Glycine max
  Peptide Sequence Number=SeqID_203087
atgactaacacaattcgtgtctgtttctacttctcttacatcacattccttcaactcgtctccagaatattggctcaatctgaaaattatatcatccacatggacacatcatcgatgccaaaaccattctccagcaaacacaattggtatctgtccactctttcttctgcattagaaaatactcatgttaccaacaatgacaatattctcaacaccgcttcttctaagctgatttatacctacgccaacgccatgaatggttttagtgcaaatttgtcacctaaggaacttgaagccctcaaaacctccccgggttacatttcttccacaccagatctgcaagccaagcttgacaccacacactcaccccaattccttggcctcaatcccaataaaggggcatggcccgcttcgaaatttggtgaagatgtcattgttggatttgtggacagtggagtttggccagaaagtgaaagcttcaaagatgaggggatgactcaaattccttcacgttggaaaggccaatgtgaaagtagcatcaaatgcaacaagaaactcatcggagctcagttctttaacaaagggttagttgccaaataccattatcccgcaacagttgagaactcaactcgagacacagaaggtcacgggacccacacatcaagcactgcagctgggagccaagttgagaatgcatcattctttggctacgccgatggaacagcgaaaggagtagcttcaatggcgagaatagccgtgtacaaggccgtgtggcaaggtcaacttttctcatctgatctaatagccgcaattgatagtgcaatatctgatggggttgatgtcctttccttatctattggctttggtgatgtactcttgtacaaggaccctgttgctatagcaacatttgcagccatggagagaggcatttttgtgtccacgtcagcaggaaatgctggtcctgaacgtggaacccttcataatggaataccatgggtcataaatgtggctgctggcactttggatcgtgaatttcaagggactcttgctctcggcaatggagtcaacatatcgggcttgtcactctacctaggaaacttctccacacaccaagttcctattgtttttctcgatttgtgtgacaatttgaaaaatcttgccggttcgtgtggcaagattgtggtgtgtgaagataagaaaggaacccttttagatctagtgcatgctgttggattgtcaaatgttgccggagcagcgttcatatcaagtagcactgatacgtcgtttttccgagagaatggttctgcagccatcattattaacccgggaaatagagaaact

SEQ ID NO: 86310 - DNA, 426 bp, Glycine max
  Peptide Sequence Number=SeqID_203088
atgagaacggtgaccaacgttgaagagggagaaataatctatactgatagtgttacacccctacaaggatttaatgtcactgttatcccaagcaagttggtgttcaaggagaagaatgagaagctaattagtgacaagttaaggatagaaggtgctaagatcgaggttttcggttactatacaaggtgtacaggtaaggaggtacaagccaaaaaactaacatatactaaaacacctcctaaagagatcaagacaagatgcaaactgcagtgtgatgcaaacagggcaaaagttgaacaaggtggatattctacgaaaatcagcttaaaaaggataaaaaaagagagctttgatgaagaacacgacggagcatggtcatggtcattccagcacactcatggtcattccaaaacaaccatgttctga

SEQ ID NO: 86311 - DNA, 885 bp, Glycine max
  misc_feature (135)..(135): n is a, c, g, or t
  Peptide Sequence Number=SeqID_203089
atgacacatcgggatcatttcgacaatactaaggaacacatcaaggacattgcgactgattacagaccagcctctcctttagccatgggatctggtaatgtaaaccccaacaaagcccttgaccctggacttgtntacgatgttcaagttcaggattatgtcaatcttctctgtgcattgaacttcactcaacagaacatcacgatcatcacaagatcctcttccaataattgctccaatccttccttggatctcaactacccttctttcattgctttctacagtggcaacgcttcttctaatcatgaatcaagggtaaataattgggagtttcagagaacggtgaccaatgttggggagggacgaacaacatatactgctagtgttacattcattaaagggtttaatgtcagcgtcattccaggtaagttggcgttcaagaagaagagcgagaggctaagttacaagttaaggatagaaggtccaaggattgagggttttgggcatcttacttggacagacatgaagcatgtgggaacacggccgttctcaaaaaatagtgacattgatggtccttttatgaaatttggagaacctaaaggtgttttggatgaacactaccatgctctgaggagcacgacggttctcgaagaatctgacgttgttccttacttgaaaatcagaacatggttgttttggaatgaccatgagtgtgctggaatgaccatgaccatgctccgtcgtgaggagaacctcttgggtaatctgattcgggatactggtggtgtggttattcaacccagcgtacgtgattcttggtcctggaatttggagccaggtcccttctcaggtcttaatcttctcttggaggcttttgttggatag

SEQ ID NO: 86312 - DNA, 1740 bp, Glycine max
  Peptide Sequence Number=SeqID_203090
atggaagagaatgagaagattgctgacttctttgcacgagtaaaggtagtcaccaatcagatggctacacaaggtgagattctaactgatggaaaaatttgtgagaaaattactcaatctctgctggaaaaatatgattatatattatgtgcaattgaggaatccaaggaagtaagtgaaatgagtttagaagaattgcaaagttcactagaagctagaaaattgttgaacaagtcttattggctcaatctagtaacaagaattatggtgacggtaacagaggaagaaatggttttagaggaagaggccgtggtaggaacaatagaggaagaaatggctatgtttctagtagtggaagaggccaaaataatgttgaaaagaaacctgatcagtcatagagaggcaggggcagaggctactatcgaggtggtagcaatggtagaggaagaggtgtgttatgcgaagaaggattcccaaggtgatgaggcaaatcttgccaaaggtgatgatgaggaaaatgagctagtgatgctcatggtgactactgcagatgaaacatgctccattgatgaatggtatcttggcataggatgttctacatatatgactggtcataaagaatggtttgtcaactttgattcaagcaagaaaaatagaatcaagtttgctgatggtagagctatgctagcagaaggagttggaatcaagatgccgaatggtacacagtactgtatgtcatgtgtattttatgtacctggactggagagcaatttgctcagtctaggacaattagtggagaaaggccataaggtgattatggaagataaaaaacttaaactgtttgattcatgtgacaaaaatagtttgatatttgatgtttctatgtctagaaataggacatttagagccaatcttgaagcactttgccataaatgcctagctgcagtagtgagtgaagatgattgggtgtggcatcatagatatggtcacttgaattttagagacttgcatgacttgaatactcacaacatggttagagggctgccattgataaatgtaccaaaagaattatgtaaaaattatgctgagtctaaacagcatagagaaccttttaagaaatttgttgaaactaaggcaaaagaaaagcttgaagtgatatactctgatagaaagagtgaagtgctaggagtattcaagaagttcaagagaatggttgagagacaaactggtttcttgataaaaactatagtcactgatggaggaggagagtatactagcaatgaatttgatgaattctatgaactagaaggtattgggcatgatgtgacacctccctacactccccaacataacggtgcagcagaaagaagaaatcgaacagtgatgaatatggtcagatgcatgcttaatggaaagaagctaccaaaatttctttgggcagaggctgtctccactgcagtgtatgtgctaaaccgaagcccaacaaaaaggcttaataaaatcacacctgaagaagcatggtctggacgcaaaccagtggttagtcattttaaaatttttggctctatttgttataaacatgtgcctgatcagttgagaaagaagttagatagcaaaagtgagataatgatactgttgggttatcatgccattggtggttacaaattgtttaatccagtaaccaaagaagtgctcgtgagtagagatgtggtagttgatgaatccaaggactggaattag

SEQ ID NO: 86313 - DNA, 590 bp, Glycine max
  Peptide Sequence Number=SeqID_203091
gccggaaactccgagggccggtcgcccgaggcgatgcccatcaccagccggccgcccgacaactggtcgatggtggcggcggccttggccaggtcgatcggatggcgcaacgagaaaatggcgctgccggtggccagcgcgatcgaacgggttcgggccgccaggaacgacaggtaggtgaagggatcgaacacctgtccggcatcgccgaagcccaggtccatcaagggcacgtcccgtacccagacggcggcaaagccgagccggtcgatctcggtcacgagctccgactgccccgccagcacctgcatgtcgccgttgtagaagcgcagcggcaggaacatgccgagggtgagctggccgggcgcgaacatgcggcaataacccggatgggcggcgaacgctggcgcggaagcgccggtggggatggatacggaggacgtcgtggttcaggcgccgacggccggcgcgggcaaggtgacgccacgctggaccgccggccgggcggcgatgcgttcatgccacgcgctcaaatgggcgtgggcgctgaaatcgaagccgacgatgcgggcgatatgggtccagcctaa

SEQ ID NO: 86314 - DNA, 465 bp, Glycine max
  Peptide Sequence Number=SeqID_203092
atgactccattgccgtcactccaaaatggtcaagtgactaaatcaaacagaacaaacactctgagggagttcccggagagatttgcaaaagataggataagatttcctgcatctaatgtccaatcttttgaatttgggatgatcggccctctcaatgagtcaatctcttgctttctcataagggtggacccttgggtactagtaccctcgtccatcagagggctacacgctctcgccttcagaggactacacgtccttgtcctcacctttagaggactgcacatcctcacctttagaggaatgcacatcctcaccttcagagggttgcacgccctcgccttcaaagggcgacacgtcctcaacttcagagagctgcacgccctcgcctttagtgggctacgcgtcctcgctttcagtgggctccatatccacaccttaagagaatttaaggtcctcttcccttaa

SEQ ID NO: 86315 - DNA, 264 bp, Glycine max
  Peptide Sequence Number=SeqID_203093
atgttctccataggtagtatattcgccgacaatttggcccccaacctcgaagtcttaatcgttaaagccaccagccatgaacaagtccctgtcgatgaaaaatatgtcagagaaatcttgacattgacatcaatttctagaagctacatcaacgcttctctcatcaccatttccgagagactcaacaagatgcacgattggatcaccgccatcaaagccctcttgctcgttcataacagtggatgtggaggtggaagagactga

SEQ ID NO: 86316 - DNA, 177 bp, Glycine max
  Peptide Sequence Number=SeqID_203094
atggcggatggcggatggcggaaggccaaaattccgccatataaacacaccattgcaccttatggcaccaccatggtgggccttccttcacaaattgcctatggagaaagtgtaaaggatttgcgagatagtggaactcccaagcgggtttcttggggactggacgtaggcaactaa

SEQ ID NO: 86317 - DNA, 426 bp, Glycine max
  Peptide Sequence Number=SeqID_203095
atggaagtagctgcagaggtagttcaaaagttgcaaccacgtgaagcatcaactgtgtttattaagacaacaaaggagaggatgaagtacaacaaaatagaaaacaacaagcaatttccatccttgctgagacatgcctttgttaagtggtggaatcaatttgacacaacaaaagcagaacaagacaaggtgaaaatctggtttaaagctcatccagagttccttaaggcagctgatctagagacttcaatgtttcttaatcagaaatccaagctaacgactttcctagcaaggtctaagtcgaaggaacatctgaccaagaacttaaaagaagttcttcaattgcttcaagaccacaaagaaggatattcttcgtcaaagaaagaagacgctaagtcaacaagcactttagatgttttttactag

SEQ ID NO: 86318 - DNA, 231 bp, Glycine max
  Peptide Sequence Number=SeqID_203096
atgaggcttggaaccttccttacttgcagtactctatcattttgctatgctaatactgcattgcggggtggcggtgggggcagagtaggtgacgccgatgcaggggtatggctgggggaggagggagagagaggaagtgggacgggtgctgcggggttagggacacttaaaaaatgtttatttttacgtgcctatcagacgttcacagtggcaatcaacgtcactacctga

SEQ ID NO: 86319 - DNA, 324 bp, Glycine max
  Peptide Sequence Number=SeqID_203097
atgatgaccgtgaagcaaggtttctgctctctgcgaggctcactccgtttcttcgcaatcctcacccttctctccttcacctatctttctctcaaatactccaccccaacaccccaggttaccaagctctcggtcgagaacctcaacgatgcgccagtaagcgagaaagaagagaaagaaggggaccacgtgagtgtagagctaggactgtgccacggagcgattttgggcgatggaggtgaccatgtagtcggggattgtgaggaagagggtggtgttgctgtagaggaggctgcgggtgatggcagggtcgacgtcttctag

SEQ ID NO: 86320 - DNA, 246 bp, Glycine max
  Peptide Sequence Number=SeqID_203098
atggcattggagcaatcactcttcaaactcaaagaatccataatagggagtcatgcagtgttaacaatgaaggatggcagaacatggcagaatgccgaaattccaccatatgaacaccccattgcaccttatggaactaccatggcaggcctcccttcaaaagactacggtggttggcaaaaaatctgccacgccattccaccacggtggcaccatggccgctatttaacaacactagagtcataa

SEQ ID NO: 86321 - DNA, 1491 bp, Glycine max
  Peptide Sequence Number=SeqID_203099
atggaagctgatgaacttctaaccaaagaaatagaaaatgacgattataaaatatccgtaaaagaaccgcagattatctggaagaatttctccaaattaaatgctgttccaagaccttcaaaaaaagaagaaaaagtaatcgcatttattaaaggatttggtgaaagtctgggattacccacaacagtagatgaagtaggaaatgttattattaaaaaacctgcaacagcaggaatggaaaaccgtaaatcgattgtattacaatcacatttggatatggtttgtcagaaaaacagtgatgttaattttgattttgatacagaaggtatcaaaatggaagttgacggagactgggtaagagcaaaaggaactacattaggagcagataatggtttaggtgtagctacgatcatgtctattttagaaagttcagacattccgcatccggatttagaagcactttttaccattgatgaagaaacaggaatgaccggagctcttgggttaaagccaggacagcttaccggacagatcctattgaatcttgacaccgaggaagatgatgagattgatatcggctgtgcaggaggaatagatgttactatcactcaaaactatgagcttgaagcagcgaaaggacaaattgtaagaattgaaatcaaaggactacagggaggtcactcgggaatggatatccataaaggtttcgggaattccaatattattttgggaagattgctttacagcggtttaccaaaagaaaatgtacaattaatttcaattgatggtggtggtttaaggaatgcgatcccaagagaagcagtagctattatctctgtaagaaacgccaatgagtttattgaggagctgaccaatggtcttaaaaaagaaattttagaagaatttgcaactgttgagccaggtcttcagatcaatatagaaaattcaacaagctctgataaagccctgtctgaagaagattctaaaaaagttattttagtcctaaaatctcttcacaatggtgtttacagaatgagtccggatgtaaaagatcttgtagaaacgtccaacaatgtggcaagagtagaacttaaaggtggaaatttaaaaatattaaacttgtcaagatcttcagttgactcaactaaatatgctgtggcagaacagttaaaatcagtttctgaactggcaggaatgcaggtagaattcagtggctcttatcccggatggaaaccaaaacccggatctgaaatcgttcagctcatggaaaagatctataccgaaaaattcactgaaaagcctcatgtggtagcttgccatgcaggtctggaatgtgggatcatcggtgctaactatccggaaatggaaatggtaagctttggacctaccatcagaggagcccactctcctgatgaaaaggccaatatcccttcaacacaaaaattctggagcttcctgaaagaaattttagcgaatattcctcagaaataa

SEQ ID NO: 86322 - DNA, 755 bp, Glycine max
  Peptide Sequence Number=SeqID_203100
atggaggattcaatcgggaaaataacaaagatcacatttcccagtcaagagggtccgctcttgacggtgaagaacacattggagaatggaggattcaatcgggaaaataacaaagatcacatttcccagtcaagagggtccgctcttgacggtgaagaacacattggagaatggaggaatccaatcgggaaaataacaaatatcacatttcccactcatgagggctccgctcttgacggtgaagaacacattggagaatggaggaatccaatcgggaaaataataaagatcacatttcccagtcaagacggtccgctcttgacggtgaagaacacattggagaatggtccgctcttgacggtgaagaacacattggagaatggaggattcaatcgggaaaataacaaagatcacatttcccagtcaagagggtccgctcttgacggtgaagaacacattggagaatggaggaatccaatcgggaaaataaaaaagatcacatttcccagtcaagagggtccgctcttgacgagcggccgccaccgcggtggagctccaattcgccctatagtgagtcgtattacaattcactggccgtcgttttacaacgtcgtgactgggaaaaccctggcgttacctaacttaatcgccttgcagcacatccccctttcgtcagctggcgtaatagcgaagaggcccgcaccgatcgcccttcctacagttgcacatcctgaatggcgaatgggacgcgccct

SEQ ID NO: 86323 - DNA, 763 bp, Glycine max
  Peptide Sequence Number=SeqID_203101
atggctcaacatcgtggaggatcaggcaacttcgcggaagatcgcgaaagggccgcggaagcgggtcgaaaaggcggtaaaaacagcggcgggaatttcagaaatgatccgcagcgtgctgccgaagcaggtgaaaaggggggacgcagccgcgcgaaaaaatacaaaaatgtgcgccagtcctctattctggtgcgttatgtctgcttccacttcccgcctcagcctgcgtattacgcgtcaggagctggtacttatttttatcactatggtctggggtggcacctttctggtggtgcatcgcgccatggcgcactcggggccattcttttttgtcgggctgcgtttcgctaccgcctctctgctgctggcctttttctttcgccgctatttgcgtcacattacctggctggaaatcaaagcgggcgcgctgattggcgtggcgattgccggtggttacggattgcaaacctggggtatgcaaaccatttccagcagccagtcggcgtttctcacggcgctttacgtgccggtggtgccgctgttgcagtggctgtttctgcgccggccgccgggcctgatggcgtggctgggcattttgctggcgttcaccggtctggtgctggtggcggggccgcacgatggcagcctgacgctgaatgccggcgagatcgccacgctgctcaacaccctcgccattgccgccgagatcattcttatcagtcgctacgccaggcaggtcgatgtgcgccgcgtgacgctg

SEQ ID NO: 86324 - DNA, 381 bp, Glycine max
  Peptide Sequence Number=SeqID_203102
atggtcattctgcaccttttgtcatccagaggcggcgagcccgatgacaggcggagacaaattatggtcattcgcacacctttccgccatctagagacgatcgagtccgatggcacgcagagacaaattatggtcattttgcaccttttgtcatctagaggcggcgagcccgatgataggcggagacaaattatggtcatccgcacacctttccgccatccaaagacgatcgagtccgatggcacacagagacaaattatggtcattatgcaccttttgtcatccagaggcggcgagcccgatgccatgcagagacaaattgtggtcatccgtgcaccttttcgccatccagggacgatcgagttcgatggcacgcagtga

SEQ ID NO: 86325 - DNA, 312 bp, Glycine max
  Peptide Sequence Number=SeqID_203103
atgccatataccacccttaacacaaaccaagacaccaatcagggagggaatattccagcgaaaaagcctgtagaattcaccccaattctggtgtcctatgcttacttgctcccatatctactcgataattcaatcctagccataaccccagccaaggttcctcaacctctatttttccgaggatatgactcgaacacaacatgtgtttaccattgtcgcaacctacccttcggcgggagggcgacgcgagggctcacgggtgcgtcttccatgggaggaagatgcacggagtcgccaccaacgtttatttga

SEQ ID NO: 86326 - DNA, 915 bp, Glycine max
  Peptide Sequence Number=SeqID_203104
atggcgataccgccgacgccgaggctggccaccagcgcggtgatattgatccccatattggagaggatcgccagcagcatcatcacccacaccacgacgcgtagcagaatgccaaggatcaccgtgaatcagcgccaggaaccagccgtgggcgatggcgacgctccagctgtccggcagatcgacaaatttcagcgcgatcagcagcgagaagatcagcagcagcagctgactggtgctgcgcagaatctccaccagaatgccggtgaagcgcacgtggcgctgttcgctgtagtgggcgatgcggttagagacaaaacgaataacggtgcgcagcagccaaaagccagttttccattggggagaatctccttgctgggagccggtgaaaagaatgtgcaaggagaaagcatagactacgctggcgtcgcgcgggacgccggcggtttactggaaacgattggccttgtcgcgcgccagccgctccagcgcaaaaatcacctgctgcagctgacgctcctgcaccggttcgatggcggtaaaacggaagctaagccgcggcgtgatgcgggtttcgttcttgctggtcacggtgctgcgctcgccgatgtgcagcagctgtgcggtcacttcgaactggccatattcgcccagctcaacgcgcagctttttgaaggtatcgccacggttaagaccttccggcagcgcctcatccagcagcacgccgacgccgccaagcgacagatcttgcaggcgaaagcgcgcggtgctgccgtccggccactggctgtggcagtagaatactggttcgagcggcgcgttgacgcgaaagaactcccggcgctgaatctgccacaccaggtcgggcagcgcggcggcaaaggcgggcaggccgtcataatcgatgcgggttaa

SEQ ID NO: 86327 - DNA, 207 bp, Glycine max
  Peptide Sequence Number=SeqID_203105
atgctccaaccatgtggtatcggcacatgcttaaaggagcactcaaaccgggtgatccccaaggcctacactccgaagagtccgttagggcttctccctcttgattcagacattgctcatgaattatacaatacctatgacctcacactcgtgtttgaaacatgtttaacacaattgtgctacaatttaacactggttcctaaatag

SEQ ID NO: 86328 - DNA, 336 bp, Glycine max
  Peptide Sequence Number=SeqID_203106
cacaggattataattaatacaacccctcgtcccatcaaagggacatttgggaatccttcacatgagcattacactcctgccaatccttctttccaccatggaaaccaactaatggacactcccatcatgccagccaagaggcttgcgggtgtgtcttccaagaaaggaaaatgcgcagagtcaccaccaaagtttattcgaggaaaacgtcggaaaaaccggaaaggggaaaagagggaggtggttgccgcccagctcgcccaggcgagctgggttgcttccaccagaaggcactgccttctgttggaacaccctggaaggtctaagtgggcctaa

SEQ ID NO: 86329 - DNA, 324 bp, Glycine max
  Peptide Sequence Number=SeqID_203107
atgggaatggattttgtgggtgatgttggggaggtctttgtggttgattgggcattctcggttggatgggcatcgagcaggggggagatccaatattggccgagtaattatattggtgtcggggatattggtacatgggattgtgaggggtttgttaggaacttgtccatgtgggtgttgtggtcacgacatgggcgtctccctcctttttctttgctccacctgttccagtcctcctattgccagaacttgttgaagcagcataatcaaattttcccctccttaggttctttcacccgcaaataccagatccacaaaacttaa

SEQ ID NO: 86330 - DNA, 162 bp, Glycine max
  Peptide Sequence Number=SeqID_203108
atggggaatatgaatgaaggatcattttgggtgatggtcagcaccacaccaacttgggtgccaacaggtgctaggtccagaataagatttcctcacaatcaaggaaaggagttaggaaggataagatggcgaagcctcgaccacaaccccgcgttcggctaa

SEQ ID NO: 86331 - DNA, 546 bp, Glycine max
  Peptide Sequence Number=SeqID_203109
atgagtgagatagaggaagttcaagaacagatgaaggccaacatcgaggccatgaaagatcaaatcaccaccatgatgaaggccatgatgagtatgaggaaaattatgaaagtcaacgcggttgcagtcgctactacaagtgtcgccgtggaggtggacccgactcacccatttggcattaatcaagtaaatcgcccagtccccgatatggtaggtcagggaggcaaagcattgggaagtatgggcgacccccatttagtgcaggtcccgagaaagcatcccttcccaccgtatgccctgcctcccaactatgcaccacctaatgttgtacatctgcccgatgagaacgttgaccactccgctcctataccccttgagagccaacaaccccagtctggccatgcacatgtctttcaacccatgtgggagacacccaaagttcctcgagaccacactctagccgacttcgagcctcacctcggatgtgccagtgaggggcaagcatttggtggcgtaccccagccaaacactttgggggctccttag

SEQ ID NO: 86332 - DNA, 546 bp, Glycine max
  Peptide Sequence Number=SeqID_203110
atgacggagaggtacgcctggggagtggctgctttggtgcttatgtacgaccagctgaacgatgcatccatgagccacaaccgacagcttggcggttacatcacactgctgcagtactggatttacgagtactttccgtcagttggggactccattgctgatcaggactacgacgaggattctctacgtgcgtggagcgcttggaccgactctggattctggatgtctgttggatcccgtatggggagcaccgatcggtccgggactcccacgtcagatcatgctattccggtctcttgcgctgggggcctgttgctgtttattatcgaccagagagggtcgtgcgacaatttggatacacgtagaccattcctactcctcctgtcgattcatgggtgtcgtatgatgatatacatgacaggtggggtgttcgttgtgccaggtcagtgttccagtgactacatggactggttcttccgcatctcgcatcctttcatgacaccaggccacgcattagatcctctgcctgatggtcacgccccgtag

SEQ ID NO: 86333 - DNA, 483 bp, Glycine max
  Peptide Sequence Number=SeqID_203111
atgcatatgcctaatgagaacactaaccacgttgttcccattgaaggccagcaaccccagttggggcatgcacctttcgctcagcctatgggggaggcccgtgaagagccttggggtcatgctttgggtgacttcgaaccataccctatgttcgccactaagggatcaacatgtagtggtatgcctcagcccaatgccgcaggggctcctcaaccccgcctactaaaacctctgcacttctcagtagggagcctgcctctggccgtggaaggaagggagaaattggatctcatcgaggaaaggctaagggtcatcgaagggattggcgattacccgtttgtctacatggcagagttatgtttagtgcctgacatctccatcccctcgaagttcaaggtgtcggatttcgataagtacaaggggactacttgccccaagaaccacctaaaaatttactgtaggaagatgggggcatactcctaa

SEQ ID NO: 86334 - DNA, 234 bp, Glycine max
  Peptide Sequence Number=SeqID_203112
atggtggatcatacttatgatgttgttatcattggtgctggtggcgtggtattgagagttgctattggaattttagaaaatgggtccaatactgcttgtattaccaagctcttcccaacttgttcacacactgttgcacctcagtcttggatcacgttgacactgtcaccactgccattcatgattcattcttgttcgacacttcatcattattttggatacatgatactttaa

SEQ ID NO: 86335 - DNA, 219 bp, Glycine max
  Peptide Sequence Number=SeqID_203113
atgcatgttgttagacatggccataagaaagagagattcaaacctagttttgcaaaacacacgaagacggaaggagaccaaacatgtgaagaagaagaaagaagcgacaacgacaacaatagacacgacaactcaagcagcagtgatgatgacagggaaggtgcaactacaagatctgacctcttgagaaaaagaatagaagttgtggcagttgcatag

SEQ ID NO: 86336 - DNA, 2004 bp, Glycine max
  Peptide Sequence Number=SeqID_203114
atgaacatgcttactgctctggaaaatttgcagctagctgacaataattttataggccatttacctcaaaacatttgcattggtggaacgttgaaaaatttttccgcttctaataacaacttcataggcccaattccagtgagtttgaagaattgctccagccttataagagtcaggcttcagcaaaaccagctaactggggatataacagatgcttttggtgtacttccaaatttggactacatcgaattgagtgacaataacttttatggtcaactttcacctaactggggaaagtttcgtagcctcaccagcctcatgatctccaacaataatttatcaggtgtgataccaccagaactagctggggcaaccaaattacaacgacttcacctgtactcaaaccatcttacaggaaacattccacatgatttatgtaacttgcccttgtttgatctctcactcgacaacaataatcttacaggaaatgttcccaaagaaatagcaacaatgcagaaacttcaaattttgaagcttggatcaaataagttgtctggcttaatcccaaaacaactaggaaatttgctcaatttattgaacatgagtctgagccaaaataattttcagggaaatattccttcagagcttggcaaactgaaatttcttacgagtcttgatcttggtggaaattctttgagaggaacaataccttcaatgtttggagaattaaaaggcttagaagcactgaatgtctctcacaataatctttcaggtaatctctctagcttcgatgatatgacgagcttgacatctattgatatatcatacaaccagtttgagggtccacttccaaacattctagccttccacaatgctaaaattgaagcattgagaaataataaaggcttgtgtggcaatgtcactggcttggagccttgctcaacatcaagtgggaaatctcataatcatatgaggaagaaagtaatgatagtaattttaccccttactttgggcattctaatactggcattatttgctttcggagtctcgtatcatttatgccaaacctcaacgaacaaagaagaccaggctacaagtatacaaactcctaacatatttgcaatatggagttttgatggcaaaatggtattcgagaatattattgaagccacagaagattttgacgacaaacatctcattggtgttggagggcaaggatgtgtttacaaagcagtgctgcctacaggtcaagttgttgctgtgaagaaactccattcagttccaaatggagagatgctcaatctgaaagctttcacatgtgagatccaagctttgacagaaattcgacatcgtaacattgtaaagttatatgggttttgttcacattcacaattctcatttttggtgtgtgaattcctggagaatggcagtgttgagaagactctgaaggatgatggacaagcaatggcatttgattggtataagagggtgaatgttgttaaagatgtagcaaatgctctgtgctatatgcaccatgaatgttcacctcgaattgttcatcgtgatatatcaagcaagaatgttcttttggattccgaatatgtagctcatgtctcagactttggaacagccaagtttcttaatccagattcatccaattggacctcattcgtaggaacctttggatatgctgctccagaacttgcatacacaatggaggtgaatgagaaatgtgacgtgtatagttttggggtcctagcaagggaaatacttattgggaagcaccctggtgatgttatatcttctttattgggatcatctccatctactcttgtggcctcaagactcgatcacatggcattgatggataagttggaccaacgtctccctcatccaacaaagccaattggtaaggaagtggcatcaattgcaaagatagcaatggcctgcttgactgaaagtccacgatctcgccctaccatggagcaggttgccaatgagctg

SEQ ID NO: 86337 - DNA, 399 bp, Glycine max
  Peptide Sequence Number=SeqID_203115
atggtgaaaggaatagacccagtgagttcattagattgtataaataattcactaagctttgacaaattttcaatggtgaaaggaatggatccagagagtttattttcatcaaggaacaaggagtccaaattgaccaagttgcctatggaagctgggattgctccagagagttcattagaggatatagataatacactaagctttgacaaatttccaatggtgaaaggaatggacccaaagagtttattttcatcaaggagcatgaagtccaaattgaccaagttgcctatggaagctgggattggttcagtgagttcattagtggatatatctaatacactaagctttgacaaatttccaatggtgaaaggtgtggacccagagagtttattttcataa

SEQ ID NO: 86338 - DNA, 231 bp, Glycine max
  Peptide Sequence Number=SeqID_203116
atgaagagagagaagcatgactttggttgtcaaggctggatttccacttcaacaaagcatttgcttctgaagcaatgtcagaagaagcagcaaatgcacagaagagaagtacttacaagcaattcatgggatatgcacacttatatgcaaaacatcgtgaaacacgaaccagagtcaagagatatgcacatcaaacaagacagccgatcagtggggtcaatatatgtctag

SEQ ID NO: 86339 - DNA, 743 bp, Glycine max
  Peptide Sequence Number=SeqID_203117
gggagagacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtgctcatcttaggacacctgcgttatctttaacagatgtgccgccccagccaaactccccactgacaatgtcttccgcccggatcgaccggccgaagccgaccttggctcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 86340 - DNA, 295 bp, Glycine max
  Peptide Sequence Number=SeqID_203118
tggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 86341 - DNA, 1179 bp, Glycine max
  Peptide Sequence Number=SeqID_203119
atgggtaggtcaccatgctgtgaaaaagagggcttgaagaaagggccgtggactccagaggaagaccaaaagctcatggcgtacattgaagagtttggccacggaagctggcgtgctttgcctgccaaagctggacttcaaagatgtgggaagagctgtaggctaaggtggactaactacctccgaccagacataaaaagaggaaagttcagcttgcaggaggagcaaacaatcattcaactccatgcccttcttgggaacagatggtcagccatagcagctcaacttcccaagagaaccgataatgaaatcaagaactactggaacacacacctgaagaagaggctaaccagaatggggatagaccccaccacccacaagccgaaaaccgacgcactcggcggctccggtggtggccaaaccagggacgcggcgaacctcagccacatggcgcagtgggagagcgccaggctagaagccgaagcgagactcgtgagagaatcaaagctgcaagtccagaacaacctgggatcatgctccagcacacaacctgcgagacttgttctcaacaaaatcacaacacaacaacaaccctcgctgccaccgtgcctcgacatcctcaaagcatggcaaagctcgtggaacaaaccgccacaacaaccaacaacaaaagaaaacaacaccaagataatgcatagcatgtatgcaatgatgctttccactgatgacactctagagtctccaacatccacgttgtgcttcccaggaacaacaacaacaacaacaatgcttcctatctccaacaacattggattactcttcaatgaaaacaacaacagcaacaacaacatgtatcctctcgcgacaaccatcgacgatggtgtgttcatgaaagacaacaccaccacaatgttgaatttgcaaatgcaagatgacgatattatggcggcagtggaagcatttagagcgtacgacaacaacagcagtaggaacaaatataataataacaatgttgttgttcctccctcactctccaacagtgtcatcctcgaaggactcaataacgacaatgatgataatagtaaggctgctttggttgtgtatgactcaaacgatgacttgggcacggaggaagcagacaacctggcaataatcaacggggacggaagcctctgcaac

SEQ ID NO: 86342 - DNA, 510 bp, Glycine max
  Peptide Sequence Number=SeqID_203120
aggactacatgtcctcgccttcaaagggttgcacgctctcgccttcagagggctacacaccctcgccttcagaggactggacgtcctctccttcagagggctacacgccctcaccttcagaggactatacttcctcaccttaaaaggactgcacgtcctcatattcaaagggctgcttaccctcgactacagaggactacgcgtcctcaccttcagagggctacacgtcctcaccttcagaggactacacgtcctcaccttcaagggctgcacgccctcgcttttagaggactagacgtcctcaccttcagagggctacacgccctcaccttcagaggactatacgtcctcaccttaaaaggactgcacgtcctcgtattcaaagggctgcttaccctcgacttcagaggactacgcgtcctcaccttcagagggctacacgtcctcaccttcagaggactacacatcctcaccttcaagggctgcacgccctcgcctttagaggactag

SEQ ID NO: 86343 - DNA, 396 bp, Glycine max
  Peptide Sequence Number=SeqID_203121
atgaatggcggaaatggaaccactccaacaatggtgtcaccaccttcaccacatagctcatgtgggtccactaagcccaaccaagaggacaacaataacaacaacaatgaagacgaaaataacaacaaaaacaacggcggcgatgacaacaaccacaacaacaatcacaacaacaacatcatcatcatcatcaacaacaacaacaacaacaacaataacaacaatggtgacaacaacaacaacaacaatggcgacaacaacaacagccaccaccaccctgaagctccttccttggtgctagtagggtgccctcagtgtcttatgtatctgatgatctctgaggataaccttatgtgcccaacatgcaaaagcattaatttgattcattttacctaa

SEQ ID NO: 86344 - DNA, 402 bp, Glycine max
  Peptide Sequence Number=SeqID_203122
atgaatggcggaaatggaaccactccaacaatggtgtcaccaccttcaccacatagctcaagtgggtccactgagcccaaccaagaggacaacaataacaacaacaacaacaacaacaacaacggcggcgatgacaacaaccacaacaaaaatgatgctgacaacaacaacatcatcatcatcatcaacaacaacaacaacaaccacaacaacaacaacaacaaccacaatagcaacaacaataataacaacaatggcgacaacaataacaaccaccaccaccctgaagcttcttccttggtgctagtagggtgccttcactgtcttatgtatctgatgatctctgatgataacctcatgtgcccaaaatgcaaaagcattaatttgattcattttacctaa

SEQ ID NO: 86345 - DNA, 216 bp, Glycine max
  Peptide Sequence Number=SeqID_203123
atgatatgtacaggttcgctaagcgcaccgcttcatctctctaagcgcaccgcttcagttcatctgcttagcgagaaagagagtttggactgggattcagagctttgcatgtctagggtttctagagagagaaaggtccaagttccaaagagttttgagagattttgctgtgtgaagatctgcagagaccagagcttgaagcaggagccggtttga

SEQ ID NO: 86346 - DNA, 510 bp, Glycine max
  Peptide Sequence Number=SeqID_203124
atgtccacacacgcgaaccaagaacctctaaattcccaccaacccgaagcgaaaccccaagatctccctcctgatcaaccaggttcggtgtctcccggagccgaagccgaagccgaagccggggaagaggaagaaggagagtgcgggttctgcctctttatgaagggtggcgggtgcagagacgagttcataggtgggagaattgcgtcgaggaggccgagagcaacaacgaggacctcctcgagaagtgcgcccaggtcaccgccgcgctcaagcgctgtatggaagcccactccgactactacgagcccatcatccgcgccgagaagctcgctgaggaacaggccatcgtcgaattggagaaggagaagcagaatcaacaacaaccaccaccacaagaccaaaagttttcaattgcagtttgttgtggtccttgataatgtgggaaattgcaaacacatgtggctgatgcggctgcaattatggtggtggcgactccagaaaccttga

SEQ ID NO: 86347 - DNA, 225 bp, Glycine max
  Peptide Sequence Number=SeqID_203125
atggcagatataagggagtgtttctatgcggttaataaaggtatttgctttcctatgcggttgaggcacgacttcaacgcgcttagcgtgaagaaagaatctagaagagcacctgaatcgaagcagagcgctaagcgcgagatcagctcgctaagtgagtcatccgtctcttgccaggctcagtgcagcattggcgccaagcccaaatccacttactcgcgctaa

SEQ ID NO: 86348 - DNA, 465 bp, Glycine max
  Peptide Sequence Number=SeqID_203126
atggtgtcgtgtcgttggtcggcgtttaaagggaaaagagagagaggtttttggagagaaaatagaaatgaaataaaagtgggatacaaatatagggggagggaaggatttgggtgctctctgtgctctgaggatgtcgttctcggcttccatagcaagggccagaacttcaccactgcgagggcgacgatgagagcttcaccggctatcgcgacgatgccaatgtcgccgacgagagcttccacacctacgacaccaacatcaccggcagctccaacgagttcaaaaactattctagcaactccaacatccccaaatgtgattcaccacctactccaacatcaccaacaggagaacacaatcgttgagatgaacgttcccgaactcgctggatttctagcttttgctttgaattttgggggttttgttaggttagagaaattaggattttgcatatctgattaa

SEQ ID NO: 86349 - DNA, 2163 bp, Glycine max
  Peptide Sequence Number=SeqID_203127
atgaagtttggcaaggaatttgctgcacaaatggtaccagaatggcaggaagcatacatggattatggctacctaaaatcccttttgaaagacataatgctccacaagcaaagaaagaagccacattccagtgccaccccagcagcactaatgcgaaagctatcacttaacagaaccttcagcggcctcacacacagatactaccagcccgtgagccctgagcatgacatcgagaaccaacccattttggtgcactcagtgaagcgagatggtcatgaaaaatatgagactaattttcttatggctgcagaagaaggcggagagtacgagttggtgtacttcaagaggctcgatgatgagttcaacaaggttgacaagttctataggtccaaagtggaggaggtgatgaaggaagctgctgagttgaacaagcaaatggacgctttggtggctttcagggtgaaagttgagcacccaactgcgtcgtttgatggctccgttgagatgactcgtcttgcttctgatgtctctgcttcagccacggcattgcatgcttctacacccaggggtgtccagctgaaccgtgcacagacaggaagaattcccacactaattgaagatatcaaagaggaaggaagtacccatcatggtcattcagaggaatcccgggatagtgaaaaaggtgaagagattcaaactaccaacaaaagagttgaagtacagaacaagaagaagaagaatatcacccccatcaaacccatcagacctgcttctgtggaaatacttaaccgagtgcaactaaataacacttgtgagactcctcgttcgactataagaggcttcatcaagtaccctggccaaacagagataaacttcaccaaggaaaatttgagcaaagttgaagaaacactcaaactggcttttattgagttctatcagaagcttcgacttctaaagaactacacctttctaaatgtgttggcattttcaaagataatgaagaaatatgataagatcacatcaagaggtgcagcaaaagcttacatgaaaatggttgataagtccaacattgggagctctgatgaggtcactaggcttatggagagggtagaaaatgtattcattaagcatttttccaactcaaatcgaaatataggaatgagagtcctgcgaccaaagccgaagagagaaaggcatagggttacattttccatgggtttttctgccggatgctctgctgctctaacagtggcccttattctaattgtccgtgcccgtaaaatcatggatcattcaggaacattggcactaaccagtgtcctagcgaatctagacatgcaaatagatccagagacaaaagaatacaaagcgttcactgaacttttgccacttatcctggttctagttctgattgccattttattatgcccattaaacatcgtttatcggtcaagccgtatgttcttccttacatgtctgattcactgcatctgtgctcccctgtacaaggttacactgccagatttcttcatggccgatcagtttactagccaggttcaagccttgagaagttttgagttctatatatgctactatggttggggagacttcaaacaaagagaaacatcttgcaagtcaaacaggatattcatagctttttcgttcattgttgctgtgattccatactggtcacgctttcttcaggagaaagataaaatgcaaggatataacgcgttgaagtatttcctcactattgcagctgtttgcctaaggacagcttatactcttcatcaaggaatgggattgaaagtgatggcctggatattctcaatatctacagccattttttccacatattgggaccttgtcttagattggggcctcctccaaagacattccaagaaccgctggctcagagacaagcttctagtccctcagaaaagtgtatatttcgcagctatgacaatattgaatttgaatttctcctccttacatagacaagccatggtcagcattgttgccaacttagagatcattcgtcgaggcatttggaacttctttaggatagagaatgagcatttgaacaacgttggcaagtaccgtgcattcaagtctgtgccactacccttcaactacgaggaggaggaagataaggatgagtga

SEQ ID NO: 86350 - DNA, 1701 bp, Glycine max
  Peptide Sequence Number=SeqID_203128
atgtcttctatttttggttccgcattaggtgtaggtggaagcaatttcgggtgttccatccaacaacccatggtggaatgggaagtggttctcattggtgattactcattggaggaatcacctcatgaggcttctgacagcgagtcctccttcttcaagaggttgatgaagccgagtcatgtcagcgaggaagaactttcggcgactactacaagaagtaacggaggtgaagttaggatttttcctcaaaacaggcgtcgttgtggtagcgaagcgccttcgtcccctccctttgttgttggtttcaaatgggtgaaggacgatgttctaaggacgagtttttattcatgtgtgatggttcaggctgttgacccttcttctaagtctactgctacatgtttgagggcctttgaggtcctgtgtccattcttcaatatcagatccaacgtgcctatgttcctctacttctttgaaatgaagttgactgggaagattggttgggtgttgttgagcagtgtgtccaagaagatgttcgagttcaagtcaaacgtgtttcatatattcaaggactgtttcttcaaggtcaaggcaaccagtgtcatcgctgataagtttccactgatgcatgattggaatatggaacctcatgatatacatcctcttacctcgtcattcctaagccttctgctagggaaggaggtcaaactaaagccagagtcaaccctcctcgagcttttgaagctgatgaggaagaagtttttaaggttacacccaacgtgcttccacctgtggcaaccaagaggaagcgcaatgaaggggctaggggcccctttgccttctcaagttgttgttgttgttgtggttatttttgattcccttatacctctatttgtgcctcttcaggcgatcccttccactatgctggctacgtcaacccccttggtggttcctgtttctgctcctctttcttctattatgatgccattgctaaatgttggtgtgacaacaatagatgccttggtgaacctgcatcctccttcctcggccttgctaccctcagctccaaccatcttgccttcagcaataccttcctcctcttcgcctccaagtgtttcactagaccatgtatacacttgtcgggatacaaagtcattgtggagcatggtctacaagcctaagcagaggaatcctactaactttgagtctggctatcttggaggagaatggaaaaggcacaaggaggttctgaacaagattatatctttagagactaaggtcaccaaatggagagccattactcggactgtgttcgaacgttgcaaagatttattgaaggaaagttatgacttcgtgagcaaggtagagcgcttcactaaagagaaggaagaacttaatgcgatagtgtctgaatctgctaaggagattgctaagctaaaggagttcgagcttaaagtggcaaaggagaaggaagaaaataaagagcttgaggaggagctaataatgtttaaaaaggaagtcgtggagcaacacgagaagggattcctcaagaccgtcaagcaggtcgatttcttcactgagggtcttgacttatgcctttttgacccgtttaaagatgtgaaggatgatcaattgcttgacaaggaggagattgttgttggggaggaggacgatgatggagaagacaatgaggccaatgtttag

SEQ ID NO: 86351 - DNA, 309 bp, Glycine max
  Peptide Sequence Number=SeqID_203129
atgggagtgggattcaaggtatgttgcctctcatgttggagtaccatggaaaaaaaccctgttgatagtgggcaaaggatccatgagcaatacttgggagtggacaatagaaaacctttcatcaaggcctttcaggaatcatatgataagatcttgctagacatgcacaaggatgagaatgaaggtgcttacggtgcggtgagagaggaatctaagagagcaattgatggtgcaagggacagtagcagcgtggaactctacgtgagtgtgcctatgcaaagaggctttccatgtgcgagagcaaggtga

SEQ ID NO: 86352 - DNA, 360 bp, Glycine max
  Peptide Sequence Number=SeqID_203130
atggcgtggagattgagatcagttatggagtccttggttaatcattttcaatgtagctttgtgcctaacagaaatagtggggacaatattattatagctcaggaagcaatccattcaataaggaataagagacatgggaaaggatggatggtaattaaaatggatctagaaaaaacctatgataggcttaattggagttttgttgtggatactctgagagatattggttttcctgagagctttgtgaatatggtgtatcagttcatctcaacctctaatatgagagttatatggaatgatgaagcattggattccttctctccttcgttggaatatctaacaccccttctagatgactag

SEQ ID NO: 86353 - DNA, 231 bp, Glycine max
  Peptide Sequence Number=SeqID_203131
atgcatatcaaaggattcgacaccatctacttggaattttccctcaccacagtggtgaaaaacggtagcaaaattgacaaagttaggaatccagcgcttattggggatttttttaattctattcttagatctcatgagcaccaagggggggctacatctccttcaaggaaaaggatgaatgattttgatgagatgatgtttaagtgtaatctcattaatggagggttttaa

SEQ ID NO: 86354 - DNA, 324 bp, Glycine max
  Peptide Sequence Number=SeqID_203132
atggatcctttgcccactatcaacaggacaaatgcctcacttccttttttaacaaaaattgcagcagcgactacgagtgttcgaagggaaactcctcgcaagacgttgaaaagagcaacaaagtttgcacctactgtggtcaaaccaagcatactatcaatgaatgttatgctaaacattcacgctatcctggacgtccctgctatcgcaaccgctcaagcaactccaccgtcaatagtgacaccgcaagcaacattgaggaaggagacaagaaggaagaagcctctcgaagctcagtgtcaacatcactacaactcagcatga

SEQ ID NO: 86355 - DNA, 249 bp, Glycine max
  Peptide Sequence Number=SeqID_203133
aagcatggacacttcaagtcagactgcccaaaactagagaaatccaaggacaagtacaagtattacaagtccaaggaaaagaagagtttcgtgagcacttgggagaatctgggcgataccacctctaatgaagaaggaaaagaagaagccaacctatgtctgatggttgatatagctctaaagcacaattactccaactcctctctgtcatcgactttggcgccctcctcgatgttcaatttgctgtag

SEQ ID NO: 86356 - DNA, 266 bp, Glycine max
  Peptide Sequence Number=SeqID_203134
cctggctaggagcccagccttctccttctagagggggtggggcctccgcagcccaggagcctgcttctgaggagccaacagcagcagcaacagagggggaggatgagctcacccctcctgagcccttttattttgatgcatgtatacacatggcccaggaagaggatgcttctacagaccagatcccagagtcatccccaacacccatacatgatgatgcctcaccatctgcactagcatttgagttagagcatcctatctcttag

SEQ ID NO: 86357 - DNA, 525 bp, Glycine max
  Peptide Sequence Number=SeqID_203135
atgataagtactgttgctttatttgatgcatttcagcaaacggtaagcgctcctttcagggttgtcccgttttttgatcccggcccatggggaggccagtggctaaaagaggtgtgtgatctggacagaagtcttccgaattacgcctggggatttgattgtgtccctgaagagaatagtctcttattgggtttcggaaaccaggttgtagaaataccttcttccaatcttgtttttttccagccagaagctttgctgggaaaagaagtatatgagggatttggggatgagtttcctatccgttttgactttctggacactatggaaggtggtaatctgagtctacagcttatgatgaaggagctggaagctgcgcaacatgatcaggtcccttttgacgcagagaagtatgtacaaaaatggccggtccgcaaacatgaccatgtatctattccttcgggcactgtacattgttcgggagcgaattctgtggagatggctggcgggaagaacgtacaggtttag

SEQ ID NO: 86358 - DNA, 237 bp, Glycine max
  Peptide Sequence Number=SeqID_203136
atgtctgatatgccttttagaggctcgaaaagtgcaagaaaacgaactgcgttttttgaaaaatgcgatgaactcgctaagcgagtatgctgcgctaagcaagttcatcaatactcattgtgtacaaaggcgttcttggaagaactcgctaagcgtacctaccacgctaagcgagttcatcctttgagtatgaacactcatccacttgctgaactacctgtggctaagcgaggctga

SEQ ID NO: 86359 - DNA, 276 bp, Glycine max
  Peptide Sequence Number=SeqID_203137
atgggtggtgatgacattgatatgcagctgcaacctaactatcttgacttttctagtttttcaagtgatgatttattaaatttggctcaacgtgtgagaaaggagcacaggtttgtggttatgattcaaaagtcaaaagcaaagatggacatagcagcagaggtctggaagatgttgaagaattggagtagtgcgctcaacacgagaagccaagttggaagccagttgtatcgtgcaagcttttggagggagttagtcaacaagggcacgaaatag

SEQ ID NO: 86360 - DNA, 318 bp, Glycine max
  Peptide Sequence Number=SeqID_203138
atgattattaaaggagggagtttgttggatggtggaggttggagaggacactgtgagttgatgggaagatggatctacaagggcattgttaaggggcattcttacaagcaactggtcggttcaggagttggtgtgaagcaactaggacattcgggttggaagacacagtttgataccagattgcaacatcattatttcaatagttccatgcatttattttatcaattacatgtttacttggggaactttggtggtgctgttggtttttgtgtgacctggctcatgcgtatcttgtgcttgcttggtttatcttcataa

SEQ ID NO: 86361 - DNA, 1143 bp, Glycine max
  Peptide Sequence Number=SeqID_203139
atgggagttttccttgaatatgttgatagaggagtatgggatcccgttatgaatagtccttacattcctaaagttgttgttgatggaaaagaggtagaaaaagactttaattcttggacgccggaagaaaataagtgtgctcaatataatgttagagctaaaaatattcttgcctccactttaacgcttgatgagttttatcatgcttctcaatgtccagatgccaaggaaatttgggaaatcttagaagtgactcatgaaggtactaaaaaagtcaagagggcaagaaaaaacactcttattcaagaatatgaaatatttcaaatgttgttgggagaaaacatttctgatgtgaaaaagcattttacacatgtggtgaatcatttattggctcttggcaaaacaatggaaaaacaggagcttaataggctaagagagtttgagttagagcttgggagactcaaggatgaagaagttgacaagaaaaagaagggattagccttaaagatgagtacttcacatcatgtagctagtgatgaagaccctacagaaaattcggataataaaaatatgaatttgcttgttgagaatttctccaacacaaagaaaattgactccactctcacaacctacacatgcattaagtgtgggacacaaggtcacataaaaacatattatccaacctacctcaagaaacaacaaggaggtgatacgaagcaaaagaagtcatttaagaatagaagaacatacatagcatgtgatgataatgatgctagttctttaagtgactcaagtgatgaagaagaagcagacttgtgtctcatggacgacatttatgaggatgagaccaaaagcaatgtaagtgactctttttctgaatctaacacaaactatgacaatctacttgatgcattcaaagagttacatgaagaagcacaaagactaatctttgcaaacaagactttaaaaggccaagttagatggcatattgatgtagaagcaaagcttcatggtgaatgtgattcaaagaacaagatcaagattcaagaagaaagcctagaatcaagaatcaagatccaagattcaagacacgacattatctctatgttcaattatatggcaattgcagctttggtaggctag

SEQ ID NO: 86362 - DNA, 297 bp, Glycine max
  Peptide Sequence Number=SeqID_203140
atgagttgcaagtgctttatccttaagactagagatcaacttgcaaaacttgattcaaaggtggacaaagaaatcttctcagggtattttgatacttctaaagcatatagagtgtttaactcaagaactttagttgtagaagaatctatccatgttaagttcattgatcgtctgacaactaataggaatatgaagtcaaacagcttgatgaaattcttcctcatattggataatcatctgatcaacaatctcaaacaaaaggactggaagtttgtcaactaccaccctctagattag

SEQ ID NO: 86363 - DNA, 1056 bp, Glycine max
  Peptide Sequence Number=SeqID_203141
atggggatttgggttgttttcatatggttggttgattcagttggtaattggttattccagtgcaggtcagaggaggagctctcagagctgcaagggactcaacttctgaacacaactaggagtgtgaaacaatatgtgcagaatgaatttaggagactggaagaagaaattataatccctaacaagaagcttttcccttcttctattacacttgatgacttcttctgggcatttggaattctaagatcaagggcattttctcgccttcgcaatgaaaacttagttgtgattccattagctgacttgataaaccatagtgccagagtaactacagatgatcatgcttatgaaattaaaggagcagcaggccttttctcctgggactacctattttctctgaggagccccctttctctcaaggctggggaccaggtatatatccaatatgatttgaataaaagcaatgccgagttggctctggactacggtttcatagaaccaaatacagatcggaatgcatataccttgacactgcagatatctgagtcagaccccttttttggtgacaaactagacattgctgagtccaatggttttggagagacagcatactttgacatcttctacaaccgcccccttccaccaggattgcttccatatctgagactggtagctctagggggcactgatgctttcctattggagtcaatatttagaaactccatctggggtcatcttgaattgcctgtgagccgcgacaatgaagagctcatatgcagagtagttagagagacctgcaaaaccgcccttgctggttatcatacaaccattgaagaggatcaaaagttgaaagaagcaaagctagattcaaggcatgctatagcagttggaattagagaaggggagaagaacctcctacagcaaattgacgagatcttcaaggaaaaagaattggaattggcccagttagaatattatcaagaaaggaggctcaaggaccttggactttgtggggaaaatggtgatatccttggggaccttggaaaattcttctag

SEQ ID NO: 86364 - DNA, 1245 bp, Glycine max
  Peptide Sequence Number=SeqID_203142
atggtgacagttgctcgactgttgaatctcacattggttgttccagagcttgataagaagtcattttgggcagaccctagtaattttgaggacatttttgatgtgagacatttcattgattctctacaagatgaagttcgaatagtaaaaagagtgcccaaaaggtttagtaggaaaagtggatactctaccctgaagatgcctcctgttagctggtcaaatgaaaagtattacttggagcaggattgtaatggtcatagatatttgtatatgatgatgatgatgatgatgatgatgatggtgaggcagatgacaaatattctgccactttttggcaagcataaggtggtacatttcaacaaaacagatgcacgtctagcaaacaatggtctcccacttgatctacagaaacttaggtgtcgtgtaaatttccaggcattgaaatttactcctcaacttgagaatttgggccaaaaattgattcggatacttcgtgaaaatggaccctttctggcattgcatctgagatatgagatggatatgctggctttctcaggttgtacgcatggttgctctattgaagaagctgaggagctcaagcagatgaggtatgcattcccttcctggagagagaaggagatagtttctgaagaaaggagatcacagggtctctgtcctttgactccagaggagtctgccttaattctgcaagccttgggttttgacagggagacaccaatatatattgcagctggtgaaatttatggtggtgaacatcgattagcacaactcagagctgcatttccaagaattgttaagaaagagacattgctggtcaatgatgagttgcagcagtttcagaatcattcatcacaaatggcagctttagattttatggtttcagtagccagtaacacctttgttcctacgtattatggtaacatggcaaaacttgtggaaggccatcgcaggtattctggttttaagaaatccatcttattggatcggaaaaagctcgtagaattgtttgacatgcatcaaaatggaacccttccatggaatgaattttcaaatgctgttcgacaggttcatgaaaaaagaatgggacagccaactcatcggagagtcgatgtagacaagccgaaggaagaggattatttctatgccaacccttatgagtgtctgtgtgagggaacaaagtgtgatgacttgctaggtcctcttaactctagtcaaatacgatga

SEQ ID NO: 86365 - DNA, 273 bp, Glycine max
  Peptide Sequence Number=SeqID_203143
atgcatgttgacccaattcgactccctcttccaacatccacatcatgggggcactttagtgagacgctggacgacatccatgaagtcattgggggtgacttagatgactttggaggaaacaaaatagattatgactttaagaggggtggatgggcccttggagttgaagctcttacttcaacaaccaggttctgccaacgagaaattctgatgaacatcaagattcaagttgtcgagccatgtatctcactcgactttggagtgaaaatgtga

SEQ ID NO: 86366 - DNA, 426 bp, Glycine max
  Peptide Sequence Number=SeqID_203144
atgataaaacaagacgattttattgaggagaaagaaatatttaggttgcttaaccctcatttaaaaagtaatccttgtatgaaagcccacgatccaaggcccacaaagtcgaacacttccttattaagtttccttgacgcctactcaagctacaatcaaattagggtgagcctgatacatgaagacaagacaaaatctataaccaattcaacaaactattactacaaagttatgccatttagactaaaagatgtcagagctacctatcatcgactaatggacaagatatctagcgcacaactaggccgaaacctagagaaaagggagaaagctcgaaaaaccctattttttgagagatcaaaggtccgggggttggttacgcaaagggaaggtactagcaccctaaacgtctatagtactctatag

SEQ ID NO: 86367 - DNA, 453 bp, Glycine max
  Peptide Sequence Number=SeqID_203145
atggccaacggaaggtgggctgaagagatcctgaagaagtgggagggatgtcccttagaaggaaaaatttcaaagaagccgagaacaagaaggccctacaggaaccttcgtcgtgatcatccccttgtgcacctcgttgtcatcattaccatcatcttcatcctcctaaaccccgttggtcatatgggtcgctacaggaggggtcgtcgacaattcagcaatagaagccccatcttcgggaatgtcatcaatgggaatcaattgcccattatagacatccttatccatgttaaagatggactcatctggcacgtcacaatgaaaaagcacttgatgaaggtggtgattgaagctggatgcatgcacctcaaatacatcatcacaagccttctactcaatgcgagccttctccttcctgttgtcatccctctctttgtccaccaaagcaagtga

SEQ ID NO: 86368 - DNA, 210 bp, Glycine max
  Peptide Sequence Number=SeqID_203146
atgggtgaatacaaccaactatcattaagaatctcatccttagaccaaaaacaggcaaaaggtggaataccgcaaagagaaagcgtacccactaaaaaagaagtttttgtaattggtagaactatgaaaaagaggaagaagtcgagctacaagaaaaattcccgcggctaccatagtagcagcatgtataaagggcggaaattggagtag

SEQ ID NO: 86369 - DNA, 1185 bp, Glycine max
  Peptide Sequence Number=SeqID_203147
atgagttcgggtagcagccacagcagtgagaaggagaaggagaaacagagggaggatccctcgctcgtcaaggccagggactacgacaaccgaacgccgctccatgtggcgtccctccacggctggatcgacgtcgccacgtgcctcatcgagttcggcgccgacgtcaacgcgcaagatcgctggaaaaacacccctctggcggatgcggaaggagctaagaagagtaatgtgatcgagctcttgcaatcgcatggaggattgtcttttgggcaaaatggaagccatttcgagccgaagccggtagcgccgccgttgccgaacaagtgtgattgggaagtcgagcctaccgagctcgacttctccaactcggtgcgaatcggaaagggttcttttggtgagattttaaaagcccattggcgtggaacaccagttgctgttaaacgtattcttccatctctttcagaagatagattggacttcaggcatgaggtcaatttgttagtgaagcttcgacaccccaatatagttcagtttcttggagctgttactgccaggaagccccttatgctaattactgagtatctaagagggggtgatcttcatcagtacctcaaagaaaaaggtgcacttagtcctgcaacagctatcaacttttccatggatattgtcagaggaatggcctatcttcacaatgaaccaaatgttataattcatcgagacctaaagccaaggaatgttcttttagtcaattctagtgccgaccatttaaaagttggagattttggattgagtaagcttatcacggtccagagttctcatgatgtatacaaaatgactggtgaaactgggagctaccgctacatggctcctgaagttttcaaacatcggagatatgataagaaggttgatgtgtactcctttgcaatgattttgtacgagatgcttgaaggtgaaccaccttttgcaagtcgtgaaccttatgaaggagcaaaatacgctgctgagggacacaggcctcattttcgggcaaagggttatactcctgaattgcaagagttaacggagcagtgttgggctcatgacatgagtcagagaccatccttcatagagatcctaaaacggcttgaaaagatcaaggagaatttacctacagagaatcactggcacttgtttacctcataa

SEQ ID NO: 86370 - DNA, 342 bp, Glycine max
  Peptide Sequence Number=SeqID_203148
atgggttcatttagagacaactcaaaggagtctgaggagttaggttcaagggtcaggggttcgaatgaagaggtatttgtcgtgtccttaggttccgattccatagagtctggttcattcttgttgaccgtctcatttgctaaagagggctttactgacctctccacctttttggatagttttttgaagcagatagtggacaacatcagtcgtggggtcggtcataatgctaatacggcgacaggcttttcaaatcgtctagtcggggccctttcaaggacaagtatagtcagggaagaaaatgatgagtctttggctgaagatgcaccttggaaacgctag

SEQ ID NO: 86371 - DNA, 219 bp, Glycine max
  Peptide Sequence Number=SeqID_203149
atgaagcacggacacgccattgaagtacagcgtcccgcgtcgaaggcgcaccggacacgcaaacgggtaagactccggtgcgacgcggtgtccgttgcctccgccgtcattggacacggttggatccgtgtccgtgtcctacattttggagattacaggcgtctacgtgtccgtgttcgtgtcgtgtttggtgttcgtgttagtgtcgatgtttcttag

SEQ ID NO: 86372 - DNA, 208 bp, Glycine max
  Peptide Sequence Number=SeqID_203150
atggcagatcaagaaagtggacatcaagatacaactcctgttcttggctatactctttcaccttctcctagtccttgttatactctttcaccttttgctggccatgtcccttcagcaacaccaaatgaatccattcttccacatgaagcagaagaaatagctgataatttggaggggacaacacaaacaggaacaagtaggcttaaaa

SEQ ID NO: 86373 - DNA, 1227 bp, Glycine max
  Peptide Sequence Number=SeqID_203151
atgtgtcccaagtacttcacctgtgggattgttgcaaaagagcacttcaagaatttgaggaagaattggttggcacgaaggacctcgaaggttgtttgcagatgctccagaaggtggatggagcgttgcataacccgaaaggcattacaaggaactcgtagtggtcgtgatgcgtccaaaatgctgagcaccagcgatgagaaaggggctcgtgctcgagcgaattatgcctgtttggagcatggtggtgacttgtgcctcgatttcttgcttctgacaatatgggtacctatagggcttgatgttgactggggtggatgtgggagtgaggtgaatgcaatgattggttggtcgagacgggggtatgggagagcagacgcagatatgaaagaattcactagcaccgtcggtctaaaccaaacgacgaagttgcatgggagagacagcttcaaggtctcgggtagtgtcaccgcggagctcgataatcttcccatgatgaacgaatttcatggtgagggtgttataatcagtcaggattggcccaagggatttcaaccagtgcacatcgaggaccacgtctatgccacatatcggcaagacatggaagtctgtggcccaggtggtagactaggagagcttgcacgaagttgtgcgtgctcctgccgtcgaccaggatcacgacgggctggttcgcaatacagcccaacatgcgtagggatttgggtgagggctaagtatataagggtttgggggttccttaagacgctcatcatctgcgatgaggatgaagaaccaggaggtgttaggcatttcaagggcacaaatggaggtttaggtggagtgggaaacaagggtagggttagagaagaaggtgagggcagagagaaaatcgaggggttaggtggtgggagtggcggtggaggtcctgtgctcggggcgggacgaccgcgaggtttggccgaggatgacaagggtgagtgggtggagttgcgtcttcaatacggtcgagactcgacttgtcgggatcagcaatggaaggcggaaatgaaagcaccaaaattgttaagggcaaaagtaaaattcccagcttttgagacccagtgcgcgatggttgttatggtaggtggaggcacagaagaagaagaagttttgatggcaagagaagaaggagaagctattgggagggagattcaaagaatgaagtatgatgttgctcttttagggtaa

SEQ ID NO: 86374 - DNA, 1002 bp, Glycine max
  Peptide Sequence Number=SeqID_203152
atggagatttccagtggaggttgttctcccagaattaggtctgaatattcaagaaaagagggatccgagggaaccccttttcagcacatggaactctctgttcgtgatcgcaattatcaaatccaatcgatgaacgctttggaaattctgagagagactattaggattcttaggttcaattcgtggggtttcatggcaatcgctttcatgcttatttgtcctgtttctgccgtgcttttgtctaatgtaatagtggatgagtctattgtgaagaatctgtccattaggcttatgttggttgcacagactagtggtctccctctgagaccaatcatcaaacagtcttgtcagcggttcgcggagaccgtggtttcatcggccatgtgctttcctttctatgctacattgttgttgttgtcgaaggccgcggttgtctactctgtagattgtacttattcgaggaagaaggtcgatgcttccaagttttgtgtgattgttgccaagttttggaggaaaatccttttcacatatatgtgggtgtgtacagttgtagttggctgcatcaccttgttctgtgttttccttgtcgcgttctgcagtgctttggctgttcttggtttttcgccagatgttgttgtgtactgtgcaatgctggttgggctggttttctcggttgtctttgccaaagccataatcatctgcaacattgcgatggtgatctcggtgttggaggatgtttcaggagcgcaggcgatgcttcggtcgagtattttgatcaagggacagacacaggtgggtctgctgatatttcttggatcaacaataggaatggcctttgtggagggcttgtttgagcacagagtaaagacattgagctatggtgatggatcttccagagtgtgggaagggccgctcttggtgagggacgctgtaagagattgttcccagaaaattgtgttggccattgaggaaccttgcaagttgcaacagttcttcctctga

SEQ ID NO: 86375 - DNA, 473 bp, Glycine max
  Peptide Sequence Number=SeqID_203153
tggccatctacccatcaacctccaatccgccatccggttcatcccggtttccttcttgcccctcctcgtctcccaagccgtcgtcttttgcatctctcttttatatgcgcttctcttggttcttctcactcatgatgtggctgagcttgtccacggaactggggtggctctgtcttctttcttcttctatggattctgcacggtgttctctgtgttgggttgcttatctgtgatgagggattctgatggaagtactgaaaattggttttctgtggagtggaattgggtatacattgtgctggtttcttttttgcttgcgatgatcatgctttctaacattggggtcgatatacggtcttgtgcatatattgcaaggccaatcatggtgagattgcagaggagtttgggagggaatatgttagcttgcccttccatgatggaaatgtcacttattctgtttaagttattgcggg

SEQ ID NO: 86376 - DNA, 222 bp, Glycine max
  Peptide Sequence Number=SeqID_203154
atggagaggagcgcggggaggagctttacggggcggccgaagaagccgtggaagacgctgtgggtgatggaggccagggcgaacaaagagaagaacactacaaagaggaggaagaagagtagagggaatgagaacgggaacggtagtagtggaggaggggtttcggttagggttagggttaggggttggggttgggtttggcggaggaggatgtggatgtga

SEQ ID NO: 86377 - DNA, 933 bp, Glycine max
  Peptide Sequence Number=SeqID_203155
atgagggagcaagagcaggagcagctaggaaatggaggtcagcaaagtccccaaatgtcaactgttagctcatttactggattgagtagtgcaagctcctttactactttacaccgaggtgcatggtgcacaccccctcgcctgttgcttcaagatcagtttgatgtggtgcccccagaaacagcatctgtaagttcagtggggaagaagacaatgagagaagatccattaaagaaaaagaatcctggaacagtcaaaattagtccttggacattggcacgcttaaatgcagaagaaatttctaaagctgctgcagaagcaagaacaaaatccaaagttctgcagcctgtaacaagacatggtgaggctatcaggctagaaccagaaagcagttttagtagcagtggccgaagaatggttcccagaattgagagcaataagaaaggagctagtaagcggattcatcatcccgccaacttgtctatggagtccttgacaaaagtttctgccagtaatactgataaaggcttgagtgggatgtctaggttggcccctctcccatttgaagcacacaacacatttcaaacaagtcaaccaatgtcaagctcagctgggattgttccttcatctcctgaaagcagtttagactctcctgatattcacccttttagggtgtcttcatcaggtgctgaaaaagcaagacagcttgcagttgcaggtgcttcaggtgctggtgctgcaactctgaaggaaatttcactgtcaggttcaactagtgatggatatgaggcttctggtggggaagatagtgaccgggttgttccttttaggattgttcagagatctacaaattggactaatcttttcagagctgatcaggatgagagggcttttaaaaagcctcaatcttcaaccattgttggtcatagatag

SEQ ID NO: 86378 - DNA, 828 bp, Glycine max
  Peptide Sequence Number=SeqID_203156
atgaggaaacatggatggcagttaccttaccatcctcttcaggtggtagctgttgctgtgtttctggctctggggtttgccttctatgtgttcttcgctccttttgttggaaagaagatgtatcagtacattgtcactggcctttactcacagctgattattagtgtctttggactgtacatatggtgtgcagcagcagatccagcagatccaggggtttttaagtccaaaaagtatcttaaaatcccagacagtaaaaagcttgctgaactaaagaattctaaactaggtgaagaatcaacttcatcaatgcatgaagcaaatgcttcaatggttggatctaattctgtggataaagaggcattgggaaaaatacgaacttcaaaagatgcttcgaattcagtagagaagagtacatcatcgtcttgttcatcctgtatcctcttggtttcttctccttgtgcatatatctgcagctgctctagtccaactgagaaatcttctgataaacaaacaagtgaagatggcatgttctattgcagtttgtgtgaagttgaggttttcaagtacagcaagcactgtagagtctgcaacaagtgtgtagaccactttgatcatcattgccgatggcttaacaactgtataggcaaaaagaattatcgacaatttttcaccctcatggttgcagctatgctcttgtttattcttcaatggttgactgggatacttgtgcttatctgctgttttgtcaagaggaaggaattttctgtggatatctcctccaagttgggaaccagtttctctttggttccctttgttcttgtggtg

SEQ ID NO: 86379 - DNA, 231 bp, Glycine max
  Peptide Sequence Number=SeqID_203157
atgcttcaaccattggagatcagcataggcttaagggagcactcaaacccgatgacccccaaggcctacactccgaagagtccgtcaggacctctccctcttgattcaggtccaacccctaaaatcattttaacacagacactgctagtgaattatacaatacccacgacctcacactcgtgtcttaagcacgtacaacatattgcgctacaatttaacactggttcctaa

SEQ ID NO: 86380 - DNA, 2382 bp, Glycine max
  Peptide Sequence Number=SeqID_203158
atggaggaggccgtctccgatccccatccggagatggagcagcagcagcagcctccgccgcttcagaacggggactccgacgagcgctgcgccaagaaacctaaattcgaccaaggcgctgaattcaagagagtggcggagattgtgctggttctctccaccatggccacggtgcgcgcggggagaaagccctccgacgccgaggtcgagctcatgagggaggctcgcgccaagctcgccagcctctgcgagggtttggctccgaaggatattgtcaccagggaagctattggcaccgtcattgaggatctcggattgaacttcaagctcaaggaccagagattagggtttcgaactcccaagatgtccattgccgagaggtattcccatgctaagtggaaggtgcttaaggaatactattatgtctatcttgattgttgtgaatgtgtccgagttaggcaaatgaggatagcagtgtgtttggatatgcatcccgcacgtgaaaaaggaatctttggccagattattgtataccaatatgcatgtaatgctaagaaggatgctatgccatttcctttgatggaagaagcaaagaaaatttctgcaccttctacaccttctacaactcacacctctcagcccttgcaaacaaacattgttggaccagttgacaatcgtgtgccatcacatgttcgaatttttccttctgataaatcaagccacccatcaatcccttctatgggtgccatagtgtctattcctgcccatgtttctgtgggatcttctgcagcattgcagtatcaagtgatcagcaatgaagtaagaccaccagtggtttctggtgtgatgcctggcagtcacttggggagaaatgcatcttctttagcattgcctaaagttgaacacccacagttcaaagttgatggaggatcaaatgggtctccttacatgctgcaagtccaagcaaattcatcagcaaaccaacctttggtgaatgctccaacatggtctatacagagtcaagctgcttcattagctagaagtgcatcagaaaacaaggtgcctgttcagaactctgtcaaggttgaaggaacacctgacataactgtatcaagggcaggaccacaaataacaacagacccgagctttaaaccatttatcactcaaacagcccctggaactttacctagtgtgcaccagccattgcaggccacaaacattgttcagcctcctttgattcctagtcacactgacattgctaagattgtccagaaagtgttacaaccaaagcttcctgtccatcccacgtggactcctccatcaagggactatatgaataaggctttcacttgtcagatgtgtgagctcagtgtcaatgaggttgatactgtacttctctgtgatgcttgtgaaaagggatttcacttgaagtgcctgcagccatcagtcttgagaggaattcataatagagttgattggcactgtatgaggtgcttgagtttaagtggtggaaagcctttgcctccaaaatatggtcgtgtgatgagatcctcgaacacaccaccaaaattgccttctaatacaggtggcattctaccttgttctgagaagaaagtagagaacatagatccaaaggtcatcccacaaacgttagcaacaaatgggagctctgttcaaactgtttgcggtggcaatcacaatgttgagctgtcatctgaatcaaggataccagataccaaagatatgcaagggactaacatttcatccaccattgaagctattgataagaagcctgatccaaacaactctatgaaatctcttagtgcagcttctagtccttccccttgcttgctaggtaaaaattctgttcaacaaataaattctaaggttttgactggtaaagagactttggaatctgagtctcttcctaaattatctgagccagctaagtgtgaagatttgcaatcatcacaagattttcaagttgaacatacaatgtcacaagacaatcctgaagtatcatcagataaacatgtcgaccataatattatgaataataaacagaaggaatttcatggaggaaaaagtttaacttatgatattaagcttgatgaccaagatgctgcacttgcaaattttgttggaacttctggaactaatactgacggtacacagcactctgcattatcttcagatagttcacatgcagtagaatggattggtgatgtagtacaactagtagatgagaaaaagtattaccaatcttgttgtattgatggagtaacatataggctgcagggtcatgctcttttccccaccagccatgggaaactaactccttctaaactccaggcaagcaaatcatcatgctttccactatag

SEQ ID NO: 86381 - DNA, 291 bp, Glycine max
  Peptide Sequence Number=SeqID_203159
atgacacatcagcgggtcaaagggaaggatctccatcaagtgaaaaagaacaaacttgtgaggtcaaacaaagttggtttagaacctgctttgtggagaacaatcttattcagaatgttggaccaaatctttgctttctcgcacatcagattgtatgcaatagtcttcttgatgcaatcctaccccgcaatggcattggatagaagactccaagtagattgggcaagagatgcaagagaacaccctatggttctcatgagccttagggcagatttcgggcccatgggctaa

SEQ ID NO: 86382 - DNA, 432 bp, Glycine max
  Peptide Sequence Number=SeqID_203160
gcagtcattctcatagctaggttccctaaccctaactatggtgttaaaatgggttcctcttggtgtggggtttcaacagagaacaatggcggtttgtggtggctaatggtggctgtgggtgatggagaaagagcttggaatgttggaaatggttttggaagaaagaaaggagaagaaatggcgtttttccaaagctatttggactacaaggctcaaaacgcacaaatgagcaatgctctcggaaacggaaacggaaacatcgcgcatactccagacatcttctcaaagatcccaacgctgaaaactaaatttcgagaagatccaacggtgaatgaaggctgggcagcgttcttaccaagacagcttcatgtagcttccttgagaagcttcattaagaggcttcctgaagaagcttactcgtggcttctttga

SEQ ID NO: 86383 - DNA, 258 bp, Glycine max
  Peptide Sequence Number=SeqID_203161
atgaaagaacagcatgaagaacccttaaagctcatggtcgcacaggtaattggaattagagtaaagaggggaaacgatcggagaagaaattacactcttttttgggaagctaccactgctgtgactgtgaggaagagaaaaggggtgatggacgcgatgtcgtttaaggaaggtgccgatggcgatggatgggatgaggcgtacggcgccacccaccaatcgtcaccgtcgtttaccttgcgggattatggaagatga

SEQ ID NO: 86384 - DNA, 1224 bp, Glycine max
  Peptide Sequence Number=SeqID_203162
atggtgatgcttcatcccctcacaaaccccaacccaaacgagcttctctcgctctcatgctcttctatattccaccaccatgcattcacaacttccgtttccttcaagcccagaacaacaaaaattgctcctcaacgcctaagtcgtcgtttcggttcggtgagatgctcctacgcttacgtagataacgccaaaattaaggttgtcggcatcggcggtggcggcaacaatgccgttaatcgcatgatcggaagtggtttgcagggtgtagacttctatgcgataaataccgatgctcaggcactattaaattctgctgctgagaaccctattaaaattggagaagttctgactcgtggattaggtacaggtgggaatccacttttgggggaacaagctgcggaggaatccagagatgctattgctgatgctcttaaaggatcagatttggtatttataacggctgggatgggtgggggaaccgggtctggtgctgccccagttgtagcccaaatatcaaaagaggcagttttgaaggacgtaagagatgcttgcaggcaggcctttgaagccatcgaaaggctgcagaaaaatgttgacacacttatagttattccaaatgatcgtctgcttgacatagctgatgagcagatgcctcttcaggatgctttccgtcttgcagatgatgttctacggcaaggcgtacagggaatatcagacattataacagtacctggacttgtcaatgtagattttgctgatgtaaaagctgtgatgaaagactctgggactgcaatgcttggtgtaggtgtttcatccggtaaaaaccgagcagaagaagcagcagaacaggctactttggctcctttaattggatcatctattcagtcagctactggggtagtgtataatattactggaggaaaggacataaccctgcaggaagtgaacagggtttctcaggtggtgactagtttggctgatccttctgctaatattatatttggagctgttgttgatgatcgctacactggggagattcacgtgactataattgcaactggcttctcacagtcttttcagaagaagttgctaacagatccaagggctgcaaagctgcttgacaaagtggctgagggccaagaaagcaaggcagtccctcctccccccaagtcctcaatcaaggttgaatctagaccatccccgcgaaagctctttttgtag

SEQ ID NO: 86385 - DNA, 243 bp, Glycine max
  Peptide Sequence Number=SeqID_203163
atgacgcattccacatctatccaatggtttttcaacgaaagtatagcaagtctcattggtattgagttatttacccctccccccacagagcaaaatccggttgggaagattgagatcgaggaagaagggaagaaagagaagaacttgaattgcgcgcgtgggttaaccgcgagacaaaaaacaagcgtcattgtggcgggcatgttcatcatcacagctgtgattcggtttgggacaaagtga

SEQ ID NO: 86386 - DNA, 621 bp, Glycine max
  Peptide Sequence Number=SeqID_203164
atgtcttcatcgtcttcatcatctatggcgacgccgaattctgacgcaaccactcagactcaagattccgacactgttccctattccaattctcccaatgccctcgtccccgccgctcccgccgtttgtctcctccgcttcgccaccgactccgccgccggcgctctcatgggctccgtctttggatacggtgctggattgtttaagaagaaaggttttaaaggatcctttgtagaagcaggatcttatgcaaagacatttgcagttttgtctggagttcatagtttggttgtttgcatcttgaaaagacttagaggaaaagatgatggtgtagctggatgttgcactggtcttgctctaagttttccaggtgcaccacaagctcttctgcagagctgtctcacttttggggcattttcttttatcatggaagggctaaacaagcagcaacctgcacttgcagttcccatatcctggaaaaaacctgtgcaacacaatgcaagtccgcctttggtactgccccttcaactccctcttccagacaaactaaaagatgccttttcctttttttcctattctttgaagaagcgcagcaagggaccttatcctacatctcgataa

SEQ ID NO: 86387 - DNA, 3609 bp, Glycine max
  Peptide Sequence Number=SeqID_203165
atgagacaaagcagtaactcagaaactgcagagactcatttctctggcaccatttcatcctcatccctcaaaaaatttcttcccagatcactctcttccaaacacaaacccatttcaaaccctaaaatctcaaatttagatgcagagaacactcgccccaccgatcccaacatccagatcaaccatgaacaatcgttgccttccacaaccaaacaatcacagtccaaaacctcaatttctcagaacaacctcaaacaatcgaaattccctcttcaatccgacccatcagtcaaggttgtagtacggatcagacctacgaataacaatggaatagagggagatcgaactgttaagaaggtttcttctgacactttgtgtgttggggataggcaatttacctttgattcagtttttgattcgaactccaatcaggaagatatttttcagtcagttggtgtccctttggttaagaatgctttagctggttacaacacttcaattctgtcatatggccagtctggaagtggaaaaacttatacaatgtggggtcccccaagtgccatgtttgaggagccctcgcccaaaagtcacaagggaattgttcctcggatcttccaaatgttgttttctgagcttgagagagagcagcatgtgtctgacgggaaacaattcaattaccaatgtcgatgttctttccttgagatgaaagatgattccaaaaatgcattgtatatagagaatctgaccgaggaatatgtcactagctatgatgatgtaacacaaattctgattaagggcctttcaagcagaaaagttggagcaacaagcttaaattctaagagctctagatcacatataattttcacttttgtgattgaatcttggtgtaagggaatatcatcaaatggtttcagtagttcaaaatctagcagaattagccttattgatcttgctggacaggacaggaacaaagttgaggatgcaggcaagcaatgtctaaaggaagacaagaatgtaaagaagtccttatctcagcttgggcaattagtagatgccctgactaaagaaactcactcaggaaaagcagaagaaatttcaaacaggaattcctgtttaactcgtttactacaagattcactcggtggaaatgccaaactctcattaatctgttccatctcccctgataacaagaataatggtgaaacgctgcgcactctcaggtttggacagcgagtaagaaccattagaaatgaacctgttatcaatgaaataaaggaggaggatgttaatgatttaagtgatcaaatccggaaactgaaggaagaacttattagagcaaaggctgaggttcatagctcagatgggagtaaaaatggatacctccaagtacgcaatgtacgggacagccttaatcagttgcgagtcagcttaaaccgctctctactcctaccttgcattgataatgacactgatgaagaggtaaatgtggacgaggaagacataagacaattacgccagcagattgatgaattgtatcattcgtgtgaagagaaccctaaaaagatatcagtcagtgaagattgtgtccagtattattctgttgcagaaaattgtgacacagatatgaccagtggtgatgaaattgaaaaagaggaagtatgttatggagacgcaatgagtaagctatgtcccgaggaaagtgagggatcaactaccaccttgtatgcatcagcagatgactttgcatgcacagctaatgcctcatggacaattaaatctgcattcagagatagcatttcagttagctcatgtagtcggtctccaatacttggagaaccacagttgtctgagtctccaaaaatcaagaatgtccagaggaaaagtgtggtttattcaccaagttgtcttggaagttggaacaatgtggcagaggagaatatgaattccagtaatgatatattaaggcaatcatttaaagagggtgagcagatgcgatcgtcactacggtcaagcaaggtttttcaaggtcctaccgaatccttggcagcaagccttcagaggggattgcagataattgattatcaccagcgaaactcagcattaaacaaatcttcaacttccttctcttttgagtgcttaaccttgacaccttgtccagaagacaaggatgattcttgtgatcaaatgatgcaacagaagaaatattctgtcgatgaaagaactgctagcttgctttgcgaatcttgccttaaaagaatatacgaccaagattctactgaggttcaagatagcataaagtcaagggttgaaacagctgaagcagagaatccggatggactgacagataaggttccaaaagatttacagagtataatggataaagcaatcacgagagaaaaggaactagagaaagtttgcaagaagcaagctgctagaattgaagaactaaatcaattggtggagaaatttaaaggagaaatggaagcaaaatcttccatcattgtgtatgatccagaaagcaataaacagactaggcatgaagaagagtataactcattgaaagatgaagacaagcttccaaggggaacttccttagacaggcatttaccagatattatagaggaaaattgtgaaattaaaaaagtccaggaagaagtaactcaaagagacggctgtttcaatgcaactgagaaggaagaacttcttaaggagattcagaatctaagaagcaggctgcaattatgtagtgatgcaccagttaaaaagtccaccgacaaactaagatcatctttatcattaatgtcaagatccattcaactccaaaaaagtggtgtattttctcttgataatggtggagatgagctagagaaagagagggagagatggacagaaatggaaagtgagtggatttgtcttactgatgaattaagagttgatcttgagtccattcgtcagagggcagagagggtagagatggaactgagtttagagaagaagtgcactgaagagttagacgatgcactaaaaagagcggttctcggacatggtagaatggtggaacactatgctgacctccaagaaaagtataatgatttggctgcaaagcacaatgctataatggaaggaatagccgaggtgaagaaagcagctgcaaaggctggaaaaaggggacatgctcgctttgccaaatctcttgctgctgagctttctgcactgagggtggagagagaaagggaagcaaaattcttgaaaaaggagaacatgaatctcaagattcaacttagagaaactgcagaggcggttcatgctgctggagaactacttgtcagactaagagaagctgagcatgcagcgtctgctgcagaggagaatttcagaaaagtgcaacaagataatgaaaagctaaaaaagcaaatggataagctgaaaagaaaacacaagatggagattgttaccatgaaacagtaccttgcagagagcaaattaccagagtctgcactgcagccactatttagagaggattctgatgatgttcacaaggatgcaacttcccatgatgatcaggcatggagagtagagtttggagcaatctatcaacagcattattaa

SEQ ID NO: 86388 - DNA, 999 bp, Glycine max
  Peptide Sequence Number=SeqID_203166
atgccggaccaagatattttcagttgcattagtgaacctcgtcttgtagccagaaagttcttggccagacctcagcatgagggtgttggagccgttgttagaagaagcatagggagatttgaactcaagtactttgatcctttccttgtcttggatgaattctcagtgactgctcctgctgggtttcctgatcatccacatagaggtttgccaattggatcttctgtgtcatttatgttcttcaatgatctgatttgcttagtttctgacttgttccttccttgtggtgctcaatatggtgttaatctttgtgctggtggtgtggcaacatctgtaacgcacgaagattttgaaggacataagggaacaattgaagctggtgacttgcaatggatgactgcagggagagggttagttcactcagaaatgcctgcagctcaaggaacccaaaagggtcttcagctgtggatcaatcttgcttcaaaacataaaatgattgagccaaggtaccaagaaatgttgagcaaggacatagctgaaactatgatagatggtatcaaagttagagttatagcaggggaagctcttggaataaagtctccaatctacacaaggacaccaaccatgtacttggattttactcttaaacctggtgctcacttgcaacaacttataccaaagtcttggaatgccttcgtctacatattggaaggagagggtgtatttggaaaccaaaagtctcaacctgtaacctctcaccatatacttcttcttggtcctggggatggcctagaggcatggaacaaatcttctaaggtccttaggttcattttggttggaggtgaaccattgggtgaacctgtggtgcaatttggaccttttgtgatgaatactcaggaagagattgaccaaacaattgatgattttgagaactataccaacggatttgagaaagctagacattggaggtctgaaagtgcaattagccttgattattga

SEQ ID NO: 86389 - DNA, 238 bp, Glycine max
  Peptide Sequence Number=SeqID_203167
tcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 86390 - DNA, 938 bp, Glycine max
  Peptide Sequence Number=SeqID_203168
gggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgcttttcacggttcgtattcgtactggaaatcagaatcaaacgagctttttaccctttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcgttaa

SEQ ID NO: 86391 - DNA, 348 bp, Glycine max
  Peptide Sequence Number=SeqID_203169
ggagttgtgggacttgcgaaacctccagataggtcggatcatgatgtcgatgatcccctatatctaatgacattaaccatcccacgactttttcttaagccattgcaggttatgtgggatgctgccgtgtttggggtgtctaatgacaacttccccttgtacataaagcatgaagatctatctgaaatagcatgcggcggtcaatgtctcagcatctctgttatacagttgtgtatttttgctttgaaaaggcttgacgatactccacaaagtaaattcaaggttgctgctaggtggattgttgttaaatatttcaatgatgctaaccattggaaccagagagattga

SEQ ID NO: 86392 - DNA, 237 bp, Glycine max
  Peptide Sequence Number=SeqID_203170
atggggctccgaataatatttgatggtggaggatgcacgaacaacgctaggcaatcaattcgtggggctccggacttgatggcaattaattcgtggggctccggactcgatggtggaggatgcatgaatggcaatcaattcatggggctccgaataagatttgatggtggaggacgcacgaacaacgctaggcaatcaattcgtggggctccggactcgatggtggaggatgcatga

SEQ ID NO: 86393 - DNA, 213 bp, Glycine max
  Peptide Sequence Number=SeqID_203171
atggaacaatcaagtaagggaaaaggaataactgttgagccagaaagttcaccaccaatttttgttcccacgtcttctgattacgatcctggaaactctacctgtttaactccaaccaaaaggattagttgtcagcaaatcagttctgatttcgattctgatgagcatgcagagtatcagttatcaactaacaaacatatcaaagctgagtaa

SEQ ID NO: 86394 - DNA, 228 bp, Glycine max
  Peptide Sequence Number=SeqID_203172
atgaaacacagctccaaaatcgaaagtggaggacacatgaacgaaaacgcaattcatggagctccgaaagaagggggagaatggaggattgccttgagggtccgcactcaggcaatcataaaacacagctccaaactcgaaagtggaggacacatgatcgaaaacgcaattcatggagcccggaaaaaagggggagaatggaggattgccttgagggtccacacttag

SEQ ID NO: 86395 - DNA, 597 bp, Glycine max
  Peptide Sequence Number=SeqID_203173
atggatggtcttcaagaagaagcaagggaacccattggacgcataatgagaaaaaatcatctagaaagccaaatcatcagtgacctaacaaatcgtgtacaaacaaggtcatcatttagatcacaagagctaccgaaggggaagaaggctattggagcaaagtgggtcttccataacaaattggatgaaaatggtaaggctgtgaagaacatagcaaggttagttgccaaagtctgctcactacagaaaggtatagattataaagaaacctatgctcatgtgactcctctagaggaaatgcgaaatttactttcatttgttgctcacagcaatatgaagctatatcaaatggatgtaaaatacaaattcctagatggacttatccaagaggaagtttatgttgaacaacctctaggatttgagagtgacactcttcctcatcatgtttttatacttaacaaagcattgtatggactcaagcaagctcctcaatcttggtttgagaaattgagttcttttcttttggaaaatggaattaaacgaggaaaatggatacaactttgtttcgtaaaaattaaaactcacaatttatattga

SEQ ID NO: 86396 - DNA, 1158 bp, Glycine max
  Peptide Sequence Number=SeqID_203174
atggaagagattggttatgtaatgcctacagatatccagagggaagcactgccttaccttttttccgggcttgactgcatacttcatgctcagacaggttctgggaagacactcacatacctgcttttgatccattccatcatcaatgctgcaaaatcttccgtgcaagccctagttctggtacccacccgggaacttggcatgcaagtcaccaaggttgctaggacattggctgcaaagccaactggagttgatggggagcagaagtcatgttccatcatggctctgctagatggaggaacactgaaaagacacaagacttggttaaaggcagagcctccaacaatagtggttgcaacagttgggagtttatgccaaatgcttgaaagacattttttttcacttgaaactgtgcgggtgctgattgttgatgaggttgactgcattttcaattcttcaaagcaagtgagttctcttcgaaagattttgacttcatattcatcttgcaataaccgtcagacagtctttgccagtgcatctataccacagcacaaccgatttattcatgattctgtgcagcagaaatggacaaagagagacgtggtacatattcatgtcagtgcagtggagcctatgccatctcgcctatatcatagatttgtaatatgtgataccaaaagaaaattacataccctgttatccttgatacaatctgatgcacctgagtctggcattatatttgttgctgagcagtctgagaagtcaaaaaaggctggaaaggctccatcaacatcccttctgattgattttttgaagacatcataccaaggtgatttagatatcctcctccttgaagacaaaatgaatttcaattcacgagcagcttccctgttggaggttagaaaaggaggtggctatcttcttgtggcaacagatatagctgctaggggatttgaccttccagaaatgtctcacatttacaattttgatctaccaaggactgccatagattatcttcatcgagcagggcgaacttgtagaaaacccttttctgacatcaattgtactgttaccagcattatagttccagatgagcgatttgttctgcagagatatgaaaatgagttgatgtttaactgtgaagagcttgttccataa

SEQ ID NO: 86397 - DNA, 291 bp, Glycine max
  Peptide Sequence Number=SeqID_203175
atggattgggcgtggaattccagcctcactcttaaggagagaattgaacttttagaaaagataattgttaaaagtatttttaggatatgtttggaagtgagattttggagggaaggagaaaggaggaccaaaggcaatggaagaaattgtaggaatgagactcacttctattttctttactctgacgttgcggtggtagcattcgaacaagagaccacttcatcattctctggtatgtcctcatctcttcgtatattgttagccattgggggaaacacggaaaagttgtaa

SEQ ID NO: 86398 - DNA, 1185 bp, Glycine max
  Peptide Sequence Number=SeqID_203176
atggcgaatttcacctcttcttctcccttacctctaactctaactatgtcacacatttcaactccgtcatcttctgcggctttcgacgacagttccgaggatgcctgcagcatatgtctagagccattcagcacccatgaccctgccaccattaccagttgcaaacatgaatatcatctgcactgtattcttgaatggtcgcagagaagcaaagaatgcccaatatgttggcagttacttatcttgaaagaccctgccagccaagagcttctaaatgcagtggaagctgaaaaacgcttaagttcaagaactgtatattcacatgcattcactgattctcgtagtccccttcatcggcttaacaatgaccaagatgattctgattttgatgaacaacttacgcagcacctagtttctgctgcaagtagagctcgttatatctgcagaggggaaaggcagagatcccctggagcaggtccttcagaggttcttgtttttaactcttctatgcatgcgtcagggatgcaatcaacacttacaacttcaccatcttctggtgtgccttcaacatctgctttttcctctgttggcatggttacaacaaatacttcttctgagagtgacatgccttgcaaacccagagttatttatagccagccatcaccggagaatgcaaggagactaaacacttctgagatattctccttccctgagtccttcaaatccaaactttctgctgcttcagccagatgtaaggaatcaatttcaaaaaatactcgtggtcttaaagagaagttgattgcacgtaatgcctcagtgaaagagctgagtaaaggtgttcagcgtgagatgaatgcaggcattgctggtgttgcaaggatggttgaacgccttgatctcacctcgaaacggtcctcgtctcctctcattcctgtaaaagggaagtctgtccaagagaatggtgttgagcagtttcctaataaagaggagagtggagttttggttgctgatgttacatctaatgctgcctcactcgattctagcttggttgctgttggagtagaaattcctccttcatgtgttcaggaagaggcctgcaatgcaagagacgacttgataataaccaacgtggctgttggtatgcgtcctgcatttggtcaaataagttgtagaaattctaagtag

SEQ ID NO: 86399 - DNA, 879 bp, Glycine max
  Peptide Sequence Number=SeqID_203177
atgaaatgtaaaacggtgggattgagcctcgaatcttcaaaagttggagttgcagatagtcctgcttgtgctgtggatagggattggtgtttgctcaagttaatgagagatggcatgaattcccgtatattgctggacgctgcaaaaagttgcatattggcttcttctcctgttttcagaaggcaacaattcttgataaggtgtgtgggaggctccactgatcaaagagacatgcaagccctaaggtctcttgaggttgactctcagagtattattcgagcaattactcctgcccttgatcctaccagacataaaggccaggcaggaaatatagctgttattggaggttgccgtgaatacacagatgctgctcctgtcatcaaaagctacagtcctgagttgattgtgcaccctgttttggaagaatcttataatgttggggaggaacacaagagttccatagcaagcaaggttcttgctgaagttgataaatggttggaaagatttgactgtcttgttgttggcccaggccttggcagagacccatttcttctagactgtgtgagtgaaatcatgagacatgcaagacagtcaaatatcccaatagttatagatggggatggactttttcttgttacaaataatcttgaacttgttagtggctatgccttagctgttttaacaccaaatgtcaatgaatataagcgtcttgttcagaaagtactaagttctgaagtaaatgacatagatgctcctcaacaactactatctcttgccaaacagattggtggtgttactatcctaaggaaaggaaattctgatctcataagcgatggtgacacaggcagtcaaatcagtgagcgtctatggttctcctag

SEQ ID NO: 86400 - DNA, 2919 bp, Glycine max
  Peptide Sequence Number=SeqID_203178
atgtcagtttttgaagctattaggaaggctaagcgattaaggttgtttgagccgtctctgggtgttcttgggtttgttgttgtaactgtctttgtgatttgctgcttcttctattcggataacggataccttgcttcaagagttgggttctttgagcaaccacagaggtttgcttggttgcggatagaagggtctactgcgccacccagagttgagtttcttggagaaaagggtggtgggtgtgatttgtttgatggggaatggatttgggatgagagttaccctttgtaccaatcaaaagattgcaggtttttggatgaaggttttcggtgttctgagaatggacgacgtgatttgttttacaccaagtggaggtggcagcctaaaggttgcaacttgcccagattcaacgcaacattgatgttggaaaaactgcgaaacaaacgcatagtgtttgctggggactcaattgggagaaaccaatgggaatcactcttatgcatgctctcttctggagttcctaacaaggaatcaatctacgaagtgaatggaagcccaattacaaagcacaaggggttcttggtgttcaaattcaaggattttaactgtacagtggaatactatagagctccatttcttgtattgcagagccggcctcctactggagctcctgaaaatattaggacaactttgaaagtggatacaatggattggaactctaagaagtggagagatgcagatatcctggttcttaacacagggcactggtggaattatgagaaaacaataagagggggttgttatttccaagaagggatggatgttaagttggaaatgcaggtagaagatgcatacaaacagtccattcaaacagtgttgaactggatacaagacacggtgaatcctatcaagacgcgggttttctttcgtactttagccccggtgcacttcagaggcggggattggaaaaacggtggaaactgtcatttggaaacactaccggagcttggatcttcattggtgcctaatgacaactggtcacaattaaaaatagccaatgctatcttatctgctgcacacacaaatatttctgaaacaaacaagttcatggtgttaaatgtaacccagatgaccgctcagagaaaagatgggcattcatctatctattatctcggtcgtagtgcgggccatgtgcatcatcatcgccaagattgcagccattggtgtctacctggtgtacctgatacgtggaatgagctgctttatgcactgttgcttaaacatgaaactgctcacagagggaactttgttacacagaaacaacaggatacattttacataggagatctgcagccagggactaaagtatcagattttgttgctgccaatcaccacgactgcgagggaagggaagcatctttagctccaaatccaatggcggatacctcaagccgatcaagagacctcgacaagctccttctccgccctggcaatctcgtcggtcctaggttcgaacctggccctgagttgcgagatgaccttcaggccttcgccaaagtgttggtggttggggctggtggcttgggttgcgaattgttgaaggatttagccctctctggtttccgaaaccttgaggtcattgacatggatcgcatagaagttaccaatctcaaccgccaattcttgttcagacttgaagatgttggcaaacccaaagccgaggtagctgccaagcgtgtcatggagagaattagtggtgtggaaatcgtgccgcacttttgcaggatcgaggacaaggaaattgaattttacaacaattttaacattattgcccttggtcttgattccattgaggcccgcagttatatcaatactgttgcctgcagttttctagctgatgaggccacaattgcagttgcattgcaatctcagacaccacaaaaacctttatgttgcggccgtaaatgcggtcgtggactaatttccatctctacattcagtcccaaagatttggtgcagactgcttatgctaattttcagtttcttttccttttactgataaatctagagtacgattctgatgataatccacaagaagagacaatcaaacctatggtggatggtgggactgaaggtttcaagggccatgctagggttatcatgccagggattacaccatgctttgagtgtactatctggctttttccacctcaagtgaagtttcctttgtgtaccctggctgaaacccctagaactgctgctcactgtattgaatacgcccacttgattaagtggaatgaggttcatggcggagtggcttttgatccagataaccctgagcatatgaaatgggtctatgacgaggctgtcaagagggctgagctttttggcattcctggggttacttattctcttacccagggtgtcgtgaagaacatcataccagctatagcttcaacaaatgcaattatatcagcagcatgtgcactagaaacattaaagattgcaacagagtataatggatcagaaggcctccatactgaagttgcagaatttgaaagggacaaggactgtcttgtgtgtggtcctggtatacgaattgaactagacccttcaatcacattgcaaaagttcatggatcttctggaagaacatcctaagttgcgattatcaaaagctagtattacacatcgaggaaagaatctgtacatgcaagctccccctgtattggaagaaatgactcgatcaaacctgaatctatctctttttaatctcatgggtaaattgcccaaggatgttgtgcatgtgaatggtacaacaatcaagaacgaccaaaagttttcctgtttgagaaaattacgtgttgttttcaagggagttgacggggttacagatatggatacagctggaggagcataa

SEQ ID NO: 86401 - DNA, 510 bp, Glycine max
  Peptide Sequence Number=SeqID_203179
atggggtgtacccatgggcccgaaatctaccctaaggctcataagaaccctagggccttctcttgcatctttggcccaatctacttggagttttctatccaatgcccttgcgaggtaggattgcatcatgtgggcttagcgagaatcatgcgcttagcaaggcactcagcccgcttagcgagatgggagaatctagagaagaatatgagaagcatttgtgcgctcaatgtgtcattaactcgcttagagaggcgtttgtctcttcctgcgctaagcgcgcccagctcgctcagcagattttcactaacttgcgctaagtgcgaaaatgccgctaagcaagccttcgaggatagaaagctctttttaaggctgaagttggaaaaatcaagcaagtcgtctaagagagaggctaattcagagcgtagaaagcagaacaaaggcgcaaaacagagcaaggaagccaaaaacctcaactttcaagaggaccttaggtttaggggtaatttctag

SEQ ID NO: 86402 - DNA, 714 bp, Glycine max
  Peptide Sequence Number=SeqID_203180
atgggaagagggcctcctgctttggtggaaagggaaaaatttgatcatatagaggaaagggtgagggtcattgaaggaggcggaaattatgcatttgctgacatggtagagttgtgcctagtgctcgacatggtcattcctctgaagttcaaggtgtcagatttcaataagtacaaggggaatacttgccaaaagaatcacttgaagatgtactgcaggaaaattggggcatacgcgaaggatgaaaaactcttgatgcattttttcaagagagtctggttggggcggctatcacttggtacaccaatttggaatcttccggggcagtatcaatacaattctgatatagcctcggatagaatgcagctgcagaacatgtgtaaaagggagcaggaatctttcaaagagtacgctcaatggtggagagatctggcagctcaagtagcacccttaatgatggagagggagatgataacaatgaaagtggacacattactggtgttctattatgagaagatggtgagttacatgccttcaagctttgcagatttagtgtttgctggtgagaggatcgaagtgggtctgagaagagacaaatttgattatgcttctttgatgaataggaagcctaaggcaaatagagagaataagaatgagggagaaactcatgttgtggttgccgttcctacatggccaaatttcccactagcttaa

SEQ ID NO: 86403 - DNA, 342 bp, Glycine max
  Peptide Sequence Number=SeqID_203181
atgaagtccaagaaggagaaggagtctgcaaagggtggcccttctaacaaaggaaaacacacaacatgttctcccttaccatcactcactcctaaggcatggatagaaattgctggtttgtcctcagaaggattgatggacaatcagaacgacctcaaggatgttggagtaaagttcaacaaggtcaccaagtacatgtccttgacgaagaatccttacaccttcacttttattgttgctaaagcgaagggcaagcaaatatttgatgttggtccattgctgctagagcatagattcctaacatatgtgattgattggattatcactcctagggggagctga

SEQ ID NO: 86404 - DNA, 174 bp, Glycine max
  Peptide Sequence Number=SeqID_203182
atgcattatgttggaagaattaattcagatagagctcaacattattgttgtgcttctcgaggctcaagcctagatcaatgggcagacatgcgtacccttgtcgaagccaaattgaaaagcaagggtgtgatgctttcaaagtttgtcaaggccattctttcagagtttgtctag

SEQ ID NO: 86405 - DNA, 293 bp, Glycine max
  Peptide Sequence Number=SeqID_203183
atgatgtttcataagtatgtaagaagaagcaagaacaacaacaatgacattaaagggtttcttactgatgtaaagcctgcactgctcagtgccctggatacaaagtatgagaagaatccatttgagttaccaagaggactgtcagggcaaaagactcatcttcaactgttgttactggtggataaggcgtatgctaagaaccacaatgatactaaactgctggtggaagtaatgaggcttctgaaaaagaatgatttaccagtgcaaccagacacaacagatatagttttcag

SEQ ID NO: 86406 - DNA, 1123 bp, Glycine max
  Peptide Sequence Number=SeqID_203184
atgggagattggtctagagggtggaaggaatttgggttcttggaagaggtgggagtattggtggagcagggaggagatggcgggagggtcgagacaccattagtgtggatgaggcgtcgaacttgttgggcagaagctgaactgggctggggggtctgcatcgctaagggaaatggcgaagaaatccatcacgaaatggttgccttggatgaccacggagggaagagccagaaatttcacgatagggctttgtataaaattatgcgtactaccgctatcaacaaggatgaggacctggtggttgttgatagtgccaaagagtcgcatagtctcggaaacaggcataccggccaaggcattgaagctgagctgagggagtattgggttggagttcctgcgaggggttggtactgtcctcgtcgtcgtcagcaattagcaaatggagacgagggttgcagcgatgacccctggtccactgttcatcgcaatggtaacaaagaccccgccacaggggtggacatgtgtgtggcttggtggctggggttagaatggctggtggtgtttgaatggttggtgggccacaacttgcggaagggacatgggttggaaggcttggacctcgcgacggaggtcggggttgaggccagaaataaaacaactgagaaggaagggaggggcgagaccaaccgtgcgatttgcaagccgctcgaactccgtcaagtagtcgttgatggagccgcgctgcaagagcttaaacaaagccccatgggggaaagtgcgggtccttccatcaagggacttccaatttcaggtgaggatggtgagtgttgggtgggggagttggtgtctgaggagttgcaagaatcgcaagcatggcgagacgatctagaatggattcgagtttttcgttcatggtggagtgggcttgtgacagggtttggactgcctcctcaaggcgctcagtggccgactaacgagtattgtgctccggcatcgtcagtgagcaggtttgttgtaacggaatatggcagagtagtggtaatccttaaccgcttgaagcgtttacacaaagtccttcaggtggaccgatttgttgatcacccttttgggcctggcattcccg

SEQ ID NO: 86407 - DNA, 1203 bp, Glycine max
  Peptide Sequence Number=SeqID_203185
atgggagaagcacctacattcattcttcaagagctgcagaatggaataggcaatgggtttgaattgaaaagtgggactttcgaaacggatactattgttggtgataaaaagtatatcattggtggaaccaacggtgaaactttttcggttaaagatcaaattcttgacaacaatggtcttggggcatgcgttgatctcattgagctaggtaccaaacccatttcatgtaatgggcactcagccgtgcttttgaaagaccgaatactaattcttaaggaaactgccaagccagatgattgtatatggtttctggaggtggacactccatatgtcaggcagcagaaaaaaattttggggaccgatgttgttgcatggagtaagggtgtgataggaaattctgagaagcctgttgttattagtggtccttctggagtaggtaaaggaacattgatatctatgttgatgaaggaattcccctctatgtttggtttctctgtgagccacacaacccgtgccgcaagaggcatggagaaagatggggtccattaccattttactgagaagaatgttatggagaaagagattaaagatggaaagtttctggagtttgcttctgtccatggtaatctatacgggaccagtgttgaggctgtggaactggtatcagatgcagggaaaagatgtattcttgatattgatgttcaaggagcaagatctgtgagggctagttctctagaagccatgttcatctttatctgccccccatcaatggaagagctggagaaacgtcttcgagaccgaggaacggagacagaagaacaggtccttaagcggttacgaaatgctcaggctgagattgagcaagggaggtcatcaggcatatttgatcacatcttatacaatgacaaacttgaagagtgttacgagaatctgaagaaattattgggacttgatgaatgtatcactcctcccaagtcatcgccaccaaaagagatcaatcttccaagggatcattcagtgtcaaaaattgatgacaaaatcataataagcagcatctcttcaggactagaaaaggaatcaaagaacttgatcatgttagatgtctcctcacttaaagggggtgcacctggacggacaagagggttagattttcaagtcattggttcattttcagatggtttcaacggcaatggaccattttga

SEQ ID NO: 86408 - DNA, 2355 bp, Glycine max
  Peptide Sequence Number=SeqID_203186
atgacagtcaaggaccgtttccttatgcccacaatcgacgaactcttagatgagttgggccaggcaaaatggttctccaaactggacctctaccaaggcttccaccaaattcgtgtcgcggaggaggatatccacaaaacggcgttccgtactcaacacggccattacaaatttcgtgtaatgccgttcggtctttgcaacgcacccgccacctttcaatccaccatgaatgagcttctcaaaccttacttgcggcggtttgcggcagtgtttttttatgacatcttggtgtacatcctgacactcccggtgcatgtccaacatcttcaagcaatctttcgcaccctctcacaaggtgagttttatctccgccagaccaagtgcttattagcgcgttgtacccttcaatacctgggctatattgtctccgaccaaggcatatcaccagacccagacaaaattcaggccatgctcacttggcctattccaacttcagtctcaaaactacgcaggtttatgggattcacgggtttctaccgccgtttcatccgtggttacgcctctattgccaaccctctcacgtccctcttacgcacggattgctttcactggaatcccgaagctcaggccgctttcaacaagttgcaacaagccatgacccaggtgcctgtcatggccccgccggacttcaccatcccattcatcctcgaaatagacgcttctgggaccgccatgggagttgtgttaatacaacgagcccacccaatcgcattccacagtaaaatcctctgtaatcgcctccggcgcgcgtccacctacgtccgcgaactccatgcaatcactgttgcaactccagaacagcaaacttacatgaccaagctccttgggtatgactactctattgaatataagtccggcgcggcaaatgttgtggccaatgctctatctcgaataccttccccgagatcactactcttgttatccatgcccaattttgaattcatggatcaactgcgccaatccctacattcctctgattcctacactaatttgttgaatgctgttatacactaccccgatcaacatgaagggttcaccactgcccgcgacatgattttcttcaataagaagatttggcttccatcggactgcccgtttatttcggttattatggacgagttccactccaccccatttgtcactgaatgcaccatctgcctccagactaagtacaaagcaaagaagcctgctgggttactccatcctttaccagctccgatagccccgtgggaagaattatccctggacctcatctgtggcttaccatcttcccatggccactcttcaatcttggtcattgtggaccgattttacaaaggaatccatttgggcgctttaccccctcattacacagcacactctgtagctaccctcttcttcgacttagtttgcaaacaccatggatttccccggagtctcgtttccgatagggaccccatcttcgtcagcaaattctggaaggagttatttcgactaacggagcaatatctcagggctttcatgcacgatcacccccactcctggacacgcttcctagctctagccgaatggtcctacaacacatcggtccattctgccacgggcctcactccattcgaggtcacctatggcaaacccccaccctccattctgcagtatctgcacgatacatctcaagtagaggccatggacattctccttgccaatcatcagtgcattcgttcagtcctccacgggcgacttcgcaaggctcaggaaaatatgaagaaggcagcagattctcaccgccaggatgtctcctattctcagggggattgggtgtacatccgcctgcgcccgtaccgccaatcctccattgcctctagttactacaaattatcaaagagttattttggcccttttcaaattcttgaacgcattggaccagtcgcctaccaccttgcattacccgtcaagtcccgtatacatcctgtattccatgtttcattactcaagctccatcccgggccgcctccatccactccaggagttttgcctatggcttcaaaggacaataaccccattgtcactccccttaccatactcgactggaagtggaatgcgtctactaccccaccatctcgcctagtactcgtacagtggcacggtttgtcaccgaaagactccacatgggaagattggaacgatttggcggcaacatacgtccttgaggacaaggacatttttccgtcagggggtattgatagcaatcttaccgggaatgccaggcccaaaagggtgatcaacaaaccgacccacctgaaggactttgtgtag

SEQ ID NO: 86409 - DNA, 747 bp, Glycine max
  Peptide Sequence Number=SeqID_203187
atgaatgcagtaccagacgctacaattcatcgtccaaacgtaaggtcgattgtgagtcataagaaatgccccaaaggcgctgcatgcagtggcactggttgcattggcccttataaatcaggctgcgcaaccaacgactgtgatatcacagtaaccaacccattggctcaattcagttccagctatccaatggtcgaggatgccatattcttgtctcatacattcatccttggctttcttgttggctgcgttgacttggtggatgatgtcatctctggccatgctttacaagttggtggtggtggtggcaatcctcaagttgaatccaagtttctccaaaccaccccacttgttgtcaaccccgttgccaccggtgcagtgtctatatacggcactccttctatcgaatacttcattgatgtcaaagcagttaagattgatgaccatgttgtcaacttaaacccttctctgttgtccattgacaagaagaggaatgggagtaccaaaattagtaccgcgactccgtggactgaattacatagttcactctacaaaccctttgttcaagagtttgtcaataaggctgcaagaagaagaataaagagagtgacatcagtgtcaccctttgatgcatgctttgatataagcaccattgggaattctgtcactggcctagctgtgccaattattgatctagtgctacctgggggagtgcggtggctatttatggagccaattcaatggtga

SEQ ID NO: 86410 - DNA, 729 bp, Glycine max
  Peptide Sequence Number=SeqID_203188
atgattcactggggtcatgttcctagatcaaacactgatagggatagtactgcaggaagcaaaggatctacaagaagcaagaagtataaggccaaaacggaaggcaacaacctcagcccaatatggcactggcaccctcgaaaccagcttatcttctccttctacctctttatttctggaggtgctgaccctcgaacttggtgggtatttaatgaattcaagcgtaaagttgttatggatgcctacagttttgggattatgatcaagggtcgttgtgaagctggtgacttgatgaaagggtttcggcttttggccatgttggaagagtttggtttctctctgaatgttgttatatacactacgttgatttatgggtgttgcaagagtggagataatatgaagccaagtggaattgtgcctaatgcttatgcttacaattgtgtgattagtgaatattgtaacgctaggatggtggataaagctttaaacgtgtttgctgaaatgcgtgagaaagggaagaagtttggggaagcagtcaagatagttcatcaagtcaacaaagttggccttagtcctaacatagttacatacaacatactgatcaatgggttctgtgatgttggaaaaatagacactgctgttgagaatttagcaggagctcttgacttggtcaaggaaatggaagagagatgcatccctccttccaaagtgacatacaattctaattga

SEQ ID NO: 86411 - DNA, 690 bp, Glycine max
  Peptide Sequence Number=SeqID_203189
atggcaacttgtccagttgccctaataatccatttcttcctcttttcactgttgtcttcttcatcctccccatcgagaaagaccctgcaacccttcagtactcaacttccatcgacatggaacgcttcctatggttcgagtgcagcaaccactccaactcctcaacgcaccaccctttccgatgtgggactaacaaatgcatgcaagcaagccaagggcactgcttgcattacctgcaccaaccacactcttaaaacaggatgcacaaacaacacgtgtggtgtcgatccattcaaccccttgggcgcgttcttcgtaagtggagacgtggatgaagacatctatcttgtcctccgtccactttacacgtgccacgcttcatttctgcatgtgttggggttgatggctttctgcaagacctcgccaaggtcaagaaaggggtcttgggccttgcaaggactgctatttccttaccaacacaactcacactttgtttaccttcaacttcaaagtataacaatctttgatgatgatccttccagtgagtactttattgacgacaagtcaatcaaggttgacggcaaaattgtcaaccttaacacctgcctgctttctattgacaaacagggaaatgggggcagcaaacttagtaccgtagttccttacaccaagttgcacactttaatatag

SEQ ID NO: 86412 - DNA, 450 bp, Glycine max
  Peptide Sequence Number=SeqID_203190
atgtttaagagggagcatgaatctttcaaagaatatgcccaaaggtggagggatttggtagctcaagtagcgcccccaatgatggagagagaaatgataacaaagatagtagacacattaccggtgttctactatgagaagatggtgggttacatgccttcaagctttgccgatttagttatcaccggcaaaaggaccgaagaagcctgggcaaatgaagagaacaagaaggagggaggaacccatgttgccattcctacatggccaaatttcccaccagctcaacaatatcaatactcagccaatattagtccttctcattacccaccacactatcatccaaggacactcaatcatccacaaaggccacccctaaatcagccacaaaaaccacctgctgcacatccgataccaaacaccacccttaacacgaaccaaaacaccaactga

SEQ ID NO: 86413 - DNA, 377 bp, Glycine max
  Peptide Sequence Number=SeqID_203191
aacttcgtcttcgtcctcactaaagggaccaagttcttcattaggtaagcctgactatgctgtgaactcaagctcgtttggttgggttgatgagaaaggctctattacaaggatactgaaggtatcagcggttacggaacaatttgacaattgcatgaagaagcaagtagaagcaattgcgcgagttttgcatttatttcaatcctacaaagaggacaatattccgtgcaaaatcgacgagggtctctatttgggttcgattgccactgcagctaacaagcctgctttgaaagactgtaatattactcacgttttgactgtggctggtagaataccacctgcacatcctcacgattttgtctataaaattatagacg

SEQ ID NO: 86414 - DNA, 291 bp, Glycine max
  Peptide Sequence Number=SeqID_203192
atgactaagtttgttgagttgtgcttgaatgaatggggattgaatcttgttttaagtttgatggtagataatgctacctcaaatgacactggaattctacacttgaaggaaaggtggaattcaacctatttgatattagatgttgctttgaagcctaagaagacatttcagaagtctgagttttatgacccacaatatgttgatgatttaggaaaggggataggtctaccatctaatgaagattgggaatatgttgaggctattctgcccttcctgaccattgtttattaa

SEQ ID NO: 86415 - DNA, 270 bp, Glycine max
  Peptide Sequence Number=SeqID_203193
atggagaagatgaatgtgcacataataacaagggggacccctaaggctcgcccaggcgagctgatacttagccatgaactaactagcttgcccaggagagctggttacttaacatggaagtcttatggtggcccaggctatccaggggctagcctgggcgagctagggtctaggaaactcaagaaaagacccttttgcccctcctgtttggcaactggcaaaaaccaaggaagaaaaacctgtaaacaaaaggacattgaagccttataa

SEQ ID NO: 86416 - DNA, 273 bp, Glycine max
  Peptide Sequence Number=SeqID_203194
atggttaaaagccgcaatatcagtcattttgaagagtcagataattgtgagagagagatgatatttggtcgtgctggaatacctcaaatcaagttgaagtgctctccaattgctcccaaggagtcatttctcaagcttaatactgatgacaatttcattggaaaccctggtcattataggtttggtggtttgcttaggaataacctaagtggttactgggttctcgattacttaggttcgtgtgggtatactataaacatcattccacaataa

SEQ ID NO: 86417 - DNA, 252 bp, Glycine max
  Peptide Sequence Number=SeqID_203195
atgaagaagataccatcattcctaaccaagaagccagtgtatattcccctaatggaacaggagtcacagataggagtatgtgtgaaggccccatgggaaggtgggcaggcaatcaaacatatgcctcacaatttaagtcatgttaaaagtatacataatttcatgacccacttgctctaccttgagccagatcagaaacaagaattccaaaagaacatacaagataaaaacaactggaacctcagaaaataa

SEQ ID NO: 86418 - DNA, 687 bp, Glycine max
  Peptide Sequence Number=SeqID_203196
atgctactacacattctagtccatagtctcagaattgagagaccccttgattttgcgaatttctataccacaaaaacatatattgcttggaagttagtgatcaaagagcaagaagcagttcaagtatccctcatggggaaagtgcaaggctttagccttcgatcctttggtggctgctttgatagttgtcgtgaccatagtcaaggctctggttatgggacaaggatatggaacctcagtgatcgaccggtggagctgcaaataagggtgggatcaatactgaagaagattcacacgttgaagccggggtcttctaaaagactgaaatgtaaaagcatatataaggcttatattcctggagggagtggcagtgttggtgggagcttgaagagcttattgtattactatgatgaaacatgtcaaccttatattttgattcgtgacacagggtgtcaatccttaaggatggctaagcaacagtatattagccttgaggatctgagggattcttctgagattaaagtcttctgggatcatctgagaggggaatgttacagattgaaagaagacgatttgatagacatgaaacaagatcaacgaataattgctgaaactgaaatattaattcatatattgcgccgatgtctttgtactgtaggcagaaataagagattgagtaatgaataa

SEQ ID NO: 86419 - DNA, 897 bp, Glycine max
  Peptide Sequence Number=SeqID_203197
atgggaatttcatggagtaatagtaacagtaacagaagaagaagaagaataaatacttactttcaccctccacatcttccacccccatactattaccatcccccgccaccgccaccgccaccgccacaaggttactttattgcctcaaccaacccttatgcttccaccacaggctacgtgggtcctcctcctactcagtattacccaaatggtgtcaattctgtgatgcttcatcagcagcccttagcaagtggaattcttgcttcgccaccaccctatgttgatcatcaagctactaagaagataaggaacgatgtcaatttgcataaacacactctgcgcctccaccttgatcctaacaattcagatcaccacttgatttcctttgatttcgatgccctctatgatggcagcattacaattttctacttggccaaagaagaagaaaaatgtaggtttattccactatttcctgatgtgttcgagccaatcacattcccctttcaaaaaggagctggccagaaattttgtcagccttctggaacaggcattgacctaggtttttttgagttggatgatctttctctgccctcacccgaagaagatgtgtttcccctggttatatgtgctgaaactactagtaattccgtaatagatgcatctcctcacatgcaaattactcaagctgtcttagagaaaagcaatggtattggtcctttccaggtaaaagtagttaggcagattctgtggattgatgatattcgttatgagctgagagagttatatggaataggaagttcaacagtagcagattttgatgataatgatcctgggaaggagtgtgtaatatgcatgactgaacccaaggacactgctgtcttaccctgccgacatatg

SEQ ID NO: 86420 - DNA, 438 bp, Glycine max
  Peptide Sequence Number=SeqID_203198
atggatccttttgatttgttaaaaattatgccaataacactggcacttgtatatgttggaaccacgttcaaggatctatcagatgtgactcgtggttggggcgagttctcaaaaactcatttgccttggatcatttctggcctggtgatatctgctttgtatgccaccagctcagtgctgcaatggctgggcggtagatgcgtggctgagtgggaaaaggctggtcgttgttgtatttgggaatgtgtggttctaatgatatgggttactaaagttgcgaagtctgctttagataaagccttggcagaatgtgaagatatggataacactgcatcttcaccagagctaccgattgtcactgaaacttcagtagatctcaatcagcctctcataaataagacaaaccaggatgaaggcaatctaaattctactgtgtaa

SEQ ID NO: 86421 - DNA, 372 bp, Glycine max
  Peptide Sequence Number=SeqID_203199
atggaaaatcctttatatggaaaatttaggatcaagggacttccatttgctcacaagttgattgaactttttaaggatgtagttgctaatggagagttccaatgggctccctcgtctgggatattgcccgttagtgttgaggttgatatgaatgatgggtaccatccaagtcttgaaggcattggcctagatttagaggaaggctcaagtgatagtgaagatgcaagtgttggtgcaatagatgcttttgagggaattcatatgaatgattcacaaggaactattagccaaggaattgttagtcaaaagagaaagggaatcaatcacactaaaaagttagcaagaagaaggcaactacctcttaaagaatag

SEQ ID NO: 86422 - DNA, 330 bp, Glycine max
  Peptide Sequence Number=SeqID_203200
atggattgtcaatttctggtttgtgcttttgtcgattattgtcgttatcgaagttggaattttgacgttaccatccgacgtgatgtaggccggcgggccgcggacgctgaggctttggaggaggaaacgcgacggaggatcttcgaggaggaccagacgccgaggagaaaggtggtgtgggcgcaaaggaaggaggagatgacgacgatgaccacggaggagttgaaggcggcgaagaaggaggaggaggccagtagggcaaagatgagagagaaccacacggcaccgaggttgaagagaaatagagcaaggggatcagggcgttgttga

SEQ ID NO: 86423 - DNA, 1609 bp, Glycine max
  Peptide Sequence Number=SeqID_203201
atggttggaatggttgtggtttggagcattgatgggtgcacagtcaagaacatcattcaagcctggaggtatcaacaagattatcttgctgtaaagtctcatactcctaatttaacttttgtctctccatatagtcctgtgaacttcactgtgtatggcaaaaagccccttctagttaaggggcatgcaagttgggtttcaagtgagttagaacccaacttgacttcaaatctcatagctagatggtcagctcgtggaggtgagccttgtaaagattccaaggctgtggagattgcaattcctgggttggatggtggggaagtgattgagctatcagctggagatgtgcatgaatttggttttcaagcactggatgattcagggaagcctctttgtgtaggtggggactactttgagactgatctttcaggggactcatggaaatctaggcctttggtgaaagatttcagcaatggttcttacttaatttcattgcaggttcacccagattttgatggggtttacaatctcactataatcctgctctatagacactttgaaggtttgaagtttaccccatggaggttttcttatgaccaaatgctgcgaagtgttgcaatcagattctacaaaagcagtgttcggctaccagaactgcagggttgcaaggcttctgattttgacagggatgtgtggattggaaggtggacaaggcatggcaagaatgatgactgcactataggaaatgatggtaggtaccggtgcctagcaccggattttccttgccaagcaccttggtgcgatggttccttgggaattttggagagtaatggttgggtgtattcaactcattgctcattcaagttgtattcagctgagtctgcttggaattgcttgaagaacagatggattttcttctggggtgattcaaaccatgttgacacaataaggaatttgctcaactttgttttagacttgcctgaaataccttctgtccccagaagatttgacatgaacttttccaacccaagagacccttctcaaacagttaggattacaagcatcttcaatgggcattggaatgaaacacaaaactatctggggttggattctctgagagatgaagggtttcaagatttgctaaagaagtacttctcagaagacacaattcctgacactgtgatcatgaactctggcttgcacgatggcgtccactggcgcaacataagagcattctctgttggagcagactatgcagcatccttttggggagatgttatgaagacagtgaagcaaagggggttggcatggccaagagtgtttttccggaatacagttgcaactggtggatatgcaaggtcactagcattcaatcctaacaagatggaggtgttcaatggtgtgttgttggagaaattgaagcaatcaggagttgtttctggtgtgattgataactttgatatgacatttccatggcattttgataaccggtgtaatgatggagttcactatggaagagctccagcaaagatgaagtggagagatggccaaattggacatcaatatttcgtggaccttatgttagctcatgttcttctcaatgcgctat

SEQ ID NO: 86424 - DNA, 219 bp, Glycine max
  Peptide Sequence Number=SeqID_203202
atggtggttgaaaatattgtcctaacccatcaatccgtaaatgtcacgtggacttatgagcatcgcgaggacttaagaggatatgaaggtgttacatgtttcaatccttattacaatgttggagatgattcactgtggtggcttgaggttgagagagaaagaggacaaatagtactatcctttttgaaaaatgcattccactactggtatgtgcaatag

SEQ ID NO: 86425 - DNA, 285 bp, Glycine max
  Peptide Sequence Number=SeqID_203203
atggacctgaaattgggactcaaaatcactaaaactagagatgacattgcttccatctctgagtatcgattagcaaaggcaggacctatctttcaatctagagaaacaaacattatgttcatcctcactgctcatcttaaaggttataagaggaataacattgacatcaagattagtgaagatggtagtaagatatcaattagtggagagaagcctgttcagaatattttgatgatgggatggttaatgcataggaaagaggttgatgttgcagggttcaataag

SEQ ID NO: 86426 - DNA, 273 bp, Glycine max
  Peptide Sequence Number=SeqID_203204
atggcagatctgagtgtgttgttttgtttctaccttagcacatctgccaagggatatcattcagtcccaaaagagattgctaacccaaatgctaaagagttcaagggaatcttgctgcttaggcttgcttctgtaaaagaaaatatgctttcaaaggctttcttgacaaggtttttgtctttaataaaaaataaaggaggggtcatcgagaagctgaaagcctctaggcagcagtgtatactgcaacctattctttatataagatgcaaatag

SEQ ID NO: 86427 - DNA, 1399 bp, Glycine max
  Peptide Sequence Number=SeqID_203205
atggagatgagaagcaaggaagagatagaaataggaagagacataacagcaacactgactcctctctctttttgtctccacactttctatcttcacactcactgctctgcttgcttctcttcccttccaattcccaatcccaatcccaatcccaattcactcttctattgctcccctccatgctccgccgcactttcacctctccaccactcctccgccgagcgccacctacctccctccgctcactcctcccacctctgtaccgccctccgcctcctcctctcccaccgccccacctcctcctcccgcctcgccggcctcctctccaatcgccacatcctcacctccctctctgtccacgacgacgtttcggagagaatcagcgtcggtgccggcgccatggcagaagcgatcgcgaagcagcgcggcatccccaacgacgacgccgttttggaggaagccacgattgcgctcagcgcggtgctaacgaacgccgtggaggtgcacgataacgaagggcgcgccctcggaatcgcggttttcgaccaaatcttctcttggatcaaccacagttgttcccccaacgcctgctaccgctttgtcctctcttcttcttcgcattccggggaagccaaacttggaattgctccacacctacaaatgaatagtagcggggttagtattagcagtagtgaatttgcaaaagggggcctgggttatggtccaagattggttgtgaggagtatcaagaaaatcaataagggagaagaggtcactgtagcctatacggatctcttgcagcctaaggcaatgagacagtcagagctatggtcaaagtataggttcgtttgttgttgcaaacgatgtagtgctctgccctcttcctacgtggatcatgcgttgcaagaaatttctgctatcacttgtgaatcatctggttcatgttccaagttcctcaaagacatggctgatagaagattgactgagtgcattgatgatgttatattggagtatctttctgttggtgatcctgagtcttgttgtgagaagcttgaggagatactcacacaaggtctaaaagagcacttagaagtcattgaagtaaaaccagattactctgaaacagatataaaccaattaaaagcttttgacatgagcaggatcagtgctgcgtattctttggtacttgcaggagcaactcatcatctcttcaattctgaatcctcactgattgcatctgttgcaaatttttggacaggagctggtgaatctttgttatctctaagcaaaagttctggatggagtatgtgtgttaatttgggtcttgttattccaaaccttgcttctgccatgaaattcaaatgtacaaagtgctccttaatggataggtttagagctg

SEQ ID NO: 86428 - DNA, 522 bp, Glycine max
  Peptide Sequence Number=SeqID_203206
atggggccaacaattctcaactttccatgcaagagtcttaataagagagagcttccacacttgaggttttcaagaagaaggtttcttagtaatgtttgtgatcagcttgatatagcagccaagggaacttatatattgaataaagactttgatacaatgactagagttgtggctcggctttatgatgaaattgaacataaaaggacaatggtgcaattctttttggacaagaaggatgataaattctctttgcaaatggtgaaggagcttaagaaaagtggtgatgggtttaggaaacaagtggaagaacttaaagagcatgtgtacttgtgccttgtgacaattaaccgagcaagatgtttggttactgaggaaatgacaaaaatgtgtacagaaggcattgggagtgtagacatgttgcttgctagttctgaacaagaaaaagtgaagaactccacaaggaaaatggtgggcaactcaaactccccggagtccaaagttagaagatatatggatagttag

SEQ ID NO: 86429 - DNA, 924 bp, Glycine max
  Peptide Sequence Number=SeqID_203207
atggtgattttatgttacactcaggcaatgagacagtcagagctatggtcaaagtataggttcgtttgttgttgcaaacgatgtagtgctctgccctcttcctacgtggatcatgcgttgcaagaaatttctgctattacttgtgaatcatctggttcatgttccaagttcctcaaagacatggctgatagaagattgactgagtgcattgatgatattggagtatctttctattctgaaacatatataaaccaattaaaagcttttgacatgagcaagatcagtgctgcatattctttggtacttgcaggagcaactcatcatctcttcaattctgaatcctcactgattgcatctgttgcaaatttttggacaggagctggtgaatcttttttatctctaagcaaaagttctggatggagtatgtgtgttaatttgggtcttattattccaaacattgcttctgccatgaaattcaaatgtacaaagtgctccttaatggataggtttagagctgatattacgcagaaagtttggggtttccttatctctgattgccaatttttgcaatcatgcaaagatcctatcatttccagctggctaatgtctaccaaaagttcaagtacagtgaatgttgaggtttgcgttaacaaaactaacatgcgttacactcacgaatctgaaaatagcgtctctctgggtcatgaacaaacctacgcagatcatgcagtagcatgcatttttcatcttggcctacactgcttagcatatggaggattactggctagcatttgttatggcccccattcacatttgcagaagcttgatgggatgataaatgctgaagagatagatgtacaactcagttacagcatcataggtagtaaaatgaagtgtataaggaacattagattagatgattga

SEQ ID NO: 86430 - DNA, 546 bp, Glycine max
  Peptide Sequence Number=SeqID_203208
atgtggtcgaaaaccgcgattccgagggcgcgcccttcgttatcgtgcacctccacagcgttcgttagcaccgcgctgagcgcaatcgtggcttcctccaaaacggcgtcgccgttggggacgccgcgctgcttcgcgatcgcttctgccatggcgccggcatcgacgctgattctctcggaaacgtcgtcgtcgacagagagggaggtaggtggcgctcggcggaggagtggtggagaggtgaaagtgcggcggagcatggaggggagcaatagaagagtgaatagggattgggattgggattgggaattggaagggaagagaagcaagcagagcagtgagtgtgaagatagaaagtgtggagacaaaaagagagaggagtcagtgttgctgttatgtctcttcctatttctgtttggagcatcacattgttggtgcttattaaaaaagaaaatgttgggaaacagaaagatgcacatcaatagaaagaaagcacatcgatcatcaaatgggtcttctatccaccatatgaacccgatgtattga

SEQ ID NO: 86431 - DNA, 591 bp, Glycine max
  Peptide Sequence Number=SeqID_203209
atggggtttaatgggaagtgggtgtcttggataaaaaatatgctctcatcatcatccatttcaatactggtaaatgaaagtctcacaggagaattcaaatctacaagagggttgagacaaggggatccaattgcccccttcctcttcctagttgtagttgaaggattgagtggactcatgcgacaagcactattgaaaggcctctacaaaggctacaaggtggggaagcaaaatgcggagctctcccttctacaatttgcggacgatactttgttctttgtggaggactctctccaaaatgtcctttgcattaagtccattctcagaagttttaaaatggtgtccggcctcaagattaatttccacaaaagctccattggagggattggggtggttgatactttgttgcataggtatgccctttttctaaattgctcttacatggattttccttttgtatatctcggtgttcccattggtgcaaaccctaggagaaagagtgtgtggtccaaagtgttagaaaaatgtaggaaaaaattgagtgtgtggagacaaaaaaacactttccttggggggggaggggtcatttaa

SEQ ID NO: 86432 - DNA, 242 bp, Glycine max
  Peptide Sequence Number=SeqID_203210
ccgatggccaaaacgtggaccatttcctcggtgagccagagcaactgcgttttggcggagtggagaagtttggggtagagttgaaggacggcgtcgaggaaattgcgccgttgaggagggcgtattggtcgggggtgggaatggataaggagaaagggggtctcagggatggttgcagagactcgaaggctaccctcagcgacgcttccaacgcgttttcggcttcgaaaggtgctgtctga

SEQ ID NO: 86433 - DNA, 1668 bp, Glycine max
  Peptide Sequence Number=SeqID_203211
atgagtgtttgctgctctgatgatttagacagtatatccgatgtatctgacaatacattcagcaggactagtggatcttcacattgggaccatttagaaaatacatattatcgaagagaactgagcagtaagctgtatgcagaagatggagttagttattttcagttagaggtagatactaccattggtgcctcatttgctttaccttctccttctgtgagaagatccattagaacatcaaaccctccaccttatcttcttgattacattagacctcaacctagacagaaatctcaccctatacaagatcattgctctctggttcacctccactctccttataaggacttcattgctcaggtttccaccatttatgagccacaattttatcatcaagctgttccttttccagaatggcaccaagccatgacagctgagatcaaagctttggaatccaataacacatggactttggttcctcttccaattgctaagggttacacacagcaagctggtattgatttctcggatactttttctccacttgatgtggataatgccttcttgaatggtgatctatttgaggaagtgtatatggaacttccaaaagggtacacttcagttgataaaaaccttgtctgtaggctcaacaaatccatttatgaccttagacaagcttctagacagtggttttataaactctctacaacattaattgagaatggtttctctcaatcaaagaatgactattctctttctaccattggcaaaggtgcttctctggttgttctgttagtctatgtagatgacattttgcttgctggcccaagtgctacatgtgttcactctgttcaggccaagcttcaagccttgttcaaactgaagatccttggttccttacaatattttctgggcctgcaagttgcaaagtccagcaagggcattgttttgactcagagaaaatatgccctttctctgttagaggatactggttttcttggctgcaaaccatcctctcttccaatggatccaaatttaaagctcgacatgctcagtggtgatttgctgcccaatccctcaatgtacaggtgcttacttggtcgcctcatgtacctcactatttcaatgccggatattacatttgctgttaacaagcaaagccaatgcatgcagcatccaagaatacctcatctaaatgctgtgcatcatctcctacaatatatcaagggcactccgggtcagggtcttcattttccagccagtaactccttcaacttatctgcatatgcagatgctgattggggaggatgtttggacacacgcacagcagaggcagaatatcgagctctttcctcagttcccagtgaagtaatttggctaagacgattgctcctgcactttgagatttccatcccatctgccatgcttttctgtgatagcaaatctgcaatttatctagcgtctaatccagctcaccatgaacgatccaaacacattgatattgattatcacttcattcgtgagttagtgcagtccaacacccttaagcttgttcatgtgaaatcccaacatcaagttgctgatatcttcacaaagcccttaatgcttctggctttctcttcttttatccgcaagttgggactcattaacatttactctccaacttag

SEQ ID NO: 86434 - DNA, 2535 bp, Glycine max
  Peptide Sequence Number=SeqID_203212
atgacagattttcagccgctacagcagaagcctgagcctgctgatgcccatgctgagtttgagcttggactggaggagtttatgcgtgggcacttggatgattgtatgtcgtttgcttcgtgtagctcgtctcgtgctccggatgatgaggatgacgagggtgatcagctggttcggaggagaaggaggtctgaccttgaaggggatgatttggctgagtcgtcggctgcacgccggcggcattcgaggattttgagcaggtgggctgcacggcaggcacaggagatgataactactatagagaggaggaatcgagagtctgagttgatggcgcttgcggggttgcataccgtgtcaatgctggattcttcttttctgaggggttcgcagtctccaacttctggccaggagggggctgtggagaggccgagcactcaggcgtctgccattctgcagatgtggcgtgagttggaagatgagcatttgttgaaccgggcgcgggaaaggatgagggtaaggttgcggcaccagagaaattctgactctaataccaatgtgtccagtaccatgtctgatagtcgaggcagtgagaaccaagggagtttgggggatgcaagtgaaagtgaaactgattatggtacttggtcacatgatcagattggatcaaggaatgcacatggggatcataatgggtctagcagggaacaatctcctgatcttggcgaagttgagagggagagagttagacagattgttcagggatggatggaaagtggtattagtgatcattcatctaatgtgagtcagagaaacaataaccggagagcagaatggcttggagaaacggagcgtgagagggtaagaaatatcagggaatgggtgcaaatgattagccagcagagaagttcgcgtgggagccggagggatgctcaagtaagtgagggtgctcaatctgatcgagcccgcgatgtagtagctgataatgatgagagtcagccagagcatgttcggcgggacatgttaaggttgcgtggaagacaggctctagttgatttgcttgtgaggatagaaagggaaagacaaagagagctgcagggcttgttggagcaccgagctgtttctgattttgctcatcgcaaccgtattcagtcactgctcagaggtagattcctccgaaatgaaagaactgttgaagatgagaggccaccgtctatggctgcaagtgaattagttcagctaagacaacggcacacggtctctggtttaagggaggggtttcgttcaagattagaaaatattgttcttggtcaagcaggcaccagtcctgattccacatcaaatagtaacgcgagtgaaacaagaggtgatgggagccaagcaaacagtctggtagatggccaacaagaaaactatgaacagcagattaggagcctggaaactgatgtgcgtcagttgcctaatcgaacaggaactttggagagtagcacaagtgagagtattagttggcaagaagctagtaatcaaggggggaattggcaggaacaaattgctgaagaagggggaggaaactggcaacggagtccatttgatcagacgagagatggaagggcagtcagtgattggccacaggaacctcccagaaacttaactggggaagatcctcatccccaggaagctcaaagaatttggcatgatgataacacaagggaaactgttggtaattggtccgaaggaccttctggagcttcgaggaatcgccgtggggttcccataagaagattcaatagatttcatccacctgatgatgataatgtatacagtatggagcttagagaacttctgagcaggagaagtgtttctaaccttcttcgtagtggtttccgtgaaagtctggaccaattaatacagtcatatgtggaaaggcaaggtcgtgcaccaattgactgggatttgcatcggaacttgccaacaccaactcctgcctctcctgaacgggacccagaccagcagggtgaggaacgtgatgagggtcaacatgaaaccattaacaggccttcactggtgttgccttctccaccagtacctccaccacaacctctgtggcaccaggatttgcatcaaactggatggtctcgccatagcatgcatcgttctgaaattgagtgggagataatgaatgatttaagatcagacatggcaagacttcagcaaggcatgaatcacatgcagaggatgttggaggcctgcatggatatgcaactggagttgcagcgctctgtcagacaggaagtatctgctgctctgaaccgctcaggattgagtgctgagacatctgatgatgggtctaaatgggggcatgtgaagaaaggaacttgctgtgtttgttgtgataaccatatcgattctcttttgtacagatgtgggcacatgtgcacttgttcaaaatgtgccaatgagttaattcgtggtggtggtaaatgtcctttatgccgagcaccaattgttgaggtggtccgagcatattccatactgtaa

SEQ ID NO: 86435 - DNA, 114 bp, Glycine max
  Peptide Sequence Number=SeqID_203213
atggcaatcattgatactacagtaagtaaccagtgcttaaagaaaaatgtgactaatgcgtgtacatttggtgctgccagattcaaaccagggagttttgggttttttgcgtga

SEQ ID NO: 86436 - DNA, 3609 bp, Glycine max
  Peptide Sequence Number=SeqID_203214
atgttgacgaaattcgagacgaagagtaacagagtgaagggactgagtttccatccgaagcggccatggatcctggcgagtctccacagcggcgtcatccagctctgggactaccgcatgggaaccctcatcgacaagttcgacgagcacgacggccccgtccgcggcgtccatttccaccactcgcagcccctcttcgtctccggaggtgacgattacaaaatcaaggtgtggaactacaagctccaccgctgcctcttcacgctcctcggccacctcgactacatccgcaccgtgcagttccaccacgagaatccctggatcgtcagcgctagcgacgaccaaaccattcgaatctggaactggcaatcgcgcacttgcatctccgttttgaccggacacaatcactatgtcatgtgtgcgttgttccatcctaaagaggatctcgttgtgtcagcttcgctcgaccagaccgttcgcgtttgggacatcagctctctcaagcggaaatccgcgtccccggccgacgatatcctgcgcctcagtcagatgaacactgatctcttcggcggcgtggatgccgttgttaagtatgttttggaaggccatgaccgcggcgttaattgggcttccttccaccccacgctgcctctcattgtgtccgctgccgatgaccgccaagtcaaactttggaggatgaatgacacaaaggcatgggaagtggacaccttgagagggcacatgaataatgtttcatgtgttatgttccatgccaaacaggatatcattgtgtcaaattctgaagataaaagtattcgcatatgggatgcaacaaagagaactggaattcaaacattccgccgagagcatgacaggttttggattcttgctgcccatcctgaaatgaatctgctggcagctggtcatgacagtggcatgattgtttttaagctggagagagaaaggcctgcatttgttgttagtggtgattcgttgttctacactaaagaccggttcttgtgtttctatgaattcccaacacaaagagatgcacaagtacttccgttccgacgaccgggctctttaagcttgaatcaaagcccaaagactctttcctatagcccaactgaaaatgcttttcttctgtgttcagatgtagatggtggatcttatgagttgtattgcatatcaaagcaaagttatggtaggggtgatgtgcaagatgaaaaaagaggtcatggagcctccgcagtctttgtggctcgtaatcggtttgctgtgctggagaagagcagcaataatgtccttataaaaaatttgaagaatgatattgttaaaaagagtgtccttccgattgccactgatgctatattctatgcaggaacaggcaacttgctatgtaggtcagaggataagaccccttttattaaatatgttgtctggtctgatgatatggaacatgttgctttactcagcaaacatgccattataatagctagcaagaaacttgtgcaccaatgcactctccatgagactatccgtgtaaaaagtggagcttgggatgaaaatggtgttttcatttatacaacactaaatcacatcaaatactgtcttcccaatggagataatgggataataaagacattggacattccaatttatatcacaaaggtctctggcaacacaatcttctgcttggatagggatggtaagaacagagcaataattattgattctactgaatatatttttaagctttccctcttgaagaaaagatatgatcatgtcttaaacatgataaggaactcacagctttgtgggcaggctatgattgcttatcttcagcagaagggctttcctgaggttgcactgcattttgtgaaagatgagaaaattcggttcaatttggctttagagagtgggaacattcaaattgcagttgcatcagcaacagcaatcgatgagaaagatcactggtaccgattgggggttgaggctcttcgccaaggcaatgctggcattgtagagtatgcataccagagaacaaaaaattttgagagattgtctttcctttatcttgtcactggtaacatggagaaactgtccaagatgttgaaaattgctgaagtcaagaatgatgtgatgggccagtttcacaatgccctatatatgggtgatgttcgagaacgtgtgaagatattggaaaatgtgggccatttgcctcttgcttacatcactgcatcagtccatgggctacatgatgttgcagaacggcttgcagctgaattgggagataatgttccatctttgcctgcaggaaaagtgccttctctcgtgatgcctccatcacctgtcatgtgtggaagtgattggcctcttctcagggtcatgcgaggcatgtttgatggggtgcttgacaatacaggtcggggagttgctgatgaagaagagtatgaggctgctgatggtgattggggtgaggagcttgacatagttgatgcagatggcttacaaaatggagatgttactgcgattttggaggatggagaagtggctgaagaaaatgatgaagagggtggatgggagatggaggatttaggtctgggccctgaagctgacactcccaaagcttctatcagtacacaatcttcagtttttgtgaccccaacacctggcatgccagtaagtcatatatggactcagaaatcatctcttgcggctgatcatgcagctgctggaaattttgatactgcaatgaggttgctgaaccggcaacttgggataacaaattttgcccccctgaaaaccatgtttctggatcttcatactggcagtcattcctatctccgggcattttcttctgctccgatcatatcacttgcagttgaaagaggttggactgagtcatctagtgcaaatgtgagaggcccaccggcacttcctttcaaattgtctcaattggatgaaaagcttaaagctggttataagtttactactgctgggaaattcactgaggctcttaagacatttgttaatattcttcatacaattcctttgattgttgttgagtcaaggagggaagtggatgatgtgaaggaactaattatcatagtcaaagagtatgttttgggctcgcagatggagctgaagaggagggaagttaaggacaatatagtacgacagcaggagcttgcagcatatttcactcactgcaaccttcagacacctcacttgaggctagctttgcagaatgcaatgactgtctgcttcagggcgaagaaccttgccactgctgcaaactttgcccggaggctacttgagacaaatcctaccaatgaaaaccaagctagggcagcaaggcaagtggtagcagctgctgaaaaaaacatgactgatgctacccagttgaactatgatttccggaacccatttgtaatttgcggtgcaacctacatgccaatctatcgaggacagaaggatgtctcttgcccatattgttcttcacgttttgtgcctacccaggagggacagctctgtaatgtttgcgatcttgcagtgattggagcagatgcttctggtctgctttgttcaccttcccagatacgctga

SEQ ID NO: 86437 - DNA, 333 bp, Glycine max
  Peptide Sequence Number=SeqID_203215
atggcctcgagattggacagcctcttcaccactaacaacaacttccgcgacggcggcgatcacacaaccaccactgatagtgatgccactgcacacgtctcaccgacaatggcttctgtcgttgcagacgtactctgccttcgtttataccatcgcaagactaatgctctgttagtggttgtccgagttcgcaccaccaatctctctgtcacggacatagaagtggttgcagagctagacaacggcagtgccggtgaggatcatcaggatggagccaacaagaaggagtgggacagcaccgtcaaggaggagacagatcgaacctgcgactaa

SEQ ID NO: 86438 - DNA, 1473 bp, Glycine max
  Peptide Sequence Number=SeqID_203216
atgatgcactctgtaaagggtggctgggggcagacgtttgcgcttgctaaacacaatgaatccgaagggagaaagactcggattcgccgctcaaagcaggaaaggaaggcaatggttgaatcctttataaagaagtaccaagagttgaacaatggaaactttccatcacttaatcttacacataaagaagttggtggctctttctacacagtacgggagattgtacgtgatataattcaagaaaatagagtattgggtcctgctaagttcactctagaggagctaaacactgatcaattttttgaacaaaatccactgggttcaattgccagagatcctcaaccttttttggctgcatctttaattgaaaaccattgtgagcttgacaaacttcaggacacaaacagcaagatgatttccgtttctgatgtgtcttataccgaagctgtgcaccagcaggtggttgacaaaggggatgtcataagtgttggccatgtagacgtgacaaacaaggaatccattgaagcagctgttgttgttgatgggtgtgatactggagatgagcatccaatgtttgacaaagggcaaaccatgaatgttagccaggtagatgtgacgaacaatgaatctgttgaaactgctgtcttttctggagggtgttgttctggaaccgagcacaaaattgttgacagagggcatgtcttaaatggtagccaggtgaatatgataaacgaggaatccaatgaaactgttattcctgagatgcaggtaggtgatcctttggcactcaatcagaatgctgaacaagagttggcagttgccacaacaccaatggctaaagtaactgctgtgacagaagacttggtagtagagacatttccattaaactctgtttctgggactactgatctgggagggttgggggactcaagtaattcaccagaaaatgatataaaaaagttgaaattgaaacaatgcgagaaatttgagtatgcccctggaaatcaaatattagaggactcctctaatgctgggcttgataaggaggagaatgtacaggatatgttagaagaaagctccaatcattctacccgcaaagaactttttgatcatcatgaatttgaagatcgcagtgattctcaagttagagcatataatcaaaatatcataaccttcaaaaccatcagccaaagccagatgatagatggagttaagacaagcactcaaaccaataacctcagcaagacttgtaaaccttcagaggaagatggtagcctgctaaaagctgataaacatagagttgatgatcaacttggtggcaactctcaaagaagaagcaacacaactgtggataggatcaatctagaatcctgggatggagcagctaagaattctgcaaagcaagaacctaaccctcttttagctgttttgaaagtttttgttgatgcttttgtgaaattttggtcagggtga

SEQ ID NO: 86439 - DNA, 1542 bp, Glycine max
  Peptide Sequence Number=SeqID_203217
attcaacaggggtcatgggaatggaatttattccagaatgaaatagacttgtcaaagatagattccaatagaaaagtttccattgtttatgctgttgagcatgagttggcaagtcttaattattcaacaagcattgttgagaatggaacagaggttccactgcaagatgaactaacccaattggatttggatactttgagagaaattgaaatatctgaagagaatgaaatgtttgaagtggaagaggctgaagagagaatggagaaaggtgttagtgtatgggatgatatatatcgtaatgctagaaaatctgagaaactgaagtttgaagtcaatgagagggatgaaggggagcttgagagaacaggacaatctgtgtgcatttatgagatatacaatggtgcaggagtgtggccatttttacaccatggttctctctatcgtgggttaagcctttctagaagagcgcagagacaaacttctgatgatgtggatgcagttggtcgcttgcctcttttgaatgacacatattatcgggacattctctgtgaaatgggaggaatgtttgcaattgcaaatagggtggatagcattcacaggaggccttggattgggtttcaatcatggcgtgctgctggtaggaaggtagcattgtcagcgaaagccgaaaatgtcctggaagagacaatgcaagagaattttagaggagatgtaatatacttttggggacgtttggacatggatcagagtgccataagaaaccacaatgcaatttctttttggtacatgtgtgacatcttaaatggaggcaactgcagcccatttgaaaaatatgaaacttcctctaaaagaaatatgtttggaggttcagaactggaatttctagaagttggactttggagtttggatattgtaataattgtttttcaagatggcttccgccagatgtatgcattgcccccccatgcggaagcactgccccccatgccggaagatggtggttattggtcagcactgcacagctgggtgatgccaacctcttctttcttggagttcataatgttctctcggatgtttgttgattccattgatgctaagcacagagactccactaaatacagcctgtgcttgttaggctcttcagagattgagaagaagcactgctactgtcgcatgttggaacttctcatcaatgtatgggcttatcatagtgcacgaaagatggtatatataaatcctaacactggttctatggaagagcagcaccctattgaacaacggaaaggttttatgtggtcaaaatacttcaatttttcattgttgaaaagtatggacgaagatctggccgaggctgcagatgatggtgaccatccaagggaaatgtggttgtggccaatgacaggggaggtacactggcaagggatttatgaaagggagagggaagaaaggtacaggctaaaaatggataaaaaaagaaaaacaaaagaaaaactatttgaaagaatgaagtatggttacaagcagaaatcacttggacgataa

SEQ ID NO: 86440 - DNA, 579 bp, Glycine max
  Peptide Sequence Number=SeqID_203218
atggtacacagtgagagtcttcccgtttgcacctctgacaaccttcaccataactgcaacctaggatacatgagccaagctctcaggcagcataacctctccaaacatttcatcctcaagacgaaaggacaaaacaaaatagtaccaagcaccggtcacatagcgcttggcaacccaatgaacaagcccgtcctcaaaaccatcgggagcatctccagccacgtaacagacaggagcaatgctatcaaggatcctccaagacccagttgcaagagggtaaagctcaaacaagggagcagaaaggccaaagctttcatcatccacgatgcaagaaattctgatcaccttgtaatcgcaattactcgaatcaaaaccgagggcaatgtaggaatggtggtagcaagggtagtcgtggggtgcattgttcaccgtaggcaatgcaaaggagatctcggtgatgcaggcattacagaaggcaacgacggggaactcgtgatcggggaaggagggaaggcggagggtgaggaagggatctcggcggcggtggtggagggagatgaaggattcgttggtgactag

SEQ ID NO: 86441 - DNA, 510 bp, Glycine max
  Peptide Sequence Number=SeqID_203219
atggcttacattcttttgtatgtggatgatattatcttaacaacttcctcttatgttattcgcatgtccatcatatcccttcttaactcggaatttgctatgaaggacctagggccattgagttatttcttgggtatagttgtaactcgtcatcagatgttgattggtgtgggtgtccgaataccagacgctctacatctggttattatgtgtttcttggttgttcgtggggaagttcgagtcttacctgtcccgtcacgttatcagattgcagatatttttacaaagggtcttcccttggttctatttgagaattttcggaacaatctaagcgtacaacaacttcccgtttcgactgtagtgcttcattctgcggttgtttatataattttgactaatttgattaggtccgttacgtccgtggaagtgaaactgtacagtcttggtttctaccttattcgtgaatcgcgtgatttgaaagtgaaagtaccattggctattgggggttga

SEQ ID NO: 86442 - DNA, 342 bp, Glycine max
  Peptide Sequence Number=SeqID_203220
atgaaggtgatggactttgatgcatttgatctacggaggcggcttccagttgtagttagcaaattatacaaggcaataaattccaatggaggtgtaacatatatacattgcactgctggacttggaagagctccagctgttgcggtaactcaaattgagttcatggcatttatgatttctatgcataatgattgtgtagcaattattgattcttcaacagttatagttgaatcaccagtttctaaaattagagcaaaaggtcatgctttccaaaactggatgccattaaaagtgcaacagctgatattgtgtgatcttcttgataagtctttctctccttga

SEQ ID NO: 86443 - DNA, 270 bp, Glycine max
  Peptide Sequence Number=SeqID_203221
atggagttaaacatactagatgaaaacacacttccaggatatacagatgagatcacaagtgacaatgaagaaaaggaaaagaaacacaagaattggggattcaaattggccaagcatatactgaggaacgggatatttcttaaacctaaacaagaaatctcaattatcacctgcccccatccaatatcaagtcctgaaatttccacggtagagcaattgctgccttcccatgacaaagtgacagacttcttactgaggcctgtaagctga

SEQ ID NO: 86444 - DNA, 501 bp, Glycine max
  Peptide Sequence Number=SeqID_203222
atggcatacaacaaattacagttgttgatctcattgatcatgaatcacaaacttgaaaatataatatgttgcgacattgctgctatccattcaacacctttggtgaatctagaagatcaagaccaattggcatggaaatttactcccacggattgggaattgaggcatttgaaggtgaatggcaactgggtggctgttaggaaacttgaagctcccacaaaaatcaagcatttcctttggagagctttgcgtggatgtttgccaacgagacaaagattgatcaacaaagcagcaacttccagccaacaccatcactcgcataactattgttctttggagcatatggagaagaagaaaccagaagcacttcagtttacctggagacaggccaacctcgtcgctgataagttagcaaagacatcaaggtttcatgttcacaccaaagtttatgattttattcctcatcttgtttatcccattatcatgaatgaaatgaaatag

SEQ ID NO: 86445 - DNA, 558 bp, Glycine max
  Peptide Sequence Number=SeqID_203223
atgaatgagggaacgagaactcacgagagctatccttggcgcgcggacgccaattctgggctgggagcgaaccggatcgagtccatcgccagagaggaacctctgcgaaatcctcccggggacgaagcggagcgcggagccgaagcggattcctccgctgatgtacctggcgctatcggcactctggcggaagacggaggtgatggagctctgcaagaccatggaggcgagggcgaagaggaagaccacgacgatgatgaaagcgtagaatccggacttggacttggggaacgggaagagccacagcaacaagcccttgcgcttgtggaggtgagatcggatgctaatgttgttgttgttgctgctgctgctgctgctgctgttgttggagcgcggcaattgccgatcgaaggaggcgcggtggcggtggtggccagggttccgcttgaaggggaatccgccgcggatcgcaccgaatccaatgtccccgccggcgtcgtcgatctccggctgcgaagccacgttgcgcgacaatcccatcggaaaatcaatgaatga

SEQ ID NO: 86446 - DNA, 168 bp, Glycine max
  Peptide Sequence Number=SeqID_203224
atggagaattggcgaacagcgctacgcaataacttcgcggggctccagactcgaagagaatggagaattggcgaacagcgctacgcaataacttcgcgcggctctaggctcgaaggtggaggacacatgaacagcgctaggcaattacattcatgggtctccgaataa

SEQ ID NO: 86447 - DNA, 108 bp, Glycine max
  Peptide Sequence Number=SeqID_203225
atggagatgtttgtttacccaggggagaagtcagataatgcatgggggagggggattcaagcactccttcaagcatgcagactgctgaggataacagaaggcaattga

SEQ ID NO: 86448 - DNA, 258 bp, Glycine max
  Peptide Sequence Number=SeqID_203226
atgcataatgtgatatgtggaggagaaaaatttgtggatagttatctaatgattttgaccaaagctggagtcagaataaatgtgattcaaggtgataaagacaaggctgtcccaatggagtgttgtagtaagttaaacttgaaggctcctaatgctgaaatcagcatcattccaaatgcaaaccatggcactgtactatttggcagaaagaaggaatttgcatgtagtttggagcatatatgggaatcttgctgttga

SEQ ID NO: 86449 - DNA, 869 bp, Glycine max
  Peptide Sequence Number=SeqID_203227
ccaatggtgagaacttcaggggaaaccacccttctgagaatgccatattcttgcatggatttctctgctcttcctcattttggacacagacagtgtttccatgtttttctgaaaaagtgaataaaaattacagattgattgccattgacttgctgggatttggcaagagtccaaagccaagagattgctcatacactttgaaggatcatgtggaaatgattgagaaatccgtgattcaaccgttggagttaagtagttttcatttggttgcacactccatgggttgcataattgcattggccttggctgccaagtaccccaagtgtgtaaaatcaatcacccttgttgctcctccatacacttcttctgagggaaatgaagcttgtctaaatgcactatcaatgcttgctggaaagaaattgtggtccccattgtcatttggttcttcattcatgtcatggtatgagcacttgggtcgcacagtttgccttgtctattgcagaaatcacaggatatgggagagcattctaaaattcattactcgcaagagggatcttcctttctttaccatagacttgaccaggcacacccatcattcagcttggagtaccatgcacaatgtgatatgtgggggagcaaaatttgtggatagttatctaatgattttgaccagagttggagttagaataaatgtgattcaaggtgataaagatcagattgtcccaatggagtgttgtagtaagttaaagttgaaggctcctaatgcggaaatctgcatcattccaaatgcaaaccatggcactgtactttttggcagaaagaaggcatttgcatatagtttggagcatatatgggaatcttgctgttga

SEQ ID NO: 86450 - DNA, 354 bp, Glycine max
  Peptide Sequence Number=SeqID_203228
atggggttccttcattttgggagaaaaagggaagattccaaaagaaaacatggtagaggagctggtggtgcagggtcagtgaaccgttggtctgattggggctgtgaatcttgcctttcatgggtcaatgatggaagtgactataataagcttcattttgttgagaaggagcctttgttagccacttatgagaatttcagggaaaaccctcctgagaatgtcatattcttgcatggatttctcagctcttcctcattttggacaaggacagtgttcccatatttttctggaaaagtgaatcaaaagtacagattgattgccattgacctgctgggattcaaccgttggggttaa

SEQ ID NO: 86451 - DNA, 1956 bp, Glycine max
  Peptide Sequence Number=SeqID_203229
atggtgttggacactgatagagcaaatacagttgatctaatgaagtttttgctgagttatgcaagtaacccatttctctcttcagaagggaacaatctcaataaaagagatattgttgaatcatctgtcagaaatctatttggcgaacttttcaagctgagttatagtgcacctggaccaaatgcttttgattcggtgaaaagtcaaatggctggtagatttgaacagacaaagcttcctcctggacaaaaaattgaaatgaagaggggtgattggctttgcccaaggtgtaatttcatgaattttgcaagaaatatcaaatgtcttgagtgtgaggaagcaaggccaaaaagacaactggctggaggtgaatgggaatgtcctcagtgtgattgcaagcaacccgggcaaatatctttgggtaccaccaataccatgtcaaatatggggtacgaaaatggaaacaatcttaatacttcagatgttgatgctaggttagctgctaatgaagaaaaagcacagcgttggtttagcaaggtttctcaactagacagcagtgctgatattaacagtgtgataacagatgaagattttcctgaaataatgccattgaggaaaggagtgaatagatttgtcgtgagcacaagaaagactccactggagaggaggttggctaatgctcaatacaagagaaacttgaccaataatgacattcccgggattgaggattctaatgctggggagtcaatcaagccccatggcaatctggatgacatgctaggtcgttcagctggccttcctcaatttgataataagaactttgttgatgaacaaaattccagtggagacagccaaccttcatttgctagcaatacttcacattttaacaatgtgaaagggagctacagtagtactgttcctcccattccattgtctgcagatgcactttcccaaaagtccgagaacttgttagcagaggagagcaaaaaggtggtattagacactgatgttggatatgctagttcgggagacagttcacaactttctaataattctaatatcacagaggacagggagaaacagcaaggtgaaaaatctgagaggtggtttagaaaggttgctgagctgaatgattttccagatataccaagtgcaatatctgataaggacttccctgaaataatgcccatgcgcaaaggagaaaatcgatttgttgttagcaagaaaaaagatcgttctttgacaacaccagcatataagagacgagcggccatggagcaatctggcaaaaccaactttgtcccctttgttcccttcccccctgattactttgccaaaaaggacaagcagcaggcagatggaacagattcaacagtggcagatgcagctgcttcgacggataggtctgatgatgatacatcttccatatctgaggtggcgcagaagcctccagagatgtcagttgatgctagagctcaacctggacagagtccaaatccttctgaacaaagctcaaataacaatgatgttggttctatgtatggggaaacaaccagtggaaattcaaggcagagtttcaatcaagatcgtgttccgaatttgacagaaagttcatccccaggtccagcatctgagaaccagagtggtagagcagagtggacaggaaagagtttggaggggtcggcagtgaaggacccagatcctttggacatgtcagaggaggcaaaggctgagagatggttccgtcgcgtcgcacagattaaggatatttctgagctcagtcagattccagacgaagattttccttcaataatgcctatgcgcaaaggggtgaacagatttgttgtaagcaagaggaaaacaccattggaaaggagattgacgtctcagcagtacagaaggaatcttccaactgtgagctcagatccaattaataaagaaaatgaaggtagctga

SEQ ID NO: 86452 - DNA, 322 bp, Glycine max
  Peptide Sequence Number=SeqID_203230
atgtctctagcagtagcagtttcctcaccaaaatggctgaccaattgtgttcaagcactcacctcaattctatgttgtgttgttttcctcatgtttgattttcttgatgctgttttctgcgttatctatagattccttgatgaacgcgttgaaggggaggcttccccttgttgctgttctaaccgggaaatgctgaagaggaggatgaatgtgacagatgatgatggtctatcagatagcttgtatgagaggaaaaacacttttagagaaatggggttccttcaatttgggagaaaatgtgaagattccaatagaaaacatg

SEQ ID NO: 86453 - DNA, 891 bp, Glycine max
  Peptide Sequence Number=SeqID_203231
atgacgctcttatcctctcccctacttgttttctccgccgtccaccgtcgtgctcctccgccatccaccaccaccccaaccacaaaccacactgtccggtttctgtgttctcccgacgtgccagctgtccgcttggatcaaaggttgccgcgctttgttgtccccgtcgcagcagaagatctgctctacaatgccggagccaccgtcggcgttctcggcggcggttacgctctcgtccgtgcctttgatgaactcactcggagaaacatcctccaacaggatagcaactcccctaaggctcgctactttgctgcttttgttcctctggtcaactgcttgaggcttttggtcaatggtctgtcactcgcttctgatgagggactcatcaaatctgtgaccagagaaggagatccactagaattgctaaggggtcccctttattatgttctgatactgattttttgtgctcttgtgttctggcgtgagtctccagttggtgtggtctccttggctatgatgtgtgcaggggatggtatagctgatatcattggtagaagatatggatccttgaagattccttacaatcaacataagagtttagctggtagcatgtctatgcttgtctttggattcttggtttcaattgggatgctctactactattcagttctaggacatgtgcagttggattgggcaagcactgtgcccagagttgcttttatttctttcgtggcaacattggtggagtcccttcccattactaagtctaacacactgataccaaatctccttgaaaattacttccaaatccaagaattggatccaaaccagtggcttaatataagactagttatgatctacgcaagcagatttttcatggcagagtattga

SEQ ID NO: 86454 - DNA, 276 bp, Glycine max
  Peptide Sequence Number=SeqID_203232
atgaccattggacctgaatcgggtcatgcccaaaggaggaaacacgtcaggtcaattagtgacccactggttcaaccattgatccaatatcttgacccgatcaatcaccggttcaattttttaaaattatggacggtggtggggtggaataatgataacgatggggacaacgacaacggcgacaatgacgatggtggtggaagttgtggtggaatgattgcgatggaggtgacaatgacgaaagtagtaacaatggtactagttgtggtggaatga

SEQ ID NO: 86455 - DNA, 1236 bp, Glycine max
  Peptide Sequence Number=SeqID_203233
atgatatctactagcaagatttctgatttctatgtgcagaaaggtcgtctatcagaggatgaggcacgattctatgcagctgaagttgttgatgctctcgaatacatacataatttgggagtcatacatcgtgatattaagccagagaacttattacttacagctgaaggacatattaaaatagccgattttgggagtgtgaagcctatgcaggatagccaaataactgtccttccaaatgcagcatcagatgacaaagcctgcacttttgtgggaacagctgcttatgttcctccagaggttcttaattcctctccagcaacttttggaaatgacctttgggcacttggctgcacattataccaaatgctttctggaacttccccttttaaagacgcgagtgaatggcttatttttcaaagaattatagcaagagatcttagatttccagattacttttctgacgaagcaagagacctcattgaccgcctgttggaagctagaaggtatacttgtaggctattggataatagacatagggtgtatttgatgcacattgaaggacaagatttggaccccagcaggagaccaggtgctgcacctgatggttatgctattttaaaaaggcacccatttttcaagggggttgactgggataacttgagggcacaaattcctccaaaacttgctccagaacctgggactcagtcgcctgtggctgatgatgttcatgactcatcttggagtccttctcacattggggatggttctgcagcttcggttagacaacctgatggtgctacatcttccgaggggaccggtcacataactaggctagcttcaattgattccttcgattcaaaatggcaacaatttttggaacctggggaatctgttcttatgatctctatggtgaagaaattacaaaaactaacaagcaagaaggtgcagctcatccttaccaacaaaccaaagttgatctatgtggacccatcaaagctaattgtgaagggaaatataatatggtctgataatccaaatgatttaagcatccaagtggctagtccatcaaatttcaagatttgcacacctaaaaaggtaatgtcgtttgaggacgcaaagcaaagagcatgccagtggaaaaaggcaattgaaggactccaaaaccgcccgtggttagaccgtgaagcaatcttgaaatttcaaatggattatttggcccttggcaatctgtaa

SEQ ID NO: 86456 - DNA, 155 bp, Glycine max
  Peptide Sequence Number=SeqID_203234
atggcaagaataaacctcctagcacaagcattatgctttatcttaccacggagaaatgttggggctcggttcaggcggctgcaaaaccgtcttactcttgaagagaacatatttgacctttcccaagacaaggcagtgaaattcctcttcccaga

SEQ ID NO: 86457 - DNA, 531 bp, Glycine max
  Peptide Sequence Number=SeqID_203235
atgggttcggggcagattgtcggcggcggaaacggtgggagttgttgtgatatgagtgtgaaatgttcgtgtaggtggagattggagaaccaacagtactataagcggttattttcttcgggttttgttttcttcttcgggtgtttcgttttgttcggatccattgccaccctctacggttggctcgctttttcgcctacagtgcacacctcactctcttctttcggttgtcgtgacgacaatgagggttcttggtctgttggggttttctacggtgactcacctttctctcttaaacccatagaagctgcaaatgtatcaaacgatgagagtgctgcttggcctgtcgccaatcctgtggtgacgtgtgcttcagtttctgatgctggttaccccagtaattttgttgctgacccttttctttttattcagataataggttcttgttgtcacccttggttccctcctccatcatggagagagaggcttggtgttagaacgtgtagggaaacagtgaaagctaatgcgtga

SEQ ID NO: 86458 - DNA, 642 bp, Glycine max
  Peptide Sequence Number=SeqID_203236
atgatgtctgcacaatcgacttcaaattgggtggcaccgagcgatattgcgttcacacctgcagtcaaagccaggcaggcagaaaatggttcaaggataggctatgcaaaattcgaaaggactcgcggttgggagtctcaggtcacgcccatacttgccgaatttattgccgcgcagacaagcatgtatatcgctacagccaacgcgcaagggcagccttatatgcaacatcgcggcggcccacgtggttttctgcgtgtactcgacagccaaaccctggcgtttgccgactatgctggaaacaagcaatacatcaccgcaggtaacctcgacgaaaacccaaaggcacagctatttttaatggactatgccaatgcacaacgcgtcaaaatctggggagaagccaggatagtgacgggcgaccaggatttaatcaggcgcgtttccttgccggatgatccagccaaggctgagcgggtcgttgtatttacagtcaaggcctgggatgcgaattgccacaaacacattcccaaactgttgcatgtagaagatgtgttacctgcaatccaggaacgcgaccagaaaattgcaaccctggaggcacggttaaaactgctggagaaaaaaatagcagggcaataa

SEQ ID NO: 86459 - DNA, 621 bp, Glycine max
  Peptide Sequence Number=SeqID_203237
atggcggtaaacagcattaatgcctacagtgccttgcaaacgcaaagcacttccagcgtgcaacagctcaagcaaactgtgaatgctcttgattcagcgttgaaatcaggcgatttgcaaagcgctaaagatgcttactcaaaactaagccagctgaaaacgatagacagcaatagtccacttttcacgattgggcaggcgctcaaaaaagacgatattcaatcggctttacaggtaatcaatccggtacaaaccaatgcgactgataagacgaccccgttagcatggcagcaattggccaaactcacagccgggaccaacaccacagagagtactttgtcagcgaataacaaaatttccagcttgcttaattatttagcctccggaagtggagacgctacatcaacctctacaaactacacacctgggatcattaaccaagtgatatctcaaatgaatagcgccagtagcacggtctcattgggaagcagcacgtccgctgaaaccacagagttgtactcccaattggcgcaacaaatcaaaaataatccgcagctgggtgcgatacttgtcgagcgcttgaaagcacaatcctccaatggcgtattcagctatttataa

SEQ ID NO: 86460 - DNA, 135 bp, Glycine max
  Peptide Sequence Number=SeqID_203238
atggcggtgtctgcaaacggcttcttcctaacattccctagcccatcaaaaacacattgtcctcaaggtgttgggtgcataaaacagaacatgagtaaagttgctttgtttgtgggcttgtttgagtcaagttga

SEQ ID NO: 86461 - DNA, 144 bp, Glycine max
  Peptide Sequence Number=SeqID_203239
atgggtgcccccgctgtcgacgtcaacttggtcatcgtctctgccataagtgatatttggcatacccatatacttggcactggtgagtggaaggaagacggcgttagtgttcaatggttagaccctcttgggtatccgacatga

SEQ ID NO: 86462 - DNA, 306 bp, Glycine max
  Peptide Sequence Number=SeqID_203240
atgagtgacatgttaacaacatttacgaagaagaaagaggtggataccatcatcagagacacctttgataaagtcgtggtcctccgctttggtcgtgcctctgaccttgtctgtctccagcaagatcacattctttctaaagcagcaagggatgtgtccaagtttgccactgtggcactggttgatgttgactctgaggagattcaagtctatctcaagactgctgatcatactaaatggattggtgctttttacgcaaagcaagacttcgtagatgttgtagagggtattcatgttgatttttga

SEQ ID NO: 86463 - DNA, 333 bp, Glycine max
  Peptide Sequence Number=SeqID_203241
atggtagcatgcagcaagcttcatgtgcttaatgattctcagacaatgcaagggactagggttaatgtgttgaactatggtgcaacagttgaaattgttttccaagggacaacaaaccttgttggagggacagaccatcccatccatctccatggctacagtttccatgttgttggatatgggttaggcaattttaaccaaagcgtggaccacatgaatttcaatcttgttgatcctccttatttgaatacagtggttgtgcctataaatggatgggctgccattagattcgaggctgtaaaccctggtatgtggcttggaataccatcttaa

SEQ ID NO: 86464 - DNA, 420 bp, Glycine max
  Peptide Sequence Number=SeqID_203242
atgggagaacaaggaaaggctctgattcacctaagtgaaaacttatggcctaatgagtctctgattctaatgacttccgcccctcgtgtttacttcgactttacttccctcgatttccccaacaatctatatattcatgctaaggacgtaagcgaaataagtggggaagtagggatgatgttgtttgctaagacagcaattgtcgtgcttggagatttagctgatactttgggcagtaatactggccccttgattcagcagaaggcggaaaaacttttgacacaaacagattctgttcataaggagttcatgccattgcaagaagaggcagagctcacccaggaggagatcatgaataagtggtttactgaggatgtctttgttgaagctgcagaggaaggagactttaagaaggattag

SEQ ID NO: 86465 - DNA, 270 bp, Glycine max
  Peptide Sequence Number=SeqID_203243
atggagggtgatagcgttacattcatttccaatcctgagacctatgaattggagagtgatagttttacaaaaatttcctctcctgataacggtgataagtctaagacgattgtgatttcattgtctaagtatgccttccctctattggttccaaagggtgcggtttgggtagagggagataacaagtataacagcaacgattcaagaaaatttggtcctgttccttttgaccttattgatggcaagatgttctggaataatgccacttaa

SEQ ID NO: 86466 - DNA, 225 bp, Glycine max
  Peptide Sequence Number=SeqID_203244
atgtcgttgggtggggaaatgctccaatatccacgaccttctaccatcatcaaaaaggagaagcgttgcaaatgtcatcgcattgaattcgttgaccgtggtggtgtttggacatgtgtaggggtgtgcgtagtggttttggtatttggcgagtggtggtggtgcacagcatggaggagacggggtaggacagtcccacggtgcggaggtggtcggcggtggtga

SEQ ID NO: 86467 - DNA, 1296 bp, Glycine max
  Peptide Sequence Number=SeqID_203245
atggtaagcttggggaaacagtttttctctctctttgttttatctctattctgtttagggcttccacgtacggttgttgacctcatcttttggtttcagacccaaggtaatattgcaaaatggaggaagaaagaaggagaaaagatagaagtgggggatgtactatgtgaaattgaaactgacaaagctacactagaatttgaaagtcttgaagagggatttttggctaagatattggtacctgaaggttcaaaggacgtgcctgttggacaaccaattgcaataacagttgaggatgaaaatgacatccaaaatgttcctgcttccgctgggggtgagaccagggttgaagagaagaaaccaacacgtgaggatgtcacagatgagaggaaatcagaatcaacttctgctataattaatgcatcagaacttccacctcatgtccttcttgaaatgccagctttgtcaccgacaatgaaccaaggaaacattgctaaatggaggaaacaagaaggagacaagattgaagtgggcgatatattatgtgagatcgagacagacaaagctacacttgaatttgaaactcttgaagaggggtacctggctaagatacttgctccagaaggttcaaaagaagtggcagttggacatcctattgcaataacacactggagcatatcaaaatacttacgctacctgcttttctacaaggttgaagatgcaagtgatattgaagctataatgaactctgttagcagaagttcaacaaaccaacagaaggctccccaacgtgacactaaaagcgaggccaaagctcagaaaaacaatataatacgaattagtccagctgcaaagttgctaattacagagtatggattggatgcgtcaacattgaatgcaactggtccttatggcaccctactgaaaggggatgttctttctgcaattaagtcaggaaaattatctccaaaacctgcttcatctaaagaaaaggtatcatcatttcaaagtcatcaacaagttgcagcttcccaagagtcaaaatctgacttaaagctgtcagatgcttatgaagattttcctaatagtcaaattcgcaaggtgatcgccaagagattattggactcaaaacaaaatacaccacacttgtatttatcatcagatgtcgtactggatcctcttctttcccttcgaaaggatcttaaagagcagtatgatgttaaagtttctgtgaatgacattattgtcaaagttgtagctgctgctctcagaaatgtaccagaagcaaacgtatag

SEQ ID NO: 86468 - DNA, 306 bp, Glycine max
  Peptide Sequence Number=SeqID_203246
atggcatgtattttcgcctctaaaactgaggaacacgtcataagtgcatccactaaggatggtgctgcctgtgggacaggcagtggacagtcagagatactgagagaagccaaggagttaggaaaaccctgtccaggtagagactctagattttggcatccttttatttctctgtgtctgagtgctgtgaacagggataatggaaaggatgaaagactgtcacaacaactgctttctatgtgcaaatgcttacgtgcccggaaaggactccagagatggacaattgcagatgaccaattcccttag

SEQ ID NO: 86469 - DNA, 612 bp, Glycine max
  Peptide Sequence Number=SeqID_203247
atgatacaacttctgcgagccccactttacatgggtctcttgaggaggtttcagtcaagaaaccttcttcccaataattattggacagaaggtttcttgactggaactgggcagaatagtggtggtaacatagattttaccatgcatgacatggtctgtgttttagccttgtttgtatctgcaaaaatttatcctatctttgacagaaatgatgagagcattgaaacttctttcttgatctcaaatctgcaaaatgttgaagaaagttcatctgagctttatggccctctaatggaagaatatatccccttgaaggataatattgacgttggcaacataactcatggccttgaccaacaaactccaaaaattgaacttaattatttatctactactgcaaatgatgctgtccaaactacatttgagtatgggactcatttcgatacactcagaattttggatgcatcacagctagtggaattaccatccgaactgcacagcctcagaattgaagggtgtcactctttcaagtccctgcaagatgttttgatggacagaagaaccaacttctttgaattgtttataattgattgttcttttctcgagtactaa

SEQ ID NO: 86470 - DNA, 426 bp, Glycine max
  Peptide Sequence Number=SeqID_203248
atggacccaggcccaccactcagctcaaacagcccatcttcatcaccatgtgtcgtccttgtgaatctggacccacgtgaagctgctagcggaggccggtgcgaatctggaccattgcgaccaaagcggcggcctcgcggcgctgcacatgggggcaggggagattctgatggtgacgccaaaggggaatccgatgcagttcggactcaggattggactagaaggtgggaatccgagaacggcgtaggatctggcgttggaaggggcagtgttcgagcgaagtttgtggcggaggatttggtgaaatacttccaggctggccttgagtacgacatcactacggcggttcttgcgaaaaggggtcgcggttcatggaattgggatgcagagaggaggccatttttaacaaatagcggcggttattga

SEQ ID NO: 86471 - DNA, 447 bp, Glycine max
  Peptide Sequence Number=SeqID_203249
atgaaaaaaggaaagagaaccggagatttcaggtttatagatattcttagtagtccctttagttgcagagtgcagacccttcatgaaattattccagttcttttgccttccctattatgtttgtttgaacatacgcttgatgaaaacatgctattttggaagatttttcagagtgcctggtttactagtctgagattagttacccaagttgttgacccttgtgagcaggactgtaaaatgtccaaagcttgcattcttgctgtagggagaggcaacaaagttgtggaaccagtaattggaactgatggaattgagaagccatcaattgccactaagttgagcttaacattgtctgctgatcatcgtgtttttgatggcaaagttggaggtgcatttctctctgctttgcaatcaaacttcagtgatataagacgactgcttttataa

SEQ ID NO: 86472 - DNA, 794 bp, Glycine max
  Peptide Sequence Number=SeqID_203250
gggaaatttgcacttgatgtagttgtgaaaactttggaactatacaagggttactttgccactccctactcgctgccaaaattggatatgattgcaatccctgatttcgctgctggagccatagagaactatggtttagttacatatcgagagactgctttgctatatggtgaccagcattctgctgctgcaaataaacagagggttgcaactgtagtagctcatgagctagcacaccactggtttggcaaccttgttgcaatggagtggtggacacatttgtggctgaatgaggggtttgcaacatgggtgagctatttagccactgatagttgttttcttgagtggaaaatatggtctaaatttcttcatgaatctactgagggtcttagtctggatggacttgcggagtcccacccaattgaggtagagatcaatcatgcttgtgagattgatgaaatatttgatgcaataagttatagaaaaggtgcatatgctgcactcgaggaaggatttggtgaaccagtgaacaagttaatgacctcatggacaaagcagaagggatatcctgttgtatatgttaaagtcaatgataaaaaattggaatttaatcagtcgcaattcttgtcaagcggtgctcaaggagaaggccattgtaacatcctggaaattctacccggaattttcgaaaacgattactttcaaaaactggccccgacggacgcagagaaacgcgagaaactggaaccagagaaatggcacgcaacccgaggcaggattttagcgtttctaag

SEQ ID NO: 86473 - DNA, 1401 bp, Glycine max
  Peptide Sequence Number=SeqID_203251
atgacgccagaacgggtgatcctgcggcagcggctcgcgggcgaacacgtccagcgtggcggcggccagttgcccctgctccagcgccgccagcagatcggcttctaccaggtgcgcgccgcgcgcgatgttgatgagataggcgcccgaactcagctgcgcgaacagctcgcggttgagaatgccgacggtctccggcgtattgggcagcaggttgatcagcagtttgacgccgtcgaggaaggcggcgcgctgcgcctccccggcgaagctttgcacgccatcgatctgtttggcgctgcggctccagcagcgcacgctgaagccaaactcggtcagcttgtgcgccacgctctgccccagcacgccggcgccgaggatgccgatggtgaaatcatccagcgacgcctgatactcgtcgaaacggcggaaatagcgcagcacatagctcagcgcgtattcctgcatctgctgcgccatgccggtatcctccagccgcagcagcggcacgccggcaggcagcgtgccggggtgtttgcgctcctgatcgaggatcgcgtcgacgccggcgccgagggcgaacaccgctttcagatcgcggcggttggccagcatctcgtgcggcgggcgccacaccagcgcgtaatcggccggccgctcgtcgccgcgctgccattcgcggatctcggcctgcggcaggcgttgcttgataccggccagccattcctgggcgttaaacaaggggtgcctttcgcgattcgccgccggatgcaagcgttaaagcccaaaataaaaacagccccgaccagtggggctgttgtgcatgttagccaatcaggcggcagttgggccgtcgcgccggataaggcgccgcagcagcggaatgagaatcagcatcgccacgccgacgcccgtcgccccccaacccagcgcgctgaagatttcgctgtagccggggttggtctgcagcggcgtgctgccgctgttttccggcatcaggccggagacgtagcccgccagcaccgaggcgacgccggtcaccatcatccagcagcccatcatcacgccctgatagcgcggcggcgccagcttgccaatcatggcgtaaccgatcggcgagatcatcaattcaccgacgctttgcagcacatagctgatgacgatccatttaaacgccaccagcccgtcgccgcccgccatgctgatgcccagcggcagcaccagcatgccgagcccgatgcagaacagcgatccggagaactgcagcggaatgtcgatgttgcaaccgcgagcgcgcaagcggttgaaccaccaggccagcagcgggccgcccaccacgatcaccagcgtgttgatgttctggatccactgcggcgccacctgaatgccgtaaacgttcag

SEQ ID NO: 86474 - DNA, 831 bp, Glycine max
  Peptide Sequence Number=SeqID_203252
atagccgggatcttcctgggcgatgcgatcgatctcctgcccgcgatacttgccgaatttgaacttcttcagcagcaccggttgttcggtgatctgcaccatttgctccggcgtccagcccgaatccttgatgatgcgttgcagcagcgcggcggtgacgtagcagtcgtacagcgcgcggtgcgggtacagcgtggcgtctgccggcagctgcacgtccaggttcagcgcgtagcgcaaatactggttgccgtacttgatgtccggatacagcgtgcgcgccagtttgagggtgcagatccaggcgccgttcatctccggcagcacgccgcgatcgaaagcggcgttgtgcgccacatagtaggggctgccctgatagcggccgatcgccaccgcaatgcgcggtttgccttccaccatttgttcggtgatgtgatgaatcgccatcgcgtcgaggctgatggggcgatccgggctgaccagatcgctcatcgggttggtcaattggccgtcgagcagatcgagggaggccacttccaccacgccgccgtccagcccgcaggtctcggcttcagcttaaccgccgcaggcggccgtgccaaccgcccccaggttgtaggcaataaaaaacccgccttggcgggtttaatgacggatggaagggcgcttactcaccagacggatgcgcttttttggcgcgtttctccgcacgttctcagctggggttttcaacggcttcttcttcgcattctttttgctatccattcccttactcatgatggcctctcgttacctatgattgggtggcttgctcagccattaaccgcctaa

SEQ ID NO: 86475 - DNA, 2416 bp, Glycine max
  Peptide Sequence Number=SeqID_203253
atggcagaagcattggttggcggtgctcttctttctgctttccttcaggttgcatttgacaggttggcttcacgccaagtggtggacttctttcgcggaagaaagctcaatgaaaagctgctgaagaagctgaaggtgaagcttctgtccataaatgctgtggttgatgatgcagaacaaaagcagtttgagaattcatatgtgaaagcatggcttgatgaggtcaaagatgctgtgtttgatgcagaggatctgttggatgaaatagacttagaattctccaaatgcgagttggaagccgaatcccgggccggtactagaaaggtacgaaattttgacatggaaattgaatcaaggatgaaacaagtccttgatgacttggaatttcttgtaagtcagaagggtgatttaggtttgaaagagggcagtggtgttggtgtgggattgggtagtaaagtgtcacagaaattgccatcaacatctttggtggttgaaagtgatatttatggcagagatgaggacaaagaaatgatctttaattggctcacatctgacaatgaatatcataaccagctatcaatactttctgttgtgggcatgggcggggtgggtaagactacgcttgcccaacatgtatacaatgaccctaggatagagggtaaatttgatatcaaagcttgggtttgtgtttcggatgattttgatgttttgacagtaacaagagcaattcttgaggcggtcattgactcaactgataatagtagaggcctagaaatggttcatcgacggttgaaagaaaatttgataggcaagagatttcttctcgttttggatgacgtttggaatgaaaaacgagaaaagtgggaagctgtgcaaactcctcttacttacggggccaggggaagtagaattcttgtcacgacgcgcactacgaaagttgcttctaccgtgcgatcaaataaagaacttcacttggagcaattgcaagaagatcattgctggaaagtttttgctaagcatgcattccaagatgataatcctcggttgaatgttgagttgaaggagattggtataatgatagttgaaaagtgtaaaggattgccgcttgccttgaaaacaattggaagtcttttatacacaaaggtatctgcctcagaatggaaaaatgtatttctaagcaagatatgggacttacccaaagaagataatgaaattatccctgctttattattgagctatcaccaccttccttctcatctaaagagatgctttgcttattgtgccttgttctccaaagatcatgagtttgacaaggacgatttaattatgttatggatggctgaaaattttctacaattccctcaacagagtaagcgtccagaagaagttggtgaacagtactttaatgatttattgtcgagatccttctttcaagaatcaaggagatatggaaggcgctttatcatgcatgaccttgtaaatgatttggctaaatatgtttgtgggaacatctgtttcaggttggaagttgaagaagaaaaaagaataccaaatgcaactcgtcatttttcatttgtaatcaatcacattcaatattttgatgggtttgggagtttatatgatgctaaaaggttacgtacttttatgccaacaagtgggagagtggtttttcttagtgattggcattgtaagatatcgatacatgagttgttctgcaagtttaggtttttacgtgtgttatctttgtctcaatgttctggccttactgaggtgcccgagtctttaggcaatcttaagcatctccattcattagacctttctagtactgacataaaacacctaccggattcaacatgtttgctctataacttgcaaacactgaagcttaattattgttacaatttggaggagcttcctttgaatttacataaactcaccaatttgcgttgccttgaatttgtgtttactaaagtgagaaaggtgccaattcatttgggaaaactgaaaaatcttcaagtattgagttcgttttatgttggcaaaagtaaggagtccagtatacagcaacttggagaactcaatcttcataggaagctatcgattggggagctgcaaaatattgtgaatccatcagatgcattagcagcagattttaaaaataaaacacatcttgtggagctagagttaaattggaactggaatccgaaccagatccctgatgatccaaggaaagacagggaagtactcgagaatctacaaccttctaaacacttggagaagttgtcaattaagaactatggggggcttgatgggatagtgaatattgatgctaatttttatgggagtagctcttcttcatttacatccttggaaacattgcacttctccaacatgaaggaatgggaagaatgggaat

SEQ ID NO: 86476 - DNA, 1308 bp, Glycine max
  Peptide Sequence Number=SeqID_203254
atggtaaccttcaatctttccgtcgagccgaaacccttcaccaatgacgtggtgatcatctccgataaagacacccggtggggttttgggggcactctcctcaaagcttttcaactgtgtggtttccgtgcagtcttagtcggggctggtaatgagctaggaagaaaggaaattgaagaatccatggttgttattcctgtcttctccatggaccttgtatcctctccagatcacttggaggaacttgccacggtggttgatgagaagaggatgtgtcaaatgtttctgccttttctttacaagctggaactcaaagatgtgcgatatctgatgggtggaaaactgtttgagaaattttacgaggttctgactaaagtgactgatttgactggctttcgtttcggggatggagttacatatgaataccagtgtgtcgaaaagattgttcaagtgagcgctaaacacgctgcttccacgattggagtaattcctcgagtgacggaagcgatgttgcttttgtctcccgaatctgacaatggagtcaacgtggttggagttgttggaccaggaaaggaaacaataactcgtaaggtttatgaggtaattgccccaagttttcctgctcattgctttcttcctgatgtgggagaaaaaattagggaacatgggccggaatatctccaaaacatgcttgggccttatatgcttggaaattcccaggaaggagtgccatttataaggcatgagaaggttcttgcagttttggattgcattgactctctggattcgttgaaagctgctcttggacttactcctcgctttgctcctggaagtcaagtcttcattatagctccagatataactttgcttgaaaataatggaattgaaaaggtatatgaagtaaaggggttagacaagacatcggcttatcaagtgctttgcctagaggctttcagttccatgaatatgagtttcaaatacatggacatcataagccgtgctgaaacttgtgctgatggcaatccttgtgctttgaaagctattggttccagttttcgtggaaaaacaatagcggaatgcgagattgcattagatgaatataaaagaattcattattctgaattgatagagagcatgattggagaaaacaattggatcccatcgttcggggatatttcagaagagtatacggagtatgacatgccagatgtcgaactagcctcagatgatggaagcgggatggggaattttctgggatcctctaccctcttgtcccaggcaaacatgcaagatgtcgaagcagcctaa

SEQ ID NO: 86477 - DNA, 1824 bp, Glycine max
  Peptide Sequence Number=SeqID_203255
atggctcaaggagtaagggttgaattctggggatcgctcgttcgtagaggctttggtattataccgaggattaggataacacttgcatgggatggagagtacctccctgcagtccgtcccttttgtacattatttccctgtccccattcctgctccccacaaaggggaaagctatatattgttgatgcacggcctaggaaaaatgcattggctaatggtgccatgggaggtggttcagaatcatcatcaaactattttcaatccgagatagtctttttggggatagacaacatccatgcgatgagagagagctttgttcggctccgagaatacatggacactcatggaagaacgtcatcagatggaatgtcctcttttttgagacaaggtgggtcaacatggggtggtggcaatctaagtagtatgtctgcttcggtatcaacccttggggacagtggatggttactacatgttcagaatgtgttggctggtgcagcttggattgctgctcgtgttgcaatggaaaatgcttctgttcttgtgcattgcagtgatggatgggataggacaagccagttggtttcacttgctaatttgttgcttgatccatattatcggacattcacagggtttcaggcactcgttgataaagactggcttgcttttggtcatccattttctgatcgggtgggaatgccatctgtctctggaactggcaatgtgcctttcgagttatctaggcagtcttcaactagcaatttcccaccatcacccatgcgccagtcatcagggacttttgtgtcgcaacctccagcttcatctcactcgcataactcaaacaactattctcccatttttttgcagtgggttgattgtgtttcgcaattattacggatatatccttttgcttttgagttttctgcggctttcctggtggacttcgtagactgcatgctttcttgtcgttttggaaacttcttatgtaacagtgagaaggagaggcagcaattcaatgttttcgaggcatgtggatgtctgtgggtatacttggctgatttgcggacatcatcaggaggttcccatgtgcattacaatcccttttatgatccactgaagcatagtggtcctctgttgcccccagcagcagcattagcccctactttgtggccccaattccaccttcgttgggcatgtccagaagaagctcaagctggggagattgaagcacaatgcaggaagatagttatgaaatatgctgagatgcagaaggtggctaaagaaatggcagaaaggaaagctaaagaagttacaaattccatggagtcgttgaatgctgaattacgacgtgagaagcagctaaacagctcagctatgaacatggccaagagtatgagcaaagaaaatatggccataaagcgtgcaattcagtcaatggggtgcaaggttcatgtctctggtagtagtggtgaatgcattgttgatattgaaagcaacccagacattctgtgttgttcctctaggaaagaatcaaatagtaatgtgcgtgatgacaaaaaggatatgtccgtttcagtagtgattacagcaggtgatgatgatgatggaaacaatgcaattggtcgggtatgtgaaaccctatgcccatttcgctttggagatggtcgggtatgtgaaaccctatgcccatttcgctttggagatggaggctgcaggtggccaaatggtggttgtgctcaactaggtagccagtatgttggcctgaaggcaaattttgatgcatttgacaaactatcaattgatgatagttatttcaagtctgagtga

SEQ ID NO: 86478 - DNA, 303 bp, Glycine max
  Peptide Sequence Number=SeqID_203256
atgagcagaaggagcgatgaaactgcggctcagcaagagggtccgaagcctagccgtgtacagtttccgaaaacccaagtggcggtggttgcttcttcgcctctgcaagctgaacctgatgctgaccactctcccgctgctaagacaaccaatcctcttatactctggcagatttatgcaataggagcgattgcgatttcatcatgggtttgggcaagatggaatgagaggaagggccgaggtggggggtctcccaatgatgagaggggtgaaggaaggcattctgatgatggaaatcagtga

SEQ ID NO: 86479 - DNA, 222 bp, Glycine max
  Peptide Sequence Number=SeqID_203257
atggaagtgggatgtgacttactctctttgacctctcactgttctctagatgataggttaacagggatgtgggggcaaatggctaggatggtgaaacttccttcaacaagggaggtggtaggcgagagggagattaatagtgataggtcaaatgggaggccaaatggtgatgtcacttgctgcatcaggcatcagctaaagggatgcctcagaacactttag

SEQ ID NO: 86480 - DNA, 1416 bp, Glycine max
  Peptide Sequence Number=SeqID_203258
atgggaactgttacacgcagctcctctgaagtgtattcaagtgacagtgaaaaggggtttgcgatgaaccactctacttctacttccccagagctagatgcaggggcaaagtttgttcttgtatctcgaggatcatggttgcactgtgggtaccatttgactacatctattgtggctccggtgcttcttactcttcctttctccttcactttgttgggttgggttggaggagtgctttggttgacccttgcagcagttatcacattctattcatacaaccttttatctgtggtcttggaatatcatgcacagcttggccgtcgccagctacgattcagggacatggctagagatattttaggacctggatgggcaaaatactttgtaggccctcttcaatttgctatatgctttggcacagtgattggtggtcctctagtgggaggaaagagcctcaagttcatttaccagctctacaacccagagggatcaatgaagctttatcaatttattattatatgcggggtcataacactgattttggctcaacttccatcctttcactccctgaggcatgttaatatgatttctctaattcttagtgtgttgtatgccacatgtgtcacgatcggttctatatacattggtcactccaaaaatgcgccaccaaggcattattctgtaagaggttctgatgctgatcaactctttggtgtgttcaatggtatctcaatcattgctaccacatatgctagcggaatcattccagaaatacaggcaacattggcgcctcctgtgaagggcaaaatgctgaaagggctatgtgtctgttattctgttatagccaccacctattttagtgttgcaatctcaggttattgggcatttggtaatgaatccggtgcatcaattcttgctaacttcattggtgagacgaagcctttgcttcccaaatggtttttcttgatgactaacatattcatccttctacaagtgatggcactgactgcggtttatctgcaaccaacaaatgaaatgtttgaaacaacttttggagacccaaaaatgggacaattctccatgcgcaatgttgtgccaagggtggtacttcggtcactatcagtggcagcagccacggttttagcagctatgttgccattctttccagatataatggctttgtttggggcatttggatgcattcctcttgatttcattttgcctatgggtacttcatttcaacatggattcgggcaaggtggaatgagaggtagggttgaggaaggtctcccaatgataagagggctgaaggaaggcattctgatgatggtagtcatccatcttcaaggaaatgggatgaatagaaattctcactggacacagtgctatgtcaatactctcaaattctctgtatga

SEQ ID NO: 86481 - DNA, 237 bp, Glycine max
  Peptide Sequence Number=SeqID_203259
atgtattggcgggaaaagagtgatcaggttcagcgtggagaggtgccaccacaacgttggttatgggaaaccgaacgacgctgggcttcggattccgacgccgaaaaggacaaattattccatgaaaatcaccgcgctttcaatttcagtgtttttggtcattgtcgttcttttttctcaagcgtcaaggagatagcaatagctatggaaatcaaaagcggcatgaaattgaactag

SEQ ID NO: 86482 - DNA, 1242 bp, Glycine max
  Peptide Sequence Number=SeqID_203260
atgacggaaatcgttacagcctccgtcataacgtcgtctctgattcctccgtcacaaaccctaaccctaaccctaactaaccctaagtccctaatccctctttctcttggtggtcaccgaagctaccctctcctcgactatccctcccacgcgcagcctcacctccacgctcccacgcgccaccacttcctttcctcctcctcctccagtcccaccactctccccgccgccgacatcgccaccgccgactactacccacacgcctcctccttctccgacgactccgccaaatccaactccaaacgcgcctccgccgccggcagcccctactacaacaagaagctcaaatccaccaccgattcggttccagcgaccgattactcgaaggaccgcgaagaatggagcgacacggcgatcgcgtgtctgttggaggcgtacacggagaagttcaacttgctgtaccgcggcaacctccgcagccgcgactgggaggaggtggcggaggcggtggggggacggtgcggcggagaggggaagcatcagaagagcgtggagcagtgtaagaataagattgataatttgaagaagagttggttgttcaaggcatgctatgctgtaagacattgggatggccttcttaccattagtgataaatttgttggcagatatgcacctagcaacgctactgtggcaatcaacctcaaattgaagccggcatcaaatctgaaatggcatagagttttgtttaaaattagtggctctgcattggctggaaactgccagaacattgaccccaaggtggcaatgcagattgctagggaagtggcaacaacttgccgccttggggtggaggtggccattgttgttggtggtcgtaacttcttttgtggagatgcatgggtgtctgctaccgggttggatagacctatggcttaccaaataggtatgatgggaacagttatgaattctattttgcttcaatctgctttggaaaagctgggtgttcagacacgtgttcagaatacattcttgatgccagaggttgctgaaccatatcgcaggcaacgagctattagacatcttgagaaaggaagggtcatatttggtggtgttggtgctggcactggaaatccacattttaccactgatacagctgcagctctcagagcttctgagcgtatgaccttgcacttccacttaagcatcgcatctttagttttgctgtttttatgtcagttctaa

SEQ ID NO: 86483 - DNA, 144 bp, Glycine max
  Peptide Sequence Number=SeqID_203261
atgattccactaggagtgattttagccattcttgatcctgtgctcattgctgtttccaaaagtgctcctgcgctcattgctggaaactcatttgtgctgaaacctccaactcagaagatccagctagttcttgcctcccattaa

SEQ ID NO: 86484 - DNA, 186 bp, Glycine max
  Peptide Sequence Number=SeqID_203262
atggaacgcgaccaccgatggcaggcgagtggaggggagtttgagccaattacaagtggcgaccatggtggggtagggggagaaggtgtgaactttctttttgccgtcgttgaagccacccgtttggacaagggtgtcattgggtgcttgggtgcaaggaagaaggagaggaggtgtcaaggctaa

SEQ ID NO: 86485 - DNA, 303 bp, Glycine max
  Peptide Sequence Number=SeqID_203263
atgactcatagtcacgatcagagtcagtcattatcactcaaccctaagaagcttacggcacttgtcctaaggttgaatagttgtcgtcttctcaaatggagctcgcatccacattccttcactgtcgtcgactcaagtggagatcgtgaagccatagcttttgcgtcatgctttggaattaaatccgcggttgtaggaggatcctcaacaacaggcatctcttatcgctgcctacgggcagatgcggtaggccttcgccgttggggcatcattatcatcgtcactagcctctttccttcctag

SEQ ID NO: 86486 - DNA, 195 bp, Glycine max
  Peptide Sequence Number=SeqID_203264
atggcgtggagacttaaagctttcctcctacctcgatcagtgagcacaagttccccaaacaaagaaacaaagaagaagaagaagaagacaacaaagactaaggtccttgcggttacaaagaagaagaagaagaagttgtacctaggtaacgtggctacgagtcatggtcgcgaagaagctgtacaaagaacctga

SEQ ID NO: 86487 - DNA, 1545 bp, Glycine max
  Peptide Sequence Number=SeqID_203265
atggttgatcttcactctaaccaacttcgtgggtctattcctaatttcgtaagaggtgctgtccatttggacttctcaaacaataaattcagctttatcccacctgacattagagagtctcttcgtttcacatatttcctctccctctcaaacaatagctttcatgggaaaattcctcaatccttttgtaattgttctattctaaggatgcttgatctttcccataatagctttaatggctccatgcccgagtgtttgacctcaagaagcagtactataagggtattagatataggtggaaacaaactaacaggttccatatctaatacaattcctagttcgtgtaacttaagattcctaaatctcaatgggaatttcttggggggtactattccaaagtctctggtcaattgtcaaaatttagaagtcttgaacctaggaaataacatgttgagtgatagatttccatgcttcttatggagtatttccacccttcgagtgctgattttaaggttaaacaaacttcatggccccattcaatgtcagcataacattggtaattggaagatgcttcatattgtcgatcttgcctacaataatttcactggtgcaataccacaaacacttctgcaaagttggatagcaatggttggtaatgaaggtgaagcacaacaaaagtctggcaatttattttttgacttgtatgatttccatcattctgtgcgttaccaggatgcactagcttctcttgacaaaattattgtgatgagattagcccaagttgtagcaactataccccctttggcaattgactccatgttctcatattttgtaaatgcttaccaattgcaatttgggggagcctacttggattcagctactgttgtcaccaaaggcttgcagatgaaatttgtcaaaattccagccatctttgcttcattagatttctcatcaaatcattttgaagccccaataccaaaagagcttatgagttttagagcattgattgttcttaacttgtcccataactctttttcaagccacataccatcatctttgggaaatttgacacaacttgagtccttggacctatcaagtaactctctgagtggagaaattcctcaagagattgcaagtttatctttcctctcagttttggatctctcctttaatcacttggtggggaaaattccaacgggaactcaaattcaatcctttgaaccagtttcctttgaagggaatgaagggttatgtggacctccaataaccaagaattgtattgataatgatgggtcgccaacaccaccatctctagcttactatggaacacatggctcgattgattggaattttctaagtgctgaattgggattcatttttggacttggattagtcatccttccccttattttttggaatagatggaggctatggtacatcgagaatgtggaggatttactttgttggatttttcctcaactttattttgtgtatcaacaccgtggagagcgaaagtataggtctttacggtggaggcatggttga

SEQ ID NO: 86488 - DNA, 600 bp, Glycine max
  Peptide Sequence Number=SeqID_203266
atgacagaccttgggtttgacaagcctttggagatgcgactaggagcatgtccatcttgggttttgtcgttttgctgttctttgaaaaatagcctccttattgatggttccttgacctcaacaaggatcatggcacctgtgccatatggccttgaggatgactctattgacttcctcctcatgatcgttggtctggggatgttcaacaaaggttacgaggtgcttgacactgagtcttgtcaggaagtcttcagaagcctcatctttgaattgggtgttgttgtcggtgacaatggcgtaagggaggccataccttcatatgagtcaataatgactagtaaatatttgattgctcctggcaaaaggccaaggggagctcaggctgtggagattgttaggagggatgcacgtgttagtcgttattcaacagccaaagaagagaaggttcaagtagctgatgactccctcagcgaggcaaatctgctcagtgacgtacagtcagcccacccagtgaggtcgttgtctcttctcacgcttagcgcgcctagtctcgctaagccaaaattcacttactttcgcttagcgagccagtctcgctag

SEQ ID NO: 86489 - DNA, 582 bp, Glycine max
  Peptide Sequence Number=SeqID_203267
atggagaagagattgaaacctccacttgtactgtcttcattcgattccttgttctccctccacgaatattatctctcaaatccaaacggtggaagcgtgcggattgaatttcgaaccacatatccaaatttcatgaaaatccaacggctaacgaaaccgggatcgtacttttaccgagacagttttgggtttctgcgggaaattaaaatgctacaatgcgaagggttttcctctaagctcagatatgattttgaaattcccaacgatgagaatgttcgaaattgggttgcgaacatgatactcaaatttcacgatgatccaacggtgaacgggttcgagatcgtcatttttctgagacagtctcacttctccaaaggcttgtcaaacccaaggtgggtacttggtgagtctcgcatcgccaaaggctcattaaacccaaggttcgcccttggtgagtctcgcttttctaaaggctcgtcaaacccagggtctgtccttggtgagtctcgcatcaccaaaagctcgaaaaacccaaggcccgcccttggtgatgtagaagcaaagcttccaagattattgtga

SEQ ID NO: 86490 - DNA, 324 bp, Glycine max
  Peptide Sequence Number=SeqID_203268
gtgtggagggggaaaagcatatctcttggatcaaatgggaaaaaaaaattgtcgagaaagagaacggagggctaggagtaaaggatgttgcattgctcatggcattaattgcttgcaaaatgaaaatgaggaaaataattaaggatgacgggagtcatgttgctcgcaatgtaaaggttttctggctgacagcaactgcaaccgcaattttaaaccatgacaggagtctttggtgcaatgttgttgaatcaaaggatgctaaattctggctggagaaccggaatggtgatacagtttttgggctttggctgacaagtatagcag

SEQ ID NO: 86491 - DNA, 339 bp, Glycine max
  Peptide Sequence Number=SeqID_203269
atggaatcgtttatcacacttcatgactatgggttggcaagaagcatagaagtttggaaagatggtgaactggtaggtggcttttacggcctccagatcggtaacgtcttttgtggtgaaagtatgtttgccaaagtaggtgcattaagggtccttatagcagggatcatattattgcctatcgcaatttcgaagtataaactatttcctaaaaaacacatcaagtggcttattttggcagcgatcacggggaattttatcccgatgttcctctttcctattgcagaaacagaagcgcactggtatggaaatttgaaaccacaaaacatcagatcatag

SEQ ID NO: 86492 - DNA, 438 bp, Glycine max
  Peptide Sequence Number=SeqID_203270
atgtcattaattaaaagtatttcaggaatccggggaacgatcgggggaaaagtaaatgataacttaactccacttgatgtggtaaagtttgcttccgctttcgggacctggcttcagaacaataaaaacaaaaaaaacttaacgcttgttataggaagggatgcaaggatttccggtggaatggtttcttctctggtaacagctacattacagggactggggatcaatgttattgatctcggactttccacaacacctaccgtggaaattatggttccggaactgaaggcggacggaggaattatccttaccgcttcccataatccaaaacaatggaacgcccttaaattgttgaatgaaaaaggagaattcatcagtggtgagaacggagcagagatgctggcaatcgctgaaagtgaagatttcaactttgcggaa

SEQ ID NO: 86493 - DNA, 192 bp, Glycine max
  Peptide Sequence Number=SeqID_203271
atgtcatatgacgcagcgattgaggtgaggaaccatgtttccccagagccagaggtggaggacgccggagttgcttcgttggcgaatccaaaggcttgtgacaaattcggaatgcaaaatgattttaaaggttcaaaggtagcaagcaaatctgaaaatgtgagtaaatgtgaaagattttatggcaagtga

SEQ ID NO: 86494 - DNA, 2430 bp, Glycine max
  Peptide Sequence Number=SeqID_203272
gagtcatggatatcgcagattttggggaatgctggtcctggtgatgcttcctccttggtggtttcgatcttgtgtgatgtgttgggtataattcaggtgttgaatgatatgccccttttttacaaggtcattctgggatctcctccggcatcacagctgtttggtgggattcccaatcctgatgaggaggttaggctttggaagtcgttcagagataaactggaatcaatcatggtgatgcttgataagcgttacattgctgatacttgttttgcatggttgagggggtgtgtaagcaagataagtggaagaaatttgattgatgtcgtcggtagtggccaggatctggcttgtgctgagaaatcaataagggagacaatggaaagcaaacaagttctgcaggagagtctggaatggctcaagagtgtttttggctcggagatagagttgccatggagtaggattcgggaacttgttttggaagatgattcagatctttgggatgagatatttgaggatgcttttgttggcaggatgaaagcaatcattgacttgagatttagggagctaacaggtgctgttgatgtgctgaactcaatttctgctataggtgacttttgtaccaagctggaagatgttcaggggtatttgaacagaccttctacggctggtggtgtttggtttctagaatcaaatgccagaaaaactggagttgcttctgggtttaaagtccagcctgaagagagcgaatttcagtattgtcttaatgcctattttggtcctgaagtaagtcgaatcagggatgcagttgatgtttcttttcagagcatctttgaggatcttttaagtttcttagaatctccaaaggcttcccgaagattgaaggatctggcaccatatctgcaaagtaaatgttatgaatgtgtgtcttctatattaatgacactgaagaaagagcttgatagtttatatgccccaacagaaaatggcaaggtgccaacagctgttactgttgaaaaatctcttttcattggacgtttattgtttgcattccaaaatcattctaaacatatacccttgatacttggttctcccagattttgggctaatgggaatgcatctgcagttgggaaattaccaacactggtgaaacaatctcgatttgggtctgattctgctatttgtgatagtccaggaagacaaacaagccttggctctaaaagacaaaattcatctgccgtatctgctttgcttggtgtgagagaaggtgcaagccatgagttggaagaactgaataagaccattggggatctttgcattagagcttacaacttgtggatattatggatctcagatgaactttctgccattgtctctcaggatcttaaacaagatgatgctttatctttgagcacaccttggaggggctgggaggatatcattgtcaagcaagatcagtccgatgagaaccaatcagatatgaaaatatctcttccatctatgccttctctgtatatcatctcatttctatttagagcttgtgaagaagttcatagagttggaggtcatgtacttgacaagaagattttgcataaacttgcatcaaggctactggaaaaggttactggaatctttgaggactttctttccactgcagagagtggtgttcatcaagtgtcagaaaaaggagtcttgcaggttttgttaaatttcaaatttgctactgatgttctctctggtggtgattcaaacatggttggggaattatctagtaacccaaaagcaaagctacctggcagaaggaagcaggaccaaagtttgacaacctcagccattagagaacgttcaaatcaattgttaaatcgtctttctcagaaactggatcccatagactggcttacgtatgagccatatctctgggagaatgagagacagtcttacctacgacatgctgttctctttggtttctttgtacaactcaaccgtatgtacacagatactgttcagaaactgcctactaattcagaatctaatattctgaggtgttctacagttccccggtttaaatacctccccatcagtgctccagcattgtcctctagagggacaaagaaggcctttactccatcatcaagtgaaatctcttcaagaagttcgtggaattcaattacaaatggagaactttctcaaaagataaatttggatgacagttcaagtctgggggtggcggcaccattactgaagtcttttatgcaggttggaagcaggttcggggagagtacttttaaactgggatccatactaactgatggtcaagttggcatttttaaggatagatctgctgctgccatgtcctcatttggagatattctacctgctcatgcagctggtcttctttcatcttttacagctcccagatcagattcataa

SEQ ID NO: 86495 - DNA, 1818 bp, Glycine max
  Peptide Sequence Number=SeqID_203273
atgttctccacacttcctcacaatacatttcccggtaatttcaggctttcaatgatgaactttggaaaacaacttttaggccaagatgagagacaacttgaaatgaacaatacatgggtacccatccccactgagaagctcgttcaactaacatctaatacaccatcagactggccagtgaaccaaatgagaaggccaaattatcaagaaattcgtctacctggaagtgattacatgaaagagaagtcgctgcattattacccaggaccaaatcagaatctccctctgataggacaaacaagtcaaactggagagaacaaaacatttgatggccacttgatgaatagaaacagtgttctagatcacattccaggatcctacactcagccatggcactatgagagcaatggatcaaacagtaataccttggaacaactgctcaagaagaacatatctaatatagattctgctaacaggaatttggatgcgaacaataacatggcagcaagaaatccattgctatcaatgttttatcctcaggctagcagcaatgtgagtgatccctatgcaggtgtacaacgaggcaatattcattcagcttcagacattgtgttcaaagaagcaaatagacttctgtttccaaataagaattctgaaattgatggcagtaactcaaacagcttgctcaacaatgacattcattgttcagtcccaaaccaactggagggcttcttctctgagataacctatggtgattcttaccacaattataatctgaactatgtgccaatagctgaagctggtgtcactgctagttttaccaactctctccaatcggtaccaaaaatgatggatcaactcaaatttgtggacaaccagttttttacaataccagattacatgatagctgaaagcacaagtcaggagaaagacaaacaaaaaacctcagtttctgcaacagagaatgaatttcaggaacattgcgttgggcttctacagcaaattgttgattcatcacctgcagcaatttctacaacatatggggatcaaaagggttctgacaacatctgtggcaagggaagtgacctgggttttgacctgaacaagacacctgagcagaaagcaccccaacgaagaaagcatagaccaaaagtaattaaagaggccaagccgaaaagcactcgaaagcctgcaactcaaaagacacagatgaaggagaatccgcacaaaaagaggaagtatgtccgaaaaactgcagcaacaccacagaccaatgttacagaagaaagtgttgattctattgttgcaacaaaaaaatcctgcagaagagctctaaattttgacttggaacataataaatatgcaagccaaagcacaataagttgccagcaggagattgaccatagaaatgagaaagctttcaataccacttcagaccacaaggccaaagaaccaaaaaacacagatgataatacacttctactgcatgaaaagcaagctaataatttccagtcagaaagaaaattaatcacagccttgtcagaaactacagaagagccacagatagcaaaatttcctgccactgaggaaggtccagctctggaaaattctgatttgtgccaggaaggaaataatggaagtaggcatcaatatattcaaacaaaggaaattgacaacatcctctatcaatcagaaacatgttttgaaaactctcagaagaccggggaaccaatttgtcagaatacccttcagttggtgcctaacatcctctccaattccattgaagcagcaaagggttccaagagaaaatattcgtaa

SEQ ID NO: 86496 - DNA, 605 bp, Glycine max
  Peptide Sequence Number=SeqID_203274
atgtctaaagagaatccccagaacgcaagaacaaaagacaaaaatggatttcaaacacagtctaatgaagaaataccagatatatgtattgaaagtaatagatttgtggagcagcaaaacaatggagccagcactggtgaatgctttgctatctcagaggaaccacaccagatatactctaatctgatagatgagataatttgtcaactgaatgatctcaaacttggggagagcaacatgacagagatggaaggacaaaaggccctagtcccatataatggagatcgttcagttgtaccctatcaggagtttgaattacttaaaaaacataaaccaaggcctaaagtggatcttgatgcagaaacagagagaacctggaaactattgatgggcaaaggaggaagtgaaggccttgaaggaactgacaaggaaaaagagaagtggtgggacgaagaaagaaatgtttttcacggacgagttgattccttcattgcacggatgcatcttattcaaggagatagacgcttttcaaagtggaaaggatctgttgttgactcggtgataggtgttttcctcactcagaatgtttcagaccatctttcaag

SEQ ID NO: 86497 - DNA, 1809 bp, Glycine max
  Peptide Sequence Number=SeqID_203275
atgatgagcaacccaacagaaaaatttatgcttctttcctttctttgcagctctgcctttatgtctctagcatcaaggtttcctcttcagtcaaaaagcagcaagaaatcatatgatgttgacacaaacacattgcttaaagaagcaggactctgcatagtaaatccagctgatacaataacaccatatggatctgggacattaaatcaaccaacctatcatctttgctttgagacaccccatcatgcaagagagctttggagagacagtgaaacttcaaggccaaaagggagcctaataaagccaaataatcagagctcagaggaagaatttttatcaccacaagattctcttgattcctcaattactcaagatgccagaaatagatcttcctcaggatccaattcagaatcagaaggactggactgcaggtgtgaacatagagagactcaatttttaactgcaattaattctttacaggtaggaaagaccactatgttccaggaattttacaacagtataaatggagtgtcactgtttgaggagagaaataaagatggacagctgcatccagaagaatatgtgaaacaaaattgtagcataggcagaaacagtagtcccaatatctgctcagcatttagtcatcctaacaactttgcttatccaccaaagcaactacctgtagttccttcaactgactataggctatattactcagacacacaagggctgaagacttttcaaatgaatggtggaaagttttcttggactgaaactgtttctgttcacagtgagttacaggacaacaattctggcaataggaaagtgggagatagtgcagataaacccacagagatgcaatatgcaaatggaacactagggtctccagagataccaacaattgacccttatggaccattaagcaagtatttagtccttccacatgatacttctcaatttggatctcatacaaattacaatcaaccttcacctaatcatcatcttgtaggtcagaaatccttagaatcagaaagtagggaatttacaaactcattaaatacgtctcatatattggacagatgtcaagatgatgtagttaaggatagcggcaatattcctaagcatgcagaaggtcttgacagtgaaaaaatatctgcagcaaacagccagggatgctcagaaaatagtagggctgaatcaaatcctttgaagcaagtttattctcccaactctatcgataaaaagagcaaaatcaaggtttcaaaagaaaggaaagcaaaacctgagactgagaaaaagcatgcaagtgactgggacaaactaagaaaggaggtacagataaatagaatagagaaagaaagaagcacggatacaatggattcactggactatgaagcaataagatgtgcctctgttaaagagatatctaaaaccattaaagagcgagggatgaacaacatgctagcagaacgaatcaaagaattcctgaacagattggttacagaacatggaagcattgatcttgaatggttaaggcatgttccccaagataaagcaaaggactatctgcttagctttcgaggattggggttaaaaagtgtggaatgtgtacggcttctgacacttcatcatattgctttcccagttgacaccaatgttggaaggatagctgttagacttggatgggtccctctccaaccacttcctgaagcacttcagttacacctccttgaactgtatccagtgctggaaacagttcagaagtatctctggcccagattgtgtaaactcgaccaaagaaccttgtaa

SEQ ID NO: 86498 - DNA, 138 bp, Glycine max
  Peptide Sequence Number=SeqID_203276
atggtgctgattgtgttttgtgtgatgctggttgcggttttatatggtgcagcacaatcaagtgagatctcatctcattcaacatgcactattacaaaaagcagttttaacatcggtttattaacatcgattttttga

SEQ ID NO: 86499 - DNA, 1221 bp, Glycine max
  Peptide Sequence Number=SeqID_203277
atgcatgcccaatgcgagcagagtgcaggcactttgcaagtgcttttgcaagcatctacatccttcctttgcaaggctccatcagtgcatcctttaccccctcgtcccaagttttttacatgtatttccaatgcacggcttgccttgcctggaccagaagagaagcgcatcgtaagtatgcatgttcccattgcaactgagagaaactattttgtcaatgagaaccccatggtcctacctctccttgagaacaacttgagcagacaagtaaatcctgaaagttggcagtgtgaaccaatcattgaagaaccagcaacaccagaaagagagtggaaagaggcagaagaaagtgacatggaggactttttaaaggtggattctgatgaaattctttccattggcctcaatgccaaagagtcaacagtgaatgtacagaaccacttgcaagaatacaaggagcataatgaaggtgacatgtctaaggcacttgtggccttgaatccagagtctgcttctatccctacaccaaaactgaagaacgtcagtcggctaagaactgaacaccaagtatatgaacttccagattcacatcctctcttggaaaagatggataaacgggaacctgatgacccaagcccatatcttcttgcaatatggacaccaggtgagactccaaattctgttgaaccaccagaaagaagatgtgaatcccaagactcagccaacctgtgcaatgatagcacatgtttttcatgcaacagcattagggaagccaattcacaaacagttagaggaacaattctgataccttgtaggacagcaactaggggaagctttccactgaatggaacttactttcaagttaatgagctatttgcggatcatgcatcaagcgttcaacctattgatattcctagggaatggatatggaatttgccaaggaggacagcatactttgggacctctgtatcatctattttcaaagaccagtttatcacgtacggtataattgtactcaccaaaaatactcatttctaccaggcctttccacccaacaaattcagcattgcttttggagagccatcgccaacaccaacacctagaaacaatttcataagatttgtttgtgtcaggggatttgatcaaaaggaacgtgcaccacgacctcttcaggccagattgcatttttcagcaagcaggttagcaaaggcagaaaaatga

SEQ ID NO: 86500 - DNA, 792 bp, Glycine max
  Peptide Sequence Number=SeqID_203278
atgtccttaaagataaaagaagaggtgaaaaagaaatttgacgttggcttcttggtagtcgctcggtactcgaaatgggttgccagcattgtgccagtccctaagaaagatgggaagggaacattctgctacaatgtgatgtcctttgggctcaagaacgctggggcaacctaccaaccggctatagtagaattattccacgatatgctacataaggaagttaaagtctacgtggatgacatgattgccaagtctaaaaccgaggaggaacatctcatcaacttgtggaagcttttcgaaaggctgcggatagaggtggaccccaacaaggtgaaggccatccttgaaatgcctgagccacacactgagaaacaatccatccaatggaacgacgactaccatgtggcatttggaaggatcaagcgatgccttatgaatcctcttgtgcttgtgccaccaatgcctggaagaaccctcattctatacatgactgtgttggatgagtcgatgggatgtatgctgaggcatcatgacgcgtctgggaaaaaggagcgggtcgtctattacttgagcaagaacccaccgtctaaggaaatacatgctgagctacaccacttgactgagttcgacattgtttacgtcactcaaaaggtgatagagggaagcaccttggtagattacctagctcaggcgacgcttgacttgtgggtgcatcttccaagaaaggaaggtgcgcggagtcgccaccaacgtttacttgaggaagacgtcggaaaaacaggaaaagacgtg

SEQ ID NO: 86501 - DNA, 1320 bp, Glycine max
  Peptide Sequence Number=SeqID_203279
atgtcccatactaatggattcgggtccacaacgatgggttcaaatgtacgagatcttgtagcacttaccaacgaggccctatcgattagtattatacaaaaaaaatccatcatagacactaatataattagatctgttcttcatagacaaacttgggatttccgatctcaggtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcgagatttctctatgaaaaatatgaatcggagtttgaagaaggggggggagtcctcgaccccacaacagatagaggaggattttttcaatcacatcgtttgggctcctagaatatggagcccttggggctttctattttattgtattgaaaggcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataagccaattcatttgggaccccgcggatccactctttttcctattcaaagatcagccttttgtctctgtgttttcacatcgacaattctttacagatgaagagatgtcaagggaacttcttacttcccaaacagatcttcctacatctatatataaacactggtttatcaagaatacgcaagaaaagcattttgaattgttgattcattgccagagatggcttagaatcaatagttcattatctaatggatttttccgttctaatactctatctgagagttatcaatatttatcaaatctgttcctatctaacgaagcgctattggatcaaatgacaaagacattgttgagaaaaagatggcttttcccagatgagatggttgttgctatctgctccaataacgaatcattggtttaa

SEQ ID NO: 86502 - DNA, 1584 bp, Glycine max
  Peptide Sequence Number=SeqID_203280
atgcagaacataagagattctgctgtgtttctaaggaggctagtttcctttgctatccttattttctttatagtagattgtacaagaggtgagtcatcagaatctgagtctttcttcaatttcataagggcccttgacccgaaaaacgtgcttaacattacctggattgagtcaccatcacatccatgcttggtcaagttgaatggtgtaagatgcaactcaaatgctaccaatgttgtacatataaggcttgagaacttgaaccttagtggcacaatcgatgcagattccctatgcaggctccaaaagttgacacatttaaatgtaaccggcaaccaatctagtgggaggttgccaaatgccttaacaaaattgaaacatcttaggaacttagacatttccaataacaacttttctggtatgatccctagtaaacaacaatatagtcacctccttagttattatgtgactccaagtaacaagttggaaagcaatagtaccaaagagtggctaaaggaaagtgacacacacacaatacacacacctaataacggcaaggatccatggccagaaatcttgggggtgatacttttgggtgctggattgcttttgtcaaccatttactttattgtaaagaagtcagcaaagttcagtgcagagagagaggtagttaaagaccatcgtcgtgtgtctccaataacaaaggctacaactcatgaagttcaagaggtgaaactaaaggaaggagattctgagcttgttttctttgttgaagatcgtgaaaggttcacactcgaggacctacttcgagccaccgctgacttgaggagtgaaggcttttgcagcagcctttacaagaagataagtaacttgaagcatcagaatattctcccccttgttggttatcgttctaccagtgaagaaaaactcatcatttacgaatatcaaagcaatggaagcctgcttaatctgttaaacgattatatagcaggtagaaaagatttcccatggaaaatgcgtttgaatatagcatgtgggattgcaaggggtttggccttcatatataggaagttggatggagaggaggtcatgtctcatggaaatctcaagccatcaaacatccttcttgatgagaacaatgagccactaataagtgagcatggcttatcaaaattcatgaacccaaatagaggtttcttgttttcctctcagggatacacagctcctgaaaagagcctaacagaaaagggaaaaagcatagaggtgagtagaatagagcttgctagatgggtaaggtccatggtgagggaggaatggacaggagaggtatttgacaaagaggttagggaaaatgatcatcaatgggcatttcctcttctcaatatagccctcttgtgtgtgtcacgtttccaagaaaataggccaaccactatggagattttggagaagattgaggaggtcatggatcaacatcacgaacgttgtgcttccaaatgctgttccattggatccaaccacgatgagtgttgttcacttcacaaaatcatacctgaaacatgggattctccaggatcaaattattga

SEQ ID NO: 86503 - DNA, 711 bp, Glycine max
  Peptide Sequence Number=SeqID_203281
atgaggggaggaggttgcacagcagctcgcccaagcgagctcatgtcgcccaggcgagctggttactttaaccctaagctttctggtggcatgggcgagccaggctcaatttggcaggcaagaacccaaatgtttgcaaatgattgtccccagacgaaatttgggtatgacaacatacttggaaatcacaaggttgtgaacacaacaaaggccatgttagactacgtccattctgactattgggggcctttgagagttccatcactaggaggggcaaggtatttcatctccatcattgatgattactctaagatgacatgggtgtctggatgtccgacatactctcacgtaagtgaaggtaagttagagccctttgccaagaagggattctttatgggctatggagatggagtcaaaggaatccaagtctggtccccatctaaaagaaagattattctgagtagagatatcatttttgacgaactttctatgccgcattctaaatctgatgaagatttaggcaaggttatggatgtcactaatggaaactctggacatggagttagagcaattcaatgtccaaactacctttctcaaggaagactagagcaacacattctgatgcaacaattgaagaagctgaagtcatttgagatgaaggacatgggaactgctgaaaagattcttggcatggagatcaagagggattga

SEQ ID NO: 86504 - DNA, 261 bp, Glycine max
  Peptide Sequence Number=SeqID_203282
tttcagaccaaagaagaaaaggttcaagcagctaatgactcattgagtgaggcagatccgcttagcgagtggcatccatttagcaaggcatccagctcgcttagtggatgggaaactctagaaaacaaagagtcagagatctacgcactcagcaggcagctaacccgcccagcgaggacgttgtctcttctagcgctcaccgcgccctatctcgctatgccaaaattcactaacttgcgcttagtgagccctgctcgctaa

SEQ ID NO: 86505 - DNA, 1785 bp, Glycine max
  Peptide Sequence Number=SeqID_203283
ttcggtgctccaaaatactggggcatccgaggatccgaatcgaagcgggtcgggtcagaattcgatggcgaggtacaagctgatgtcaccggcgaagcttccgatctcgaggtcgccgtgcatcacgattcctccggggctcagtccgacgtcgtttctggaatccccggttcttctttccaacatgaaggaaatggattagaagaaggaaaggtggaggcttcaccaactacagggtccctccgtaagctccaacaaacaatgcatggttctatggcctctgctgcatttccagtaaccactgcctgcttcgataccaatactgttgatgacagaaaatcaagtttctttgagttcaaaccactcagcagatctaatatggttcctgcagacttcaacaaccatgtaagtaaacaatctactcaagtagaaggtccaggaaaaactcaatcatttgcttcctcaccattagtggaaagtgagatagcagttccttctaatgaattaagcctatcatcacctgtacaaaaggttagttctagtgctagtgctcctgttgatgttgacttggatgacattaaccacaaaggcaacacagctactgggcttcaagcatcacatgttgaggttagaggcagtggactttcagttgcagctgagaaaacatctgatgatggatacaattggcgaaaatacgggcaaaagcttgttaaaggaagtgaatttcctcgcagttattacaaatgtacacatcccaactgtgaagtgaaaaaactttttgagcgctctcatgatggtcaaatcactgagatagtttacaagggaacacatgatcatcctaaacctcaaccaagctgccgatactctaccggtactgttatgtctattcaaggagagagatctgataaggcttctatggctggccgagatgacaaagcaactgctatgtatggtcaggtgtctcatgctgctgagcccaacagtactccagagtcatcacctgttgcaacaaatgatgatggtttagagggtgttgccgggtttgtgtcaaataggactaatgaagaggttgataatgacgatcccttctcaaagcgaagaaaaatggaacttggaaatgttgacatcactccagtagttaagcctatccgggaaccacgggttgtcgtacaaactttgagtgaggttgacatattggatgatgggtaccgctggcgtaagtatggccaaaaggttgtgagaggcaatcctaacccaagggatactgagatggacatatgggtgaaggctgatgagaactggagctattacaaatgcacaaatgctggttgccctgtcagaaaacatgtggagagggcatctcatgatccaaaagcagtgataaccacatatgagggtaaacacaatcatgatgtaccagctgcaaggaatagcagccatgacatggcagtaccagcagctgcagcaggtggacagacaagaactaagttagaagaaagtgataccattagccttgaccttggaatgggaattagctcagctgctgaacataggtcaaatgggcaagggaaaatgctgcattcagagtttggggacacacaaactcatactagcagttccaacttcaagtttgttcatactacctcagctccagtatactttggtgttctaaataacagctcaaatccctttggttctagagacaataggagtgatggtccatctttaaaccgttcctcatatccatgcccacagagcatgggaagaatactaatgggtccatga

SEQ ID NO: 86506 - DNA, 1488 bp, Glycine max
  Peptide Sequence Number=SeqID_203284
atggcggctgttatgcctctctatccttataatccaatgctatacttttcgactccttcgagtttttgttctcaattttggattttggagagagagcgtttgggttctgcgaggttgaagaatttggtgaaacttgcagcacattccaatccgaggattctcaagagcaacaggaagtcaaagtatggagaggcactgtcgctgtacgatagcgacgaagacgatgaagaattggacgacgacgacaacgaggatgacgatgatgattggctttctgatgaggaattttctgagcctgctaacttagatgttaataacaagagatttaagtcaaagacaactaaaggaaacgatagacaacaggaacgggagtggggtttgagatcttttgacaatgaacaaagcattagattgcctagaagtgagagagtggcaaccttacaaagaaatgagagtggaaagctaccaaatcgtgatacacatagtagaaatgtaaaggataaaaaatatccgcagttgtctgaggagattcctttggatgtgaaatggttaccacttcttgattacttaagcacttttggaatgaaggaatcacactttgtccaaatgtatgagagacgcatgcaatcacttcaaattaatgtgtgttctgcacaggagaggttagaatacttgttgagtattggtgttaaacaaagagatgtaagaagaatccttttgaggcaaccacaaattcttgagtatacagtggagaacaatttgaagtctcatgttgctttcttgaggggcctgggcatacctaattctagaatagggcaaatcattgctgctgcgccatccttgttttcttatagtgttgagaattcgttaaaacctacagttagttatttaattgaggaagttggcatcaaggaaaaagatttgggtaaggtcattcagcttagtccccagattcttgtgcagagaattgacatttcatggaatactcgttgtatgtttcttaccaaagagttgggtgcacccagagatagcattgtgaaaatggtgacaaaacatccccaacttctccattacagcatagatgatggattacttccaagaataaatttcctaaggagcataggaatgaaaaattcagacatcttgaaagttttgactagcctaacacaggtgctatctctgtccttagaggagaatctaaagcccaaatatttgtacttggttaatgaacttaacaatgaggtgcaatccttgaccaaatacccgatgtatcttagcttatctttagaccagagaattcgtcctcgtcataggttcttggtttccctaaagaaagctccaaaaggaccatttccacttggatctctagttccaactgatgaatgcttttgccaacagtgggctggaactagtttagataaatatttggcatttcgtcagagattattacttaaaaagtttgctgagaaatatgaaagaaaaatgtga

SEQ ID NO: 86507 - DNA, 423 bp, Glycine max
  Peptide Sequence Number=SeqID_203285
atggaagcagcagcagcatcttcttctttgtctctgctttcgttagcgagtgtgaaaactaggagcaaagtcgcacagaactgtcacgtgactcaacaaagacaacgttgtaatcatgtttgtgttaagaatgcaagaagaacaagggtgactgctgtgcctgtgaatgttgatgatgtaaccacagtacttgaccctgctccagtggaagtcacatggcaaattgtggttggagctatagctggggttaccccttttgtggtggcagggattgaatttagcaaaagaattatagctcaaaaaagatgcgaggtgtgtggagggtcagggcttgttcttagggaaaaggaaaaggactatctccgttgcccagaatgtggtatgattgcattcacttcttctcatatcatgtactctatttaa

SEQ ID NO: 86508 - DNA, 780 bp, Glycine max
  Peptide Sequence Number=SeqID_203286
atgtgggtctccttgaaggataatgtcaaatgtggaaacaagctcaacgatgtaatcaagcagcaaacaaaatgcggcaaaggaagtggctatgttgcagaaaaggagaaaatgaatggatataatagacctctaatggaaactccaactactagcctagtggtttcaagaccaagcaacacactgggaaggcttcatgagctgagtgttggagacccatcaagaaaaattgtggagatgatatttcaaaaagcttggtttaacaaatcaaagccagtgaagaaggtcagaacagtcctcagggtgagttactcagaagaagtccttgaaaggtttgagaagtatagagaatatgtcaagaaggtggcctctgagcaaaatccaaggaatccaaggagcgcagttgatgggaacgaactgttgcagttctatggtactacaatgagatgttttcaaggaaaatctgctaagaaagttcatgatctgtgtaaagatccatcttgttatctttgtcaaataattcagtttaatttcaacacacgatatgccgagattcacttgaatacaagtgacaaagagtcgagaaacagaacaactgccactgccagagtacataatgtgaaaaaagctgcaataatttgcaggataattgctggaactgcagtaaatgaagttgatggtgaatatgaagggtctcactcaactgggttgggagaaatgcagtttaccttacaaaaatttgtaagtaacttgactatgagttccgcgaaagaagattag

SEQ ID NO: 86509 - DNA, 453 bp, Glycine max
  Peptide Sequence Number=SeqID_203287
atgcccccgatgatagagagagagatgatgataatgataatggacacattgttagtgttctactatgagaaaatggtaggttacatgccttcaagttttgcagatctagtgtttgctggtgagagaattgaagcatgtttaaggaaagggaaattcaattatgtttcttttgcgaatcctggtaataggggactcgggaggagtggtgagaggaagaaggagggagaacctcatgttgtggctgcagttcctgcgtggccaaactttccaatagcccctgtcacaacctacccttcggcgggagggcgacgcggggctcataggcccacttgggccctccagaatattcctccagaaggctgttgcttctggaggaagcaacctggctcgcctgggcgagctgagctcgcctgggcgagctgggcggcaaccacctcccctattttgctataa

SEQ ID NO: 86510 - DNA, 1186 bp, Glycine max
  Peptide Sequence Number=SeqID_203288
tgacattgtcatggcattcgagtatgattcttgtcctgattcccttcatgttggacgcaccattaacgtagaggctctaccagtctggggtggtttagtcgttttcaatgaattctgccagaaagtttgccataaattgtgtcttcatggggtctcgaggtttttccaacacctatttgacggggtagttcgtcttgactaccacctggtgactctgaaagtatggcctcagacgtcaggccaagtgcttctcaatgtcatggagtatgtgattggtgaggttgagctaacgacttcctcaaatactgagagatatagaagtaggggtactcctggcctaggtcaagtcaggactggcagtgtggcaatggtcttcttaaagaccaagaagacttgttcgcagaatggattcgcttttttggcgagctttgggaggaacttggacagggatgtcggtctaccatttaacttatggacttactggacgttggcacatgtcatatttgcggatttctccgaatacttcttccaggtctaccatgtgttgggctatgctatggaatttgatgaccatgtctttgacatagacctcgacatttcgtttgatctgctgtttgaagatccggcatccaggaagcttagtacttggaacccagatgcttcatcgactagcttgtcgatgctgagtaaaggatattcatccttgggtcatgccctgttgggattggtagagtacctgacttctctaatgaaattggctttgaggagcttgtccacttcctctctgaccattttgcgtcgttattcccccatcttcctcttcttctgtgatactggttttagcttggggacagatggcaagcttgtggcatataatgctagggtggatacccggcatggctgccaagtgaacagacccttcgtccatgctcatgacttgagtatcgccactcgttgtgaggtgagacttggtaggctccctgctcctcgagagctggccttgatcaaaggtggtaatgaggccgatgtagcctctgatgtcgaaggagctgccctggtcaatgagaaccttggacacgatgaagttgacgattatgatggagacaaccatggggtcgacatagttgatgtcgatgtccttaatggcgtggaggtgacgcttgcaagattggctggactgccttcc

SEQ ID NO: 86511 - DNA, 1431 bp, Glycine max
  Peptide Sequence Number=SeqID_203289
atggatatggacatgactgttagcgcacggcaatttctggtctctaatgcgaaatctctcagaccaaacgtaatttgtggtgttccaaacaaactaaagcgaaacgtgcgttatagtatgaggagcgcactggtatggatttttaccttgaacgtttgccttcacattttatttattcctggtggtgactcaaagccgcatccgcgtttcagagagaaaatcactgaggattacaatcgcggatttataagcattgactgtggagcaagtaacgattacttggacgaggaaacaagtacattttataagacagacacagatttcatagaaacgggagaaaacttgttggcgtcttcccaatttattgacataaatatccctggttttggaagacaactacgcacattgagaagcttccctgagggaaataggaactgttatactctgaagcccgagtataagcaaggtgaacagcaaagttatctgattcgggctatgttcggatatggaaactacgatggaaaaaatcatccccctacgttcgatctctatcttggggtctactactggataaatgttaacccggcaaaatattcctatctttggaccgagattattcatgctcccacaacagacaccatacaagtgtgtctggttaatattgacactggtacacctttcatttcgtcattagagttacgacctttaagcacttccatttaccaaatcatgtcacaatcatatctacacctctgggggcggtttgatgtcggtggccctgttgaaacctattataaaaggtacaaggacgatatctacgatcgcaggtggtactcgcccgatgttaaagattggtataagatcaatacaaccatagatgttaataaatctggcaatgatatttataaagtaccagctgaagtcttgaaaaccgcagtgcagtccttcaatcgctcatatgacttgtactatgactatgaaattgaatggaatgttcacttgaacaagtattccagatattatgtctactttcactttgctgaaattcaaaagcttgctccagggctcagaaggataatcaacatcactctcaatgatgaaaacatactctctgagcctataactctcgaatatatgaagcctgtcactattagtaacaaaaatgcaactcaaggtttcgttcgcttttcaattagagcaactgcagaatcggatgctcccccaattctcaatgcttttgaagtttatgaattaataacagatctaaattcaccaacagatattaaagatgttgatgccatggagaacatcaaacgctactatgggatatccagaatagattggcaaggggacccatgtcttccagaaaagttcagatggagtggcctggactgcagctacggcatcaatcctagaatcatatcattgtga

SEQ ID NO: 86512 - DNA, 591 bp, Glycine max
  Peptide Sequence Number=SeqID_203290
atgatgggaatgttattgcagtttctttatgtattgtttggggtacttatttctgtggttctggttcaagcacaggatcaatcaggctatactgagaagaccacaagcatattttacatttcagatgccaaatttatagatgctggtgtaagcaagagtatttcaccagcagagaagagtactcatctacaacagctagcatatgtgaggagttttcctagtggagagagaaactgttacagaataaatgtaaccagtggtactaaatatttgatcagagctactttcttttatggaaactatgatggcctcaatcagccaccacaatttgatcttcatcttggacctaatttatgggacacagtgagcttccccaatgcatcactcagcgaaatcagtgagatcatttacaccccatcactagattacatacatccatgtcttgttaacaaaggtcaaggggctccattcatttcaaccatagaattgaggactttgaaaaatgcttcctatgtcacagcgtcagctgaatcattggcatactatcggcgatatgatttaggttccatcaccaacttagtatacaggtga

SEQ ID NO: 86513 - DNA, 333 bp, Glycine max
  Peptide Sequence Number=SeqID_203291
atgctagacttgtcttacaatcatttgaagggaaatattccaacaggaactcaattgcaaacctttgatgcctccagcttcatcggcaacaatctatgtggtccaccactgcccataaactgcagctccaatgggaaaacccatagttatgaaggaagtgatgggcatggagtaaattggttttttgtcagtatgacaattggatttattgtgggattctggatagtgattgctcctttgctgatttgtagatcatggcgagggagagtagctgaacgtaaagaggggaaggataggaggtgtggggaaatggaactaaggataaccaagtaa

SEQ ID NO: 86514 - DNA, 163 bp, Glycine max
  Peptide Sequence Number=SeqID_203292
atggttacttccatgcttcaacttgacttgatgaaccttttcgtaaaagcacgagcttggttcaacttcataacccagggaatggcaattttgatcgccaatacttcatcaacaattcatagggatgaaagactcgggaatatgcgtgctatgcatggaaaat

SEQ ID NO: 86515 - DNA, 489 bp, Glycine max
  Peptide Sequence Number=SeqID_203293
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcattgttgctaaggtgaacccgaagtccccatcgggcctcagccaaatgaatcatccaacctcagctatggtaggcaaagatttgggaagtacgggcggcccccattatgcacaaagtcaaaacaagcatgccttcccgccatatggcctgcctcccaactatacaccgcccaatgtggcgtacactcccaataagaatgtcaataactccactcctatacccattgagagccaacaaccccgaactgatcatgcacatggcaagcagttggtggtataccccttgaaacacttcggaaggccctcaatatcacccccagctacacctcttgcattccacgacaagtaa

SEQ ID NO: 86516 - DNA, 1118 bp, Glycine max
  Peptide Sequence Number=SeqID_203294
atggctaaattggcttcatgccctgactatttcatccgtgaagtggcagttcaggctagaaaggaactccaaaggttggctgctaaaccagatatgcttgcaatgtcacttactgtaaaccctcagcatggtttaagtgatttatcagtaatctcccctagaactcctacttcaccaaactttcaggtgcctcctccctattgggatccacaatctgctggcaatgtcaatccggactttatgggaatgaattacttggattctattgtagaacttcagaagcagacacagatgcttactttggagaatcaaatagatgctgtaaaaactgggactggagggattgccaatgattactatggcttagatgcttctgctgccaatttgggtggaaaagctgggagaaggttttctgaatttccaatgaagatatgtcactatttcaacaaaggattctgtaagcatggaactagctgcagattctatcatgggcaagttgtccctgagaatttctctcagatgtatggaaatgatgctattagtgaggatcaggtgatttcaccggggtcactggcacagttagagtctgaaattattgagctcctaagaacaaaaggtggtccaatgtcaattgcttccctgccaatggcatactacgataaatataaaaaggtactgcaagcagatggttatttaaccgagagccagaggcatggtaagtctggctatagtttgacgaagcttcttgcacgactgaacaatagtattcggctaataggcagacctcatggacagcattcagtggttctggcagaagatgctcccacacaaatgcaaaagggagattttgctcgaaatatcagtgcttcacggcaaatatatctgacgttcccagctgacagcactttcacagaggatgatgtctcaaactacttcaacacatttggacctgttgcagatgtcagaattcctaaccagcagagaaggatgtttggatttgtgacatttgttcattcagaaactgtcaaaactgttttggataagggcaatccccattgtgttcggggttctcgggtgcttgtgaaaccttaccaggagaaggcaaaggttaatgaaag

SEQ ID NO: 86517 - DNA, 1039 bp, Glycine max
  Peptide Sequence Number=SeqID_203295
tgagccatatgtaactgaagatgagctaaaattgatgctaagaggtgcagaattaagtggggcaatagaggaggaagaacaggatatgattgaaaatgtgttagagataaaagacacacatgtcagagaagttatgacgcctcttgttgatgttgttgcaattgatgcaagttcaagcctgggtgagttgctagaaagtactacagttggagatatggctcacaagcctgcttattttgtacctgattcaatgtctgtttggaatcttcttagagagttcagaatcaggaaggttcacatggcagttgttcttaatgagtatggtggaactgtggggattgtaactcttgaagatgttgttgaggaaattgttggtgaaatctttgatgaaaatgactcaaaggaggagatacagaaaaaaactggctacatagtaatgcgagctgagggtgtttttgatgtggatgcaaacacttccattgatcagctctctgaagatttgaacatcaagatgccagagggtcaccaatatgagacggtatcaggctttgtgtgtgaagcatttggatacattccaaggacaggtgagtgcatcaaagtagttcttgaaagggaagatgaagatgataacaatgagtccaatgctgaccagcaagatcagaaggagaagaaccagattttcaaacttgagatactagctggaaatgccagaaaggtgagcgctgttcggtttgaacgcataaataataatgatgaaatgttggagactaaagtaactcgcatggtccccaaaatcatgaaaagaaaatggagcagtgatgagaactcggacaatgatgcagaatatgacggagatacatttgcaaagagaccacaggatgacattcctagtgaatatttagttgatcaggaaaattctaacagagcctatgagatggaaaaattgagatacatgtacaaaatgagaagcaatgagttcaagcatgtaaaaccttgcaaaagacgaattagaggcatctttgctaacgaaagtctttaa

SEQ ID NO: 86518 - DNA, 672 bp, Glycine max
  Peptide Sequence Number=SeqID_203296
gaattgttaaagaggggaatcatcctggctgcaactgtttgtggggtattggtgtttggatgttcacgagttttcgccgttgaaggggttgcgaatgcaggatatggtgtttttggacagagcattcttttgcttacgaatacatggcctaaagtgttgcaagttcttcgtatatttaaggagcaaggtttggtgctggcagtgcttttgggcctttcagcttttttctcgatggcagagacttcaatcactacactttggccttggaaggttcgtgagttggccgaaaaggagcctgaaaatggcgtcttcagactactccgaagtgatgttactcggttccttacaacaatacttattggcacaacggtggtcaatattggggcaactgctctggtcactgaagcagcaactgctatgtttggtgaagctggtatcagtgcagcaacaggagtgatgactgttgccattttgcttctcactgaaatcactccaaaaagcatagctgttcataatgccacagaagtggctcggtttgtggtcaggccagtggcatggctttccttggtgttgtaccctgtaggaagaattgttacctatctttcaatggggatgctgaaattgcttggcctaaaaggaagaaggtctgctgaaaagattgccagagattaa

SEQ ID NO: 86519 - DNA, 2897 bp, Glycine max
  Peptide Sequence Number=SeqID_203297
ggatcccccttgaatcagggaagatcttgtctgcacttgcaacgttccggattcttcaagagcccatttaccgtcttccagatacaatttcaatgatagcacaaactaaagtttctcttgataggattgtgtcattccttcgtcttgatgacttacggtctgatgttgtagagaagcttccttggggcagttctgatacagcaattgaagtagttgatggaaacttctcttgggatttatcctcccctaatccaacattgcaaaatataaatcttaaagtttttcatgggatgagggttgctgtttgtggtacagttggatcaggcaagtctactttactttcttgtgtattgggagaagtaccaaagatatcaggcatccttaaggtttgcggaacaaaggcctatgttgctcaatctccatggatacaaagtggcaagatagaggataatatattgtttggtgaacgcatggatagggaaaggtatgagaaggtacttgaagcctgttccttgaagaaggatctggagattttgtcatttggtgatcagacaattataggagaacgtggaataaatttgagtggtggacagaaacaaagaatacaaattgcacgtgcactttaccaagatgctgatatatatctatttgatgatccttttagtgcggtggatgctcacacaggatctcacctctttaagttcttccaacagcatgactctagtagtattatttatgaatgcttgctgggccttttaagttcaaagacagtggtttatgtcactcatcaagtggagttcttacctgctgctgaccttatattggtcatgaaagatgggaaaattactcaatgtggaaagtatactgatctgcttaatagtggtgctgattttatggaacttgttggtgcacacaaaaaggctttgtctacactagattccttggatggagcaacggtatctaatgaaataaacgccttggaacaagatgtaaatgtctctggcacgtatggttttaaagaaaaagaggctagaaaggatgagcaaaatggtaaaacagacaagaaaagcgaaccacaaggccagcttgttcaggaagaagaaagagagaaaggtaaagttgggttttcagtttattggaaatgtatcacaacagcatatggaggagctcttgtaccattcatattattggctcagattctttttcaagctcttcaaattggaagtaattattggatggcctgggcgactcccatctcatcagatgtggagccacctgttgaaggaacgactcttatagcagtctatgttggtttggccattggaagttctttctgcatccttgccagagcaatgcttcttgtcacagctggttataaaacagctactatactctttaataaaatgcacttctgcattttccgtgccccaatgtcatttttcgattccactccaagtggacgaatccttaacagggcttcaactgatcaaagtgcattggatacagacattccttatcaaattgcatcatttgcgttcatcatgatccagcttttgggaattattgcagtgatgtctcaggctgcatggcaggtttttgttgtctttatacctgtgatagcagtcagcatctggtatcagcaatattatattccatcagcccgagaactagcacgtttagttggagtctgcaaagccccaatcattcaacacttttctgaaacaatttctggtacttcaactattagaagctttgatcagcagtcaagatttcaggaaacaaatatgaaactgactgatggatattctcggccaaagttcaatattgccggtgccatggaatggttgtgcttccgcttggatatgctgtcttctatcacatttgccttttccttagtattcttaatatctattccacagggattcatagatccaggccttgctggtttagctgttacatatggacttaatttgaacatgatacaagcttggatgatatggaatctctgcaatatggagaacaaaattatatcagtagaaagaatacttcagtatacttgtatttctagtgagcctccccttgttgtggacgaaaatcggccagatccttcctggccgtcatatggcgaagttggtatacaagatttgcaggttcgttatgctccacatctcccacttgtgttgcgtggtcttacatgcaaatttcgtggaggactgaaaactggcattgttgggagaacaggaagtggtaaatccactctcatacaaacacttttccgaattgttcagcctacttccggccaaattatgattgacagcatcaacatctcttcaattggacttcatgatttgaggtctagactaagcattattcctcaggatccaacaatgtttgaagggactgtgagaaataatctggaccccctggaagaatacagtgatgaacaaatttgggaggccttggataagtgtcaacttggagatgaagttagaaagaaagaaggaaagctcgactccaaagttgatgctgtagttaccgagaatggtgagaattggagtatgggtcagaggcagttggtctgccttggcagggtgctgcttaagaaaagcaaggttttggtgcttgatgaagccactgcatcagttgatacagctacggataatttgattcagcaaactcttaggcaacaattctctggctctacagtaattactattgcacatcgaataacttctgttctacacagtgatatggttctgcttctcagtcaaggactcattgaggagtatgacaccccaacaaggttgatagagaataagtcatcatcttttgctcaacttgttgctgagtataccatgaggtccaactccagttttgagaaatctgatgatcattga

SEQ ID NO: 86520 - DNA, 1531 bp, Glycine max
  Peptide Sequence Number=SeqID_203298
atgtttatgttgtctcttttctcaccactttccactgctgttctcctcaaacccattttccttcatggcttctccgccttcatccaccttctgttgctgcttgcggtttcgctgtcatgggtttggaacaaaatcacagcaggtgccagggatgagtccaaggagaagccaagccacaccctcttcaaaacgacggtgttttcttctcttggtgtttctgctttcaattttctcctctgtttgtttacctacttctactggtatacaagtggctggtcagaagaaaagcttgtgacccttttggatttggcgctaaaaacacttgcttggggcgttgtttgcgtttgcttgcaaaatgggttcttcagttccggtgaaagaaggttctcgttcttcttcagagcctggtgcactttctaccttgttgtttcttgctattgcttcgtggtggacattgttgttgtatcggagagacgtgttgctctgccaactcggtacttagtctctgatgtggtctccacttgtgttggtttgttcttctgttacgtggggtattttgtgaaaaacgaggttcatgttgataacggtattcaggaacctcttttgaatagcgatgccttggagtcaaaggagagcaagggcggggacactgtgacccctttctcatatgctgggtttttgagcattcttaccttctcttgggtgggtcctcttatagctgttggtaataagaagaccctggaccttgaggatgttcctcaactagacggcagagatagtgtaattggtgcttttccaagtttcagagagaaacttgaggctgattgtgggggaattaacagagtcaccacactgaagttggcgaagtcgttaataatgtcagcatggaaggagattcttatcacagcttttcttgcattgttaaacactttggcttcttatgttggtccatatcttattgacggttttgttcagtacctggatggacaacggctatatgaaaaccagggctattttttggtttctgcatttttctttgcaaagcttgtagagtgcctgacccaaaggcattggatctttaagttgcagcaagttggactccgaatccgagcactgcttgtcacgatgatctataacaaggctcttaccctttcttgccaatcaaagcagggccacacttctggggaaataatcaatttcatgactgttgatgcggaaagagtaggtgtcttcagttggtatatgcatgatttgtggatggtggctctgcaagttacgttagccttgttgattttgtataaaaacctcggtctggcttcaattgctgctttagttgcaactgttgttattatgttagcaaatgttcccttgggatcgttgcaagagaagtttcaaaagaagttgatggagtcaaaagatacaagaatgaaggccacatctgagattctaaggaacatgaggatcctcaaactacaaggatgggaaatcaagtttctatcaaaaataaccgagctcaggaaaaatgagcaag

SEQ ID NO: 86521 - DNA, 681 bp, Glycine max
  Peptide Sequence Number=SeqID_203299
atgaccgtcgaacctaggaatcgcgggttgaacatagtttccatcagccatgactctctcaactcaattttcttctttctcactctttcaagaaactgcagtctcttgtatcaggcctcttgcggagctctgataccagctgttaggtatctagtaatttgcgggccaaattacttcccaatagctgtcaggctaaatatatcaaggaagtgctttggagggctccttggcttggcaccattaagtacaaatggatttgctcatggttctcctggtcatgctggttccaacgatatttcccatgatcatcagggaggtatgcttgattgtttctcctcttacatagatatttataactctttttttgctgagatttttgctgttattcttgctttggaaatggccaaagacaaagggtggttaaacctttggattgagtatgactttgcgtttgtcattcaagctttttccaatccctctattgtcccttacaagctggctaatgttggtgctttgtctcgtgatttcttcaattggtggaacttgattcccgtttttgttaggaaggagttacttagaaatagattgtctctttcgaattaccggtttcgccaagttgttgtgggttttgatataataccccccactttcttcatattgttctttttaattccaatttaa

SEQ ID NO: 86522 - DNA, 1527 bp, Glycine max
  Peptide Sequence Number=SeqID_203300
atgctgcttatgtacttcacggaaacaaaatccattgatcaaaaaggagtgtggttccttgattcagggtgcagcaaccatatgtgcggaattaaagattggttctttgattttgatgataaattcaaagaatcagtgaaactgggtgacaattcgaggatggcaattaaggggaaggacaatatcaaattgaaaattgaagggataactcaggtaattacagatgtgttttacatcccagaattgaaaaacaatcttcttagcattgatcaacttcagcaaaggaatctcactatagtttttaagcaagacatgtgtaaggtctttcacaacgcaagaggtcttattatgtctagcaaaatgtctgcaaacagaatgtttgccatagctgctcaagtgactgtcccttcttgcttgcaaatggagagtgagggaagtacatatctatggcattgtagatatggttatctcagcatcaagggactgaagattattgcacagaaagaaatggttagaggcctactaaaacttcaagagtcttcccaagtgtgtacagactgtatggttggcaaacaacatagagaagtgattccaaaggagagttcttggagagcctcacaaagattggagcttattcattttgacatttgtggacccatcaatctagaatccaacagcaataaaaagtatttcattacctttattgatgactacagtaggaaatcttgggtttattttatgtcagaaaaatttgttgctcttgatatctttaagaagttcaagattatggttgaaaaggactctggaaactctattttttgtttgagaactgacaaaggtggagaatttaattcctgtgagtttaatagcttctgcagcaacaatggtattaaaaggcaacttactgcagcatacacaccacttcaaaatggttttgccgagaggaaaaatagaactatcatgaatatggtaagaagtatgttgtctgaaaaaggagttcctaaacagttctggccagaagctttgaaatggaaaatttatgtgctcaatagaagtcctactctagctgtgaaaaatgttactcctgaggaggcatggaatggcaccaagccatcagtcaaacactttagagtctttggctgtattgcctatgctcatgttccagatgctcaaaggaagaagttagatgacaaaagtatcaagtgtgtgcacttgggagtgagtgaggagtccaaggcttacaagctctatgatcctattacaaagaaagtcattgttagtaaggatgtgatatttgctgagaaagaaaaatggaagtggaacaaggaagaaataggagaaaagaagaatttagcagaatgcaaagatgataatgaaagttcagaaggggaaaatgcggagattgaagctacacagaacactaataatgaaaatgcagaatcagaagatcaaaatcctcaagcggcagattcaccaaatcctgctgaagggaggactaggagacaaccggcttggctagaagactat

SEQ ID NO: 86523 - DNA, 645 bp, Glycine max
  Peptide Sequence Number=SeqID_203301
atgttatggttcaaattggaattggaaaatgagatcataaacctagatgatgatgatgatgatgatgatgatgatgatgatgatgggtgtacatcaaaaggattgcatggaaagaaagtcatttctcaaattattgcagaaaatgaacatccaagttcatcggatgcaatccagcacaaaagcatttttacagaagcacaaaggtttgaagcaatcaaaagaaaatgtttatctgacacgcagagttctacttccacatcttctgatgacgatgattcatttgagtttgacgaaggtaatccccccaagagaagaaaaactgcaccagacagttctggagtaaactctttgccaagatatggtagtcacattgaagttgaatgtaagaagataataaggacaaagggagaaaaggtcgacaatggtgtcgccacgtcggagaaaacgatgtcggcagcggaaaattccaaggaattgggcaccttggagcctcctgctgatcctggagaatacgccgtttttggaggcgcagaactggatgacctttctcttaactctctcgccttctctctctctctctttctctctctctggcaaccaatgaagattagacttggccgctgtttgaatttgaacaagttttga

SEQ ID NO: 86524 - DNA, 204 bp, Glycine max
  Peptide Sequence Number=SeqID_203302
atgggtgatcaagccacaaacattttccgccaacttcagtgttttaaaggctccttagacgttttagcttctgaatgctcgcttagcgagactagctcgctaagcaagaggtttcccaacctgctaagcgagctgtatgcctcgcttagcggatttcacttgctaagcgtatctggctcgcttagcaagacatcagctacttga

SEQ ID NO: 86525 - DNA, 477 bp, Glycine max
  Peptide Sequence Number=SeqID_203303
atggcgaaagaagtgatgaacacacatgatatcatcttttcaaataggccttatgtgcttgctgctgatgttatcacttatggctctaagggcatgaccttcagcccacaaggaacttactggaggcagatgagaaagatttgtaccatggaactgctagcaccaaagcatgttgactccttcagatcaatcagggaacaagagttgacaatttttgtcaaagagatatctttgagtgaagggtcacctatcaatcacagtgagaagattagttcattggcatatgtgctaatatcacggattgcttttggtataaaatccaaagaccaacaggcttatagagaatttatgaagggcgtcactgatacaggtgcagggttctctcttgctgatctgtatccttccattggacttcttcacgttcttactggcattaggactagtgttgagaagatccatcgatcacggaatggatag

SEQ ID NO: 86526 - DNA, 1524 bp, Glycine max
  Peptide Sequence Number=SeqID_203304
atggggttggagcttcatatttccttatctataatccttcctttcttcctcttggtgttcatcctaatcatcacactttggagatcaaagaccaagaattcaaactccaagttgccaccaggaccaaggaagctacccctcatagggagcatacatcatcttggaactctgcctcataggtccctagcaagattggcaagtcaatatggttctctcatgcatatgcagcttggtgagctatattgcatagtggtatcttcgcccgaaatggcgaaagaagtgatgaatacacatgatatcatctttgcaaataggccttatgtgcttgctgctgatgttatcacatatggctctaagggcatgaccttcagcccacaaggaacttatttgaggcagatgagaaagatttgcaccatggaactactagcacaaaagcgtgtccagtccttcagatcaatcagggaacaagagttgtcaatttttgtcaaagagatatctttgagtgaagggtcaccaattaatatcagtgagaagattaattcattggcatatgggttactatcacggattgcttttggtaaaaaatccaaagaccaacaggcttatatagagcatatgaaggatgtcattgagacagttacagggttttctcttgctgatttgtatccttcaattggacttctacaagttcttactgggattaggactagagttgagaagatccatcgaggaatggataggatacttgagaacattgtcagggatcacagagaaaaaactttggacacaaaggctgttggagaagataaaggggaagatctagtcgatgttcttttaaggcttcagaagaatggtgacctccaacatcccctgtctgacactgttgtcaaagcaaccattttggacattttcagtgctggaagcgacacttcatcaacaattatggtttgggtaatgtcagagctagtgaagaacccaagggtgatggagaaagtgcaaattgaggtaagaagggtctttgatggaaaaggatatgtggatgaaacaagtattcatgaactgaaatacttgagatcagttatcaaagaaactttgcgtttacatccaccttctccatttctgcttccaagggaatgcagtgagagatgcgagattaatgggtacgagataccaaccaaaagcaaagtcattgttaatgcatgggcaattgggagggatcctaactattgggttgaggctgagaaatttagtcctgaaaggttccttgatagcccaattgattacaaaggtggtgattttgagtttatcccatttggagctggaaggaggatatgccctggcatcaatcttggcattgttaatgttgaattctcacttgcaaatttgcttttccattttgactggagaatggctcaagggaataggcctgaggaacttgatatgactgaatcctttggcttgtcagtaaaaagaaaacaggatttgcagttgattcctatcacttaccacacagctagaagttaa

SEQ ID NO: 86527 - DNA, 2148 bp, Glycine max
  Peptide Sequence Number=SeqID_203305
tgtgggttggtgcgtgggggtgggtgtgggggtgtgtgtgtgaagattctctcaagggcacaagttctgaatttacgatctgttttcaaatgtgggaaaatagaccctttgtcctgcaagttttcatcgtctttttcaaatgggtctccgcctgaaatgtatgggaaagttaaagttaattcctttatggatgatgcctcccattcccaagacaatgcattcaaatcggagggcatgagaaagacagtgcacgatgtctgccgggtgttggacacatatccttgggggcctgcccttgaggatgccttcaacacgtttgatgaaatgcctcaaccagagttggttgttggagtgatctggagattgaatgatgtgagggtggcattgcattattttaggtgggtggagaggaaaactgaacaaccgcattgccctgaagcctacaatgcacttctcatgcttatggcgaggactagaaatttggagtacttggaacagattcttgaagaaatgagtatggctggatttggaccctctaacaatacttgtatcgaaatggttgctagttttgtcaagttgcggaaactaggggaagcttttggagttattgaaacaatgaggaagttcaagcttcgccctgcttattcagcttatacaacgctgattggttctctctctgcagctcacgaagctgatcccatgctcactctcttgcgtcaaatgcaggaaataggttatgaaatgaagagtaactcgtttaatgctgaccttgtcctctataatgtatgtatagactgttttggaaaagttggtaaggtggatatggcctggaaattctttcatgaattgaaatcacaagagtcggtgcccgatgacgtgacgtatactagcatgataggggttctttgcaaggctgagagggtggatgaagctgtagagatgttggaagaacttgatagcaacaggagtgttccttgtgtttacgcttataataccatgataatgggttatggttcagttgggaaatttgatgaagcatacagcttacttgagaggcaaaagagaaagggatgtatacctagtgtaattgcatataattgcatcctgacttgccttggaagaaagggaaaagttgaggaagcactgagaacccttgaagaaatgaaaattgatgcagttcccaatctttcatcctacaatattttaattgacatgctttgtaaggcaggagaacttgaagctgccctgaaagttcaggactccatgaaagaggctggcttattccctaatatcatgactatgttagattctggtcaaactccaaatgcagtggtgtatacatcccttattaggaacttcttcaagtgtggtaggaaggaagatggtcacaaaatctataaagagatgatgcataggggttgttctcctgatctgatgctccttaataattacatggattgtgttttcaaagctggtgaaattgagaaaggtagggctttatttgaagaaataaaggctcagggtttaattcctgatgttcggagctattcaattttagttcatggtcttgggaaagcaggtttctctaaagaaacatacaagttgttttatgagatgaaggaacaaggactgcatctggacacctgtgcttacaacatagttattgatagattctgcaagtctggtaaggtcaacaaagcttaccaactactggaggaaatgaagacaaagggtctccaacctactgttgtaacttacggttctgtcattgatggacttgccaaaattgacaggctggacgaagcatatatgttatttgaagaagcaaattcaaaaggtgttgatttgaatgttgtggtctatagtagtcttattgatgggtttgggaaggtgggaaggattgatgaagcatatttaattttggaggagttgatgcagaaaggtctgactccaaatacatacacatggaattgcttactagatgcattagtgaaagctgaggaaattgatgaagctcttgtctgcttccagaacatgaaaaacttaaaatgccctcccaatgaagcagactgccttgagcaggcagcaattgttggtgctgtcttaagggaaatggcaaagtctcaacatgcgacaagattgacttga

SEQ ID NO: 86528 - DNA, 1223 bp, Glycine max
  Peptide Sequence Number=SeqID_203306
atggccttccaactcaaacccgaacctgggtctccgcctatgtccacttccaccacccagaaaaactacaaagaaatgagcatttctcagcttgtctcggttttgcgtgtttcgtttcaaacggaggattttgataaagttgaggaagaattggcgaacagggacgccaaacttaaggcggagattgagccactccgggagaagatcgaggtggagaggctcaagaggattgaagccgaagaaaaacttaaaaatagagatgagcaatgcgaaaaggggaaaagagcacagcaaaactatgagcagttgttgaaggaagtgaagaaaaacggtttggttgaaaaaaacacgattgaggagttaaggcaaatgagcctcgctttacaacgtgaaaattgtgagctgaagggcttaaagaaaaaatggctagatgatggcaaatctgtgggtgaacttaggagcaggatcagtgtgttggaggaggagaagagtgctcttgatgcccttagcaccaagaacagtgaattgaaggaagcaatcaagattaaattgaccgccatagagggtttgaggaccgaaaactgtaaattggcagatgagaagcgcagacttgagacattgatggagaatttagagaggaaatttgcggaaatcggtgtcaagattgtgaagttggaagatgcaacacagtctttgttagatggcttaaaagctgaaggaattactgtcaatgttgaagaggttggtgactacaagcttgaaaatgacactgggggccatgttcccttccaaaggaatgaagatactcgtcactcaattgatgctcagtctcttagcaaagggaataaggatgctctaggtgcatcagggttcaaattggaattggaaaatgagatcataaacctagatgatgatgatgatgatgatgatgatgatgatgatgatgatgatgggtgtacatcaaaaggattgcatggaaagaaagtcatttctcaaattattgcagaaaatgaacatccaagttcatcggatgcaatccagcacaaaagcatttttacagaagcacaaaggtttgaagcaatcaaaagaaaatgtttatctgacacgcagagttctacttccacatcttctgatgacgatgattcatttgagtttgacgaaggtaatccccccaagagaagaaaaactgcaccagacagttctggagtaaactctttgccaag

SEQ ID NO: 86529 - DNA, 267 bp, Glycine max
  Peptide Sequence Number=SeqID_203307
atggggagggatcctaactattggattgaggctgagaaatttaatcctgaaaggttccttgatagctcaattgattacaaaggtgcagagtttgagtttatcccatttggagctggaaggaggacattccctggcatcaatcttggcattatggctcaagggaatagtccccaagaacttgatatgactgaatcctttggcttgacagtaaaaagaaaacaggatttgcagttgattcctatcacttaccactctgctacaagttaa

SEQ ID NO: 86530 - DNA, 330 bp, Glycine max
  Peptide Sequence Number=SeqID_203308
atggaaattgttggcaaacttgtttccaaggttatttttaatctcggaacaaaagttgaaggtggtcgggaatatggggagtttagaggaatggcatatgagagcaagccctttgggcacttagtctacaaattctgcatattcacaatgaacactagatggtggttcagaggccctgcacatcaccttagcagagaatgtcacagttggatctcaccagatttgctctggccttaccggaatcacttgaagatcatttttggctacactcgggcattggaaggtcttcagctgaatgcaatatatggatggttatatggagtgcagtaa

SEQ ID NO: 86531 - DNA, 144 bp, Glycine max
  Peptide Sequence Number=SeqID_203309
atggtgatttggttaaggaataacaaaaaccaacacagttcctcagactcatcaatttcgctgcttatcatagatccaggcattccatccctagaggaagttgaaacttcggcattttccaaagccatcaactggatccgttaa

SEQ ID NO: 86532 - DNA, 669 bp, Glycine max
  Peptide Sequence Number=SeqID_203310
atggaatctaagaaaaggaaggctccttctacaccttccaaaatcagatttgacagatcaatatttcactctcaagaggcttgggagagatacattgacataattatgcctagtaagttgttaccagaaaggaatgtggttgtatattatactgaatttgatgagttcaatgaggaacttgagagaagacactgggatgaggagttgactagttttgctgacggcaacatcgatgttgccattgtgaaggaattttataccaacctctacgacccagaagataagtcacctaagcaggtgagggtcagaggtcatttgatcaagtttgatgaagacacattgaacacattcttgaagacctcggtaattttggaagagggggaaaatttgtgtgcttattccagatttgcactcctgaggcttgatcctcaggagttggctgctaagctctatatcccagggaggggatttgagctaaacgctgatggtcagcccttgaagatcttaaggaagaacatgaccatgctcgctcagacatggagcgttctttccttctctaacctgattcctacctcccacacatttgatgtcaccttagacagagccaaattaatttatggcatcattataaagatggatatgaatgtggggtacctcatctcccactag

SEQ ID NO: 86533 - DNA, 342 bp, Glycine max
  Peptide Sequence Number=SeqID_203311
atgcgttttctggtggtgtattcttgcaaccagctgcctccagcacaattggaaaatgcattaaatagaattgcagccttgaaggcaccattgattgcgcatgcaagccagccagatatacaatctaaacttccgagggctgtgctggttgttctgggacttgcttccgattctcaggtttcaagtcaagcacaaactagtcagacacaaactagtcagacacagactagtcaaacacagactactcagacacaaactagtcaaacacagactggtgagacaagcagctcagacaaggacacagcgacagaaaaatcaaaggaatcgtctacagccagctaa

SEQ ID NO: 86534 - DNA, 822 bp, Glycine max
  Peptide Sequence Number=SeqID_203312
atgtctccgtcgttggatcttcctcccaagggtggcttcagttttgatctatgccgaagaaacgcaatgcttcaaaacaagggcctcaaagccccaacctttctcaaaactggcaccactattgtcggtttagttttccagcgagaatatggggagcctagtctggctctggatatcttgatttctgaagtttcccacttaataaatctgcctcaggatggtgtcattcttggtgctgatactagggcaactgaaggacctatagtggctgataaaaactgtgagaaaattcattatatggcacccaacatatattgctgtggagcaggcacagctgctgatacagaggctgtaacagacatggttagctcacagctgcaattacatcgctaccatactggtcgagaatcaagagttgttacagcgctgacccttcttaagaaacaccttttcaattatcaagggcatgtctcagctgctttggtgcttggtggggttgatatcactggacctcatttgcatactatttatcctcatgggtcaactgacaccctcccatttgctacaatgggatcaggttcacttgctgcaatgtctgtatttgagtccaagtacaaggaaagtttgagtagggatgaaggcattaagctagttgttgaggcgatatgcgctggaatatttaatgacctaggaagtggaagtaatgttgacgtttgtgtgataaccaagggacacaaggaatatctcaggaaccaccttctaccaaatcctcgtacctatgtcaatccaaaaggctttgatttccccaaaaagacaggttag

SEQ ID NO: 86535 - DNA, 768 bp, Glycine max
  Peptide Sequence Number=SeqID_203313
ggtctatactctagtgatttagatggtgcccttgaatctgcttgggcatggatgcttaaattcaaagacaaagtgtactcaatagcttttcaacatggaagtggtggcgcaaagctgctggcactgaagtttgttgaggcagttattcgtctttacacacctgatcccaatggttcctcagagcccacttctcatcaaggtattacattgagattggttgggcggggtcatcctgtacttaacattggagatttgaaaattgaagccagccatcgtttgggtctcttgcttgatcaactcagatttccaactgtgaagtcccttagtaactcagtaatcattgtgctgattaaaagtctatcagccattgcatttgacaggcctgcattctatggccgcatcttgccagttttgctcagtttggaaccttccagctctgttgttaatggggtctgtgtatcagctacacattttgctttgaagaatgcctttgttacttgctcgaaatgtacacatccaagtgctgctccggaaatgcagtcagaaggaaaggcagatcgggtgttccacctaatctctgctagtaatggaaccatagagagagagaaagatgatcaacctgttatcaaggccaaaattcccccatatagacatgcaattgctgcctatggcgctgccatggtaggcctaccttcacaaattgcctatggtggttggcaaaaatccgccatgccattccgctatagcagtcatggggccaccatttaa

SEQ ID NO: 86536 - DNA, 2481 bp, Glycine max
  Peptide Sequence Number=SeqID_203314
atgtctagtcgtgcagatttcgtccttagcttgaaggaggaagaggaacctgcaacaaattctggcgattcagtgcagaataatttggcaagaaaacgatcaggatcacaaattggaggtgatttagctgaagatgaagaaactcctggaaaacgggtcaggacaactgttgttgctttggaagagcctaaggagttagatgaatgtaccactacctactctcaggatgagactccaactgtaccaacatcttcaaaaggagatgtggataatgggcctgtacggcaacttgttgccacatttggtgctttgattgctcaaggtgaaagagctgttggacatttggaaattctcatctcaagtatttctgctgacttgctagctgaggtggtgatggcaaatatgcaaaacctacctccgaattaccctaatgctgaaggaaatgatgaacagctgcaagacattagtatgattggttctgatgacaaggctaaatatccaccatcatttgtagctgctgttatgtcactttctagtactttcccgccaatagcttcccttcttgatgcacatcaatcagtgtccaatgagaagtcacaagtggaggaagaaatttctgcaactgctgcaaatagtggtgctgtggattctggcatgaatattgaatctgaaaatataccatcgcctattgattttccatcttctgatgccagtatacctggagtagagaatggctgcacaactatgcctcctgacatccatgatgttggaaactcagagagtggaatccctggcctagattcttttggtcgtagtgattctgtgtcacaaacttctgctccttccttgttggtttccactgaaacatgcctagaagatggcagtcaagagcaggttacaagtttggatcagaggtcacctctgaacgtagctccatcaatatcaacagataggtctgaggagctgagcccaaaagcggctgttagagatgtcaatagcttggtgtcctcaacagctacttcagttgtgcctccccgattagtcttgccaaagatgattgctcctgttgttgaccttgaagatgaacaaaaggatcatttgcaaaagtcatgttttatgcgtattattgatgcatataagcaaatagctgtagctggaggcaccaacattcgtttttcgatacttgcttatttaggagttgagtttcccttggaattagacccgtggaaactattacagaagcatattttgattgattacattagtcatgagggacatgagttgacattgcgtgtcctctacagattatttggtgaggctgaagaggagcctgacttcttttcttccacaacagcagcttctgtatatgaaaatttcctccttacagtggcagaagcacttagagattcctttccaccttcagataaatcattaagtaaattgcttggtgaatctccttatttaccaaaatcagttctgaaaattttagaaaacatgtgttctcctggaaatggggataaaggtgaaaaggagttgcactcactgaatgcagatagagttactcaaggtctaagtactgtatggagtttgattcttctaaggcctcccattcgagatacttgcttacaaattgctctacagagtgcagtgcatcatctggaagaagtgcgtatgaaggcgatacgtctggtggcaaataagctttatcctttgtcatccatttctaagcaaatagaagattttgcaaaggaaatgcttttctcagtgatgagtggggatgcatctgaagctactgatattgaaggttccattgctgattcagaaaagggacctgatgttgagaaggttccaaacgaacaatcatcattgagtggcagcactaaagatgtcacctcagataatcgtcaatcatgcacatctgagagtgtctcaccagattcagtttctgaggctcagaggtgcatgtcattgtattttgctttgtgtacaaagaaacattctctctttcgccaaatatttgtcatctatagaagtacatcaaaggcagtgaagcaggcagtacatcgccaaattccaatactagtacgtactatgggctcatcttcagatctccttgaaattatttcagatcccccaaatggaagcgagaatcttctaatgcaggtattgcaaacacttacagatggtacgatcccttctaaggatttaatatgtactgtgaaaaggttgcatgattcaaaactcaaggatgcagagtttcttattccgatattaccattcctatcaaatgatgaggtaatgcccattttttctcacattgtgaatcttcctttagagaagttccaagcagcacttgggcgcatattacagctcaaccttacaaaatcggattgtaaggtgaaagtagccccactacttatatacagtattttggcaatatcacttataacacagggactgcgtggcggtctttggcgatga

SEQ ID NO: 86537 - DNA, 234 bp, Glycine max
  Peptide Sequence Number=SeqID_203315
atgtatttactcagtgacgaatttgcgaacggggccgaaacaatcagagtaaaagaagaagagcaaggggacgaacttggtgagaaggtcgaggtctttggtgaaagtttgaggcagagttggcacaacgattcgaggatggaggggagtggttggccaacttggcgatgttcgcaagacatgggagcttttcgcgggaagtcattgccatggacattgctttttcgatcatga

SEQ ID NO: 86538 - DNA, 459 bp, Glycine max
  Peptide Sequence Number=SeqID_203316
atggcggcgacttcccgcgaaaaactggcgagtctcgtgaacgccgccaagctggccatcgacatcccttcgaagctagaatcgctgcgccaactccgccacgaacttccccccgaagaccccgttctcctcaccgagttcctcccctcgctcttcctcttccactccgatcgcttcggccccgttcgcaaattcctcaccgagattgattctggaagctatccttccctcactcttcctcttccgctccaatgcctcggccccgtttgcaaattcgtcactgaggacacctttttcccgatgcttggggagattggattgaagaacacagagttcttgtccaacattgtgcctgtgcttattgatttattggatgatgacacgccggcggttgttcgccaagttctactgtgcggaactgacttgtttcgcgccactcttgagaaaattgtggttcag

SEQ ID NO: 86539 - DNA, 234 bp, Glycine max
  Peptide Sequence Number=SeqID_203317
atgtatttactcagtgacgaatttgcgaacggggtcgaaacaatcagagtagaagaagaagagcgaggggacgaacttggtgaggaggtcgaggtctttggtgaaagtttgaggcagggttggcacaacgattcgaggatggaggggagtggttggccaacttggcgatgttcgcaagacatgaaagcttttcgcgggaagtcattgccatggacattgctttttcaaccatga

SEQ ID NO: 86540 - DNA, 331 bp, Glycine max
  Peptide Sequence Number=SeqID_203318
atgggactaggatcaattgcagcaaaaacatttgaggatataaagtttccaaaaggtcatattggaattaagagttttgatgccgaactagtcaatcaagagggaaactctataccttcgtatgaaacttacctttatcattggtttgcaataaagtaccataaaaacattactatgtcattgaatcctaaacttcatcgtcctgaggatgcttttttcaaaagaaatgaaggcacatgtaatggtggtattctttcacattattggggattcagagttgaatcacgaggaacatcgtcaaacattcttgatccttttgctatagaacaag

SEQ ID NO: 86541 - DNA, 117 bp, Glycine max
  Peptide Sequence Number=SeqID_203319
atggaaaatgggattctaagggtttacctgacccctaaacattatgttgggaggcttcttgactttcaagttttagctcctatcaacttgttccaacttaggataataagctcatga

SEQ ID NO: 86542 - DNA, 178 bp, Glycine max
  Peptide Sequence Number=SeqID_203320
atgtttctactctacaacagttggaggattgagatgctatgagaatccaaagaataagattactgcagtcccttctgaggaagaggaaatctggggtgtattattcaaggtaatcttagagcttaagaagttagagttgaatatccattatgtaactaggattgccaattgcgactaa

SEQ ID NO: 86543 - DNA, 216 bp, Glycine max
  Peptide Sequence Number=SeqID_203321
atggatggtccccggatgaaattagggtatgacaatattacttggcaaaaaagcagtctaaagctactctgtcatcatggacctcatgtatcaaaagcaaatacaaatggtaatgatgctgatgttgcacctgaattttctcctttcaaaactgttcaatttggaaatccttctcaagacactgttgacccaagagatggaggctttgaaggatga

SEQ ID NO: 86544 - DNA, 780 bp, Glycine max
  Peptide Sequence Number=SeqID_203322
atggctattgttaaagcattggtgttttacattagaatcaacattatctcagtcatcaatcttagaatatggctctggggatctctaattgcaatcttaatgtataaaacaatagctatttggtctcacaggtactactccatgtatgggcatgttgagaaactagcagaagaaataaagaaaggggcttcctctgtggaaggtgttgaggccaagttatggcaggcattctcttggagcaaaactatgcttccaaattcattcttgctaaatttgagaagaaatgtacctgagacactgctggatgaggtgcttggtaagatgagtgcaccacccaagagtgacgtaccagtcattacccccaatgaactatccgaggctgatggctttgtattcggcttcccaacaaggtttggaatgatggctgctcagtttaaagcctttctagatgctactggaggcttatggagagcacaacagcttgcaggcaagcctgctggcctcttctacagcaccggttcacaaggtggtggacaagagactacagcactcactgctatcactcaactggttcatcatggaatgatattcgttccaatcggttacacattcggtgccggcatgtttgagatggagaaagtgaaaggtggaagtccatatggtgctggaacttacgccggtgatggctcaagacagccaagtgagcttgagttacaacaagcattccaccaagggaagtacattgctggcatcacaaagaagctcaagcaagctgcataa

SEQ ID NO: 86545 - DNA, 357 bp, Glycine max
  Peptide Sequence Number=SeqID_203323
atggcatatataacactcaaacttgacactgatgctacaactaagagactactaaagctgaagacagggccccactcactgcccttggcaaggatcaagaagatcatgaagaattctggggaggatgttaagatgatatcaggtgaggctccaattattttctccaaggcttgtgagctcttcattgaggaacttactagaaggtcctggatcatggccatccaaggcaaaaggaggactttgcacaaagaggacttggcttctgctgttatagccactgatatatttgattttttgatcactttggtttccagttctgaaagccatgcagttggtggtgccacaaatgtcatggag

SEQ ID NO: 86546 - DNA, 2358 bp, Glycine max
  Peptide Sequence Number=SeqID_203324
atgaagaaccatattatgccttttatgagaattattttcctttgttatcacatacttgtctatctttctggaatttccttggcacttgactcaatttctcaagacctgtccctaagtgatgatggtaaaaacaccaccttggtttctaaagatggaacctttgaacttggatttttcaccccagggaactcccagaaacgttacctgggaatttggtacaggaaaatccctattcaaactgtggtttgggttgcaaacaggctcaatccaatcaatgattcatctggcatcttgagaatgaacccaagcactgggacccttgtcctcacacataatggcactgttatttggtctacagcatctataagaagaccagagagtccagtggcacttctcttaaattctggcaatcttgtgataagagatgagaaagatgcaaacagcgaggactatttgtgggagagctttaactaccctactgatactttcttacctgagatgaagtttggttgggacttgagaactggtcttaataggaagctaatagcttggaagagtcctgatgatccatctcctagtgacttctcttttggtatggtgctcaataactaccctgaagcatacatgatgaagggtgatcaaaagttctaccgaagtggaccatggaatggcttgcattcaagtggttcaccacaagttaaggccaaccccatttatgacttcaagtttgtttccaacaaggatgaactttactacacatacagccttaagaactcgtctatgatctcaaggttggtgctaaatgcaacaagctacgttcgtaagcggtatgtgtggattgaatcaaagcaaagatgggaggtgtacacttcagtgccactggacttatgtgacagctattccctttgtggagctaatgcaaattgtgtaatttcagattcaccagtgtgccaatgtttgcaagggttcaagcctaagttacctgaagcatggagctcaatggattggtctcatggatgcatccgcaataaggaattaagctgtgagaacaagaacaaggatggatttaacaaattgactttgctgaaaacgcctgacactacacatagttggctggatcagaccattgggttagaggaatgcaaagccaagtgcttggataactgttcttgtatggcttacgcgaattctgatatcagtggacaaggaagtggctgtgctatgtggtttggtgatctaattgatattagacagttcgcagctggaggccaggatgtatatgttcgaattgatgcttcagaattagaacacgccaatgagggccacaagaagggtggagtcctagtggcagtaacagttactttggccttggctgcagttgctggaatactaataatacttggttggtgttatagaaagaaatcacgttgcagtgtcaaagagagatcagacttcagtatcaaatcaaatcaaaacagtggaatgcaagtggatgatatggacctaccagtttttgacttgtcaacaatagctaaggccactagcaacttcacagtcaagaacaaaattggagaaggtggttttggacctgtatacaggggaagtctaacagatgggcaagaaattgctgtgaagaggctttcagcaagctcaggacaaggattgaccgaattcaagaacgaagtaaaattgattgcaaaacttcaacaccgcaatcttgtaaagcttcttggatgttgccttgaaggagaggaaaaaatgttggtttatgagtacatgcttaatgatgagcaaagaagtggatcactggactggtcaaagcgcttcaacattatatgtggaattgccaagggccttctctatcttcatcaggattctagactaaggattatccacagagatctcaaagcaagtaatgttttacttgacagtgagttgaaccccaaaatttctgattttggcatggctagaatttttggtgtagatcagcaagaaggaaacacaaagagaatagttgggacatacggttacatggcaccagaatatgcaactgatgggctattttcagtgaaatctgatgttttcagctttggagttttactgctggagattatatcaggaaaaagaagtagaggatattacaatcagaaccacagccagaatctcattggccataatccagaggataggcctggaatgtctagtgtgctcctaatgttagtgagtgagcttgaattgcctgagccaaaacagccaggattctttggaaaatattcaggtgaagcagactcctccacaagtaagcagcaactaagttccacaaatgaaataaccattaccttattagaagcgcgttga

SEQ ID NO: 86547 - DNA, 177 bp, Glycine max
  Peptide Sequence Number=SeqID_203325
atgtgtttgaaagagaaagaaagcgaaatgaccgttcaaaagatagccatagttggaccaactacattcagaattatgctggatgctttttcacatgcttttgtgctttataccgaatggccacataggtgcccttccattggaagtatgtgtagaaagaaaagaggaaattcatga

SEQ ID NO: 86548 - DNA, 1383 bp, Glycine max
  Peptide Sequence Number=SeqID_203326
atggcagataatgatcaatttcaagcaagtgggaactggtgggaaacagcaagaagcgtgaggtatgagagcggagcatcacagtcatcttcctcagccatcaccaacataggcaacaactttggttggcaacaaggttctgatatggcagacatgaagccaaggtcttccatggattcttcttctgtggttttccatgacacacagaataataagcttcagcaaccagattctgccacttcaactgaccccaacttgcatatgatggggctaggcctttcttcccagaccatggattggaatcaagcatctttgttaagaggagagaagggtacggagaacagtttccggtcgatgctgcaagagaatttgagctcatcaaggaccaattttcagcaagaaactgggaatatggggttgtctcaacaagttcaatggaggtcagagaagatgttctcttcagagtcttcaaccaatgagttcaagcaagtgaataataggggtggtggtggcttctctttggatcaaagccagtttagtcctcaatatagctctggggacagcacagtgacaagccaagggttaccctcttctaactttcagattgattcttcagccttatatgggaccccttcaatcttgcaaggactattgggacctgatcacaataaccaaccccaacaacaacaacctatgagttttccataccaaacaacaagctatgggttgaactctaatgagttggttccttcttggtccaaagttcctcaattcttgagagcttcacctccaaaacaaccacccaataaccagttgcatttcactaacaacgcaaccttttggaatgattctgaggctgcaaacaacaaagatgttcgccccagcttcttcccctcattgcaaccccctttctctacgccaaattttgaagtacagtcaaagaatatatcagaagttagggagtcaggtaccgtggtaaagaaaagtgggaatgagccagcacccaaaagaacccgtaacgaatcaccatctcctttgccagcttttaaggtgagaaaagagaagatgggggacagaatcactgcactccaacaattggtgtcgcctttcggaaagactgatacagcctcagtgctctctgaagccattgaatacatcaaattcctccacgaacaggtcactgctttaagtaccccgtatatgaaaagtggagctccaatgcagattcaacagaattctggcaaatctaaggaagctgagggtccaaagcaggatctaagaagccgagggctatgcttggtgcctgtttcgagtacatttcccgtgactcatgaaaccacagttgatttttggacaccaacattcggaggaacttctagataa

SEQ ID NO: 86549 - DNA, 720 bp, Glycine max
  Peptide Sequence Number=SeqID_203327
atgggtggagcagcggaggacagcggtgtcagacttgtaggagtcacaaatctagaagtgcacgtgcttgagggagaggacattggcggcatgcacatgctgtcacatggcaacatggtgagtggtgatgatgggttaagggaagaagcatggggtgaaggtgaaggtgaaggtgggaaggaagagacgcaaaatctcaatgtcaacccaacaacacttccctctgaggattttgaggcttatcccaacacgcaagagggttgggtgagtgatcatggaggagttgtttttgttgttggggagatagacagagggtttggtagggaggtgggagcaccaacaggtgcagaagctcatgttcataaatataccagatacaaggagaaggtggatcatgggaaactaataagaagaaataacgagccaatagtgggtgtggataaggagtataagcacacaacgtatgatgctgggaaggcgagcattccataccagatagtagacacgaggcgacaaggagaaatggtaggggaggaaggtagtagtggatatgaatggttgaagaacttgaaggactttggtaagttacaagggatgaaggtgcaagaagtccaaaaatgggaccccgacattgcatcagctaacaaggttggaagcttagaaggggtggatgaagacactctaactttgaagtatgtggaatatgctcgtatttggtga

SEQ ID NO: 86550 - DNA, 459 bp, Glycine max
  Peptide Sequence Number=SeqID_203328
atggccaccaagaggttaaaaaagttgttagaagctcgtaaatcttccagtcgagacacttcaggtttggaagaggttttctccacaactaatggtttctctgttacaagtctacttaggcatggaacatatggttctgtttattatagcctcctccatgatcaggaagttgctattaaaagaatgacaactactaaaacaaaagagtttatgtcagagatgaaagttttgtgcaaggttcatcatgctaatctactagtcatgaggagcttttccttgtatatgaatatgcttagaatgggttcactcaaaagccatatgcacgatcctcaaaataaggtccagattgcacttaatgttgccaggggtcttgaatacatacatgagcacacaaaaactcattatgttcaccgtgatatcaagacaagtaacattttacttgatgcttccttaagatga

SEQ ID NO: 86551 - DNA, 348 bp, Glycine max
  Peptide Sequence Number=SeqID_203329
atggatgcaaagagaagagaagatatggttgatgtgcttccaaagagaagaatattgatgcggcatgagaagtcacaggggaaccggaacacgacggcgtacaccaccatactcgactacaacattcagtcaacgacgcaaggcatgacccaggccctctgcaccggcgagcacctccaccgcatgataggcagtgacggcttctcccctgacttacgggtgcagttctatatgtccccctacgcctgcacccggtcgacgctccccaagctcaaactctcgaagaagaggatcattggcatgagggaagagtcgcgagttcgagaatgggatttcgggaactttcag

SEQ ID NO: 86552 - DNA, 276 bp, Glycine max
  Peptide Sequence Number=SeqID_203330
atgaacaacaacattaagagcaacctaaggaagggattgtggtcacctgaggaagatgaaaaactcataaggtacatgatcactaagggacaaaggtgttggagtgacattgctaggaatggtggccttcaaaggtgcggcaagagttgtcagcttcgttggattaactacttcagacctgatctcaaacgtggtgtattttcaccccaagaggaagaactcatcattcatttgcactctattcttggcaacaactaccttctcgatcttaattaa

SEQ ID NO: 86553 - DNA, 282 bp, Glycine max
  Peptide Sequence Number=SeqID_203331
atgtttgtggaggacactgataacagtccaataactctgcttaagaagtgggtgcattttgggtacattgggttgtggactggccagtacctcactactttgaattctgagttccttagtcaagtggaaaattccattcctacaggtaaggagaccaagcttcttgtggcgtgtggaggaggattaagcctccgccgtcgtgccctccctcgtgggcttccacgtttcgtccgtcgtgccttccggtatcttctccggcctaagttgtggaagtttggtgag

SEQ ID NO: 86554 - DNA, 318 bp, Glycine max
  Peptide Sequence Number=SeqID_203332
atgagtagaagcaggatcgggaaaagccataagaaatgtagtaaaacaccaacaaaatgggaccaaatagaactcaattggccaaacggcatccaaagtagccaaacgggggctggggatatatgtggcgacaagtttggtggtgcattggcaatgttacaatcgctagacgaagaagacactgatggattggtcaggccaattaaaaggaagcacaatggtggtcaagaagccctcgctgctatcgctttgttgttcatacgaatgagaaaagtgttgtggagggagaaaaaaaaggacaaaggatttgaaacctaa

SEQ ID NO: 86555 - DNA, 534 bp, Glycine max
  Peptide Sequence Number=SeqID_203333
atgttgattttgggagtaatcaaagaaggagatgacccgaaaatagtatcgctattttgtatccctttcttagtacagattcataacctccctatgggttttatgtcacaaatggttggagaaagcattggcaactttatcgatcaatacttggactatgatgagaaaaataatgtcaattacttgagatcttttatgcgtatcggggtgctaatggatgttcaaaagcctttcatgaaatctaagattaagaaacctggaggagagtttaaagaattttgttacaaatatgaatacctaggtccattttgctatttctgtggcattttaggtcatactgaagatcattgtcgcactctgctgttcatgcaacaagatgatggaaagtgtggcttgggtccaaaaattcaagttgaagcatgtcctaatgatggtgctagtggatcacgttacctatgggacaccggagatcctaaaccgtggcagttttcgtcagaaaagaagacaacaaatgttgacaataaaatgcaatga

SEQ ID NO: 86556 - DNA, 147 bp, Glycine max
  Peptide Sequence Number=SeqID_203334
atggatgcctcagagccctacattgaggcaatgaaagacaccatgcataagcctcaagcgaacctaggggcaaatcagaggttctcacccagtaggttccctactgcaaggttaaaaacccaaaagggcagcctaagcaaaaattag

SEQ ID NO: 86557 - DNA, 581 bp, Glycine max
  Peptide Sequence Number=SeqID_203335
atggcacggggagacgattatgatcatccataccctttttgccatccagagacaatcaagtacgatggcatacagagaccatcatggtcattcgctctcattgttttcaagactattttaatctccttttccatccagagacaatcaagtctgatggcatacggagatcatcatgacaatgtcttcagtcattgcacgccttcaaaaggcgacaatgaccatcattttcatttcgaagacgacaatgtcttcagtcattgcatgccttcaaaaggtgacaatgaccttcatccacatttcgaagacgacaatgtcttcagtcattgcataccttcaaaaggcgacaatgtcatcattttcattttgaagacgacaatgtctttagtccttgcatgccttcaaaaggcgataatgaccatcatttgcatttcaaagacgacaatgtcttcagtcattgcatgctttcaaaaggcgacaatgaccttcatctacattttgaagacgacaatgtcttcagtcattgcacgccttcaaaaggcgacaatgtcatcatttgcatttcgaagacaacaatgtcttca

SEQ ID NO: 86558 - DNA, 456 bp, Glycine max
  Peptide Sequence Number=SeqID_203336
atggtgttgatggaccaaacgggttcaaaaattggagctactctttggcaagaactcttcactgaattgcgggacaagttacagtgtggttcttcgtatttgattcagaacctgaggattgttgacaaccaatctgaatacagagtcagcctagctccatatttggtttatttcctaaaaactacatctgtcaaggaaattcaccgtccaaaaattccttctaatgtttatctcataactccttttactgatataatctctggcctcgcaccacgccatactttagtggatattgttggtgtcattgttgatctgatcgatgttaagacagttaatccccctcacaggatgatagtcaggctcagggataacagtaactacgacattctaataactgtttgggaggactatgctattcaactacatgatgctattgacaaaaaccttctgctttag

SEQ ID NO: 86559 - DNA, 198 bp, Glycine max
  Peptide Sequence Number=SeqID_203337
atgggatcaagtcaaaagccttcgcttaaaaagaagttttatcaagtcaaaatcaagagcttagaggtcaccagtttaggaaagttggggcaattaatgggtcaacttcaatggcaagccttccgcaaagcctatggaattagaccgccaaaggcgagtcgaaaatggggtggtcggaataccgatgtcataccctaa

SEQ ID NO: 86560 - DNA, 426 bp, Glycine max
  Peptide Sequence Number=SeqID_203338
atgcaaaagagcagagtcaccctaagggctgaatctcaacactttgcaagtgtacatgatgacaattcctgtgtagcttccatcccttactctgggttcattgatgaaatttgggagcttaactatgtcaaatttactgtttgtgttttcaaatgtaaatgggtagacaacaacaccggtgtgcggaccgatgatgtgggatttatgtttgtagacctaaacaaactagcttaccacaatgatcctttcatcatggcagaacaagctaaacaggtattttatgtgcaagacccttgtgatgaaaggcccatggctactccacctgcctcgtgtcctcctcctcctcctcttcctcctcctcttcctatagtagcatcagtgtctccgtctaccttgaagcggacacgcaaagccacacggctatga

SEQ ID NO: 86561 - DNA, 246 bp, Glycine max
  Peptide Sequence Number=SeqID_203339
atggcttcctatggtgtggtgtctccattcatctttctccttctccattccactgcaataagacctcaagaagcaaaggaatccattgatgaagaagatccaaggcctacaagctccacattgatctacatcattcgagagccatggaggatgacgggcgggaggtccttagagctgatgttctggtcacccaatggtagcagtcaatacatcctgacgtccatgggcgacaaaggaaccctgtga

SEQ ID NO: 86562 - DNA, 1032 bp, Glycine max
  Peptide Sequence Number=SeqID_203340
atgcatacgttcaatcatgccaaccgggcgatagcgtgcgctgaccatcacctgcggccggcaccagatccacagcgtcgcattttgcgtgctgcgctcctctttactgaaggtgacgtcattcagcaccgccagcagcgcatcgttttgctgcgccagtcgggtgcgcggcgaggccgaatgaatctcatcgaaaaaatcgtcatctacgctgaagtggtcctgaacccagcgctcggcgcgggcatgattcaggttaatgtgcagccagagaaagcagccgtcggtttccctgcatcatcgtccgaccgcggacggcccaatctgcacccgcgcagcggtcgcgcgtcgcgcgtgctgtttctgctgctgctggtggccgggctggtgttcaccggtatcaatctgttcaacgacgtggaagagaccggcgcggtcgtcaccagctatacgccgttcctgctgctcggcgtggcgctgctgattgcgctcggcttcgagtttgttaacggctttcacgataccgccaacgccgtcgccacggtgatctacactcactcgctgtcgccgggcgtggcggtggtgtggtccggcttgtgtaatttccttggcgtactgctctccagcggcgtggtggcgtttggcattatttcgctgctgccggtggagctgattctgcaggcgggcagcggtcacggtttcgccatggtgtatgcgctgctgtgctcggcgattgtctggaaccttggcacctggtatttcggcctgccctcttcctcttcgcacacgctgatcggctcgattatcggcgtaggcgtggcgaatgcgctgctgcacggccgcagcggcaccagcggcgtcgactgggatcaggccatcaaggtcggttacgccctgctgctgtcgccggtgattggcttcatctgcgccgccgtgctgctgctggccatgaaggcattggtacgcaatcgccagctgtatcaggcgccggaggcaatcagccgccgccagcgtggattcgtggcctgctga

SEQ ID NO: 86563 - DNA, 348 bp, Glycine max
  Peptide Sequence Number=SeqID_203341
atggcttctccaccagccttgcctcctcctcctcctcctccttctcctcctcctcctcctcctcctcctcctcctcctcctcctccttctcctcctcctccttccgacggaaagcctcacgtctacgctccttgtctactagaccagctggtgttgagagaccagtggtccacgttgatcctgctactggcaaggccgacggtggacgtgacatacgagaactggaaggaggtccctactgctcagaaggacttgatttgggaggatattcaggcggaatttgatatcctagaggcttctgacagtcggacgaaaaagaagttacttaagactgttggtgagagatag

SEQ ID NO: 86564 - DNA, 225 bp, Glycine max
  Peptide Sequence Number=SeqID_203342
atttatatgtccagtattttcgggccagatgtcctggacatcgtatccgacattgtggatcctgcagcttccattcttcatttgacttttatcttgccttccagtattttcgggcaggatgtcctggacattgtatccgacatcgtggatcctgcagcttcaatgcttttagcaattccagtattttcgagcaggatgtcctggacattgtatccgacatcgtga

SEQ ID NO: 86565 - DNA, 303 bp, Glycine max
  Peptide Sequence Number=SeqID_203343
atggtgtgcatgcatatgaaaggaaaacgtagaataactatcgcaacctgcccttcagcgggggtgcgaaaagggcttctcggatgggccaagggtgcatcttccgtcgaaggaaaatgcgtggagtcaccaccaatttttattcaaggaaaacgtcagaaaaaccaaaatggaaaaggtcaaaagtctacgtattttaaaaatgagggttcaggagtggtttacacacagggaagattgattttaattgtgaacaaaagtcatttaaggcgttggacctttgaacgacctcttgatttttaa

SEQ ID NO: 86566 - DNA, 492 bp, Glycine max
  Peptide Sequence Number=SeqID_203344
atggcaatgaagaaagaagctagaggtattctggaaattctcccctacagtgaatatacagttcagaaggcctatcacaatattatggagaacatcctagataatacccatctaagatgcgaaggagattggatgctcatttggaagcttcaagcacctccaaaaataaaacacttcttatggagacttctaaggggatgcctactaactcggtccaaccttagaaagaagcaaatattgtgccctttaattggattgtgtttgctgcaaaacaaaatcattgaaaatgaatggcatttattccttgcatgtgatcacgctcaacacatatggcttgaagctatcttagggaatcttattgagcaaaaatgggataatgttgagaactttcactctttgatctttcatctcttacaggattttctttcacaaaatagtcaaaattggtgtggttctttggtgcatttgaaagacccacaacacaaaaattag

SEQ ID NO: 86567 - DNA, 324 bp, Glycine max
  Peptide Sequence Number=SeqID_203345
atgcccgggttgggttgggattggtcaagcttggttttgggcaatagcaccccactgacgtccctaaggtctcgtgacccccgcgacatatctccaggtggcggtcaggcgatggtgcaagtcgactatccagatccacaaatcacacatgaatccaccatccccagttacccaccttcaactgagctcacgtactcccacgtagcccttatcctcgttcctctcaacaccgggtccccatcaatccccccaagcttccacaacatccaagaaatttcaacatccaaacatcatgaactatcaaaaccaagcaaaacagggtag

SEQ ID NO: 86568 - DNA, 204 bp, Glycine max
  Peptide Sequence Number=SeqID_203346
ttgagcttagctcatcagtggactaagcgcgcatccaccgctaagcgcagcttcagcgcgcttagcgcatcacaagaatctagcagagcatcaatatcaaggtcgcacgctaagcgtgagatcagtgtgctaagcgcatcatttgtcttcagccaggctcagcacacgactggtgctaagctcaaatccacttatgcgcgctaa

SEQ ID NO: 86569 - DNA, 189 bp, Glycine max
  Peptide Sequence Number=SeqID_203347
atggggcgtagcaagcaaatgctcaccaacctcttagggagtctgaagctcataaaaagggagaaaattgcttgtcttgaggagctcaagccccttaacttgagagagttccatgggaaggaggagaataaaggaagaggaatgatgcagaaagatgaagctcaagcgaatgagagaaaaaaggaataa

SEQ ID NO: 86570 - DNA, 129 bp, Glycine max
  Peptide Sequence Number=SeqID_203348
atggatgttgtagaatggatattaaggtacttaaaatctgcaccaggaaaagcatatgacaaaaggtttacagctgactacttcacttttgtggaaggaaatctagtaacttggagaagtaaaaagtaa

SEQ ID NO: 86571 - DNA, 108 bp, Glycine max
  Peptide Sequence Number=SeqID_203349
atgaagaataggtcaaataaatcagattctgctaaaaatatgcaagatttgtcttcaatccttacacctgagcatcttgatgaatatatatacgaaggagaagattga

SEQ ID NO: 86572 - DNA, 420 bp, Glycine max
  Peptide Sequence Number=SeqID_203350
atgcatgaacgacaatcaattcatggggctccgaataaaagtggagaatggagaattgcactaggcaatcactacgcgtggctccagactcattggtggaagatgcatgaacgacaatcaattcatggggctcccaataaaagtggagaatggaaaattgcactaggcgatcacttcgcgtggctccagactcattggtggaagatgcatgaacgacaattaattcttggagctccgaataaaagtggagaatggacaattgcactacgcaatcacttcgcgtggctccagactcattggtggatgatgcatgaacgacaatcaattcatggggctccgaatagaagtggagaatggagaattgcactaggcaatcactacgcgtggctcaaaactcattggtggaagatgcatgcatga

SEQ ID NO: 86573 - DNA, 208 bp, Glycine max
  Peptide Sequence Number=SeqID_203351
gcggtggacaaggcgacactgtacctaacgtggaagcgctctggcagaccgcgatgctaagagttggctcgtgccacatcaagttcctcgacaaaggattggacggtgaggaaggtcgtgacaataactgtggcgaaggtgcttcgattgagagaaatttggtatctcaaaataaggctctacgtttagattcggtgcagaatcagag

SEQ ID NO: 86574 - DNA, 438 bp, Glycine max
  Peptide Sequence Number=SeqID_203352
atggagaataggacaaatgaatcagattttgctccacatatgcagaatctgtctttaatccttgagtatcttgatggtacaagttatcctgaatggcaccaaaaaggaaaaaaaatggagtcttccaaggacaactccaccgctactactggatttgttgctaagtcagtcattataaacgctaatggtgtttctttcccagttatgggtagtgctacaatatccgtttctcccttgttatccatttctaatgtgctttttgttccttctctcaactgcaatattctctttaatatatatacgaaggagaagattaacaatggtaaaagaagtgaaggattatactatcttgaaggtaattctaaatataccaaaggaaaagcactggctcactctataagtgatgaaacacaagttaagaataaaaaatatatttga

SEQ ID NO: 86575 - DNA, 171 bp, Glycine max
  Peptide Sequence Number=SeqID_203353
atggaatcaacacctacaaatgaaatcactgttgcaaaatctgcagaaccggaatcatatatagtgataatcaaatgtaattgtagattaaggagcgtgtaccgaccaatgaatgcgaaacggacgaagaagaaggggccaatattcatagatttgccaaggcccaattag

SEQ ID NO: 86576 - DNA, 640 bp, Glycine max
  Peptide Sequence Number=SeqID_203354
cattgccgcgcgcagaagcctgcagaggcatctgtagagccgagcatcacgctcgctcgatcgggatgtcaggcaacaggatccgagcatgggctcggctctagcagcgcgtcatgcgatccgatagcgcttcaacaccttgcccaatccccgtccatcgcgcacggtttccgcgtgcaggccggcagcgcgtgcgccgcgcacattggtgaacaggtcatcgacgaacagtcgtgtgtgaaggcgccacgccgagtacctcaagcgtgcgcaggaagacttccggtgcgggtttgcgcaggccgaaaccggcgctgcagaacacacgctgccgcagggccgggaacagttccggcagcagggtgggcaaggcctgccgcatcagcgcgccgttgttggtcagcaccgccatcggcagttgcaggggctgcagccgctgcaacacggcagcttgcggatggctggcggcccgccgtgccgcggtccatgcagccacatcgacagtcgtgcccagacgctcccccagctgcgccagataggccgggccatccagcgtgccattgtcatgcgccgcttccagtccgctgtcatacagcgcggcctgcacggcctgcgccggaacctgcagctcctggtccag

SEQ ID NO: 86577 - DNA, 216 bp, Glycine max
  Peptide Sequence Number=SeqID_203355
atgaagaaagatgtgcagaatttttgtgagcgttgtatcttttgcaaaaaggccaagtcaaaggtaatgcctcatgaattagggtacatacacacaatttttagcaagcaatacagaattccagagcaaggacaccgtagtgctaaatttgagataaaagctctagaggcagctagaggaatagctttgcagagaagcctagggttcatcaattag

SEQ ID NO: 86578 - DNA, 324 bp, Glycine max
  Peptide Sequence Number=SeqID_203356
atgatttgtgcattgtgcggagagagacccactcccacttgccccggaaaaattaaccccctcactgaattgccggaaatgagttgtcatattggagaagaggaaaaggggcttcataggtgtgatgccaaggtacaaggagttatgtcatctgctaacattcaagattttggcagtgaaagggagaggcttgacgcaacagacattttgacttttgagggagaagaaagattgccgatgataacgatgatgattgggatggtgaagatgtgggggatgcctatgatgatggtggtggtgggacgaaattatcgttatagatga

SEQ ID NO: 86579 - DNA, 443 bp, Glycine max
  Peptide Sequence Number=SeqID_203357
atgggtgacctagaggaagtacaggaacagatgaaagctgacatgttggctttcaaagaacaaatggcttccatgatggatgccatgttgggaatgaaacaactaatggagagtaacatggccatcgccgccgctgttagttcggctgccgaagcagacccgactctctcaactaccgcccaccaccctattccaaacatggtgggacgagagggaagcacatcgaggcatatcaacaacccccattcgtggtacaaccgaggtacttatccctatggtttaccacccaattacacaccaccagccatacatgaagacgtgggtcacgttcctaccctcatcctcgaaggggaacctcctcgacatcctgacggggtccacgagaatcctcaagagcatgctcagggagacatcaactcctactgtagaagcaaagcttcatg

SEQ ID NO: 86580 - DNA, 137 bp, Glycine max
  Peptide Sequence Number=SeqID_203358
aatgtttatacggataaccactcgggtatttccgcccgtcagcatgactcaaaagtcagtatcacagatcttgtgagtgcggaagatgatgtaaatctccgcgcgtcaacgggcttatcagccgcgattgacgaagg

SEQ ID NO: 86581 - DNA, 129 bp, Glycine max
  Peptide Sequence Number=SeqID_203359
atgagtgagataagaagatttggaggtttgggaatggaggaacgtcgcaaggaggaaggggctgcgcagggatttctggaaaatgtgatatttatagagcaggacgcgtggccatctgttctagtgtaa

SEQ ID NO: 86582 - DNA, 381 bp, Glycine max
  Peptide Sequence Number=SeqID_203360
atggcagaatcatcaaagaaacgtaagggttcatctgcctctgcttcggcttcatccgcctctgcttcggcttcatccgcctctgcttcagtttcaagagctcatcgttccggagccattagcgcttccacagcaccaattccaccctcattatcctcttccacattgttttcttccgaagaacaacagaaacggtattcaaatcttttctcatctcgttccattattgaccctaagtttattgatatggaattattttctgctgaaacttttgattgcattcaagcctttcagaacctaggtcttatacctttcatgtcattacaattgcctgtttatcctgaattggttaaagccttttattgtaatcttgaaatttag

SEQ ID NO: 86583 - DNA, 136 bp, Glycine max
  Peptide Sequence Number=SeqID_203361
atgacacagtcagacattcacagagatgaacatcagataccaactaacaccacacaggatgatcaatttgtcggcgatgacaactcagattccaccgataatgatgtaaatatgacacaggaaaacattaatatag

SEQ ID NO: 86584 - DNA, 1146 bp, Glycine max
  Peptide Sequence Number=SeqID_203362
atggcgccggccaccttcctgcgcgatttctggcagaagcgcccgctgctgatccgtaacgccttcccggacttccagaccccggtgcagccggaagacctggccgggctggcctgcgaggaaggtgtactggcgcgcctgatcgagcacgacaaggcccaggacggctggcgcgtgcgcactggcccattccaggaagacgtgttccccgccctgcccgaccacgactggaccctgctggtgcaggacgtggacaagtgggacccggacgtgcgcgccctgatcgagcacttcagcttcctgccgcgctggcgcatggatgacgtgatgatcagcttcgccgctaccggtggctcggtcggcgcccacgtcgaccagtacgacgtattcctgctgcaggcccacggccaccgccgctggcagatcgatgccagcgaatcgatcaagggcaggcagccgccgctgggcttccgcccggacgtggagctgaagctgctgaaggtgttcaagccgacccacgactgggtgctggcaccaggcgacatgctgtatctgccgccgaacgtgccgcaccacggcgtggccgaagacccctgcctgaccttctcgttcggcatgcgtgcgccgtcctcggccgagctgatcagcgactacctggacaccctgattgccgatgccgacgagaacatccgctaccaggatgccgacctgaaggtgccggccgacccgaacgagatcgacacagtggcgatggcgcgggtgatcaccgcgctcaatgccatccgcatgaacgacccggacaagctgggcgactggttcggccgcttcatcaccacctaccgtgcagcgggcgaagtgatggcccaccaggccgcaccggcaccggaggaagtggcccaggcgctggcctcgggcctgctgctgcagcgccacccgtgggcgcgactggcctggcgccgggccaagcgtggcgccagcctgtatgtcagcggccaggacttcgcgttgccggtgaaggacgcacagcgcctggccggtgccgagcagctcgacgctaccgcgtatcgcggcctgtccgacaaaggccgcgcggtggtccagcagctgctggttggtggcgtgttccagttgatcgatccgaacgag

SEQ ID NO: 86585 - DNA, 957 bp, Glycine max
  Peptide Sequence Number=SeqID_203363
atggttaaattgcttgcgagtcttgaaacaattggtgtttccaattgtggttctttagaggagatcattaaaatacctgacaattctgataagattgagtttcttaagttgaagtctttgtcacttgaatcattatcatcattcactagtttttataccatagaggggtcttctacagacagggatgagatacaaattactgttgcagagaatgagcatagtgagatggctcctcctctttttggggaactggttgaaataccaaacttagagaacttgaatttaatctcaatgaacaagatccagaagatatggagcgaccagcccccgtcaaacttctgctttcaaaacttaataaaattagttgtgaaagattgtcataatttgagatatttgtgttcattgtccgtggccagcagcttgaggaaactgaaaggcctctttgtaagcaattgtaaaatgatggagaagattttcagcacagaaggaaatagtgcagacaaggtttgcgtctttcctaagttggaggaaatctgcctcgaccaaatggatgagttaacagacatatggcaagctgaagtgagtgctgattccttttctagtctcacttctgtgtacatttataggtgcaataaactagacaaaatttttccgagtcacatggaaggatggtttgcgagtttgaactgcttgaaggtttggttttgtaagtcagtggaagtgatttttgaaatcaaagattctcggcaagtagatgtatctggtgggatagacacaaatttgcaagttgttgttgtaggttttctcccaaagttgaagcaagtgtggagcagggatccaggaggaattcttaacttcaaaaaactacagagtataccggtgtctcattgtgaaagactgaggaatgtatttccagcttctgtggccaaagatgttccaaagcttgaatacctgtcg

SEQ ID NO: 86586 - DNA, 407 bp, Glycine max
  Peptide Sequence Number=SeqID_203364
atggcggcaggaagtacaaccatagaaaaacctagggatcaatggagtaaggaggaaaagaaattagttcaatacaatttaaaagccaaaaatatcattacatctgccttagggatggatgagtactttagggtatcaaattgtagaagtgcaaaagatatggaatggcaacccaaggtaacaaccattattgaatcacgagatctatctaatatgtctcttgctactttgtttggaaagttactagaacatgaaatggaattgatgagattgaatcaacatgaggaaaatgataagaagaagaaagggattgctcttaaagcttcatcttcaatccaagaagagaatgataaggaggatttaattgaaatagatgaagatgatgatcttagtctgtttgtaaaaag

SEQ ID NO: 86587 - DNA, 348 bp, Glycine max
  Peptide Sequence Number=SeqID_203365
atgaatggggtagttgaggccgccaataggaacatcaagaagattgttcagaagatgatcatatcatacaaggacaggcatgagatgctaccattcgcattgcatggtggagattcttctttgagaagtctagcagagtcgggattggaagaagcagaatgggcccaggcacgttttgatcaattaaatcttattgagggaaagagattagctgccatcaaagattttcaaacacaagggaagggttgtccatgtgtggttcagagttttgtaaaaggactttacaaagatagtggaaatctcaagcgggttgcttggggactagacataggcacagggcgtggctga

SEQ ID NO: 86588 - DNA, 417 bp, Glycine max
  Peptide Sequence Number=SeqID_203366
atgggattgggagcagccttccctagacctctccctttttccctcaaggaattgactttagagaggctgccaaaactggagaatgtctggaatgaagatcctcatggaattctaaccatgcaacttctacaacatgttattgttgcagaggataatgcagatccaagagaagcaaatctggagcttacgttcccttgtccctgtgtgagctcattgaaactacatggtttgcccaagttcaagtatttttactactgctcaccccagacacctaccgaggatgaaatgcctacatccaacttacagtgcctgtcactcggtgaaaaaggactggagatgatcaagcgtggagaatttcagagaaacttcttacacaagttacaagttcttactctgtgctttcatattgggtcgaat

SEQ ID NO: 86589 - DNA, 267 bp, Glycine max
  Peptide Sequence Number=SeqID_203367
atggtggaatttgtgtcggggatgctccggtggctccggaacgtgatgttctatgtgccgcagcagaggtggatgaacccttgcgcttcttggatgattctgtcatttggtgaagttattgaagattttgattaccagcagttattgaagattttgatcggctttgtgggaggtgatttggttgagaaacaagtgagatatgaggattggaagttttgggagaaagggagcgccataactcgtgatttttgtgactgcagcttctga

SEQ ID NO: 86590 - DNA, 348 bp, Glycine max
  Peptide Sequence Number=SeqID_203368
atggagataaaaaggtgttattcaattgaagagatagtctctaaggacggggatgaatcacatgaggaggaagtttctataaaggaagtttctatatttccgcagctcaattgtttgaaacttgaagaactaccaaacctgagaagcttctataaaggaagtttattaagtttcccatcattggaggaattgtcagtaatctcttgccagtggatggaaacattatgtccaggtaccctaaaagcagacaagttggttcaagttcaacttgagaagtactcagatgctatcaaattggaaaatgacctgaactctaccatgcgggaggcattttgggaaaagcgttag

SEQ ID NO: 86591 - DNA, 609 bp, Glycine max
  Peptide Sequence Number=SeqID_203369
atggggacaatcatgtttgaagcacaatggcacactaaatgtgagcatctttctcttttgaaaattaaaccttggtttgccacattcataggagtaaccctttacgcaagacccaacccttgttgtaagtggacagaggcagaacctgtagtggcacacgagttcgagggaggccccggcgatgccgtcgaggagggcaccacggcgggagtcggcggcggccttgggcggttggtccccctagaggcggacgacatagacttcgaggacggtgacgacgaggttggggagggagccgacgtggtggcgagggcgggagggccactcggcgtcgatgtcgtcgggctggagaaggacgaagtgagagcgagagtgggtgaggaacccggtggcacaattgtcgatgtcggtggggcactgcatcatcttgtacgccgcgaaactcatggtggaagaaacagtgtttcttgtagttcaatctcagcggtgaaagagaagagagagtatgagagcgtgagagtgagagggaggctgagtggaggccagcttcaagaattagggttcgcaaaaggaaggacaacttataggcctaaaagactttttgaatag

SEQ ID NO: 86592 - DNA, 249 bp, Glycine max
  Peptide Sequence Number=SeqID_203370
atggagataattgggtgtgattcaattgaagagatagtgtcttcaacagaggaaggggatgaatcagatgagaatgagataatatttcagcagctcaattgtttggtacttgaacatttaggaaagctgagaaggttctacaaagggagtttaatcaaaacagacaagctgttagaagtgaatattaattggggcggagatgttatcccattggaaactgatctcaactctgccatgcaaaaccgatag

SEQ ID NO: 86593 - DNA, 420 bp, Glycine max
  Peptide Sequence Number=SeqID_203371
atggttattttcggagaagaagggggcagcaatttgcactttctccaacgttccactccctcacctctgatgaacacttctaggttatttcgcatctcaaaacccaaaccccacttcgattctcgcaaaagggtatctccaaaacccaataaagttttagtcttttccattgtcattttccattgccttcgcctttttcttcatcttcttgtcctcgaggctgccctggtggtggaggtcgaggaattgcagggagcatgtggtgtggagctagcgacggtggtcttcaaagtgaatggggaacacagtggacttcgattgggaacccatgcggaagatgaaggtcttggaagcttcatcactggaaatagtggaaaacaaaatgaagaagaaaatgatgggaggaaaggaattcaataa

SEQ ID NO: 86594 - DNA, 396 bp, Glycine max
  Peptide Sequence Number=SeqID_203372
atgggtatttcgagcttggatgattctccaaaggtggcttggagtgcagttgcgattggggttgttgtggttttgggagtggtggttcgtgcggactacgtgaaagcggaagagtactgtgaaagggcaattttggcgaatccaaatgatggaggtgtgttgtccatgtacgcagatttaatatggcaaacacaaaaagatacttgtggagctgaggggtactttgatcaagcagttaaagcctcccttgatgactgttatgttatagcatcttgcgcgcatttcctttgggaggccgagaaggaggaggaagaagaagaagatccgtcgaaagaatcatcaagtttcttccatggaactcttcaatcctcaactcctttagcagctgcttcttaa

SEQ ID NO: 86595 - DNA, 1994 bp, Glycine max
  Peptide Sequence Number=SeqID_203373
gattttcagctgctcccgttgttccttttgtcgagcctgtcatgcctacccttgtcaattatagtggtgatgatgagctctatcatgggggttccttctgtcaaaatcccattgatttgggtcgcctgtgtacttatggttcaattgtggatgagtactactacactcctagcaagcgagctcgaatcaatgccctggatgcgttcgaatttctagggcgagagcaagatcaaaagcctaccattgatgtccttcctgatgaatgcctttttgaggttttcagatggctctctagtggcaaagagaggagctcttgtgcctacgtgtctaagcggtggcttatgctcatgagcagtatctgcaaagctgaaattcacaagtctgataagatgattgaggggtctgcttccggttatgttgaaatggcctcagtggatgaggatcaaggtattgaagacaatggctacttaacgcggtgtttggaagggaagaaggcaactaatgtaaggcttgctgcaattgcagttgggactagtgcccgcgggggacttggaaagctgtctatcagaggaagcaattctgttcgcggtgtcacagacgttggcctctcagcagttgctcatggttgcccttcacttagatcattttctttgtggaatgtgtcttctgttggtgatgagggtctgtctgagatagcaaaaggatgccatatgttggagaaacttgacatatgccaggcctccttcattagcaacaaaagtctaattgcaatagctaagggctgccccaacttgaccaccttaaatatcgaatcgtgtccgaagattggaaacgaggggttgcaagctattgccaggtcttgccccaagttacaatgcatctctatcaaggattgtcctcttgttggggatcatggagtatcaagtctattatcctcagctattcacctttcaaaggtaaagcttcaggatttaaacattacagatttctctctggctgtcattggccactatggaaaggcaattttaaatttggtcctctgtggtcttcaaaatgtcactgaaaggggcttttgggtcatgggtgttgctcaaagtctgcagaaactgatgtcacttacagtttcttcctgccgagggataacagatgcaagcattgaagccatgggtaaaggttgtgtcaacctaaagcagatgtttctgcgcagatgctgctttgtatccgacaatggtttggtagcatttagcaaagttgcaagctctcttgagagcttgcacttggaggagtgtaacaacatcaaccagtttggcattatttgtgccctttcaaacttcaaatcgactttaaagtctctcacccttcttaagtgcaagggagttaaagatatagatctggaagtatctatgtttcctccttgcgagtctctccgacatttatccattcataactgccctggtgttggaaatgctagcctggctatggttgggaaattgtgcccccaacttcagcatgttgatctgaccggactttatggtctaactgatgccggccttgttcctcttttggagaattgtgaggcgggacttgtcaaggtgaaccttgtcggctgctggaatttgacggataacatagtttcagtattggccacactacacggaggaaccctcgaattgctaaatcttgatggatgcaggaagattaccgacgcaagcttggttgcaatcgcggataactgccttctgcttaatgatctagatgtgtcaaagtgtgcaatcactgatgccggtatagctgttctttctagtgccaaacagcttactttgcaagtgctttctttgtcaaactgttctggtgtaacaaacaagagtgcgccttccctaaaaaagttgggccagaccttggtggggttgaatcttcaaaactgcaattcaattggctgcaacacagttgagttcctagtggagaacttgtggagatgtgatattctggcttaa

SEQ ID NO: 86596 - DNA, 705 bp, Glycine max
  Peptide Sequence Number=SeqID_203374
atgaaaccctacttttgtgccacgattccagagtttgaattcaaccaagaagagagccccatcagagagcaacagaagcttcttgaactcttcaattaccgacatggactcaacggcggatttgggccagaggagaaaggaaagagggaggtggaggaggacgatgacgactcgtccgagttacacgacttagtggctcacttgggtgagggagggacaagggagagaagcaaggtgcaaagcttagcgagcttgatgcggaagaggaagacgcgatggaggaagaaggtttcaggcggtggcggcagtggcagcggctcctcgtcttcgctggggaaggataagcttatatttatggttcataatgcatcatcacctgcccgcaatgatgaagtgtttctcggtgtccttagcctctttatgggttttccttgctctcttttctctaagtttcacttctgtagtcctttatgctacactttggagtggcgattccaatcacctttcctccttctccattatgctgccattgatcttcaagaagcaaaggactccattgatgaagaagatccaaggcctacaagctctacatggagctacgttacacatcgacttgcaattctctcacactcatcgaggttaccacaccaaaaaccaaacgtattttatacggattcatatgccccactaattgatatgaaatag

SEQ ID NO: 86597 - DNA, 295 bp, Glycine max
  Peptide Sequence Number=SeqID_203375
atgcaggtcctcaatgccaacaacgaacctccaaggaaaggaaatgatgcagggaggagaagaagctcaaaaacgaaagaagctcgaacacacggccaagtaaatgaaacggcacaaggaggagaccgtacatacataggtgcagaggacaacagggctaggcgcttgggctcaggtgaggagcgcagtacaggtgcaggtgtcagggtggcagggtgggtttcgcaaggtgtgctggcgaaacaggctatgggtttcaccattcctactgacgaaatagcctatgactgtgctg

SEQ ID NO: 86598 - DNA, 597 bp, Glycine max
  Peptide Sequence Number=SeqID_203376
atgtctcgcgtgtatgttggtaacttggattcacgagtcaccgagagagatctcgaagacgaattccgcgttttcggagttattcggagtgtttgggttgcacgtagaccacctggttatgcttttattgactttgatgaccgcagagacgcacaggatgctatccgtgaattggatggggatttgcactgctatcgcgagctacacttctgttgcataatgggtttgttttatgagatatgtgcttctacacttaacctatggggaccatgcaagaatggttggagggttgagctttctcacaactctagaggtggaggtggtggtcgtggtggtcgctctggtggttctgatttgaaatgttacgagtgtggtgaacctggtcattttgctcgtgaatgccgcatgcgtggtggttcaggaagacgccgtagccgtagtccgcccagattccgtaggagcccaagttatgggcgaaggagttacagtcctcgtgggcggtcccctaggcaccgcagtttgtcacctcgtggacgtagctacagcaggtctcctccttatcgtgggcgtgaggaggttccttatgctaatgggtag

SEQ ID NO: 86599 - DNA, 285 bp, Glycine max
  Peptide Sequence Number=SeqID_203377
atgcggatttcctcaagtagaattcaaaaagaagacaatacaagcaaagacagcaacatgttgaaggcttcagcagacatatcagagtcacacccacacaatttttcagaaacactttatcctacaaaagacaccatggatgatgcatataccatactgctacctgaaacaaattcagaggaaaaagtttcattcccaagtaaaataaagcactgcttgaggatgatctcaagaaacttaaatttcaaatccatgtttgcgccatcaaccctcggagcagtatga

SEQ ID NO: 86600 - DNA, 219 bp, Glycine max
  Peptide Sequence Number=SeqID_203378
atgacatgcatttccctagtctcaagttcaagttcaggagaactggtgaagccaaatgctaataacggagacatgggcatggagaagatgtctctcatccaaggagtagaactccaccatactatcattgcacccaataacactacatcccggcacttttcggaacccggtatctctcatcgcgaccttcaaccgggcgacatcttgcgatcttcctag

SEQ ID NO: 86601 - DNA, 385 bp, Glycine max
  Peptide Sequence Number=SeqID_203379
atggttccaaagaaactcacctctaagagagctagaaagaccactgtaggagaaggatctaaaacaactccacttgtagaatttgaatttgatggacaccactttcatagtgaggaacatcagcgccgctttgaagtgatcaaagattggtctttcctcaaggaaagaagggtccaattagctgaggagcccatgcctaaatatgaccctgaagttgtcatggaattttatgcaaatgcctggcctactgaggaaggtgttatggataagcgctccaaagtatggggccaatggattccttatgacacagatgccatcaaccaattttcagggaatccattgatcttagaggatgggcaacaatgcgaatacacgacaagaagag

SEQ ID NO: 86602 - DNA, 243 bp, Glycine max
  Peptide Sequence Number=SeqID_203380
gcggccaaccaccgggcgcatgtacagacccatgattgtctttaccagctgagcctcagcttgcagagccagggttttacttcttttccatgtcctactccggatcagtttagggcagaggtcgcttggcctggagattggccggaggcaccagcagaggctcccgacgaggcagatgaggcccgcgaggacgaggagatgaccgatttgcttgatttcttgggagtgagcggagccacatga

SEQ ID NO: 86603 - DNA, 411 bp, Glycine max
  Peptide Sequence Number=SeqID_203381
atgtcggatgaagtgaaaggccaaaaagctgacatgaccaaacaaattaccatcataacatttcacatgtcagggataactggatgtgaaacactcctgtggattctcattgctgactttatgtggtactgtatgatcaacttgcttctttttggactaagccactcagctgctcgtttgcttcttcaactgcatcagtcagctgctgctcgtgttacacgttcacaccttgatcagataccaaatatggaactgcaaccactgcaagctcagttctacatagctggattgccgatcagttctaagggagcaagttttcttgctaatattggacaaaactcaattgagaggcctagttccactataagagatgctttaagcggagaattttggggaaaacatattgaatag

SEQ ID NO: 86604 - DNA, 861 bp, Glycine max
  Peptide Sequence Number=SeqID_203382
atgaaggaattctatgcaaatctatatgtccctgaggacaagtatcccaagaaagttagggttcgagggcacccgataaaatttgatgttgattccctcaacaactttttggagactccagtggtcgtggagcaaggggagagcttgccctcttactccaggtttgctatactgaggcctgatcctcaggagcttgcagcccggctatgtatccctgggaggggatttgtacttattgccgaaggtttgccatggaatctcttgaggaaagatcttaccactctggcccaaacttggagtgttctatcttattctaacttggccccgacatcccatacttctgatcttaatctggatagggccaggttagtctacgggcttgtaatgaagatgaatatgaacttagccctgattactgccttgtgcaagccccgaggagtcacctcagattctcttaccttcgagtcactcagcccagccattaatttggcttatatgaagaagaattgctggaacctggatgaactttcagtcagttttctagggacccaaaaatctagggctagaagatctaaggccccatcttcttcagctacccctgctcccactacatcagcttcatctacttctattcttcctttaccaccagtagctccagttcctccagagtcggcaccaaggctagctcctgatcatgcagagtttgcaggatgtggtccagtagtggccagttatgagcgtggaggagtttctgcagacggggatgaggcctctgcagcccaggagcctcagctggaccaggaggatggaattcttgaggcctcagatgatgcaatcctaccccgcaagggcattggatag

SEQ ID NO: 86605 - DNA, 441 bp, Glycine max
  Peptide Sequence Number=SeqID_203383
atggcttggagattccaagaagattgggccagagatgcaggagaaggccctagggctctcatgagccttaggtggcgtctccaattacctttcctccttctccattccgttgccattggtcttcaagaagcaaaggactctattgatgaagaatatccaaggcctacaagctctacatggagctacatcactacccctaatacaaaaactagtctagcccatggggccaaaatctaccttaaggctcatgagaactttaggaccttctcctccatctctggcccaatcttcctgaagtctcctggtcatggctctggtgatggatctccttggaaggattgcatcaaaaggttggttgcacttggagctccaagcttgggggcttgtggaggtcctttcacagattgcctaggtgactttaagggtggtttttctcagtag

SEQ ID NO: 86606 - DNA, 1419 bp, Glycine max
  Peptide Sequence Number=SeqID_203384
gctatgactgtatcgacacagactactgccgggagcgtggaatagtggtcagtaatgttccgggttactcgactcgtagcgtttccgaaagcgtgattgcttctgtctttgccctaaggcgcaatctggttgagtactgctgctcgtcacataccgagtggagtctgtcctcgcatttttgtctgcataagtcgcctatcggcgacattcaggaggcaacgctgggcattatcggacgcggcgatattggctgtgccgttgcccgcctcgccagagcgctcggcatgaacgtgttgtttgccgaacggcctgggcaaaacagtgtgcgggagggctatacgcttttcgatgacgttatctcacagagcgatatcctgacgttacattgccctctcactcctgaaacgtatcagatcatcaatcaggatgtgctggtacgcatgaagcccagcgctctgcttatcaacacggccagaggtgcgctaatcagtgaggacgatctggccgatgccctcaccagaggggaaatcgctggcgcagcgctggatgtgctggctaaagagccgccttctcctgaaaataagctccttcatgttcgacataaaaacctgttgattaccccccatattgcctgggcgagtcagacaggagtgaataaccttattaaaggaattaactacaatctggccggcatcgggcatttttatcccaatgttggcgtggatttaaaacccttaggggatacgtttatcaagctcattcgactgctgatcgcgcccattattttctgcacgatagtcagcggcattgccagtatgaaaagcctgaagagcgtcggtcaggtaggctggaaatcgctggtctattttgaggtgctgactacgcttgcgctcatcatcggattaatcggtgttaacctgatggagccgggcaaaggaatgcatatcaatcccgcgtcgctggatggcggggccatcgcttcctatacaaaagcggcgcatgagcagtctgttaccggctttctgacgcatattattcctgaaactgtctttggtgcgtttgctgaagggaatattctgcaggtgctgtttatctcgatcctgtttgcttttggtcttcagttactgggtgatttaggcaagccactgcttaatactattgatttagttgcgaaaacgtttttccgcatgctcaagattgtaatgtatgtcgccccgctaggtgccatgggcgccatggcatttaccattggtaaatatggtgtggcatctctctcctcatacggtgcgctgctggtatgttactacctgaccggactgttttttgtctttgtggttcttaatatcgtggcaaagctgtgtggattcagcctatggcgcttcctccgctacattcgcgaagagctggcactggtattgg

SEQ ID NO: 86607 - DNA, 2070 bp, Glycine max
  Peptide Sequence Number=SeqID_203385
atgacgatggaactacgtcatattcgttactttctggcagtggctgaggagagacatttcacgcgggccgctgcaaggctcggtataggccagcccccgctgagccagcagattaaagacctggaaaatgaactgggtgccgttttgttccggcgcatgccttatggagcagagctgacagaagctggagaagcgtttctggaagttgtaagagatatgcccgctactgctgaacgcgcttcgcgcgcggcacagagagctgtccgcggtgagctggggctactgagggtgggatttactgcatcagctgcatttaacagcgtggttcctgctgccatcagagcgtaccggcgtgcttatcctgaagtaagactccagcttgaggaaggtaataccagcagactggttgatggcttaaatgagggatcgctggatgcggtattcctgcgcccgggctttgccggtagcgaccgtttccagttgcgcatgctttctgaagaatcgatggtgctcgtattaccggaaagtcatcctgctgcatcaaagccatcgattgcactcagcacacttcgtgatgacgatttcctgttattcccacggaatattggtcccacgctttatgattccgttattgacgcgtgccgcagttcaggatttgaacccatcatcgcgcaacttgcacctcagattgcgtcagtgattaatctggtcgcagcagaaatgggggtgtcaatagttcctgcctcaatggggcaggttaaggtgaaaggggtggtgttccgtcagattgatgatgaagcaccggtggctaaactggccttggcattcagacgcgcagatacttccccgtgcgggctaaagtacacgcctctaatctgtcagccagtatttcacttaggtgttacatcaggatttacggtgcgactgacaacgccatctcttatcactatgaacagtagcgttgatcgaataggagatatttcaaatcggctttcaaacttaaccgaacgtacaaatcgcgcaattgccgaggtgttgtccggacgtcagcaccgctttatgacaccattgctttttgccggacctgcggttattgcgtcaatcgcctatatggaccccggcaactttgcaaccaatatacaggcaggggcagggtatggttataccctgctgtgggttgtggtaatggccaatattatcgccatgctttttcaggcgttgtcggcgaaactcggtatcgttactaacaaaaatttagccgagatgtgtcgagaccagtttccttacccggtagtatggggcatgtgggttgtcagcgaaattgccgcaatggcaactgacttggcggaattcctgggcggtgcgctggcgctgtcacttctgttccaccttccgttactggtaggaatgagtataaccgctctaatcacctacgtaatgttgatggtggaaaaacgcgggttccgtcctttagagctcatgattggtggactggctgtcgtcattgcattgtgttatctgatagaaatgttcattgctccagtcaactgggccgctgcaggtattggcatggttattccccaaatgcctgatgcacaggcgttaacaatttctgtaggtatcatcggggcaaccgttatgccgcatgctatttatctccattcgggtttaactcagaatcgtagcccagcacaaaatccagctgaacgccgtaagttactgtctttctcaaatattgaggttgtaattgcactgagcatcgcggggcttgtcaatatagcgatggttattatggctgcgagtgcattccatgcgggacacagtgatgttgccgaaatcgagacggcctatcacacgctgacccctttactcgggattggtgctgctggggtattcatgctgtctcttattgcgtccggcatttccagttcagtggtggggacgttggcaggtcagatgattatgcagggctttgtaggattctacgttccggtctggttacgtcgtctgataacgatgcttcctgcctttatcgtggtctcaatgggggtcaatgcaacagatgcgctg

SEQ ID NO: 86608 - DNA, 1323 bp, Glycine max
  Peptide Sequence Number=SeqID_203386
atggacatcatcgcgctgtatgcagagaagctcaccacacctgaagatgccgtatctggtattccctccggctcgcacctgtcgatgggcatgtatgccggagaacccccagctctgctgaatgccctggcacatcgggcagaacggggggacgtcggtgatctccgggtgtattactacgaaactgctaaaatcgctggcgacacgattcttcgttatgaactgaacgatcggataaagccttacagtatgtttgttactggcgtcgagcgtgcccttattcgtcgtggcattgaggatggcgaacgtaagatcatcaactatgtcccgtcaaatttccaccaggctcctcgcctgctggctgacgaaattggaatcgatacgtttgtgcatacggtatctccgatggaccagcatggttacttcagtttaggtacgggtaatgactactcttcccgcatcgcccgctccgcgcgcagcctgatcctcgaggtcaacagccacatgccacgcgtgcagggagatggagcagagattcatatttcagaagttgatgcgatcgttgagaacaacgtcccactcattgagttgccaacacgctccgccaatcctgaagatgaagcaatcagcaacataatcgccggactggtccaggatggtgcctgcctgcagatgggggtaggcgccttgcctaatcttgtctgcgctgctctgcgggaaagaaatgatctcggtattcataccgaggcgctgaaccccggattggtcgaactggtcaggtctggagtggtgacgaaccggcgaaaaagtattgaccgtggcaagtcagtgtttacctttgctatggggcaaaaagccatgtatgactatctggacggaaacccttccgtattcagccggccggttgattacgttaatgatccccgcatcattgcccaaaacgacaatgttgtctccgttaatgctactctgcaaattgataagaccggagcctgtaattcggaacatatgctcgggcatcagtacagcgcatcaggtggccagcttgattttgttagaggggcatatgcctccaaaggcggccgttccattatcgctgctcggtcgactgcggcaaaaggcgtcgtttcccgcatcgttccccggctggatggtccggttacgacaccacgtatcgatacacattacatcgtgactgaatatggtagcgctaaccttaagggattgtcatcaacagaacgcgcaatgcgtatcatcgaactggcccatcccgactttagggaagagctgacccttgcagccagaaaaatgcatctgatataa

SEQ ID NO: 86609 - DNA, 682 bp, Glycine max
  Peptide Sequence Number=SeqID_203387
atgacgccgaaggtcgagcagtactctattgacgagatgtttctcgatttaaccggcattgatggctgcgaggactttgagcacttcggccggcgcctgcgcgcccacgtgctggccacgaccggcctgaccgtcggcttccgcggggtgctggcactgacgccggataatccgaagcgtaccgcgacgctgctggaaaaccagcccgtagaggagatatggggcgttggccggcgcatcggcaggcggctcaatctgatgggcattgaaaacgccctgcagctggcgcgcgcgcaccctgccctcatccgaaaaaacttcagcgtggtgctcgagcgcaccgttcgcgagctcaacggggaatcgtgcattcccctcgaggagtttgcgccggcgaaacagcagatcgtctgcagccgctcttttggggagcgcattacgacaaaagtggccatgcaggaagcgctgtgtcattacgccacccgggcggcggagaagctgagaaatgagcgccagttctgccggcgcatcagcgtttttatccggacctcgccgcacgcgcagggagaagtcttctacggcaacagcgccggcgagaatctcaccctacccacgcaggatacgcgcgacgtgatcggggtggccatgcgatcgctcgaccgaatctggcttgacggacgac

SEQ ID NO: 86610 - DNA, 1439 bp, Glycine max
  Peptide Sequence Number=SeqID_203388
tggaccgactgggtcgctgatgacggcgtgcagtcccgcgatcctctccacccgcagggtcgagcgctgtcggacagtcgcgcagcgacagagggggcgtcgtcaccgcagcgcggcacgcgtaccggctacctcctcgtcggctccgacggctatgcgaacaccgaggtggcgggcgagttcgctcgcgtcgacagcatccataaggcgatcgggcgcaagccgaaactcgacgaggagatcgagctcacggagctggtcgccgccctcgtccctgagccgagcaaccctcacgaccgaaacgcggtcatggtgcagatcaacggtcagcacgtcggctacttggagaaggaggatgctgtgcggtatctgccggtgatcaggcaagtgtgggatgccggctacgttgcggcgacgggagcgagagtgtgggcgtcggcccgtgagtcctgggaatcgaagaagctcaagtacgtggcgcgcgtgacgctggcgctgaacgagccgcacctcctcctgccactcaacgatcctcctgtggaggagcacagcatccttccgtggggccacgggctacaggtgaccggcgaggagctccatcaggatgtactcgcgaactacacgaacgcccagggcgacggagtcgtgttggcaacgctcagtatcatcggcggcggcacggcgaaggctccgaaggacgtcgtcgaggttcgtttcgacggtcgtcgcatcggacagctgacgccagggtcgagccaacatttcgttccgaccatccggcacctcgcgtcggaaggcgacgcttcaggcgacgaagtgctcacgaactctccgctgactggttcacggagtccgatacggtgccgagactctaccgccggtagccgaccctccatccaaccggctgccgaacagaagactgccgcctgcgtagatgccgagggcgtcgcgagagggatcgagcagcgcctggatgcgcaggccatcgaccatggccagaacgagcgtcaccttctcgtcggcagtgagcagctcgctgtcgctcgtggggagggggccgtcggtgaagcgcgaccgcatgcgctcgcggcgaccgaggaagaactcgtgcgcggggtgctcggggttcgtcgcggccacggcgagggccagccagttgcgctggaactcggagttcgagaattcatcggcgagcaccgcactcagaatctgctcacccgggacgttcgccgtcatgatccgcgcggcgagggcctcctcgtgcttctctcgctgcgcgagtgctgcaggaagcagctcctccttcccggcgaagtgacggagaagagcggcgtgcgtgagcccggcgcgggaggcgatgtcgcgcagggacgcgcgctcgtatccgtgctcagcgaagctggcgagtgcggcgtcgacgatctgagcgcgtcgcgcgg

SEQ ID NO: 86611 - DNA, 606 bp, Glycine max
  Peptide Sequence Number=SeqID_203389
atgtctgacaattttttatcgttggcaaaaaaacgccgcactatttacgcgctgggcaaagacgttccggtgtcagaaaatgaactcatcagcacgatcaaagaagcggtgaagcaggcaccttcagcctttaactcacaaagctcacgcatcgtaatcctgctgaatggtgaacacaggcgtttctgggagcttacccgtgaacaactaaaaaaaatcgttcctgctgaaaatttttcgggtacatcggagaaggtgaatggtttcgctgctgcagctggttcgatattgttctttgaagatcaggatgtagtggcaaagcttcaggagcagtttgctacttacgctgacaattttcccgtatggtctgaacacagcaccggaatagcgcaatatgcggtctggctggctctggcagacaaggggattggagccaaccttcagcactataacccgttgattgacgaagatgtgcgtaagacatggaacgtaccttcttcctggaagctgcgggcgcacatgaactttggctccgtaatttcgtctgccggagagaaaacctatatggaagacgataagcgcttcatcgtcgcaggatccctgtag

SEQ ID NO: 86612 - DNA, 507 bp, Glycine max
  Peptide Sequence Number=SeqID_203390
atgtccagaatcagcctggcctccgaacgcatcagggacattaaccgcgtaattaacgacattgccttccagacaaatattcttgcgcttaacgctgctgtagaggctgcacgagcaggggaacatgggcgtggcttcgctgtcgtagccagtgaagtcagatcgctgtctcagcgcagtgcgcaggctgcaaaagaaatttccgtcttgattgacgagtctgtttctgaaattgccgtcggcgcgttacttgctgaaaacgcaggagggaccatgagtaagattgtggataatgctacttccatatccagaattctgcaggatatcgccctggcatcgtcagagcagagcgcaggactaacacagattaatgccgccatcggacagcttgagggaggaacccaacagaatgcctctctggttcagcaggcgacggtcgcgtcagagtcccttaaaaagagcgcccgcaagcttgctgacacaacaggtcagttccgcacagaatga

SEQ ID NO: 86613 - DNA, 864 bp, Glycine max
  Peptide Sequence Number=SeqID_203391
atggaaacgggaagttttgctgcggcagcgcagcggttgaaggtcagccccgggcaggcatctaagatgatcacgcgtctggaacatgatttaaacgtgaacttaatccgccggagcacccgctcactgactctgacagaagtcggacaagcgtattacgaacagataacgcaattaattgccagctatgacgcgctgaatgattctgtccgcaactcatccagcaccccctccggcacattacgcatttcggctcccgtcacgtttggaacctttcaactgcctgaattattgatgaaattttcaaaaaggtatcctgacattgagcttgatgtgcgattttctgaccggcttgtaaacctgatagatgaagggtttgatctgtccctgagaatagggcaattagaagacagcagcctgattgccaggaagttgtgcgatatccggatagtcctcgtcgcatcaccagcttacgtggatgctaaaggcatgccggaacaatgtgaaaaactcagcatgcatgactgcgttgttgacacaaactttcgcgagccctatatctggcccttcgtgagaaaagacaggaagatagtgattcagagcgtgaagggaaagatgaatttttccaatgcagaagtctgtctcaaagcctgcattgctggatttggaatatcgcggctgcccttgtttgtcgtcagtgatgcgataaaaacaggaaaactcattactatcctgtctgattatgaagcgcctcctctgggtctgtatgcggtttacccgtcagccaaatatattgcgaataaatcaagagttttcatagagttccttgcgaatgccttttcagaaaagccacaatgggaatga

SEQ ID NO: 86614 - DNA, 180 bp, Glycine max
  Peptide Sequence Number=SeqID_203392
atgacgtcacaggagccgtcttggggacagtggcgatgggagatagccggcggaactcctattatcacgaagtatggaatgagggatttttatcggataagtcggtttgccggtcctgctaacaaaacagttatgcgggccaataatgcagacaattctgagctaaaatcattgtcataa

SEQ ID NO: 86615 - DNA, 264 bp, Glycine max
  Peptide Sequence Number=SeqID_203393
atggcaatggaattaattggtggtgttgctcttattctgggtgtttatagccgttatgttgccttgatgttgattcctgtattgttaggggctattttcactgttcatgcacatgcaggtttctttttcacaaatccaaatggtggatgggagtttcctgcattctggattgttggcctgatagctctttctctgaccggagacggcagaacattccacaataaaccagaaaccctgaacgctgaaaacaagccctctccttaa

SEQ ID NO: 86616 - DNA, 225 bp, Glycine max
  Peptide Sequence Number=SeqID_203394
atgaagaaaatcagaatcgttctggtggcatctttttttagcatgatttccctgagcgctttagctgataacattacagctactgacactaccctggacggtgctgaggaaaaaatagcggcagaggccaggcgtgaaaatgcacattacaagattattcaggcaagcacaaataaccggatccacattacggcaaaaatatataaatcgggttcagctcaatag

SEQ ID NO: 86617 - DNA, 1185 bp, Glycine max
  Peptide Sequence Number=SeqID_203395
cagcggcgtgacctgacgtttctgcacgtggcctactctacacttctgcacatcagcgagcttggccggctgcgggtgcgtgaagtctcgcgcgcggcggacggccggatcatcctggacttggcatggaccaaaaccattgtgatgaccggagggctcattaaggctctgggcgatctatcctcgcagcggcttacggaatggctgacactttccgggctggccggagagcccgctgccttcatcttcggtcccgtccaccgtgtgaaccgggcgatggccgtcactgagaagccactctcagcccggacactggaagatattttcgcccgcgcctggcaggaggccggagatgccggcgctgtgcggccgaataaaaaccgctaccgtacctggtccggtcacagcgtccgtgtcggtgccgccattgatatggctatgaagaagtacagcaccgcgcagatcatgcaggagggaacctggaaaaagccggaaacggtgatgcgctatatacgccacgttgacgcgcatgcgggcgcaatgatcgacctgatgaagcagcaccagccagtacgatcactttctatcagcgcccgtataatgaagcatgagagaggtatgacgctcactcctgacgttaacctggtggtatcggacgcggatcggtctgacagtgcgatgagcgaagcaaaacggcaacacatcggcccctctatctgttggcctccggacgccatatcactcagtaataaagtttctgcaccaggctcactgcactgcaggagtgatgaggcccgtgatcatcacaggcccctgttggctatacttttcacttcggagtatttcggacatttgaaaaaaacagatacgcgggatgtgatcggggtggcgatgcgatcgctcgaccgcatctggctaaacgggcaacgctacatggaggccggcatgatgctcaatgacttcacgcctaacggagccagtcagctgaacctgttcgatgaggatacgccgcgggcgagcagcgtgcagctgatgaaggtgcttgacggtttcgaccagtccggtcttggtgacctgcccccaccggcgtctggtatttcagcgatgaatgaggcattcctcccgaaagcgaccgttgaaaccctcagtaaatccgttctgcgctggcttgcccggctggattaa

SEQ ID NO: 86618 - DNA, 328 bp, Glycine max
  Peptide Sequence Number=SeqID_203396
ggatcgcgcccgcaagacacccagtggacccggagaagtccaacagggtcttggggtttccagctctgattacgggcctctgtcagttctacggagtgcctgtcgcccccaacaaggtcatcaggccccctactaaccgagctttcatcaagaagtattgtgcccctaggcaggcgcagggcgagacactacagcagcctggggatgtccggcagcgggtaatagacactccgccgccacctccaaagcctctcagctcatctacaaaggctggagcattgccaacgacccgtggccgaccagcaggcgaccaagtccaaagccaaag

SEQ ID NO: 86619 - DNA, 414 bp, Glycine max
  Peptide Sequence Number=SeqID_203397
atgttaatgtgtaatgatcaattctcgtgtgttggcccgattgagttattatgcaccattggtagaacaccggatgatatattaaacttacttcaagccactataacctctacttatgatgtcctgcgatattacaatggaaggtggaacatgtcacgccaacacgactttgtcggtcattatgagtattcagacaaagttatcaaatttgaaattattgagctgaaaattgacgatgacatgctaaaggtcttagtacagtctaactactggaaacaatttgggccaatagaaattttagctgtttttagtaaacagacaaatttgtataacgctgcattctacctatgtacggagtgggccactgctttgcctgagaatgacaatgtgtattccacaacaacaccactggtg

SEQ ID NO: 86620 - DNA, 414 bp, Glycine max
  Peptide Sequence Number=SeqID_203398
atggcgcttagtctgaccccatcttgcctaggcgagttgtgctcacctgggctacacaccctcgccttcgtagtgctacacgccctctccttcagaggacaacacgtcctcgccttcagagggttacacgccctcgcctttagaggactacatgtcctcccctttagaggactacacatccttgccatcagagggccacatctcctcgccttcagagggctacatgtcctcaccttcagaggactacatgccctcaccttcagaggactacacgccctcaccttcaaaggactacatgtcctcgccttcaaagggctacacgttcatatgaatggcagcggaatggagaaggaagagagagaggagacgccacttcaaggagaagatgagtctagcataagctcaccaccatag

SEQ ID NO: 86621 - DNA, 610 bp, Glycine max
  Peptide Sequence Number=SeqID_203399
atggcaaggatgtgtagtcctctaaaggggaggacatgtagtcctctaaaggcgagggcgtgtaaccctctgaaggcgaggacgtgttgtcctctgaaggagagggcgtgtagcactacgaaggcgagggtgtgtagcccaggtgagcacaactcgcctaggcaagctggttacttcaccatgaagttatttggtgacccaggagagctagaggatctggcgatgatagaagtgtcagttgaagccatcgcatctctcactcaatactatgaccaatcactcagatgcttcacttttagggactttcagttagcaccaatcatagaggagttcgaaaggatcttaggatggataccaaggaagcgcttggaggagaaggtggaagctctggccagcaaaggagagtgggcagcattcatcgacgtattagctctgctagtgtttgggacagtactattctcgaatgtagatgggttggtggatctagtgacaatcgatgcctttcttgcttatcaccacagcaaggaaagctcggtcatccctgtttgggcggatgcatatgatacattcaacttgagatgtgagaagagcagtgcaagaattgtctatt

SEQ ID NO: 86622 - DNA, 888 bp, Glycine max
  Peptide Sequence Number=SeqID_203400
gatctacttgcgtatgctggtctgcattccaggaaagaagcttagagacatcttgaatctgggggacacgattcttggaatttcacaatcttcacatccaacctcgtttttcaacgttcagtcacctcgaccttctcagaaattgaagacatttaaaaacttatcatcctgcattcaccttgagcgtctggtcccattgttagtcaaacagttttggtctctgtcgttatcaaatttagttgtaagtaacaccaaacctgcttatctggagagcatcagagacctcaaagctcctgttgaggaaaatgaattttctgatagttccaatacacagatcattcctgaatctggaagaataaatcacccacaggagccactccgtgtcatggattctagagttgctgaaattttgaacacattaaggaagtacttttcctgcattcctgacttcagatatataccaggtctcaaagtcagaatatcatgttgtttgagatttgaatctaatactttcaatcgcatgttgggaaaagataaaactgccacgtccttggaagaggtggatgcacttccggctatatatgctactgtgttaaaattctcgtcatctgcgccatatgtgtcaattccatcctatcgtataccttttcttcttggtgaaccttacaataaagattctgcatctcaagatgcctccctaagtattgttcctgttgatgttggaaatgattcccaggaagaggaaaaatatagagctattgttgagattgatttggagcccagggaacccacaccaggtatagttgatgttcacattgaaacaaatgcagaaaatagtcaaatcatccaaggtcaacttcaaggaatcacagtaggcatagaagacat

SEQ ID NO: 86623 - DNA, 1461 bp, Glycine max
  Peptide Sequence Number=SeqID_203401
gatggtgatgttacaaaagatcatttaatgtcagtttcaaatactaatgtattgtccgatagagggtcaggaatggttactctgaatgctcctgctattaatactggtggtcgtgatgctgctgctcttaaaccctctagtctacagaactcgccatcggctttggatttgatcaagaagaaattgcaggactcaggaacacctgttgcttcctcttctattcctgccccatctgtacaaacaggacctgaatcaaatggttcaaaaacagttgattctacagctaagggcttgcaagtagataataacaaagataaagcaaaagatactaatggtgatgctaatgtctctgatacatcctcagattctgaagatgaagataatgggccttcgaaggaggagtgcatcattcaatttaaggagatgcttaaggagcgaggagtggtaccattctcaaagtgggagaaagaattgccaaagatagtatttgatccacgttttaaggccatcccaagttattctgctaggagatccttgtttgagcattatgttaaaactcgtgcagaagaagaacgtaaagaaaaacgtgctgcacagaaggctgcaattgaaggatttaagcggttactggatgaagcctcagaagatattaattacaatactgattatcaaactttccggaagaaatggagaaatgatccacggtttgaggcattggaccgcaaggaacaagagcacctattgaatgaaagagtgcttcctttgaagaaagctgctgaagaaaaggctcaagcaatgcgtgcagctgctgctgccagttttaagtcaatgcttaaagagcgaggagatatatcttttaactcccgttggtccagggtcaaagaaaatttaagggatgacccaagatataaatgtgtgaggcatgaggatagggaagttttgttcaatgagtatatatctgaactgaaagctgctgaacatgcagcagaaagagagaccaaagctaaaatggaggagcaggtatcatggacggaatctaagcctaaattagaaaaggatgctcaaagacgtgcaactaatcctgatcttgatccattggacacggaaaagctctttcgggaacatgtcaagatgcttcaggaacgttgtgcgcacgagtttagagttctcttagctgaagtattgacttctgatgctgcatctcaagaaactgacgatggaaaaacagtgcttaattcttggtctacagctaaacgtcttttaaaatctgatccaagatataacaaagttccaagaaaagaaagagaagcattgtggcgccgctatgctgaggatatgctgcggcggcaaaaggcatctcatgattccagggaagagaaacatacagatgctgaaggtagaaattatctagaatcttccaaacatccatttgaatctgggagatcgtacgagcgaagataa

SEQ ID NO: 86624 - DNA, 1152 bp, Glycine max
  Peptide Sequence Number=SeqID_203402
atgttatttaaaacccatggggtaaggcataatgttccgtacacgacatacagtcgtactagatcaacttcaacatgtatcttattgaaccggattcagtccaattctagtaagacattaatattcccgcaccctaagttactaattccgtctttggagtatagagaacctgtatcggtccaggatacagccctcctcagccatagtgtgatgtctctcttagtaagctatgtttatcctgtcttattagggtacgcgaaagctaatatcatattctattttaaaaatagagaagtaggtgatatcgctaaaccactaaataaacagtctattcccttaacgtttgatgatggtagtcctatttctaagtcagagatatatgctagtgtgtttagtagtatatttaaattaattgatatttatgacggttttggggttgttagaatagctattcgagcacattttgaagaaaatatccccggccctcttcaacctttaaaagaggagttgctagaggaggctctctctgaatgcattaagccatcttctggagaaatcgatatcagtaatttacctgttaaaagtcttagttctacttctcgaaagtaccctaagaatataaccgttccaaggaaatcgggcaatatatccctgaggccgttcttggtggccgatactgagaccataattaacaaaaatagtcaacatgtaccctatgcggtcggtgtcatggttgttaatccggggattcccgttagtaggcgtgaaaggatcgatacttacttcagcgaagattactcttcaagaatcttcccaacctttgaagaaaggagctgccaaatgctcaaatcatttatctttagggtcgcggctattactcgacaaaataggtctgctaaaacaatctactttcataatttaggtcgattcgatggcatttttctacttaagcaccttgcattatatcatcctaattacacggtcaccccccttatgagagacaatagactctacgaggtagctgtctattctaaaaaaaggctattatttacgttccgagactccttacatctactccccggcaaactagatgaccttgctaagaatctatgccctgagttgggttctaaaggatctatttcctatgaggat

SEQ ID NO: 86625 - DNA, 726 bp, Glycine max
  Peptide Sequence Number=SeqID_203403
atgattgaacaacgactgtccgaacaacgtggcttaggcgatcacggctggctgcattcacgccataccttttcgtttgccagctactgggacccacaacagaccggtttctccgatctgctggtgattaacgatgatcaggtagcaccgggtcgcggtttcggtgcgcatccgcacaacaacatggagattatctcttacgtgctggaaggcgcgctggagcataaagattccatgggtaccggttcggttatcgtgcccggtgacgtgcagctgatgagcgccggcagcggcgtgacgcacagcgagtttaaccactcgaaacaggacaatgtgcacttcctgcagatctggattgtgccggcagaacgcggtaccgagccaggttaccagcaggtgtcagtggcagaggccgacaaacgcggccagctgcgcctgattgtttcgccacaaggcgacaacggctcgctgcgcgtacgtcaggatatgcgtatttacgcgggactgtttgacggtgccgagcagcagacgctggaactggctaacgatcgttatgcttatattcatgtggcgcggggcagcattgaagtgaatggcgtgagttttaaagccggcgacggcgcgcgcgtacgcaatgagacggcgctgcagttcgctaacggtaacaatgctgaagtgctggtgtttgatttacgaccagtcgaagttaatcacccgcagcgttaa

SEQ ID NO: 86626 - DNA, 474 bp, Glycine max
  Peptide Sequence Number=SeqID_203404
atggctgagaagctgacctggcacgatgtgctggctgaagagaaagaaaaaccttacttcgtggaaacgctgaaagcggtagccgaagagcgagcagcgggcgtgacggtctatccgccgcaaaaggacgtcttcaacgcgttccgtctcaccgaactgggcgatatcaaagtggtgatcctcggtcaggatccctaccacggcccgaatcaggcgcatggcctggcgttctcggtcctgccgggcgtggccattccgccgtcgctgctgaatatgtacaaagagctggaacaggacattcctggctttcagcgtccgcagcacggctttcttgaaagctgggcgaaacagggtgtgctgctgctgaatacggtgttaaccgtggaagccggcaaagcgcattcgcacgcgcgtttcggctgggaaacctttaccgataacgtgatcagcgccatcaactccaatcgcgaaggg

SEQ ID NO: 86627 - DNA, 696 bp, Glycine max
  Peptide Sequence Number=SeqID_203405
atgagctgcgtccgggaaacgcgtgcaccgagtgctaaagtcaccggtaaaccgtcgaaaaaggcgcttgagaagcgcaaagagaagaaagcgaaagaagaagagaaaccgcgcgtgaagaaacgtcaccgcgatactaaaaatatcggtaaacgccgcaagccaagcggcagcagcacaccggagagcgcactttcgcggcgtaaaatctctcaacctgccctcttcgctcttcaggaaataaaaaaagccgcgccagctttcggtaaaggtacgggtgataacgtcacgctgctgttctggcgtcagcgcgttaaagcgcaccgcatagcccgacacgcgaatggtcagctgcggatatttttccggatgcttcaccgcatcttccagcgtttcacggcgcagcacgttaacgttgaggtgctgaccgccttcaacgcgcacctgcggtttctgctccagtggaatttcacggtaagcaatctcgccaaggtcgctgactgcaacaacctgatcttccgtgaaatcgccttttgcgcacaggcagcgggcttcggctttctcattgtccagcagccagaacgagttcagcagctgcggattttgtgcctgagtaatttgaataccggtaatcatagaggcctccagggcttagcgctgcggcaggagcacagcgcggttcttcgggttatgtga

SEQ ID NO: 86628 - DNA, 315 bp, Glycine max
  Peptide Sequence Number=SeqID_203406
atgcacgaaacacaatgtggaccactacgggtacatagaatgaatcgaaaagcttggttcgagcaaaataggggaggtggttgccgcccagctcgcccaggcgagccaggggttgcttcctccagaagcaacagccttctggaggaatattctgggagggcccaagtgggcctgggtgctatttgcaccccctttttactaaatgcacccccctctaccttttttgctttcgaagaagttacgaaaactcacggattgcgaaaaatacctcctttcgatttccttcacatcacggaattttcacggatcgcgtaa

SEQ ID NO: 86629 - DNA, 201 bp, Glycine max
  Peptide Sequence Number=SeqID_203407
atggtagctcatgttcttgttgtaaaaatcaaaatcatgaaatcggataagaaagaaaatgacgccgattttcctttctttaagagtcaagtgagtttcttctccacgtttgatctcaataatcattgcgtggaggaggcgctgctccttcaagccgtagttgccacattcgcccttcagggaagtggacgcacatgctga

SEQ ID NO: 86630 - DNA, 423 bp, Glycine max
  Peptide Sequence Number=SeqID_203408
atgttgtttcctgagtttggttccatagctgctgggatgtctggggaagtttttgatggacaagatgcaggctatgtgcctgagaaccctgtttcatggcttacaatgattaatgaagaaactctgaagaaactgtgctttaataccttagttgtggcagtggttgcaggaccatggccagcacccgtggcacaaatgatacttttgggattgcaagaggttgctgatataatacgattgttatttagtgataactccaatagacggttaatgcatgaaggtgatttggacagtggagatgttccttcttcacttgctagccttgtgcctattgtcatagcagcccttcaaattgaggaagagaatccaagagttgcctatctttgtgagtatttttcattgaattttaattattttttttaa

SEQ ID NO: 86631 - DNA, 379 bp, Glycine max
  Peptide Sequence Number=SeqID_203409
atggcgcagcagtgggcggaagcgcagccggtgtggctgtgtaccgtgctcagcacgtacggatcatcgccgcgcccgccgggcgcgatgatggtgattcgcgccgatgggcgctacagcggttccctttccggcggctgcgtcgaggagaattttatcacccgcgttcagcagcaggcgttctctgccgccagtcaactggtgcgctacggcgaggggggcgacacgcctgaccgcgcgctgccgtgcggcggcgtactggatattctggtcgaacggttgcctgccggtaccgccacgctgcgctacttacggcagctggaggatgcgctgaccggcgcgcgtgccatcaccaaacgcctgacgctgccgcagccgt

SEQ ID NO: 86632 - DNA, 693 bp, Glycine max
  Peptide Sequence Number=SeqID_203410
atgtgcctgttgaggctattgaagtcaaagatgcatctatcagaagttccagtttacatgaggaacttgcaagtttggctaacagtttcgccactgcagcaaaccctaattcaaaagcgtattcttcaaaagacgaagattaatttgtgccagtctcactgttgtgcaaatatattggttcctgcagaatcagacaacagatatcacagggtaagaggagcaattgctacccttgaacaagaaccttcctctagaaactggcttcttgcagtgaagaaagatgcattgacatggtgcactttcaattcagaaaaatctatgatgtcctccacttcaaaaaagtacaataatcgaagatttttcttcttggacaatgggtggaggcttgaatttgctagtaataaagattggaaggcctttaaggccctttataaggattgttttggtcgtaatttcgcagttcgtgatgccaaagctatatctatacctggtgttagagatgcctctgactatgaagaaacttacagtgctccctttcataggccaaaggtttatatatctcgaaaaggtgatgatcagctttttagggctgtcacatggaagagtagtgcaaactatgacatggattctgaagatgaaaagtggctcagcaagttcaataatattaataagaagaataaggagtctcaataa

SEQ ID NO: 86633 - DNA, 1167 bp, Glycine max
  Peptide Sequence Number=SeqID_203411
atggctcattacctgagtttgtttgtgcgcgcggtgtttgttgaaaacatggcgctcgcgtttttcctcggcatgtgtacgttccttgcggtttccaaaaaggtgtcgacggcatttggactgggcgtggcggtcaccgttgtgttggggctttcggttccgattaacaatctggtgtacaacgttgtgctgcgcgacggcgcgctggtggaaggggttgatctcagcttcctgaactttattacctttatcggggtgatcgcggcgctggtgcaaatcctggagatgatcctcgataagtacttcccttcactctacaacgcgctggggatcttcctcccgctgatcgcggtgaactgcgccatcttcgggggcgtctcgtttatggttcagcgtgattacaacttcagtgaatctgtggtgtacggtttcgggctccggtatcggctggatgctggcgattgttaccatggcggggatccgcgaaaaaatgaaatatgccaacgtgcctgcgggtctgcgtggcttagggatcacctttatcaccaccggcctgatggcatggaaattattcttggcgtggtgatgttcacgctgatcgtactggtgctctcagggctgattctggcggcgcgcgcgaagctggtcaattccggtgatgtggtcattgatatcaatgacgatccccagaatcagatccgtaccccggcaggggataaactgcttaatacgctctccggcaacgggatctttgtctcgtcagtctgcggtggcggcggctcatgcgggcaatgccgtgtgacggtgaaagagggtggcggtgatattctgcccacagaactgtcgcatattacgaaacgtgaagcgaaagagggttgtcgtctggcatgccaggtcgcggtgcgtcagaacatgaagattgagctgccggaagagatcttcggcgtgaaaaaatgggagtgcgaggttatctctaacgataacaaagccaccttcattaaagagcttaagctgcgtgtgcctgaaggggagagcgtcccgttccgtgcggggggctatatccagattgattgtccggcacacaccgtggcgtatgccgacttcgacgtgcctgaagagtaccgtgccgactgggataaatttaatctcttccgctttgtttccgag

SEQ ID NO: 86634 - DNA, 210 bp, Glycine max
  Peptide Sequence Number=SeqID_203412
atgtcatatgacgcagcgattgaggtcaggaaccatgtttccccagagccagaggtggaggacgccggagttgcttcgttgtcgaatccaaagacatatgacatatcacttaacgaccgcaatttttggaccaacgatactaaccctgccgtaggcgttaagggtcatgtcgtcaccttctactcttacttcctcatgtccaaagtgtga

SEQ ID NO: 86635 - DNA, 1077 bp, Glycine max
  Peptide Sequence Number=SeqID_203413
atggccccagatcgtgatcagctccgtgcgatgacacaaaaagagaaggaaacgttcaaggagtatgcccagcgttggagggaagtggctacccagattgtcccgccgttggaagaaagggaaatgaccaaaatatttctgaagaccctgagccagttttattacgagaaaatggttgcaagtgcaccaacagacttcactgaaatggtcaacatgggtgtgcgattagaggaaggtgtccgagagggacgtttggctgtggaaagtacccctgccgcaagtaatgccaagaagtttggaggccactttgcgaagaagaaagatcaagaggtgggaatggtagctcatggtaagcctcagcagaatttcaccccatatcgtcaggttgcgaatgtcgcatccactatcccaaacccatcatatcaccaacaaaggccacattacccctacccgtaccctccacaacaataccctccacaacaataccctccacaacaataccctccacaacaataccctccacaacaataccctccacagcaataccatcagccacaataccctcaaaaacaacaacatcgcccgcagaccccccaacaaccatatcactcacaaaaccgccagaaaacaacctttgatccaatcccgatgaaatatgctgacttactccccgccctgctcgccaaaaaccttgtccaggtcagaacaccccctcgtacaccagatgttttacctccctggtttcgtcatgatttaacctgcgctttccaccaaggggccccaggtcatgacgttgaaaactgctatgtcctgaagaatgaagtgcaaaaactagtccgggccaacttgctatccttcaaagatcagaatcccaatgttcaggcgaaccctctgccgaaccatgggcctgctgtcaacatgatacaagattgtgatgaagacggtgtcatcctgaacgtccaacacgttcgaactcccctggtcccaatacatatcaagatgtgcgaggcagctctgtttgaccatgatcatgcagcgtgtgaaatatgtcctgtgaatgtaaaaggatgcccgaag

SEQ ID NO: 86636 - DNA, 543 bp, Glycine max
  Peptide Sequence Number=SeqID_203414
atgtcgttgctgggaattttgtggttggcctgttggttggtgctctttcggcatgtctcatcaaaaaataccaaggttgtttttagaatgaaggatttgagtggtgaagttttatcttgcacactttgggaaaattactgtatgcagttcttagcctatatgaatgaacgtgggaatgatgggccgatcgttattattttgacacatgccagaataaaagatgcgcagggaagttatccagcttcagtgagcaattcgttcaaggcctcaaaattattaattaatgaacctatattggaaatcaaggaatttagagagaggcttttagatttaggtgttgaggtcaacctagttttgccacctggtgatcaaggaagttcacaactttcaggggcaatccaactatcatcaaaggatgcatttctttcgaaagctgaagccaaaactatttccaagatcaatggcatttttaaggtggtcctgttatttgtgtttactgtgtattcattgcaattaaaagtccaatttgtctacacgtgttaa

SEQ ID NO: 86637 - DNA, 143 bp, Glycine max
  Peptide Sequence Number=SeqID_203415
atctagacatgggtgatgtgcgtgtgaccttggtggtgcttagacttggattggtgcgacatggtggtgctcagacaatatactggtgcttagatctagagtggcgtggtagtggagttgtttggggtgaggaagggttttga

SEQ ID NO: 86638 - DNA, 541 bp, Glycine max
  Peptide Sequence Number=SeqID_203416
ggttagtgtgacagaaattgactgtgcggagaaattacttgtgtatctccgcacgtcacctaacttcagggtcagtgtgacagaaattgactgtgcggagaaattacttgtgtatctccgcacatcacctgacttcaagcatttcgtttccaaacaagcatttagaggaaacgctgggtccaaccaaaaaatagaagaaaatcactcaaagtgtatcaacctcacacggtgtgaggcaaacaagtcaccgacgcacgagattttggttggcaatcaaagggagaggaccactttaggtcgtggattgacattctcaacctgggtcaagatttatgacaagttgggattttggctcaaggcttgtggaaaggctggacatgatatatgtcaggtttttggccagcagtttgggggtaaaggggatgtcccacattatttccatggtacacatgcaacaatgatgattaggagattttatgcaaaactggtcatgcatgcacctatgtggacactcaagcatcgagtttttacggtcatgtga

SEQ ID NO: 86639 - DNA, 372 bp, Glycine max
  Peptide Sequence Number=SeqID_203417
atgctaactaggaagaacaagtacatccatagtgacaacatcattgtggaaggaaactgcagtgctgtaattcaacgcatccttccaccaaaacataaggatccaggcaatgtcactattccttgttctgtaggtgaagtttctgttggcaaggctcttattgacttggggtccaacattaatttgatgtcgctttccatgtgtcggagaattggagagttagagataataccgactaggatgactttatactttaggattgtggaagcaatgccttccaaggttattttgatgatgccaaagaatcaagagtcaaacaagtttcaagaatcaagatcaagattcaagattcaagactcaagattcaagtaa

SEQ ID NO: 86640 - DNA, 342 bp, Glycine max
  Peptide Sequence Number=SeqID_203418
atgccacctaccaaccaccctctagacctagataagtctaacagggccctgggttttccagcattgatcacgggtctctgccagtcattcggggttcccatcacacctagtaaggcgaccaaccacagggggcaggtgcagaaacatgagtgtctctaccagctcagcatcagtcagcagagtcagggtttcgctccttttgcgtgccctactccagatcagttcaaggcgaaggtcgcatggtccggagattggcctgaggcccaggcaggggtggcgcccgcagaggatgagaagatgacatatttactcagtttcttaggagggagtggagccacatga

SEQ ID NO: 86641 - DNA, 333 bp, Glycine max
  Peptide Sequence Number=SeqID_203419
atggcttgcacccacattccagtggaagcaaagatgctttttgctgcaaaattccttccttggttggtgttttggttcgtgctaaaggtggtgtttagcattggttgtgtggagaagggttgttattggctgagtgatgatgttgttgagctggtgggggattttccatgtaggaatggcagtcgtagcatgggtttctccttcattctcgccctcttcatttgccccagttttctcattcgtccaagcaagatgattaaattgcctcttttcagacccacttcgatccttttgctggcgaagaccaaatccgcaaagcttgaaggtgtgtaa

SEQ ID NO: 86642 - DNA, 372 bp, Glycine max
  Peptide Sequence Number=SeqID_203420
gccggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 86643 - DNA, 498 bp, Glycine max
  Peptide Sequence Number=SeqID_203421
atgaagtttatgattgggttgaaggatgtcgtaactatctttgggaagacccaaaagaaggcattatctgagacaaacatatggaagaaaaggcaagacaaaggatgttttgaaaagtcatcaagacctagttggcatgggtatacaagagcagctacatccgatatcgcaaggttggcaaacgtatttgcccccagcatgtcatacaatgtcaacaaaagagaagagaagtttttgtcaatgtctacggagtctaaaagtccctctcatgattgtcacatgttaatgcaacaactattgactatagcgattcatggtatcttgcctgacgaagttaagggttataccaagaatcaatacttaccagaagcttccattgttgaaaggtacattgctgaagaatctattgagttttgttcccagtacaatgaaatagttcaatctattgggcttcctgaaactcgtcatgatcggacacacggaggtaagggtacatga

SEQ ID NO: 86644 - DNA, 387 bp, Glycine max
  Peptide Sequence Number=SeqID_203422
atgtcttgggttaatcttatcactgtaatgccacaaaatcatagggaccattttctgcaacatggaatggaggtagcagatggagtcaggtccaaaacctggaaatgctggtggattgctttaacttggacaatatggcaccatagaaataaggtggtgttccaagatacaacttttcatggaatcaaactgttagaagatgccttattcctactatggtcatggatcaaagcaatggacaaggattttactcttcattttaaccaatggtcctctaatcttaaggaagaagaacacaataagggtaagggaaacttcattaaggagaagaagcacaaagttgtcacgatgctcgagttaaatatgagataccctatccatgtttag

SEQ ID NO: 86645 - DNA, 626 bp, Glycine max
  Peptide Sequence Number=SeqID_203423
atggacgcaggcccgcaaaagagagtcagtctccgcgcgctgcttgttgcggtgctcgtcgtctgttccgccatatcggccacggttctgctcgccaatgacaaaaagcatctgagaagcctgctcacctatctcaatctggcgcccgctcctctttccgccgtaccatctgccagggcaaaacccatcaaacggcagaagcctgccgcgagaaccatttatctgccaccttacctgctgaaattcgagcgcaatggcgccagagcgtctttcgcccgcgatttcatcatctccggcaaagacctttgcgaccggttcacggccgaaggcttctccagcccgcaaggctggcaccctagcccggtgaataaccgcagcttcgaatgtatggccgatctgggcgaggcaacgacggcggacccggctgacgcggcatcgcttttcctggaaatccgcggcgaggtttccggggaaatccggtccgtcaggctgaaggcagttgcaccgcagacatcggccggacgcgctgtcaacgcgaagcttgcggcagcacttgccatgattatcgagcagacccgttggagagatattggctcggtgcttgaaccggcgcagaagatgcaaca

SEQ ID NO: 86646 - DNA, 517 bp, Glycine max
  Peptide Sequence Number=SeqID_203424
atgtcctcagtcggaggaattcttgtcaccatcccgtccgccggcgctgctctcatcatccgctacgggaatggcgtaggacccgttcagccagcgggcgagatcgagcgagcggcagcgatccgagcagaacgggtagtcttcccgtgtcgatggtcggccgcattccgggcacggttgggatttgcggagcggcgtaacgtttccagcgccttcggtggaggattttgccacagcctatccctccagccagccagacgtcacctcgaacccttaaccggcaagaagcgacatggtctcatagagcggcagaccgacgacattggtgtaagagcccgtcaatttctgcacgaacgcaccggcgatgccctgaatgccataagcgcccgctttgccgcgccattgcccggaagcgatataggcatcgatctcacgggtcgacaggcgtttgaagcgtaccttggtctccgccaccttctgccggatcttgccgcccggggttacgaggcagatgccg

SEQ ID NO: 86647 - DNA, 882 bp, Glycine max
  Peptide Sequence Number=SeqID_203425
ttactcggcagcgccatcggctcttcctccgcccgcttggtgctctcgatcattctgcagaaggcggaagacaccagcgcagacacggcgtggctgctcgaccaggcaagcgaagcgctgcagtataatcaggacatgttgcagacggcgctggcgcagatggaccagggtatcgccgttttcgatagctcccagcaactgacgatctggaaccggcgctttcgcactcttatggacctgcccgagcagttcggccaggaacgaggcgacatgccggccggtgatacggaacagttgatcaccagctttctgaccatggacctgccattccctctggtgctggcgggcggcgaacgcatcatcgaggtgcgctccaacacgatgccggacaagggcattgtcgcaaccttcaccgacattacccagagggtggcaagcgatcaggcgctgaaacaggcgaatgaaacgctggaacagcgtgtagtggagcggaccgccgaactgacccgcgtcaaccgcgcgctggctgaggcgagagcggcagccgacgaggcgaacatcggcaagacgcggtttttcgccgccgccggccacgatattctccagccattgaatgccgcccgtctctactcatcctcgctggtcgaacggctcggagaatcgggagaaagcgaactcgtgcagaatatcgactcagcgctggaatcggtcgagaccatccttggcgcggtgctcgatatttcccgtctggacaccggctcgatgaaggcgcgcatgacatccgttccgctgaacgacttgctgaagcggatcgagaccgattttgcgccgatggcgcaggagaagaacctcgacctcgtggtcatgccgacttcgctgacg

SEQ ID NO: 86648 - DNA, 596 bp, Glycine max
  Peptide Sequence Number=SeqID_203426
gctcatcaaatgcaaacatggctcttgttggccttggcccggccgtcaactgcttcaactgcagatgcggctgacctagatctagatgtcccatcaatagcgaaggaagtggctgaactcgttctttgggacttggactctgactttccgtactcgtccctgaacccaatagggaatccgtccctttcagcccctgaacctaatgaatctgtttggtacgctgaggcttctccttcccctgaggccgaagtagaaagaaaggaagtcgcttgtgcttggcgtgctctaagctccgaagctgataccttctgctcgattgtttgttgcctcagttgggaagaaggctggaatctctctctccctagccctaggatagaatgtgatctctttctctccactccccctccccgactggaattgaaacccgctcacgataatgcgaatgaaacggcagataagcctattactggttacggcgagaagatcctaacaaacggccggctaaaggactcctattcttttttcacaatcgccgatcagatgttaggaatcgattgcagcgagaagcctctcttggccaagaagcaagagttccg

SEQ ID NO: 86649 - DNA, 330 bp, Glycine max
  Peptide Sequence Number=SeqID_203427
atgcacgaaacacaatgtggaccaccatgggtgcatagaatgaatcgaaaaacttggttcgaggggaggtggttgccgcccagctcgcccaggcgagctcagctcgcccaggcgagccaggttgcttcctccagaagcaacagccttctggaggaatcttctagagggcccaagtgggcctgggtgctatttgcacccccatttttactaagtacagaaacttatgaatttcgtaacgatacttgttttctttccgtaatgttacggaaccttgcggattatataatcatcccctttttgacttacggaatgttacggaatctcacttaa

SEQ ID NO: 86650 - DNA, 354 bp, Glycine max
  Peptide Sequence Number=SeqID_203428
atgaagttaaagaaagaacttaaagagtctcgggcttctttgccaaatgcaccaaagtccaatggtaacttggctaaggaactttctaacctaaaggttgacataaaaaagttgaaggagaaggaggccaaggattcatccttggctagggatggcaacgaggcagggcaggtacaggtagttatattagtaatggcaacgaggcggggcaggattttttccacaaatacccatgagtataggttttttttcatccctatccttgactcagaggtgtctctacagggaactcctttaaaaaaaacaaaggattcatccttggccaagatgtatcttcggcaaagaatttgttaa

SEQ ID NO: 86651 - DNA, 219 bp, Glycine max
  Peptide Sequence Number=SeqID_203429
atggatgcaaatccagtctccactcccatgtcaatgtccatcaacctggccatctctgacgacatgcccacatattgtggtggtgattctgctgatatgaagttcatgacagcttacatcatatgcttaggacctactgccatatcttggtctagcaaaaagcaaaagacatggccaagtcctccactaaagtcgagtaccacaccatcgggtctatga

SEQ ID NO: 86652 - DNA, 144 bp, Glycine max
  Peptide Sequence Number=SeqID_203430
atggcgaaggaaccgatccggaaaaacaacagaataacgtgtttcccagtcaccagaggcttcacgcttgacaatggaggacacatgaacagcgctagctccaaactcgaaaatggaggacacatgaacagccctaagcaataa

SEQ ID NO: 86653 - DNA, 759 bp, Glycine max
  Peptide Sequence Number=SeqID_203431
atgggttcaaagatagctaaagtcatcgtcagccttgagatggttgtggaggttgggaaagtggtggagaggatggaggtggtgttggtatcagagccaagggttgtggtgaaggttcaagaaaggacgacaccaaggttggagaattgtgtttatggcattttgcaaagagaggcaaaattgctcattctcttaccgttggcattcggcaaaggacttcattgcttggccaatcatttcttgaacctagccatgagtgttgaaggaggccttatgagagagggtgaatttcttcccatggtaagaaccttaagagcggccaacaaagttagcaatggtggggaacaactgttgttggctgaattcacaaaaggaaggaccaaggccattgagggcagtgatgacgaggtcgaggtcatcaacaaagtgaccgatgagagaaatgcttttggaggcgctggaaagatgttccttgagaaacatcacccaagtacgagagtgattgccatagtgcttgtatatccgtgtccaagcatcggcagaagatgttgcggaagtcatgacaatttgtgcatcagggttgcattagccaataagagcaaggaatatgtagtggtcttgccatttctaaagaccgtaggcagggttgggagtaacagtggcactgttgccaatggttgcaggacggcacggttttgtgctatcaacacagccatagatgtcataagctcaaggaaatgtgtgatttgtgcatgctaa

SEQ ID NO: 86654 - DNA, 756 bp, Glycine max
  Peptide Sequence Number=SeqID_203432
atggaagaaggatttgccaccaacaaaccacctctattcagagggataaaggatgactactggaaggagtgtatgatatcccattttgaatttattcatatagatctatgggatgtgatgaacgagatcctcagaagtatgtggacgaagcagcaaaagctcaaatttttgctaaactccaagggcaggaaagtgatgttgtgcactctttcagaagagaagtacaccaaggacactctggctataacatacgagggcaccttacaagtaaagaggaacaaacttagtctccttactcgtaaattcatgaacaagagctctagcaagatagaggtcttagaagacaaaagtcttgggctctcagtagtcaaaagaacaagaaagaatcatcgtccaaagaacaaggactcatatgaatatgagtttgccttcatctctcgcaaaatcaacaagatatggagaaacaaaagtgggtccaagtgcataagctcttcaagaagaatgcctcgagacaagatggtcaaagaaaaaagttctataatcgactatgagtgcgaaaagtcaggacccttcaagttggaatgtccagatctagagaaaagtcaagataagaagaaattcattaagactaaagatgataagaggcttatgagcacgtgggaagacctagatgacaccccatctgatgaagatgatgaagaggcaaacatatgcttgatggaaaatacaacttctgaaggatccaaattagactag

SEQ ID NO: 86655 - DNA, 306 bp, Glycine max
  Peptide Sequence Number=SeqID_203433
atggataagagcttgaaggtaggagaagatgagtggagggagagagagggaaggacacaattggagggagagaaaagggagaataagctatggttcagcccactaatccaagatcaagtccaagattctccaccaagtgtgcttaggagtcatgagctcatgggcccaaaatctaccctaaggctcatgagaaccctagggccttctcctgcatctctggcccaatcttttttggagtctcctagccatggctcgggtgatgggtcccctcattgggaggattgcattagaaacacttgcacctaa

SEQ ID NO: 86656 - DNA, 276 bp, Glycine max
  Peptide Sequence Number=SeqID_203434
atgatggcacatcaagatgatcacaataatagtagacacattaccagtgtttttctaggaaaaatggtggggtacgcgccttcaagctttgcggatttggtcttcgccggggaaagggtcgaagcggatctgaaaagaggaaaatttaatcatcctgcttggacgaatgagaaaattggggcaaatgaagagggtgagaatgaaagagaaacccatcctgcgactgctgtttctacatgggaactcccccaccagctcaacaatgtcattacatag

SEQ ID NO: 86657 - DNA, 662 bp, Glycine max
  Peptide Sequence Number=SeqID_203435
gacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccgggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 86658 - DNA, 288 bp, Glycine max
  Peptide Sequence Number=SeqID_203436
atggcgtgtgaacatagatggattttcaacctccatttcactcctccgctggaacaacaagcatgcggcagacccctattggcagctagaatgcatgcatggactcttgaactcacacaggccctgcttggtgatcttaaaccactgatgcttccacctcttgcagcaatacatcttccttcttgtggttttcatatgacgattttaagaaggttagaccctccattgcaatggcctgtcctttcggttggccctggctttcatggcaagcatgttgcccaaccatga

SEQ ID NO: 86659 - DNA, 141 bp, Glycine max
  Peptide Sequence Number=SeqID_203437
gcgcctggggtcgtgcctggtgcaggggcgccaccagtcgagcccaatggcaggcccccaccctgctgctccctcgtgcgtcgcgcttgtgccatgtgtagcgcaatcaatggagacgcctgtctgggcggcgctttgtaa

SEQ ID NO: 86660 - DNA, 544 bp, Glycine max
  Peptide Sequence Number=SeqID_203438
atgcaagattgatgtgagaccttatcatccaaagagggtgctgaggcagtttggctatgtacaaatattccatgccaaccacctctttatcctacgtatcatctttgagatcaaacatgggtggagtggcaataacatatcattcctcttgaggatgttgtactacctggagatcgttaggcctacacctccaactatctacctcaattttacaaggtttcttatgccattcagtcagaggagggacaactaccatgtggtcctatatgtttacctcctagtagagtacaactacagcatgcggagccattggcaaactatgtatcaggtggagactactcttgtcagtgttagaagctatgtggagcttgttgaacctcggagttgtgtcacagggcacaagtcatcattagacctaggatcttcttcatcaatggattcctttgcttcttcgaagatgaatgacagcggaatggagaaggaagagagagaggagacgccacttcaaggagaagatgagtctagaagaagctcaccaccatag

SEQ ID NO: 86661 - DNA, 631 bp, Glycine max
  Peptide Sequence Number=SeqID_203439
gggggcgctgttggtggagagcctcacacctttcatcacacggggtttcagtgaccccaacgcaagggtgcttcaaggagtctgcaaggcgtgggaagtggtgcaaagaaaagatagagaacttaggggaagtagcaacgggaccgtcagcagctatcataggtggttgagagcctacacacaaggtctggattggctcccgaagctaagagccgctaaagaggaggaggttgaagccctggaagaaagcgaggaggtgcaagccctcaaagcagagctcgagaaagcccaagtgaatgaagaactaagggacatcaactcggccactaccaaagccttggagcaagaaaccaagagggcccggaaagaagaacatgaccgaaacaagttccgaagagctttgtggggcaacaacaacgagcttaaactccagagagaagaaagaaaccagtcacgagtggaaggcatgattctaaaagatgaattgaagacttgtctgaggtccaagaggagtttgtctcagcaattgagcgagaccgaggaaaacatgttagccatcatcagcaagtacaaagaggaattggagttggcaacggcccacgagcataaggtggcagatgagtatgcccaa

SEQ ID NO: 86662 - DNA, 357 bp, Glycine max
  Peptide Sequence Number=SeqID_203440
atggaggagtataatccagaaaacaaatatggcttccttcctcttagcgggcatcccaagatcccttcaaattcttctacagttgttgatatctcgctaagcgagctcaatgcgcttagcgagtgtcatccgctaagcgaggcaccagcgcgcttagcggataggaggaatctggaagggaatctgtcacgcaggcacgtgctcagcgcgtcattagctcactcggcgagtcatttgtcaccatccaggcttaacgcgagtttggcgcggagcgaaaattcacttactcgcgctaagcgcgagaatgacgctaagcgcgacgtcgaggtcagtgagccctttttaagcctggaatag

SEQ ID NO: 86663 - DNA, 294 bp, Glycine max
  Peptide Sequence Number=SeqID_203441
atgaggcagttcttcgcactattgttgcctgtcaagtctccatatcattgcaagtatatgcatggtttaagggaattaggacgtggagcagtaccggttctagaagtaaagatgacgcaaggcaatgcgcagatgaaaagtggtcaaaggagagatgagcatgaattgcaaatggccaaatgccaacgttggtggtgcacttggagatatccagtcctacttcatataatgagaaccgagacacacacctcgtgcacacatataaaccacaatttgaccgcagctacacattaa

SEQ ID NO: 86664 - DNA, 1403 bp, Glycine max
  Peptide Sequence Number=SeqID_203442
caaaccctaattcttcctcttcttgtgaggaggatatatctgtttctacatctttcactaatgcttccaaccattcaagtctcactgttgagtcctctcgcagactcattgagccacctgctccttcctccaacgagttgatgggagaacatgcttcagataatcaactttggagtcatgttttatcaggtgttggatcaaacggcgagttgcacaacggccaagaaattggagagaactttctggatgcactgtcatccaaaagcatgacaagcactatgtttcaaccagtgtgtgactacttgaagaaacttgatcatacaagttgggaatataatggtccaacttcattaaatagctttgagaagcacttaaatgggttcagtgaggcgatgattgagaataatgaaaggttgaccaagttatccaatcttgtaagcacttggtctattgctccaccagacccagaagttagtagccactttgatccacaaacaaacaacatgtccttgagttctaattccatggatcatcacttcccacaatctgaacacttcaagcaaccttttagagactccacatcatcatgctctcttggaggagcaagtagaagttctggagtgattcctaattgctatgatcatgacatgaaggtgaagcaagagtatcatgcaagtgaagtgccaccaggagcagtatttggaaaaacattgaatgccaatggattcaatagcctttcagtgggtgatagttgcaaactctaccatggtatgcccaatatttcttcatgcacaagaaatttctcagatgttatatcctttaatagtagattgggaaggccagttattggagtccatagtcaaaagcctagtatgaagtacctgaacgtatctgaatcaaagaagcaaggtcttcaaacaccatcaccaccgataagaactaatgttaatggaaaaggggaggggacaacacgtgaagtaaagaagaaaagatctgaagaatcttcagatgcaatgttgaaaaaacctaagcaagatacatcaacagcttcttcttcaaaggtgcaggcacccaaagtcaagctaggggacaaaattacagcccttcagcaaattgtgtctccatttggaaagacagatacagcatctgtgctgtttgaagcaatagggtacataaagtttcttcaagaacaagtccagctactgagcaacccttatttgaaggctaacactcacaaggacccatggggaagcttggatagaaaagataaggaggacaccaagttagaccttcggagcagaggtctttgtttagttcctacttcatgtactcctctagtttacagagacagcagtggaccagattactggacaccagcatacagaggatgtttgtataggtga

SEQ ID NO: 86665 - DNA, 819 bp, Glycine max
  Peptide Sequence Number=SeqID_203443
atgaaaagaaagggcaggagttgtgacaaccaagatgccgtgaacagaggtccttggtctgctgaggaagaccaaatactcatcaactacgttcaagtccatggagaaggaaattggagagagctttccaaaagagctggtttaaaacgacttgggaagagttgcagactccgatggttgaattatctcaagccagatatcaagagaggaaacatttcttcggatgaagaagatctcatcatcaggctacatagcctcttagggaataggtggtctcttattgcaggacgattacccgggcgaacagatcatgaaatcaagaactattggaatacttatttgagaaagaaggtagagcaaaaccacaactataacaaccttcctggtcataacaacattcccatcaaattaagaattgaatctccacggtgctcaaaaaattcattgggtattgttattgatcctacaaaatcctctcacccagtgacgattaagtcaatgagctgcaccgaggttatgatgccaacgcgaacagtcaatgattttacaacaagttgggataaaaacccttttgcatcgaccccacaagatggccatggtcattgctcagaaggtttcctcaaacactttgatattagtgacgtattaatgccatacgaggattgtcgttttaatgaatatgcttgtgtcgaagtaccccaacattttggagatgaagcctacaaggttattaatgcggtgggtgaaacacggtatgataattggaagattgatgactattttccactagactatgatgtaggtttttctttattttaa

SEQ ID NO: 86666 - DNA, 153 bp, Glycine max
  Peptide Sequence Number=SeqID_203444
atgcatgagcaggaattgctacttcatcatgagagtggctttgagggaatgctggagaacttaagatatcaaagaggagggaaaaagggattgctactgtgtgcggtggccggaatccgaccactgagtctcgcccttttcaacgaatggtga

SEQ ID NO: 86667 - DNA, 276 bp, Glycine max
  Peptide Sequence Number=SeqID_203445
atgtggaggagcttgtcgtggaagtgctcagtgaaggcagagaggccgaagtcgaagaccttgaggtcgccgatggcatccaggaccagcctgtccaacaaagacgttgtctcttcatgcgctcactctcacttagcggaattttacttactctcgcacaacgaggcaggctcgctaagcgagctttcgagagctaaaaagtccaagagtcttcaaaacactgaagttggaggaaatgagaaagggaactggtcaagagccacaaggagagtctag

SEQ ID NO: 86668 - DNA, 318 bp, Glycine max
  Peptide Sequence Number=SeqID_203446
atggttgcattctttcaagggaaacaatttgaagacatgggaggaagtagtagaaagattcttgaagaaccacagtccaagcaattgttagatacttctaccggagggaagattaagttgaagactccagaggaagcaatgaaacttattgagaatatgacagcaagtgatcatgctattttgcgtgatagaacacacatacccaccaaaagaagcatgttggaactctcttcacaagatacattgttggcacagaacaagctgttagctaaacaacttgaatcactcgcagagacactcaacaaattgccaacatag

SEQ ID NO: 86669 - DNA, 885 bp, Glycine max
  Peptide Sequence Number=SeqID_203447
atgcacaacacctttcagaatccaagaatagagagacagagaggcagagaaattgagaagatgggaagaaaggccaactgtgacaatcaatatgctatgaacagaggtccttggtctgctgaagaagacaaaattcttatgaactacgttcaagtccatggagaaggaaaatggagagagctttccaaaagagcaggcttgaaaagatgtgggaagagttgtagactccgatggctgaattatctcaagccagatatcaagagaggaaacatttcttcggatgaagaagatctcattattagactgcataagctcttagggaatagatggtctctaattgcgggacgcttaccagggcgaacagacaatgaaattaagaactattggaatacttatttgagaaagaaggcagagcacaagcatgacaaaattcctagccataacgataacattcctatcaaattaagaattgaatctccgggttgctcaaaaaattcctttggtaatgttcttgatcctacaaaatcccctcacccaatgaggtgtaccaaggttatgatgccagtcaatgattcagtcaacacaacgaatttgattacaacgagctgggacaatcataacccttcttctgcatccatgcaactagatgactataatcattgcttaacaggtgtcctccaagaatttgacatcagtgacttgttaatgtcgtatgaggatgattttcgttttaatggatatgcttgtgtcgaaataccccaacatatttttgaagatgagacttgcaggcttgatgattcgttgggtgaagaagcatggtatgagaattggaagaatgacccctattttccacaagatcaagatatgggtttttcttccttttaa

SEQ ID NO: 86670 - DNA, 387 bp, Glycine max
  Peptide Sequence Number=SeqID_203448
atgtggttgctatgcaatcccttgcactgcagcaccatcattcccaccttgttcctcaatttcactcaaatttctagattggtgtaccctaattccacctttggcacccacctcattccctctaaacccttgattctgaaacccatcaaccctccccaacatggtggggttgcaattgcggtagaagagggggtggtgggcactgcggccgatggtagttgtggagttgcacgaaggggcgctggggttgctggtggtaactcaaacacggtggaggagatgacgtacaaacctgagaacaccacaaaaaccattagcaccttcgaccttcgagagagagatttggaaagaccaaacttttccactgccaaacccaagctccagtaa

SEQ ID NO: 86671 - DNA, 1533 bp, Glycine max
  Peptide Sequence Number=SeqID_203449
atggcaacaaacaggtttatatgtgaggtgtgcaataaagggttccaaagggagcaaaacctacagcttcacagaagaggacacaacctgccttggaagctaaagcagaagagtacaacaaaagagccaaaaagaaaggtttatctgtgtcccgagcccacctgcgtccatcatgatccttcaagggctttgggagacctcactgggatcaagaagcactactatcgcaagcacggtgagaagaaatggaagtgtgaaaagtgctcaaagaaatatgctgttcaatctgattggaaagcacattctaagacttgtggcactagagaatacagatgtgactgtggcactctcttctctagtggaggtatatggcaggagactgctcgcacgcgtgacagtttcatcactcatagggccttttgtgatgcgctagcacaagagagtgcaagattcccgagtggcttaaactctctggggactcatttgtttggcacaaaccacacgactagtttaagcctatcccaagtgggtaaccaactttcacaagttcaaaagcagaaccaaaccgccactactaacagcatttttctccttggcaacaatgttggtgcagcagcaacaaagtttgaacacttgattccacctctaaaccagtcttcatttggacactcaccacaatcaatgccttcctcagctttcttcatgaataacaacacaaatcaatcattatttgaagaacaccattcacaacatggaccattgttctcaaccaagcaactacagggcctaatgcaactccaagatctccaaggcaacacaaacaactccgattcttcttcagttgctgctcctaataattccaatcttttcaacctaagtttcttcccaagtagcaatattagcactggcaccataatccctgatcaattcaacaacataagtggtggtgaccaaggaacaacaacaacaacaacactctatggcaattcaatagaaaacgtgtcatcccctcatgttggatcgagtttttcttctatctttggcaattcgatggaaaatgtgtcgtcccctcatatgtctgccactgcgttgcttcaacaagctgctcaaatgggttcaaccacaaccacaaccaccaactgttcttccttactcagaggaatgtgtactaacaatggttgcaaagctgaaaatgatcaccaccacaatcttcaagggttgatgaactctattgccaacggaaacacgtccttgtttgggagcatgcaagggaacgaaaacaacctttgtgggtttcacaacgtggatgagtccaacaataagttgcctcagaatcttagtgtaaactttggaggttctgataagttgaccttagactttttgggtgttggaggaatgatgagaaacatgagtagtggtggattttcacaaagagaacaacaacaacatgacataggtactatgagttccttggaccatgacctaaagtcagcacagccaaatcgtcactttggaaagtcaacgttgcaataa

SEQ ID NO: 86672 - DNA, 312 bp, Glycine max
  Peptide Sequence Number=SeqID_203450
gaaaggaagttgcaactaagtgagctagatgagttccatttagaaccctatgagaattccaaattctacaaggagaagaccaagaagttccatgacagcttgatagctaagaaggacttcatggttggacaaaaagttttattgtataactctaggctcggactcatgagtgttgagatcaaaagtgaatccacagataagagcttcaaggttaatggacaccggctgaaaccattcctcacaaatccctccttagtggatgtagtggtggaggagacttccttacttcaccctacttctcttccgccatga

SEQ ID NO: 86673 - DNA, 204 bp, Glycine max
  Peptide Sequence Number=SeqID_203451
atgatttataattatagcagtggtgcaagtggtggaggaggaggagacttgtggtggtggtggggatgggtacttgtagggcttctttggaggtggtggaagagagtggtacttataagggggatggagatggatgatgataaggcttcttgggtggtggaggagaggggtagtggtttgctgaaatttcaaatgggagactga

SEQ ID NO: 86674 - DNA, 141 bp, Glycine max
  Peptide Sequence Number=SeqID_203452
atggggcatgaaggaggtaggagtagaactaaaccagaaggaattaagagcaaggtagagagagagagtcacatgagagagcaggtgtataaagtgaggaaggcacgagaagcacacaaggatgtgaatgtgattgaatga

SEQ ID NO: 86675 - DNA, 294 bp, Glycine max
  Peptide Sequence Number=SeqID_203453
atggcatcactcaaagctgagaaacctgttgaaaaatcttgttgctctcaaccatctgcaggacaggtgaagaaagagtcttctgccaaacctagttcaggcacttccaaagccccggtctcgaaaccaaccccaaagaaaattccaagccagactaggaagaagggtgaaaaggacgaagctgttcccaaagccagtgatggtgcatcatccaaatccaaatccaagggtccagcttccaaatcagctacgaagaaagttcctgtacagaagccccaagaatccaagaaaaag

SEQ ID NO: 86676 - DNA, 522 bp, Glycine max
  Peptide Sequence Number=SeqID_203454
atggcttcacagtgccaccctcaacaagcaacggagcacgacgtgagagagattgtgaattggtgcctcaacaagttcatcaatggccaaacttaccaccctagctttggtggaaatggtgcaactatgtttttcttaatcttctccatactagcagccgttttgggcatagtgtccaaacttttgggtgcgaatcacattaggacatggaggagtgacagtttagcatctgcaggagccacatcaatcgttgcttgggcagtcactgctctagcatttgggttggcttgcaagcaaataaacataggagggcacagagggtggaggctgagggtagtggaggctttcataataatactcacattgacacagttgttgtacctgatactgatccacgcaggactatatagcagtaggtatggtcccgggtaccgtgacactgactatggtaatgctcatggtgtgggagggactacaggagatccaatgcacaagtctgctgctgctggaactcgtgtctaa

SEQ ID NO: 86677 - DNA, 303 bp, Glycine max
  Peptide Sequence Number=SeqID_203455
atgggagcaactcaatgggaaagcacgtgtattctatccacccctgtctcagtttcagggttcgatggatcttcttggcttaaaaaaacttcttactccattttcaaagagctttcttctcgttttccactttttcctgcggcattgtctctggttcgtgggggtagcaaggttgagtgcagcggtgaaggtgaaatttccggcgtgaagctttgcggtggtcggtggcggcaaacaaggtacgcagatggcgtttgtgcgtcgcggacgtacggatggcttccggatcaagttgatccgtaa

SEQ ID NO: 86678 - DNA, 417 bp, Glycine max
  Peptide Sequence Number=SeqID_203456
atggcgaggatcaaacctcaggctctgctacagcaaagcaaaaggaagaagggtccttctcggataagtgccgtgactgttatattttactttttgattcttgccttggttgggtttttcctgtttgcttcgtacagacattggtccagcaggatgtgtcccacttctcatatagactgggaacttcagaagaacattgtctgttacctaataattcatttcttatatgcattcagatcaagattacaatccgaagatcacttgtcagtctctgagggtgaaaatacttttgtggactccaagaaatctgagctgcctggatatgctgttttaaatacctctaaaggttctataataatagaactgtacaaggaaagtgctcctgaagttgttgatgaattcattgacttatggtga

SEQ ID NO: 86679 - DNA, 459 bp, Glycine max
  Peptide Sequence Number=SeqID_203457
atgccacaatacgttcctccaccaatccagcagcaacaacagcaacagcctcagaaacaacaaacagttgaggctcctccgcaaccttcccttgaagaacttgtgaggcaaatgactatgcaaaacatgcagtttcaacaagagaccagagcctccattcagagcttaactaatcagatgggacaattggctacatacttgccttctcaatctgtccagaatccaaaaaatgtgacagctatttcattgaggtcgggaaagcagtgtcaaggacctcaaatagtagcagcttcctcgttcgcaaatgaacctgcccaaccttactctactccagaaaaagatgatgacaaaaatttaaaaaaagcaacatatccctcttccattccctccaagagcaatttccaacaaaaaaaatggaagaggcagagaaggagatcttggaaacatttagaaaagtag

SEQ ID NO: 86680 - DNA, 606 bp, Glycine max
  Peptide Sequence Number=SeqID_203458
atgctgcaacagaagagcggcggcgcctcttccgggctgggcggcgcgctgggtggcttgctcggtggtggtgctggcaaggcctcgggcggtggtgatctcgcgggtgcgcaaggtcggtggcaaggtggcggtgtatggcggcctggccgcgcttggcgtgctggcctacaaagcctatggcaactggcaggcgcagcaagcccagcagggcggcgcgcagccggtcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 86681 - DNA, 291 bp, Glycine max
  Peptide Sequence Number=SeqID_203459
atgacaaaaccaaggcttcaatgcacaagctgctcctcttttatgcttctagggctctttaccccaaataggcctgtggctgctcgggaattctgtgccttggccgttttgcatgttgtcctcagaggctctgaaatcgcgacgctgcacttagcacgagtaagtgaaattgggcttagcgccagcctcgagcttagcctgttgaaggcacctgatgtgcttagcacactgatcttgcgcttagtgcgcaactttgatgctgatgctctgctagattctcctttgcgctaa

SEQ ID NO: 86682 - DNA, 639 bp, Glycine max
  Peptide Sequence Number=SeqID_203460
atggctgctcgattttcccgcctgttaagcttgtgcctggcactgctgttttgcctgtcggcgcaggccagcctgttctcgcccactaccaataaccgctttgtgccggtcgatcaggcctttggctttgatttcagccagcagggtcatcagctgacgctgagctggaaagtgaaggacggctattacctctatcgccagcaattccacatcagcgcgcaacacgcgcagctggcgccggtcacgctgccgccgggccagccgcacgaagatgagttttacggcaagagcgaaatctatccgcaggacgtacagctgccgatcaccctgcgccaggccgatgccggtgcaacgctcagcgtgacttatcagggctgcgccgcggccggtttctgctatccgccggagacccgctcggtgccgctgacggcgattgctgccgatagcgccacgccggcaatcgcggcatcaccggccgctgaccgcacgccgctgccgttttcgccgctgtgggcgctgctgattggcatcggcgtggcctttacgccgtgcgtgctgccgatgtatccgctgatctccggcatcattcttggcggccagcgccgttactcgctgggccggctgttcgccctcgcactg

SEQ ID NO: 86683 - DNA, 210 bp, Glycine max
  Peptide Sequence Number=SeqID_203461
atggcgaggtggttcatgacaagacagaagaaccagcttagcatcactggcgacgtgtccctgccggcgaggaggaagtttagtgcagcggtgctcagtggttttttggtggagcagtccaagagatccgcgacgaggggcatggcggaggcgcgaagggaggtgaatagggatagtattgaatctttacttttgttagacattagataa

SEQ ID NO: 86684 - DNA, 255 bp, Glycine max
  Peptide Sequence Number=SeqID_203462
atgtcgctgaggcgtttcttaggctattctgatggtggggtcatgaggtctgatgcaaaaccttgtttcaggctaatgaggcacatagctgcaatctttagtgttggtggagcatttggattttgggtcctttgccgaatgcactatgtgactatgaagagtcataagtttgtgtggagctatctttctcagttaaatagtagaaggaaagaagaccaagagagacacaattttggaaagatcatcgtagaatag

SEQ ID NO: 86685 - DNA, 306 bp, Glycine max
  Peptide Sequence Number=SeqID_203463
atggttcattgcagggtgtggaagaattatatttgtgaggtttcttcttcagacatttgcaagacacccggtcggatgactccaaccgtttatggccaaatggaagctgcagtgaatgtacattatggttctcagagtttcatcttacaaaatacctatactggagtagagatgtttatgaggaaaaaacagtttatatggtgcaaaaaattgagattgtttgattcgaatagccgacttggggggttaaaaggttttcattctaatttgttcagtgcaatgcaactactcaattttgtggagtaa

SEQ ID NO: 86686 - DNA, 183 bp, Glycine max
  Peptide Sequence Number=SeqID_203464
atggctcatcattcaggtgccaactttgcatggctagtgcggattttaatgattgtttgttacccagtttcttatccagttggaaaggttctggatcacctagtggggcataatgaggctttatttaggagagctgagttaaaagcccttgtctccattcacggccaggagcttttggattaa

SEQ ID NO: 86687 - DNA, 915 bp, Glycine max
  Peptide Sequence Number=SeqID_203465
atggatggagtcgaggatggtggtgagggagagtactaccacgaggtactaccatggaaaacgaggagatccatggctgaagaagaggccacgagcaacacgtctctgatattggctcagagaagaaccacaaggaaggaccctttggataactacaaccattacaccggtggctggaacatcagcaatcgccactacattgcttcagttgttttcactgcggttcccttctttgttgttgctgcggtctggtttgtgatttttgggctcagtttatcattcatatgcttgtgttactgctgttgtccaagagagccttatggctattcacgtttggcctatgctttgtccttgatcttcctcgttctcttcacccttgcagcaatagttggatgtgttcttctttacactgctcaggggaagtttcatgggagcaccacaaacacgctgaaatccttggtgagtcaggctgacttcaccgccgaaaacctcaggaacgtgtcagattatcttgatgcagctcagaagatcggagtcgaagcggtttttttaccagccgatgttcagaagaacattgacgaagttcagatgaagattaattcttctgctgcagatctttccagcaagactaaaaaaaattcagagacaattaaagatgtcattgatgcaatgagacgggatctggttattcttgctgctgttatgctctttcttgcatttcttggattcttattttcaatatttgggttgcaaggtcttgtatacttgtttgtcctgttaaatctccagtcagtaaatatttttccttctatggctgcagtttggtcattgtcgggtggattcttgttgccggcacatttatactttgtggtgtgtttctctttcttcacaactgaaattgcaagggtcgtttaa

SEQ ID NO: 86688 - DNA, 213 bp, Glycine max
  Peptide Sequence Number=SeqID_203466
atggaaagaagaggttcttgcagcggtggaaggagagaagaaggaaatagagagaagggtgagaagaaggaagagaagagaggggtgtggtgtgaagcatggcataatggggttaccgtttgcgagcttgttctggtttttcagagaaacgcagagaaagagaagagagagagacagtgttgtgtaagatgtgaaaaagttgttgtggtttga

SEQ ID NO: 86689 - DNA, 426 bp, Glycine max
  Peptide Sequence Number=SeqID_203467
atgcctataagttggacctcccagaagagtggagctgatgttgcggaggaggaaccaaaaaatttgaggtcaaatcctcttcaagggagaggggatgatgcaatcctccctaagaagggactagtccccagagccgtgagcaagaggctccaagaggattgggctagagctgcagaagaaggccctagggttgtcatgaacctcagggcaatcttggtggtgaagcttctccttccatggcttatctcaagtagatggtgcctcctctcacctcttctcctttgtcttttgctgcaactccatggtggaaaatcaccattaaaggacctcattgaagctcaaagatccagcctccatagaagccccacaagcaagcttccatcaagtggtatcagagcacaagagcttcaagtaggtgctcattaa

SEQ ID NO: 86690 - DNA, 462 bp, Glycine max
  Peptide Sequence Number=SeqID_203468
atggctattccggaaatttgtattgaggatggttacttcaacaaaatgtctgatgaagtcaatatgcttgaggacatggatgaagatacaaggatgccattcagggaagacataaaatatcatgattgtagtacgaatgtttttgatactcaagatgggttattgaaatgggttcgggcaattgcatttgggttgggttttgctattgtcattttgaggttagacacaataaacatacaacctagaaggaagacatatgttgtgttgggttgggagaaggatgacaaatataggaaatacaaaaaggatattgacaaaaatcaaaagtgttgtgttccgaaacatatttctagcgaaaaagagacccaacacaatttcgaagcaccaatttcacagaagccaaacacccacactgggaacccaacaccacaacagaccagagcatttgtaaccaaaaaatga

SEQ ID NO: 86691 - DNA, 177 bp, Glycine max
  Peptide Sequence Number=SeqID_203469
atggctgattctgtgcgtatccttgagtctagtcagatgagttccatgcttgtggaagtagttgtagaggtggttcaaaagttgcaaccacgtgaagcatcagctgtgtttattgaggtgaaatctgaaaaccattttatcccattttgttttggatttagcctgaaaccttgttag

SEQ ID NO: 86692 - DNA, 198 bp, Glycine max
  Peptide Sequence Number=SeqID_203470
atggttggtacacaaactataaacaaaaactacttagcctggtttgtggtttgcggcaaaaaaggagacgacgaacaaagcgagaaaaggttttggggttttacctgcaatggcagtgacgacaatggcgacgacgacctgagggtggctttacgagactcagcaaggagggtttgcgagagactgagcgtgaaatga

SEQ ID NO: 86693 - DNA, 998 bp, Glycine max
  Peptide Sequence Number=SeqID_203471
tactttatgccctttggatagtgttgggggtgccgatctacaaggtcatcgtgatatggagaggtttcatgatttattgtcccaaggaaacttgcatgatatgggtttccaaggtgataggttgacttggaggaaggaggaattgggagtcaaattggaccgatgtctgatcaacatgaactgcaggttgaagctccaagaagccacgctagatatgggtttccaaggtgcatctagggatttcccaggctttgtgaaaaggacttggcggcatggctttaggaactcatcttggtttgggaatatcaatcacttctcaaatcaggtgaagcctcaaaataaggaggatgttttccaaaattaccacaaggtggcagaagtcaataaaacctttgtaacattgattcccaagaaggaggagtcaagctttgttcctgtcaggcaaagtggagataatatcattgctgcccaagagatattccattctatgaggagcaatactggaaatggctcctctattaagttttggcatgattattgggtggaagggtttagttcgttggcgagcattgctttgttggatatacctaagagtttgctagagacttgtgttgaagaatttgtggatcttgttgatggacggatgttggataatgtcaaggagtatctacctaagccaacgatcagggctgcaacatacatgaacccctcaaagtcccatgacgatccaaatagattgagatggaaaggaaatgcggatggatccttctccttgaatattgacgagatgagatggcatcctcatgcacttggccattatgctttgaattgcaatgctcatcatcaactggtggaagaaattcacagagttgtagtagcgtttgataatggtatttgggaccatgtgtttataaaggccaactgtgttgcagacaaaatggctaagcaagctttgaagataagttcttattttgttgtgcatgagattgcacctgatt

SEQ ID NO: 86694 - DNA, 591 bp, Glycine max
  Peptide Sequence Number=SeqID_203472
atggacctctctcaccctcagtctaacttgtccctcaaattttcttcctcccacacctcgctgcctcctcactccgacccgccggtgccactgcagctcatggaacaacagatggagaatgacaacttagatgttgaatcagacgatgatgaggacaaagaagttgaggagtttcacattctaggccactcaatgtgcctcaagaggcaaagagattgtgactcctcatcctcctcctccgccgccatgaaggtttctgtcgagcccgatctcgacgcgcgtaaggtcgccgtgcgcgcgtggggttgccaacccctctacatcggagttgttgatgacgatcatgccatgcctatggacatggtcattgtgggtgatgagagaggctcttttgactttgtacacaaaagtgggaatgattctagaatcatatgtagtaaaaaaggaaacatagaagatcttgctcttgtatttgctcagaacagggacaggtctctgggtacgtcttgttatctttttggtagcccttgcaacctgatgcatgccattcatgtaactgctacagtgcatactaccctatttcattgttga

SEQ ID NO: 86695 - DNA, 501 bp, Glycine max
  Peptide Sequence Number=SeqID_203473
atgcctttacgctctgttttggtggaagccgagtctgatgagccttgcggcgtgctcatagcggagattgaacggaattggaagattctagaagcaacgctaacactagaactagaagcaaagctcaccataatggattcaaggccacacccaatcttatcttcagaatgtggatggtatgcaacgagcttctcagctatagctttctcgtcctcctcactcaccgactttctcagggccgaagagcgcggagggtttgccagcacagatttccatgcggccatacttctgtttgtctctgacgccgacgtcaccgccgaggcattgaatgaggagctggaggaagccatcggggaaggagggggagtttggggtgtggacggagtaggggccccggagagaatgacaacggcggggttgaggtcgatgatggttgaaagagaggacttggtgcattctctctttcctccacaaagtgcatggataaagaaaaaaaggtag

SEQ ID NO: 86696 - DNA, 285 bp, Glycine max
  Peptide Sequence Number=SeqID_203474
atgggctcaaaatctaccctaaggctcatgagaaccctagggccttcccttggatctctgacccaatctacttggagtcttctatccaatgcccttgcggggagtaccaaaaaagttaaggaaggtcttgaagtgtttgcaccagggatatccgcctcttttatagacaaattgctacacccagcagggagtggagagaaagttatgaacatgggtgatgacgtgaacagggaagtgataggcgaagttccaaaggagaagggagggtctaggaatgatggatga

SEQ ID NO: 86697 - DNA, 546 bp, Glycine max
  Peptide Sequence Number=SeqID_203475
atgggagataaaaaatatactaggtcaggcgagttaagacaagtcctggggatatcttttggaaatactcttgaagattatgcttttggaactgctaatttgaagcctccccctccagtggctatggaggaactaaaacgattcaaagcaagtgtacaagaggcttctgtcagggctaggaagcaacttcagaatgatttggtgccaaatgaaaggctgggtggatcaaaattctcaaagatgggaactcagactcatcgaagcccatcagagcttgtgaaccaaaggccggaggatagacctaagaatgtcattctaaataaagttgaaaatgagttgtctgagaagattgagaaactaataagatgtgaggcctcatcatatcaaaaacttttgatgaagagggtggaagaaaatcttggttctattggcaattcaaaggctctatcagtacacaactctgtcatggagcttcataatatatgcaatcatccatatctcagtcagcttcatgcagaggagcatcatcgcaagatcattttctaa

SEQ ID NO: 86698 - DNA, 294 bp, Glycine max
  Peptide Sequence Number=SeqID_203476
atgaagaaatgtggtgttaaaaatcgcatatttagatgtaacaaaaacacagaagacggggagggaaatgaaaacttacgaagggtccgtttatgcatgtatcatacactgttccagcactcaaaacatgagcttcaccgctctcgtggagctgcattcgtcggctccgccaacgtagatgccaccaacgaatacgcgcggcagggcgaggttgctgcggcaaccaaggacagtgtggagctcgtcgcgaaagcgatcgtcgcggaagtgggtgatgctcttgtgtggccatga

SEQ ID NO: 86699 - DNA, 360 bp, Glycine max
  Peptide Sequence Number=SeqID_203477
atgaatacatcatcatcgagcacgtctgatgttgaatttaggagaacccatggcatttacgaaagtgttatcatgcattttgttgcatgggataaaaatactaatttcaatgtggacgttgtgggacctctacatagacaaacacaccaaaggtcaaccacaaccaccaggccccatgtttttaccattgatgtctctgaagatatgatacaacacaattatcaattggtagctgacagtcatttgaagcctggagatgaggtcgtcttcttctacaactttgaccaacacttatgggaagtcctctataggaagcaagttaaatggaatcaggaagaggacgaagctgactccacttga

SEQ ID NO: 86700 - DNA, 237 bp, Glycine max
  Peptide Sequence Number=SeqID_203478
atgcatgtggcattcttggacgcattttatgacctcatccaaactagaagctactcatggggagcggctgcactggtttatatgtatgagaatttgaatgatgcatcaaagagaagcaccaagcaacttgtaggatatatcacacttttacagtgttggatctacgagcatttccctattattgctatgtgtgttgccgatgaggattatcatgagaggaaaccatgtgcttgttga

SEQ ID NO: 86701 - DNA, 228 bp, Glycine max
  Peptide Sequence Number=SeqID_203479
atgaagagggagatgcttgactcgactggaaatgacgggtcgacaactccgaatcacaagctatttactactgtattgtattacacggtaacgggcgtagcaaagtttgtgggggaggttttccttgatctctatgacctctccgaaggggccacacgatatgaatggctgcttaaggaagaggcccaaagcaagcaaaggaaggcttctttcttcccaagacactga

SEQ ID NO: 86702 - DNA, 576 bp, Glycine max
  Peptide Sequence Number=SeqID_203480
gcacgggtgaaatcttgccccggtatgcatagtagctgtgtgatagcctccctctctggttgtgctcgcacagttggccctcctccaatatcagggggtggcccaggaaccgtgtggatgtcgagcacactgaaaatgaggacacgtagccctctaaaggtgagggcgtgcagccctctcaaggcgaggaggtgcagtcctctggagatgagggcatgcagccctctgctggcgaggacgtgtagtcctttcaaggtgagggcgtgtagccctctgacggcgagggcgtgcaaccctctgatggtgaggacgtgtagtcctctcaaggcgaggacgtgtagtcctctcaacggtgagggacgtgtagtcctctcaaggcgaggacgtgtagtcctctcaacggtgagggtaactagtacccaagtcctctcaaggcgaggacgtgtagtcctctcagcggtgagggcgaggacttatagtcctctggaggtgagggcgtgcagccctctgatggtgaggacgcgtagtcctctcaaggcgaggacgtgtagtcctctcagcggtgagggtaactag

SEQ ID NO: 86703 - DNA, 240 bp, Glycine max
  Peptide Sequence Number=SeqID_203481
atggactccagtatggcaggtgtaacgtgtagtctctgttacggtgcaaggtcatatctactctctttgcgagctacactgacctcacagatgcctcgatgtattcggcatcatcggtacctaaaagttattggttgtaggagtgagtcctctgctccacgaatgccacaaagaccaggcaatagagacatcgttaaaagtggtcgcatattctacgacggttgccaaggaccaatgtag

SEQ ID NO: 86704 - DNA, 297 bp, Glycine max
  Peptide Sequence Number=SeqID_203482
atggtgacaagaacgagaggatcaaaggaaaagagcagaggacttaccctcctacaaccaacaactttcaagttcaagagatgtcgagggagtcgtgccctctatgagcttagcatagtagtgaccccagtgagatttgttgcgagagatattgtcctgagttggagatccaagttagcacatcctgtccaggtcactgaggaccgaggagatcacatcgatatgatgcctgaggaagaggaagagtatcgcgggcttctacgagacttagagccttcgtctaaggagaaggattga

SEQ ID NO: 86705 - DNA, 330 bp, Glycine max
  Peptide Sequence Number=SeqID_203483
atggaaaatggaaagagggcaagtttctttagttggtttagtgactgtgagcagaaaaatgatgtggatgaaattcatgacgaggttgcagaattaatcaaggatgatttatggccaaatccactcacttatttcaacaatgttctgaacatcaattggtttcagaaacaacccaatggcaacgacgaggtcagcatgacaatgaatatttccgcagacttgcagtcccttttcacatggaacacaaaacaggtttttgtttttctagctgctaagtatgaaactcctaagaattccttgaaccaggttttagtttcaatttctaagtaa

SEQ ID NO: 86706 - DNA, 207 bp, Glycine max
  Peptide Sequence Number=SeqID_203484
atgatcccgaccttcatcgttgggatttgcgaaataatattcgtggagggagaaaaaggaatcgcacaaagacagtacaaatggaggcttcaatctcttctcattctctctaacatttgggaaccctatcagagcaaccagaggaagaaattgaggaatcctaggaacttgctagagatgctgctatcgcttttggaagacacgtga

SEQ ID NO: 86707 - DNA, 270 bp, Glycine max
  Peptide Sequence Number=SeqID_203485
atgactacaccaccgagctctcttcttcctcctaagtcaacaccttttccgtctacgccaaagaagactagtaaaacaacacgactcagatcatttgctactagacccgtcgggatggagagaccagtggttcatctggatcctgccacatggaaagctgatgctgaatttgatatttcagaagcatccggccaaaggacgaagaagaaaatccttaagacggtaggaaagcgatggaagcagtttaagtcacatttgacctccaaatga

SEQ ID NO: 86708 - DNA, 306 bp, Glycine max
  Peptide Sequence Number=SeqID_203486
tggatgtacccggttgagcgatacatgaagatcttaaaagggtataaaaagaatctacatcgtcctgaagcatccattgttgaaaggaagttagcagataggcctaaaataaatgttagcacttcgcaaagatacgatatcgacaagtattcattctacatcaaatcacaagacaataagagtaaaatgcaaaatagtgggtgggttgatagcaatttgggtgtgcagaccgatgatttcatatttactttggcagatctgaagaagctaacttatcaggatgagcctttcatcatggcagaataa

SEQ ID NO: 86709 - DNA, 1368 bp, Glycine max
  Peptide Sequence Number=SeqID_203487
atgcactcatcactcgtgctcattactttcatttcaatttcactctctccctctgtttctctctccgaatgtcgtgcctctcctctccctccaacgtcgacacctcctcccactttgtttattaggtacaatacagtcccctttggtgcaaaagcaaagagagtgaaagtggtgaagggagattttattcctgtggctaatgtgggagcttcccaaaacaaaattcttgctgacataagcaacttaccccaacaaccaaagcaacacatctttgttgaccaccatctcagggaaaaggaaattttgatcaagcatcttgctactagagatgccgttatagaatcgtgtaaagctgagctacacaagtgtcaaaccaactttcagaaactaaggaagcaaaatgcagaacttgccctcacaaatagtcaaatgctggtggagcttaattctagtagacagaagcaaagggaacttcagcttgaactaggaagcaaaaatggtgtactcaatgctatgagattagaattgacggtcagtttaactcatctcaaagctgttaaattgcaactaaaaaagcaaacagttaaatcgaagcatgaaactgatgcaaatgaggtgagagcatgtcagagtaagcagtcagatcagtcattgcaagaagataacaaggggaatgcaaaaaggaagagagtgtccaaatctcaatgtagtgtagtggacctaattcatatgtgtgtatcttctgcacctgctgtcattaaacaagtcaaatccaccaaaaaggtcgagaatcagaggtatagtttgcgaaggcaatctgcaggattgaaagctgaaaaacctgaaccaacaaaagatttcttggaggtagttgatatttcacatctacaagaaaattcggccaatgaaaatggaccagcatcattggggtccaaggtccatgaggaagccagagaagctactgaatcttcgagacctactaaccctgaacaagttcatgttaaaaagaatgttgagaagaagaggcagagtatgagaagacaaactaacaggttcaggccagagaatccagaaccagctgaagactgctttaagacagatgatgcaaaatttaatgtctcccaattatctgataatatgtcagaaaaaaattgtccaacaacatcaactgtaacttctgaacaagaaaatgatgcctgtatatttgagcctcaggaaactcgtagatcatctgttgggcggccattgcgtcggacagttgagaagattgtgtcctacaaggaagttccagttaaccggaagatgcgcagagataaattagggattttcatatcaggttctcactcagttaccaataactctgtatag

SEQ ID NO: 86710 - DNA, 2061 bp, Glycine max
  Peptide Sequence Number=SeqID_203488
atgaagtcatatgatatgattccggatctgacaaaagcagtctggaatgtattggaacttagacttctggttttaatcagtttcttcttgcaagtattcctaatagtttttggcaaccgaagaaaatgcatagccgatgcaaggctacaagtcagtgtctggttgacctatctctcagctgattggattgccactgttgcactgggaatgctttccaaagacagcaaaaatcctgaaaatgaccccgacttcataattatggccatttgggcacccttccttcttgtacatcttggtggccctgacacaatcactgcctactccctagaggataatgagctatatctacgacacttccttgggttattgtaccagctatcagtagcaggttatgttgtttacatttcatggaatggcaacaagcttaattatgttaccattccagttatggtggcaggaataatcaaatatgcagagaggacttggtccttgtggttgggaagcagccaaaagttcagaaaatccattctccctcctccggacccaggaccaaattatgccaaattcatggatgactacactgcaaaaaaagctgaaggatacaaagttaaattaaaggttgaacctacttccatagtattggatcattctccaggggcaatagcaaatcacaatgtagcagatgcttcttctttacacgatggattctatttctttacaatttttgagcggctatttgcagatctcatccttagcattcaagaccaccaaaacagccaacatttctttaagaacatatcatggaatgatgcatttcaagtgattgaggttgagcttggattgatgtatgataagctatatacaaaggcagtggtaacatactctcgcctaggctttttcctcaaatttgtgagcactttctgcacactctctgcatttgttacattttgctgtctgatacataaagcacacatagattatgagcggattattactttggtgcttttcgctggggctatttttcttgagatatatgcggtcattgttttactttcttcgagttgggcaatgctttggttaagcaagcgtaagaattggaaagtggatcttctccacaggtccatctcatgttttcaaagatgttttaaactctcgcacactaagaggtggtctaatcttgtgtcacaattcaatctcattagtttttgcttgaaagatgagccagtcagatgcatcaaaatccagaaattccttcgcatctatcagtttttcgagaagtcttactaccaacacacacaaactgtccccggggaattgaaaaaactcatatttgaacagcttttggagaagtctggggatgcaaaagataccaaagcatgtaaaaaattatgcgctaacaggggtgatagagttcttgacaagtggaactgccattccattgcctggagcactgaggtagagtttgatcatagccttctgctttggcatattactactgatctttgctattattcagatgtaactgctaactcaaattgtgcagagctagaaaactgtcaaataagcaaacttttgtcaaattatatgctatatattcttgttatgtgtccttttatgttgcccaacggaataggacagatcagatttgaagacacatgtgcggaggccagagaagttttgcaagaaaggaagtacatatcagacagagatcaagttttggaagtgatactgagagtgaagacagatgttctaccatcagaggttaaaggagatagaagcaagtctgtgctgtttgatgcacgtaggcttgctaaatcgatagagtctttagaaagagaaaagaaatggtcgaaagaagagaaatgggaaatgatgagtcatgtttgggtggagatgctgtgtcatgcagcaagccagtgtagagggtttcatcacgccaaacagcttagccgaggtggcgagttgcttacccatgtctggtttttaatggctcatttaggtataactgaacagtttcagatttcacaaggtcacgcaagggcaaagttgattctgagttaa

SEQ ID NO: 86711 - DNA, 4068 bp, Glycine max
  Peptide Sequence Number=SeqID_203489
atggctgaccttgcagctagtttcatcctaacaaaggttacagacgaactagctgatttccttgttaaagaatcggcacgtgcattgaagtttgtaagaagccgggttgaatggattgaaaaagagctgaggtgcatgctggcattcatagagcaccttgaacaccgcgaaggccccaatcccaatcaattagagttggtagaggatataaggatcgttgctcttgatgcacaagatgtcatagaaaccttccaaaggaggagaaggaaaggagttatgtattggtcttacaaatacaaccttggcagcgagctggataagattagcaacaggatgagacaaatctctgagagaataaggaacgctgagtctgagcaaacaaacatagttccgaccgttgaaactccaggagtgggagccaccacaatagtagccccagcgctggagaagcttgatcacattctcacccaaaatttaattatccgggatgaggagctgatcgagatagtagaacatgtgagagatgacgttcttggtgacattaaaaatgctgtgtctaatttaaattcaacaactggggagttaagtcagagagaaaatgtgtggctggaagaggtaaaggaggtttgtgattatacggtaggtgttgctgaaaaattcattgccagaagagataagcggttaagtatggggaggctttgccaggtcctctatctttttgagctttatgcttccaagaacgaatttatgaggcagatgaagtacatctgcactcagtttgagatgcactttacagaaggtggacttttggggaagacatcggagccaaaacgggatcgagatcaacacctgttccaagtgtgtcatcagtggcactgcgcaatacaaggccgagaaccccgaacaacagtgcgtaatcctttgatgactttcttgtattgcatttttgttgatgctatgcttgtcgtcgcctcacttgttttgcctttcaaggcatttatcactctcctagtcggttatgaacttactaaagttattgcatggattgagtttatgttgagatctttggaaccaaatttgaagaacaccgaaagatatttagctctaatttgtgcgttattcagtgatattgatagcgtggaaggcctgattctgaatgaaagacagaaagtgtgggtggatcaattgagatccgtgactcggaagggccactgtcttgttgctggggctccaaaggatgggtttctgtttactataaacagaatcagatttgcctggtacgtcgaagagttattgagagaaattattgatatttcagacaggaagaacaattatgccattgcaaatatccaaggaagaaaagagtcgttactaagcatccaagggagccagagtgaaaccatagttgaacacaatgatacttctggtacgggtgtaaattcacgtgcaccacctgcagcttcctcgtataggcacattacagggctcaaacggaaattccaattaatcacaggtgaaaagcaattgatggatgcactgtctcgtgatgtccaagagattggagaactagaaggaagatccaaaatctgggtgcagcaaatggaagatcttgctcgtgaaactgaacctgtcattaccaagtgtgctagtgaattggagcataaatcaatgataatctgcattatgagatactataggcggcatgttatgatggacgagatcaaaaagattagaaagaaaattgaagatgcctcgacaagaaaaaaggcgtatggtttgggtcagcttcaatcccaagctgagttgtcattgtcgacggttcaaattttacgtccgaagaagcaaccatctctcattcttaacaagcaaccatctcccattgaaatcgttgggtttgatgaagaagtagaggttttgatgaaccaattactctcggacgagaaaagtcgctgcattacttcaattgttggaattgaaggtacaggtaagacaacactagccagtttgatatttgacaatcaagttgttaaagataattttgattgtcgagtatgggtgtcagtgcctccaagttgtacggttgaacaacttctacaagaagtagccgaagaggctgccaaacaaattatgggtggccagcaagacagatggacaacacaagttgtattcacaactttggcgaatacaaagtatctcattgttgttgatggcatcaaaacttcccatgtcttggataccttgagagagaccatacctgacaagtcgacaagaagcagatttcttcttaccacttgcaatgcaaatgtattgcaacaagcgggtacaagatcctttgttcttcctatccagttactagacgatgaaaatagttggattctgtttacaagaattttgagggacgttcccttagaacaaacagatgctgaaaaagaaattgtaaattgtgggggcctgccatcggaaatattaaaaatgagcgagttgcttttacatgaagatgccagagagcagtccattataggtcaaaacccttggtctgaaacacttaacacagtctgcatgaacttaccttcatacctgaggagatgtttattttatttcaagctattccctgctgattttgggattccagtaagaagattgattgttttgtgggttgcagagggtctagtgcatcaaggggaagaccaagggccaccagagctaattgcagaaaagtacttggcagagttgatagatctgaacatggttcaaattgccaagagaaagcccaatggcaaggtgaaaacatgtcgtctccctaatccttttcgtgaattcttgctgaatgcagcagtaccaacaaattccagaatacgtcaagtggcagatcgttttgacgaaaatgatacctggcacagacatattcatggcaacactactacaagtgattcagcttccctgttaaccaactacaaggatgttctctccttcctgtcctttgatgctcgagaaggaagtaaacctggccaagatataagtaactttctaaacctgtgcatctcgagcaattgtcttctactactgcgggtgcttgatctagaaggtgtttacaaggccaaattgcctaaaaacattggaagacttactcgattgaggtatcttggcctaagatggacttatgtagagtcacttccatcatctataagcagcttgctgaaactccagactcttgatctgaaatacacttacatacatactctaaccagctccatctggaagatggaactgagacacttgttcttgagtgaaacttatcgcaccaaatttccacccaagccaaaaggtatacgcataggtagttctctatctgacctccaaacattgtggggactatttgtagacgaagagactccggtcaagggtggtctggacaaattggtcaatatcagaaaattgggaataacatgccaatcaatgtcaaaaaagcaagaggcaatggaatcgcaacttgatgtagtagctgactggattgtgaaattagactaccttcaatcactgaggctaaaatcaagagatgaagaaggtcgaccttggaatatacacttgaagtctttgaaaaatcacattaatctcacagacgtgtatttgctgggatgcttgagcagtccatccattttgaaccaattgccctcaagccttgttgaacttactctatcacattcaaaactagaggatgatcccatgcaaactttgaaagatcttccaaatcttcactcattgtctttacttgcagaatcctacctgggaaaagatttggtttgcagttctcaaagctttcctcagcttcatgttttaaaattttggaagctggagcaattagaggaatggaatatagagccagaagcacttccctctctcagacagctggaaatccgatcatgtccgggcatgaaaatgcttcctgatggactaaagcatgttaacactctccttgagttgaaattgacaaacatgccaacggaaatcaatactgacaagcattccattccgcccaaatgtgaagtccacagagatgattctcagtag

SEQ ID NO: 86712 - DNA, 154 bp, Glycine max
  Peptide Sequence Number=SeqID_203490
atgtcggctttcatctattcctgtacttcctcttggtcacccatcgtcctagatttggatctggagtctgtggatctcctcgggtgcggagtaggcgtccgccaatgctctggccttggccagcaatcggggaagttcttgactcccattcaaa

SEQ ID NO: 86713 - DNA, 180 bp, Glycine max
  Peptide Sequence Number=SeqID_203491
atggcccatatggtgagcattggggatgtctacatcttcaccggtgagtttcacttcggcaaccttggtgatgctggcgaaaacaaagagttggagggagctactgcagtccctggagatggagaggtgacgaatcagaggggtgaggccatggtggagaagggtaacttcagaatataa

SEQ ID NO: 86714 - DNA, 204 bp, Glycine max
  Peptide Sequence Number=SeqID_203492
atggcttcaacaacgatgattgcaaaggctacactggcgaaggtggggtcactagcgtcaatggagggagatgtatttagcaggaatcctcgtgacagggcccaaaacggcctttcttcaccttttaagaggaattccaagagccaccatacttcaaggctccaaatctccaataactcaatgaaaacatctgacaatttttaa

SEQ ID NO: 86715 - DNA, 1320 bp, Glycine max
  Peptide Sequence Number=SeqID_203493
gtttttcttcaatattatactggtgcattcactgttcattgctgcaacagtacaacccttttattggaattgctaactgctgttggtttaaacatgttgatgagccagatgcagaatggcttgctgtactccagagcttattgggttgctgaatctctcatagcttgggacgtggatgttggaaacgggttttcttgctacctgcttgccagcaaaaatgcttctttgaccattgcaaattgccaaattcaagctgatggggaatgcatgaactgtactggtttgcaattacctggtgttttagatgaccttttctcatatagtggtccccttggtgcacttttctcagaggaagctgtgtcactttacctgtgggcacctactgctcaagcagtgcatgcttacatctataaggacccatcaggagatgatcccatagaaattgtttgccttgaggaggaaaatggtgtttggagaactaaaggaccaaaaagttgggaaggttgttactatgtttatgaagtatgtgtttaccaccctagcactatgcggattgaaaaatgctatacaagtgatccatatgcaagaggactttcatcagatggcaggcggagttttctgcttaatcttgactctgttaagttaaaacctgatggatgggataatctggcaaataaaaaacctactatacattctttctctgatataagcatatatgaaatgcatataagggatttcagaattctagacgacctaggtgcattagtaactgctatgatggaatttggagtaactgtgagcatatgtttgaaggattctgcgggtgtacttcatctgaagaaattatcaagtgctggtatcactcatgtccatctattgccaacatttcagtttgctggggttgatgatcaaaaggaggactggagatttgtagatcagcaacaagctctcatcacagccatccaaaactttgatggttacaactgggggtacaaccctgttctttggggcgttcctaaaggcagctatgcaagtaatccaaacggtccataccgtacaattgagttccgaaagatggttatggctcttaaccatatcggcctccgtgttgtcttggatgttgtctacaatcatttgcaaggaagtgggccttttgatgaacattctgtccttgataagattgttccaggttactatttaagaaggaatagtgatggtttaatcgagcacagtacttgtataaataatactgctagtgagcactttatggttgagcgtttgatccttgatgatcttgtacactgggctgtcaattacaag

SEQ ID NO: 86716 - DNA, 229 bp, Glycine max
  Peptide Sequence Number=SeqID_203494
ctttaatgaccgaattcgagatgccatacttggtggatctccgtttggccaccctctacaacagggttttgtgactgggctactcttgcagtattggtctgaatttcctgctaagagagggaatgagaagttacttcagaaggttggattattagtttgtcaggggaagaaggagataataaatacaggaatctgggggaagggattgattgagtcttgtatcatttga

SEQ ID NO: 86717 - DNA, 753 bp, Glycine max
  Peptide Sequence Number=SeqID_203495
atggtaaaagggtcagaaatattaacatatggtgggacacctgttgcatatgcctcatgccccatagagacaatcaattatgtttctgctcatgacaatgaaaccctatttgacattgtgagcttaaagactccaatggatatcagtgtatctgagagatgcaggataaaccatttggcaaccagtattatagcattatcacagggtataccattttttcattctggagatgagatactccgctcaaaatcactggatcgagattcttacaattctggtgattggttcaacagaatcaaaccaagactggcaaacccatccttcaggcctcagaagactgacatccttgctacggtggacaatttcttgaacctgctgcgtataagatactcttcaccacttttccgcttgaagacagctaacactatccaggaacgagtacgctttcacaacactggaccatcatgggtttgtggagtcatagtgatgagcattgaagatggtcacaatggctttcctgggttgtctcagttggatcccatatattcgttcattgtggttgttttcaatgcgagtccaaaagaagtatcatttgttagccctgccctgcaattgagaaatctccagttgcatcccatacaggtatcatcatctgacgaccttgttaagagctcaagatatgaggcatcttctggctgttttgttgtgcctcgaaggacaacagctgtgtttgtggagccaaggaaaacgtga

SEQ ID NO: 86718 - DNA, 222 bp, Glycine max
  Peptide Sequence Number=SeqID_203496
atggtgtcagagggtgagaatggtatgactagcgacaaagattttcatgtagatgatgatgcacttaagaaagattatgacttgaataattctgatattataaggaggaaccttggaaagcaacacaaaaacataaagcaaaattggtggaaagtgtcaatgctaatactaagtcttttggtgattactaggaaagttcaagttgctgtatgccctttgtag

SEQ ID NO: 86719 - DNA, 495 bp, Glycine max
  Peptide Sequence Number=SeqID_203497
aaagtttatacggataaccactcgggtatttccgcccgtcagcgtgactcaaatgtcagtatgacagatcttgtgagcgcggaagatgacacagcaaaaaagaatgtttatacggataaccactcgggtatttccgcccgtcagcgtgactcaaatgtcagtatgacagatcttgtgagcgcggaagatgacacagcaaaaaagaatgtttatacggataaccactcgggtatttccgcccgtcagcgtgactcaaatgtcagtatgacagatcttgtgagtgcgaaagatgatacagcaaaaaagaatgtttatacggataaccactcgggtatttccgcccgtcagcgtgactcaaaagtcagtatgacagatcttgtgagcgcggaagatgacgtaaatctccgcgtgtcaacgggcttgtcggtcgcgattgacgaaagggcgcagaagacgacgctagtctctgcgtgttatcagcttttcgtcttatag

SEQ ID NO: 86720 - DNA, 1058 bp, Glycine max
  Peptide Sequence Number=SeqID_203498
catatcgaccattttgccctgacggaacaccatgatggtcgggatgctgcggatgcggaaacgggcgctcagctccggctcggcttcggtgttcactttcacgaagcgcactttgccggcgcgctcttcggccacgtcttcaaagatcggcgcaaagctgcggcacgggccgcaccacggcgcccagaaatcgaccacgaccggcagatcgtcctgcagcaactggtccagcgtggcggcggtggcgttgatcacttcaccgtcgaagagctcatggccgcagcggccgcatttcgcgttgtccgccagacgctcttccggcacgcggttggtggcattgcaagctgcacaaactgtattcatgttgacctcgggtacagagaaagcatggtccccgcaacgcgttgggagcttttagcgcaagttggtggcttcgtgcaccaacatcaggtaatcttcgcgccctgcgcgttggtggagaagacaatgaacgattcatttagtggcaagaacggtaaagtcaaagtgatgtacgtccgcagtgacgatgacaacggcgacgaccgcaacaagaataaacgtccggccggcaaaggccgtccggctgacggtgcgcgctcaggccgcaccggtcaagacaaggcgcgcggcggcaacgatcgccgcggcgccgactcccgccgcagtgaaagcgatcgtcctcgccgtccggcgcgctctgaagatcgcggcggcaacgagtcgccgtggagaaccgtctcgcgcgcgccgaatgaagagccggcgttcgatcacggcggcatcagcggcaaaagctttatcgatcctgagcaactgcgccgccagcgcgcggaagaaacccgcgtttacggtgaaaacgcctgtcaggcgctgttcgccagccgcccggaagcgatcgtgcgcgcctggttcgtgcagtcggtcaccccgcgcttccgcgaagcgctgcgctggatggcggccaaccgcaaggcttaccacgtggtggatgaggaagagctggccaaggcttccggcaccgagcaccacggcggcgt

SEQ ID NO: 86721 - DNA, 680 bp, Glycine max
  Peptide Sequence Number=SeqID_203499
gattgtacgccttcgccatcagaaggctacacggcctcaccttcagaggactgcacgtcctcaccttcagagggctgcacgtcctcaccttcagagggctgcatgccctcgccttcagaggactagacgtcctcgccttcagaggactacacgtcctccacgtcagaggactacacgtcctcgccttcagaggactacacgtcctcaccttcaaagggctacacgtcctcgccttcaaagggctacacgccctcacctttagaggactacacgtcctcgccttaagagggttgcacgcgctcgccttcagaggactggacgtcctcgccttcagagggctacatgcccttaccttcagaggactacatgtcttccctttcagagggctacacgccctcgcctttagaggactacatgtcctcgccttcaaagggttgtacgccttcgccatcaaaaggctacacggcctcaccttcagaggattgcacgtccccaccttcagagggcttcacgtcctcaccttcagagggtttcacgccctcaccttcagaggactagacgtcctcgccttcaaaggactacacgtcctccacgttagaggactacacgtcctcgccttcaagagggctacgcgctctcgccttcagtgggctccacatccgcaccttaagagaatttga

SEQ ID NO: 86722 - DNA, 1248 bp, Glycine max
  Peptide Sequence Number=SeqID_203500
atgacatcatttttcagggccccttcagcagtgataaaaagactaacttccattcaaagaaacttcctgtggggaggaggagcagaggggaaaaaaatcgcttgggtggcatgggatcaagtctgtgttcctagagataaaggaggattgggcattaaagctatcaaggactttaatagagcactcctcatcaaatggaagtggcaattgtttcagcaaacagaccaattctggaataggattctcctttccaagtataaagggtggagaggactggaagaggcttctcacaaacaacaccactccttttggtggtctgatttgaaatctgttatgcttcacagtagcatggctggggtcctaaaccagttccagtggagattgggcaggggtgaccaaattctattttgggaagattcttggttaagtgatggaagaacccttcgagacaattatccagacctttaccaaataacttctgacaagtctcagctagtgggaaatatgggcttctttggagaagaaggttggcagtggcaattctcttggaggaggaacttgtttgacaatgaattgggaagtgcattagagtttattgatcaggtttcagctctaagccctactgcagatacgaaggactactgggtgtggggtgcagacccaaaaggaaccttcaccacatccactgtgtatctttgtattaaaggtgaccaaccatcaccattctcaaatcatgactttaatcagctgtgggatgtaaaagctcctccgagggccttgaccttggtctggagacttctttggcataggttaccgactaaggaaaatctgcttagaaggcaagttcctcttgataatgatctctgcaccttctgtcaaaaccaagtggaatcggcttctcatctcttcttcacatgcataaaaattatgccactatggtgggaatttaactcttgggtcaaggaagcaagagtcttgcactgtaggcctgtggacaacttcactcagcatttctctatggctgcttctaaggctactaacagaaagtggaagatttggtggatagcagcaatagtttctatttggtattataggaacgacatgatttttaataatcaacagctttctatttcaaagctggtggataatgctatttttagaacttggtcttggttgaggggatgggaaaagggctttgttgttccgtttcaacaatggtcctcatccatgtcttttgccttcacctag

SEQ ID NO: 86723 - DNA, 207 bp, Glycine max
  Peptide Sequence Number=SeqID_203501
atgaaacttggtccggtcagtggcccggttaaggtagtgggtcaatggtccaatcgttcaagtcatcaggtttactcaaaatcggccgagtctgatcaagtcatcatggacaagatgcatgaccggtccaataatcaaatcgatctggttatgccatcaggtcacgattggactcattcgaccgactgggtcgtaccggatttttga

SEQ ID NO: 86724 - DNA, 600 bp, Glycine max
  Peptide Sequence Number=SeqID_203502
atggcctccaggaaacggaggattattttgccagagaggaaggttgagatataccacacggagttggatgacttcaagacagagttggagaggcgtaatcttaacaaacgcctcaccaacttggctgatgggactattgatcttgctttggtgaaggaattttatgctaacctctacagctttgaagacccttcaccaaagcaagccagagttagaggccacttggtgaagatagacgctgacaacctcaacacatttctagagactcttgtagttctagaggagggggagacattacccatctactctaggtattgcaggttacccacagatcatagagagattgagactgctctgtgcataccagggaaatggttcattttgaatgctgagggccatccagggaggattctcaggaaggatctgactaccttggcccagatgggcataagagtttgttttgtataccatagcccagaatatcagtcttgtgatattatacattgttgttgtatgagatttatgttgctcgaagacctggggaatgtgaatcccaaacatgaatttatatgtatttatatggaatgtgattgcttgtga

SEQ ID NO: 86725 - DNA, 473 bp, Glycine max
  Peptide Sequence Number=SeqID_203503
atggctctgaagaaactctccatgaagaggtctagaaaggaagccactggagaaggctctagtgccacctcagagtttgatagtcaccgtttccagagtgccgagcaccagcagcgcttcgaggccatcaggggatggtcatttcacatggagaggcgtgtccaacacagggaagatgagtactcggacttccaggaggagatagctcgcaggcattggacacctctagtgactcccatggccaagtttgaccctgagatagtcctagagttcaacgctaatgcctggcccacggatgagggagttcgagacatgcgctcgtgggtaaggggtcagtggattcccttcgatgcagatgccctcagcgagttcttgggcgacccgctgattttggaggaagaccagcagtgtgaattcagccagaggaggagccaggcagacgatttcgatgaggaagccatcgcccagctgct

SEQ ID NO: 86726 - DNA, 327 bp, Glycine max
  Peptide Sequence Number=SeqID_203504
atgacctctccagcaacaggtacaatcccgggtggaggaatcatcccaaccttagatggtcgaatccttcacaacagtagcaacaagaaccttattttcaaaatgttgcttgtagaagcaaagcttcatgatgaatcaagattgattcaaagatgttttgatgataacaaagatgatgacaaaaagctcaaaggtcaatcaaagaatgagttcaagatgttcaaagatagaatcaagaacacttcaagattcaagaggaaagttgaagaacacttcaagattcaagaggaagtagaagaacacttcaagattcaagaggaaagttga

SEQ ID NO: 86727 - DNA, 360 bp, Glycine max
  Peptide Sequence Number=SeqID_203505
atgactgaagcacgtcaaaagggggtacggaaagtaaatgaaaaagggaataaaaggttatgggaattttacggaagcattatgggtgtcctgaaatcccattttttaacaaaactggggaggtggttgccacctagctcgcccaggcgagttaggttacggaaccttgcggattacataatcatcccctttttgacttacggaatgttacgtaacctcacgaattgtgcaacgatgcttccttttgagttccggcatgtcacagaacttcacgaattgcctaacgatggatgccaagtacctcaaaatggtcaaatgaaagttgcatgccaccaagcaaaggtccccggacgaaattag

SEQ ID NO: 86728 - DNA, 1155 bp, Glycine max
  Peptide Sequence Number=SeqID_203506
atgaagtttgggttgtgcaatgttccttcttcttttcaagccaccatgaatggaacttttcggccatatctatgcaaattcattatcgtgttttttgacgacatccttgtttatagcaggactcttcaggatcacttacataatttggaacagacactttgcgccctagaacatggccaatttttcctcaagctctctaagtgctcctttgcacagtctcaaattgaatatcttggacatgtggtgtccactaacgaggtcacaccagtggaggaaaaggtggatgctattcaacaatggtcggcatcgcgatcctttcgagccctccgtgggagtaggggggttattctatcccaattgggtcaccctatagctttcttcagcaagcaattttcgcagaaactccgtcacgcatcaacttatgtaagggaattggttgccatcactgctgccattaagaaatggcgccagtacctgttaagacatcaattcatcatcttaattgatcatcatagcttgaaggaaatcatgagccaagtcattcaaacactaaaacaacatatgtacctttcacgcctcatgagtactcctaccagcggtcacatgggcgtcaagaagactctggcacgtttaggggaaaatttcacttgggccaatatgggaaatgatgttcgccaattttttgttgcttgtcttgattgtcaacatactaaatacgaatctaagaaaccagggggattagtctgtcccttaccagttccttcatggttgtgggaggacctttctatggacttcattgtcaaccttctgccttatcggggcaatacaaccattttggtggtcgttgacaagttttcaaaggaggtgcatctgggccttttgttgccatcttacacagcactgactgttgcatcgcttttcatggaaattgttgctacgaatgtctccccattcgaaataacgtttaggcggaaacaaccaagtattcctcacaacctaacaagaacttctaatgtggtagctgtagatgatattctcaatgacagggaggttgttttcaccagcttgaaaaagaagcttttaaagtctcaggaacgaatgaaggccatagtagattcccacagaagagatatcaactttgaaccaggcgagtag

SEQ ID NO: 86729 - DNA, 207 bp, Glycine max
  Peptide Sequence Number=SeqID_203507
atgaaatggatatttggaaggctaaagagcaagagattgccttcaattaaagctcccctaccctcaaaaggaacaacactaatagttgttgaagctgttgttattgttgctcatcgcctcactgggaaacgcaaggaaaactcagaagactctcaacatgttaaaactagcaatggtgctctaactgttagtaatataactgagtag

SEQ ID NO: 86730 - DNA, 291 bp, Glycine max
  Peptide Sequence Number=SeqID_203508
atgttgatactcatcgtcgagatgtcaatttcgctattggtgattgggcactacttaccagaagctaggaaagcactattatggtctacattagatcacggaggtcattggtcctgtttcttacaggattccacttgggaagagtgggctgagttgaaatccacttatcaccttgaggacaaggtgcttcttaaagcggaagggaatgataacattcagaacccaatgggaggattcaggcccaagaggatatccaaaaggccaaaaggttgggaagcatatatccagtag

SEQ ID NO: 86731 - DNA, 270 bp, Glycine max
  Peptide Sequence Number=SeqID_203509
atgccgaaatggactccctttgagaatcgatccacaactaataaaaccacagtagctccttggaagttaggcaaccctgtaatgaaatccaaggccaccttctatggagcttgtaagccttggatcttcttcatcaatgaagtcatttgcttcttgaagtttgatggtagcggaatggagaaggagaaatatgattggagacgccacttcaagaagaagatgagtctagaagaagctcaccaccataggaagccatggataagagcttga

SEQ ID NO: 86732 - DNA, 572 bp, Glycine max
  Peptide Sequence Number=SeqID_203510
atgcatttaaagaaaagaaaaacaagtacaaatctgaatttttttaacgaattccatcgacatgcaaggctgcccaagggtattagtgcatcgttccttgcacttatacctaagacaagcaaccctcaaggtttaggggagtatagaccgatttctcttattggatgcctgtataaaatgctttcaaaggtacttgcggggaggttcaagaaagtgttgaaatgtgttatttcaagtgtgcaaagtgcgttcttaaccgggaggaacattctagatggggtggtagttgtgaatgaggtgatggacatggcaaagaggcagaggaagaaatgtgtgattttgaaagccgattttgaaaaagcatatgactctgtgagttggtcgtacttggattatatgttagacagattgggctttggcgtgaaatggaggggatggatgcgcacttgtttctcctctaactcgatctctatactggttaatggtagtcccactgaagaatttgtggctcagaagggtttaaaacagggtgatcctctggctccatttttgttcctagttgcagcggaagg

SEQ ID NO: 86733 - DNA, 645 bp, Glycine max
  Peptide Sequence Number=SeqID_203511
atgcagcaaaattttgagtatatgcagcaactgctgctctcggttacaccaaatgcaacagtagatgactgctggttttggactcttgacgctgctagaggcttcactgtgaaacgttgttatgcgtggctgtgtgatttttttgcaggtggaagggtcgttgttgcagaccagcagcgggctatgtggctgaaattatggaagaacaatgctccttccaagatacttatctttgcttggcgtgtgttgatcaataaaatagctacgagagacgcgttgtctcgcagaggagtgctgagggacgattctgacaggcgctgggaagatattcaagcccactttatggcattcgggaagctaattaaagggaagaaacaaaagcgagttaaacatcttatatggatggcgggagaacttgttgggttggatggtcggactggtataattgcccaatgggatatctactttcattgtaacgtcaagtttggtggacgtagcagcagaatacttgtgctggagatgtgctgcataatcaacactgacagacgtgggagcatggaagaattagtaggagtgtgttttattgttggatgggttttaatgaggcccccgttttctcccgagtacaccttgtacttcggatga

SEQ ID NO: 86734 - DNA, 297 bp, Glycine max
  Peptide Sequence Number=SeqID_203512
atgaaagactcgggaatacgtatgtctctaaaaacagtccagtggagtcgccaactgccgcaacctacccttcggcgggagggtgacgcgagggctcatgggtgtgtcttccataggaggaaaatgcgtggagtcgccaccaacgctaataagaggaaatcgtcggaaaaatcggaaaggtgtggtctacgaactttaagtgtgaaaggttcgggagttgtttttacgcacggggaagggtgtttccctcgctcctacgtattcatcaattgtgataaggaaatcagacctacgtag

SEQ ID NO: 86735 - DNA, 276 bp, Glycine max
  Peptide Sequence Number=SeqID_203513
atggctcacttcatgattgagttcaccattctaaaggtgtttgtagtggatatccacccttataagcccttcctggtcaagtgggttaactggttcccccttcttagcgacactatcaaatgcaacacagacgattctttcaaaggctccccggggcatgcgagaagtggtggcatcttctggggccacacatgtaggagaggttggaagaagatttggctcaaatctgttatccaagtgttgaaaaactcatctgttgttccttggtccatttga

SEQ ID NO: 86736 - DNA, 449 bp, Glycine max
  Peptide Sequence Number=SeqID_203514
tagagggtacatctacttgggtttgactgagaacaagagagggtacatctcttgtggatcagttctagtggagggtacatccactaggttcaaagagaacaagggagggtacccatacgtgactggatcctctgtagtcgctatcaaatacaaagatgggattctaatggcctctaacatgggagtcgctatcaaatacaaagatgggattctaatggccgttgacatgagagacatgggagggtgttgcagttgtcatgtttcatttgtagggaagggtcatgttaaaagggtcctctacgtttgtgtcaatgtacaaccaaaaggttcaaaaggagctaatcaaaatgcattaacggtttggcaggagcttccattctcatttgttaaagacccgagatggttttccctttgctggtgtaagatctttgactcttcgatctacagtg

SEQ ID NO: 86737 - DNA, 783 bp, Glycine max
  Peptide Sequence Number=SeqID_203515
atgaagtccgcagtgaaagaggatcatgtgatcaattttttcatcactgaggagattaggaagtacataagcccaaaggagaatagggttggtaagatcaacctatatggggcagacaaggtttacaacacaataggccatgcttgtgttttgtacaagaaagagctagagaagtacatggactatgacattggctcctattgtgatgatgattggaatttggctcagaagcttatgcttaatgggtgtgatcctttgcctagaagaaggtgtttgacaagggcctcaaaggactaccaaaagcctcaccctatccatgagtcactttggagactcccagatcgaagaaatgtgaggtgggggaattaccaatgcagaaactttgagtgcttatccagccagaatccaaagaggggttactcaaaatgcattggatgttttgaaatggagaaggaaaagctgaaatgggtctctaatacctcacttgttgtggactttttgattagtgatgttttggcaattaagccaggagaggttaggattggactagactatggcattggaagtggcaccttcgctgcaagaatgagggagcaaaatgtgacaattgtctcaacagcactcaaccttgataggtctttctgctacagaaagaatttggaagactatatgtacatgtttcttcaattgaggtacaagaaacacaagtgggttatttctccaaagtcaaaggatgaggtatttctctctgcattgctggaaaaacctcctagagccatatga

SEQ ID NO: 86738 - DNA, 314 bp, Glycine max
  Peptide Sequence Number=SeqID_203516
atgggggctgctaaagctacttatgaacagttatggaaacataaaatgcaacagattaaggacatcaatgaagctgcatatcattggttgtataaccttgagaggacaacatggtgtgaagttatgcctaagcccttgaaaagcttggactacaaggttgaaaagtctgggaattgggtagctacttggggaggagatcgacattttgaagtcacacatattgcttcggtggaggaggtggagtttaaacttgtcttattcagcatcaaaagaatgacatcacacaaatcaaatgtacaaacaaaaacaataag

SEQ ID NO: 86739 - DNA, 306 bp, Glycine max
  Peptide Sequence Number=SeqID_203517
atgaggccgaggcacttccgaatcgcttctgtgatcaattcctacaccgttcttcatcgttcttcgtcccttcttcgttcgtcaatcgttaaaatgaacctttcagaaagtttaaaatcaaccctacgcgtaactttctcacttttaaagaactacgtaggtctgagctcttcatcgcacttgaggatacgtaggagcaaaagccacactcttgttgaccccaaaaggttgtcgtcccttgtaagggacacgtggggtgctaataccttccccgcacgtaaacaactctcgaacccttattcttaa

SEQ ID NO: 86740 - DNA, 407 bp, Glycine max
  Peptide Sequence Number=SeqID_203518
gaaccctattagagcaactagaggagtctcaggaacttgttagaggtgtctctatcactgtcggaagacacgtgaacccgcttagagggcgacaagttaatgctaagacccttcaagggcgacgagttaatgctaagacccatcaagggcgacgagttaatgctaagacccttcaaggggagcagatgaataggtggatgactatgaagaacctcatgctagaggacacaggaacacaacgctctgataggatgggtagagagtgtcataagcttcactccctccctcaaaagttgttgagaggaggtgccagaagaagacgttcatggactcatccaaatcaacgacctcccatgactcaggggcttcgagatcctttgcaaagccctccatggagaaattgctaa

SEQ ID NO: 86741 - DNA, 462 bp, Glycine max
  Peptide Sequence Number=SeqID_203519
atggtgtacaaccgcttaatcattgagccttatggcttaaatgctttaagtccaagttgtcgaggttctttctcaagacccaatagtctacccgggatgcccatcatggaggtgtctttttcaagagatgatgatgacaaccaacacattcattcaggtgaagccaccaagcgagccttttcctctttctttgtcaacctgttattttcggttcctaaaattgaccccttggataattctaacgagtcgatcatgggtttcatcagtcaatttgaggaaggcgacataaaaaataccagtgtggagtatgccttggggggtccgacaatgatgaagttgttgataatatactttgacgatattcgagatgcctttgatggtgaaacaaggtataagggaaatggcatagaagatgttgagggaaccaacaaggatgtccctattgatattgggtatagttag

SEQ ID NO: 86742 - DNA, 192 bp, Glycine max
  Peptide Sequence Number=SeqID_203520
atggctgagtcaattatgggttcgagctccatagtgggcaccaatattcacttcggagaacaccaaggagaaaggataaagggctctagctctaagccaacacccacatctcccctagctttgcctaagcatgaacctaaggtttcaagtctacgtcacaacccggtccatgacaacttacaagaactatga

SEQ ID NO: 86743 - DNA, 1239 bp, Glycine max
  Peptide Sequence Number=SeqID_203521
atgtccactccatattacacacttgttcttcttcttcttcttcttattgtactcatttccccatcctcctcctctcttcatccaacggacctgaatgcccttctctccatcaagaacaccctcaccgaagtctcacccacgaagcccttcttctccacgtggaacctcaccgcaccggatccctgctcctccttctccggcgtcacctgcttcctctcccgcgtctccatcctctccctcggcaccccctcccttccactcgccggcaccctccccgccgagtcaatctcccaactcacagagttgactcagctcatcctctcccccggaatcgtcaccggccccatccctccccaactcgcccgactcaccaagctccgagtcatctcgctcccttccaaccgcttcacgggaaccatcccttccttttcctctctcattaagctccacactctcgacctgagtcacaaccaactcgccgggtcactcccaccgagtctcaccgagttgccccaactcaaagttctcatcctcgcctcaaacactctcacaggcaccttgccaagaaccatcaattcgccgttactccacctagacctaaaaaacaaccaattcacaggaccgttaccaatcgcgcttccgtcatctctccgttatctgtctttttcacagaacctcatgtggggccccctcaccaacggcctagaagcactctctgagttagtcttccttgaccttagtatgaatcatttcagcgggcccatcccggcccaactcttctccttccccgcactctccaacattttcctccaacggaacaatctctctggtgagcttgggcttggacccaggtctggattcgggcccaagcccggatcgatagtcgatctgagccataatgctctgggcggggagctctccacggtgctcgagggagtggagagcctgttcttgaacaacaacaggttcgtggggagtgtgccggaggtgtacattaagagcgtgtgccgcggcagcaccagaacgctgtaccttcagcacaactacctcacggggattccgataagggacggaaccgtggtgcccgatacggcgtcgttgtgcttgtcgtacaactgcatggtgccgccgccgacggtgatgatgacgtgtccggccagcgccggcggggtgtcggcgaggccggaggctcagtgctccgtgtttaaccatcaacggaggttaattggattggagtga

SEQ ID NO: 86744 - DNA, 327 bp, Glycine max
  Peptide Sequence Number=SeqID_203522
atgttaaaaattgaaattacacgttttagagttagtgatatcgtagcgacgaggcgagtcgttacatttcccatcatcccttctcttgtggaggtgaagttggttattgactatcacttattcgtccctggcgatgaggagaagccgaagaagatgaggcttgttggtgcctacaaagtgttgttattcttcaacaccaagtcagcttgtgtctctcgatggattgataaggagtataggccttgggaagagcaacgtcaaaggttgccatgcttgttagaacacaataagaaagagatggataatctaaagttcgaggttgcatga

SEQ ID NO: 86745 - DNA, 234 bp, Glycine max
  Peptide Sequence Number=SeqID_203523
atgccaccctttccccaacaagatccttcacctcctattgtgggttttgcgaacaaaagcatggacattgaagatctgtgcggtttttgcgagatcgacaaccatagaggcaagaccggtgacgggaggttgagggtggaggagggcaaggccgtggaagggttcaacaaagggaggttggggttgtggagggcttttctcgtggaagggaggagggggaagaaaaagaaataa

SEQ ID NO: 86746 - DNA, 774 bp, Glycine max
  Peptide Sequence Number=SeqID_203524
atgagatttccttattttgatctatttccctcttcttctagcttagtacaaaaccttgattcctatttcaatcttgattctaaacagcctgcttcctctatagtttctacaccccaaccttctcaattgtcttcctctcactcaccctttgctccctctattcctcctggtttttcttctgtctccagtcaacctttatatgcctctacttttgtccatcctcaatcatcaaatgccaggtctcatagtaagtctgtcccagcaccaacttcaattcctgttaatactcatcctatgcaaactaggtccaagtctgaaattcataatcctagactacatccttcattgttccttggtcattctgaacccaagactattaaacaagccctggaaaattcaaactggtttgcagctatgcaagaggagtgtgatgctttgctaaaaaatagaacttggaactcagttcccctacctcttaatagacaagctattaggtgcaaatgggttttcatggtaaaagaaaatcctgatggttctatcaacaagttcaaaaccaagctagttgctaagggttttcatcaggttcatggttttgacttacatgagacattttttcctcaggtcaagcttgtcacaattcgtgttgttctcactcttgctttttctcaagggtttctcgaggaatctgtatttatgacacaacctcctggttttgaggttgcagataaatccctagtctacaagcttaacaaagctctttatggcttaaaataa

SEQ ID NO: 86747 - DNA, 255 bp, Glycine max
  Peptide Sequence Number=SeqID_203525
atggagagagaaaaaagaatcgcacgaagacagtacatatggagtcttcaatgtcttctccgtctctctaacgtttgggaactctatcggagcagtcggaggaaaaactggaggaatctcaggaaaccgctagagatgtcgctatcgctgtcagaagacacattgtacaatcacacgactataagaccctttaagggcgacgagttaatacgaagtcccttcaagggtgacgagttaatgctaagtcccttttag

SEQ ID NO: 86748 - DNA, 188 bp, Glycine max
  Peptide Sequence Number=SeqID_203526
atggcgagtttgctgtgcaacgcccacgtggcagggaaaccaccattcgtgatggcaagttggtgtcaggtggaactcgccacctctgctggcgagaggtgcaggcgaggtgcaggcgtaggtggtgcagctacggtgcaggtgcaggaggagcaggttgactggcttggaaatcgccaccatgacag

SEQ ID NO: 86749 - DNA, 306 bp, Glycine max
  Peptide Sequence Number=SeqID_203527
atggcatcttcgtcgtcgtcttcatcaagtatacaaattaagtctgatccaatagaaggagacgttttatggatgcaatctaaacatgtttcagaacatgtttggaatggggaaccagacagaaaatcgcacattcgacgagctgtcccgatttatcaaggtctgcatgttgatggggcaccattaattggtcagactaatcttgattgggccgaattgtgtgaagaattgttgggcgtcagaccacaggaaggtgaacttcaaggcagtgtggtaaaattaagttggatggctcaccatttttaa

SEQ ID NO: 86750 - DNA, 227 bp, Glycine max
  Peptide Sequence Number=SeqID_203528
atgttaggatttgacgatggtgattctgattccgacaacgagcaggcactgtttgggaagtacccggagctacagatgtttaagtgggagaacagtctcattcaccttccttccaatttatcatctttgttattgccgcagacaccactgtttcactgtgagcgtgaagaaaccctcagggttcaccctcctccctttcttccgttgcaagaaaccctcgatcatct

SEQ ID NO: 86751 - DNA, 210 bp, Glycine max
  Peptide Sequence Number=SeqID_203529
atggagaagaagacagagagaaggacaagacaacgcgaaggagacgaaacatacctaggtatggtggcgaaggagaagaagcagagacttgtgacgatgctcgagtgcgacgaagacgatgctcgagtgcgacgaacacgatgctcagatgcacacagagacggtttcgctagacggagattagaagaagaagagagcgcgaaagcttag

SEQ ID NO: 86752 - DNA, 684 bp, Glycine max
  Peptide Sequence Number=SeqID_203530
atggatgacgcggtggcgctgacagctagaggagacgatggtgtcacatttgcaattgcagcagaatgtgttcatatctcagaatgccctgtccttgttatatctggtgctaaggacgtgtggcatcaaggaatctcattcacgacctccaattttcaaagaacaagtctctattcatttcagatcaatttgtacacaaaaggccaagggtttgagtatagagactatggattgctgacaacacttgatctttcataccttgaacttgtccagaaatcatttcacaggaaagatatcaagggagattgggagaatgaagaacttgggagtctcttgatctatccagcatcaaactcaatggagaaattccttgcttctagctttgctgggaatcctaggctttgtggagctcctttacaaattaactgcacaggacaaagtggtaatgttcatgtgtcaaagcaacatggtggaagcaatgatgatgtctttgaaactgagtcactctaccttgggatggttgttggatttgctgcgggattatggtggcctcgtggttctctattcctcaacaagacatggaggcacgcgtatgggttccttaattatgttgcagacgaagttcatgtgttagtgccattcaagttcaacagctttattggcatgcaaccaagttccttatga

SEQ ID NO: 86753 - DNA, 561 bp, Glycine max
  Peptide Sequence Number=SeqID_203531
atgaaggaatcggctttggctgtgaaagaaagagaaagagagattaagggttttgaaaggaaagagaaagaaattaagaatgcactgtttgggaagtacccggagctacagatgtttaagtgggagaacagtctcattcaccttccttccaatttatcatctttgttattgccgcagacaccactgtttcactgtgagcgtgaagaaaccctcagggttcaccctcctccctttcttccgttgcaagaaaccctcgatcatctgtcagcgaacactgcccctactcaggacatcacccatcttcaacaggcacgcccagcgaacccaccccccacttcatcaccatctcccaatctctgcaagagatggaccaatgaagaacacaggctgtttcttgaagggcttgcctactttggcaagggtgattggaagaacatctcaaaacatgctgttaagacaagaaccaagactcaagttgctactcatgcccaaaaatattttcttcacataaaggaaaagggaaagggaaaaagaaagagcctctttgacatggccttgtaa

SEQ ID NO: 86754 - DNA, 621 bp, Glycine max
  Peptide Sequence Number=SeqID_203532
atggtcaggacctgttcgaatcggaaaaagagaagagtctttggaaagggattcccaggttcaaggaagtatttacgaagtacaaggctaggacaagaaagagggcttcgaatcattgggcgattcgagctggcgaatggtcgagtcgaagtcatcaagctggcgtatggtcgagtcgaagttcaagacagcaagatttctggacttagcacaatttctgaccaaactccacaaaatcagcttcgacttcgagcaatatggataaccgttctaaggagcagttatgtgcatttttttagtcagatttcggggtcgcaaatcatttatacaaatccttatatactcaaagtacccagcgcagagagaaacgagtacgcaaggagaatgacgggttcgagtcagatattaataatctcatccccgactccgaattcgactttggctctcagagaaaacccgaacccgaccctaaacccgatcaactcggttttccccatcaaaattgggacagatccgaggcgggtcctacgggtttggacccattgccatgcctatttgatagtggttgtgaatagtgaaatacgtgtgcatcctcaccctgtcaacaacttttgccattga

SEQ ID NO: 86755 - DNA, 852 bp, Glycine max
  Peptide Sequence Number=SeqID_203533
atggagtatgtgaaggatgtatgcttggaaaacaccaccaccaaccatttccaaagaaaggagcaaggcaagtcaaagaagtgctggaattggtgcacacagacctatgtggagtacacctccaaagaatttgataaattttgtgaaagtgtcgagaggcagctgactgttggctatacacctcaacaaaacgttcccaaagaaaagaggacaaagcttgaagaagcaagtgagagatgcatctttattggctatagtttcatgtcaaagggctatagactttacaactcgaagaccaagaaagtgatcattagtcgagatgttgtttttgatgaaaaggccttttggaattggcgaaatgataaggttgaggagaaaacagttccaacagtaaatttaaagcaaagttcagcctcatcagaaaataggcaacaaattccaagcacaccatcatcaccaggctctagttcttcatctccaagctcaactccaataaaaatgaggagtttgagtgatatttataccaagtgcaattattgttttgtggaaccaacaaattttgaagaagcaattaaggaagatgcttggcgaaagacaatgcaagaggaaatagatgatgcacttaaaaagtacaggacatgggagctggttaagaagccaaaatacaaagaagctattagagtgaaatgggtctacaaggtgaagcataatccaaatagttcaatccaaaaaaacaaagcaagacttgttgcaaagggctattcacaacaacccgttgttgattatgaaaaaacatttgcacccatggatgtttggctgcattccaatcgatacaccattggttgcgaatga

SEQ ID NO: 86756 - DNA, 1125 bp, Glycine max
  Peptide Sequence Number=SeqID_203534
atggggaaaagtaagggacagaaaacaactcccaaccaacctgctctggtggggggagctgtagctgcaggaaatgcttcgattccttctattgcagttgtaacagggtctgagggagaaagccagggtgtgcgagtttcttgttctaacaccaagacaaacactgcacaccaagtgtttggaaaaatgtctaagccaagttgcgcagcagtggtaggttcgggtaaggaacctatctcttctactactgttgtagttggggttgctggtgaaggtcaaggagctcatgcttctagctctaccactgcacaccaagtgttcgacaataggccaaagtcaaattctgaagtagcaaaagtgaatgcagcccaggtgtttgatatattgtctgactgcaggacaaaagctgtcctttccccagaggattcctatactctgggggaggatgatacctcttcagatgaggaatcttcttcatccagtgactccgaattggtacctccaactgcaaatacagaggcagcaaaaccctgggttaacctgttcaaggataacaggaaaccctccaaggggtttggattgcaattttctcctccctcagctgaagaagtactgctggatgattcagacttacaaccactggaggaggcttggggccatagccttattggctatgtagctggcagatttccggggaaaaaggctcttatggaatgctgccagaaatggggtgtgaatttttcatattcaacccatgagagtggctggttggtattccgatttcagaatgaagaggatatgaaccaagtcatatctgcaggaccatacttcattttccaaagacccctgttattgaaggtaatgcctcccttttttgattttggaaacgaggagctcagcaagatccctgtgtgggtaaagctcagaaatctgccccttgagctgtggaatccccaggctctaggaaagattctttccaaagttggtctgcccatccgtacggaccaactgactgcctctaaaggctctatatcatttgcccgcgcactagtggaggtggatacttctatggacctcattgaagaggtctgctttagactcccaaatggtaaggtcttcacttag

SEQ ID NO: 86757 - DNA, 201 bp, Glycine max
  Peptide Sequence Number=SeqID_203535
atggcaagagattcccgagagtcctcagccgacatcatcaacatcacattggcatgggcgacgtctaccagaggccgtttaaccttagcacaatcagcttacgccttttgggactcagctttggccctttcgaacttgtcaccccagaactcggcgatgccccaggatcttgaagcaaagcaagcggtgaaaactttataa

SEQ ID NO: 86758 - DNA, 687 bp, Glycine max
  Peptide Sequence Number=SeqID_203536
atggaggaccaacgttccagggaccagcaattacaagatcgtttcgatcaaatgcagagatccatagaactgttgattcagaatcaagcggcggccactggtggtttaagctcaagcggaggtactctgaatactctagttatccattcagttccgatttcatctactacatgtgtgaaggaaatttcattgggtttttcccattttgatggccaatcaccaataatggagtggatttttaaggctgagaaattcaattatcaccacactcctgatcaggatcgtgtgaatattgcatccattcattttgagaaggatgtgataccttggttccatatgcttcaacggttacagacggtgaatacgtgggctgagctccgacgagcattggaatctcaatttggacccttactatttgattgccctatggctgagttattcaaacttcaacaagttggtacagttgctgattattatttgaagtttatggggttagctcatcgctttgaaggtttgactcttgaggtgttgcttaattgttttattagtggattgaacaaagacattcgtagagatgtagttgctcaagctcttgctgattttctgcgtgcagtttccttagcaaaattgtatgaggagaaatatgtttcagtgcctagtccttgttctaccccttttacaccttga

SEQ ID NO: 86759 - DNA, 351 bp, Glycine max
  Peptide Sequence Number=SeqID_203537
atgagttttggcccctttcctctcaactatgcgcaatctgccaccgtcactcgtgaccaaggtcatgatatgattggccaagccatggagtcctttgtcaaacgccaatgccaagagaatgagcaattccctctctctatgcaaaatgccattacaactcagttctcctacctcgatgtcttcctattgcaaaacactcaacaggctcaaatgtctatgcttgaagctgttgttgcagctgcctttgtacctcaaccacctcttatacctgcacctcttgatccttcattgccacccttggctccgataccaccaccacctacaacctttccaccaccatctcaagactga

SEQ ID NO: 86760 - DNA, 1377 bp, Glycine max
  Peptide Sequence Number=SeqID_203538
atggatctgttttgtagactgaaattgaagttaactggagttagggttgagcaaattccaatttcattgttgacgttcgtggttgagagttggagcgttgtgcgtctgggattgtgcttgagtggtggtgaatcgttggtgcattcggagttttggacgattgtgatgggcattgtttttggctccaacactctctcctgcgtctcactctcacgggcaatgaataatgaatatgtaaaaactcatgttgaagaagcctttggaacgcaccaccgcattgaaccagagaatcatgtcacagaggacgatgatgtggatttgattcaaataccgaacattaaaaggttgatatcgtcatcgtcgtgtcttgataatttgactacaaagggtctctaccttcttgctatgggttctctttcaagtgctataaggtctgttaagaaagtagtgacagtggcagagctaagaagtttacagcttctcatagagctgaaggctgtaatatcaaatagatccatacgcacagcttttgtaactttttttattgaatttctttttgactgcggtgatatggacagtgttccaaagtctctatcacagaccctagatgttattaacagaggctctaatagctgcatgaatcatgtattattcaagaagtatattgaggaagaagttgactgcatactaaacatgagtgctttgacaaaacaaactgtattggatttgttgcccgatgatgaatttgataaggactttactgatgcttacttggagcaattggaagaaagtgattacagcggcagcaatgaggatgataatgatagtcaacctctggaggatatacacaattcagaaatgaaacatctggagaaagaatccatgcccactaagtacaatgaatgcaagaaccaatacctcactatcgaagatgcttgtgataagacaagtatgcttgcatataatctcataggtcatatgttggaagagtttgtcatgattgaaggcatagatttaaacttgagcaagagtttatacctcagtggtaacaatcacactgaagatgttgaagaaatgactacgcctgcttccaccgatgatggaggtggcaatcctccgccaaacggagttctcgttgagcctgtgattcgtggacactatcttcatcactttattgtgagcctacaaattccagaacggtttgcaactcctgaagatcgtgactctggttgtgtcattcttgagtgtcacgcctcgaagcaacaagatcaattgcttctctcatggcttcaatcccccatttttgctcccatgcttcgaaagttcattggttgcactagttcatggcttctctgggacaatatccaccacgcttga

SEQ ID NO: 86761 - DNA, 153 bp, Glycine max
  Peptide Sequence Number=SeqID_203539
atgattgcgtccaacgcaaaaggaagtagggcaaggatcatcctcaaaggccctaacaatatcaccctagagcaaaccctcaagctcaacttcagagcctcaaaaaaccaggcagagtacgaggcgctcattataggaaaggagtttgggtga

SEQ ID NO: 86762 - DNA, 1020 bp, Glycine max
  Peptide Sequence Number=SeqID_203540
atggtaagaaaacatgccaaagttgagtatgtgaaaagattgtatgaccaagtgaaggtgcaaattgcaaagaagaatgaaagatatgccaaccaagccaacacaaaaaggaaggaagtggtacttgaacccgatgatgatcctggacatttgaggacaaatgttttcctagaaggagggaatgataagaatcatgaaactggtaatccttgtggcgtctacccagacttatcttccttcatcggaagtggcgtctaccctgacttatcttccttcactggaagtggcgtcaaccaaaaactctacagcctgtatcaagcgattcgtgccccttacaaactggttggattcatgttcttctcctctctcctcttcacatctctagcactgcttttgtccacttttcttcttatcttctggaagcacaaggcagtaccaaatgatgaacttgctgaaggaaatggtttcattttgagtactactacttctgaggagaagatctcacatggaagggaaagtgctgttgctattgcaccaaccccaatgcacaagaatgctgaaactgttgtgacacaagcaaaggaaagtgaagaagttagtgatgataaatgccaagaagaagggttgtttttgtccacttctgaagaagtagatcacacactttctgatgagtgctcagatgggacaatttctgatgaggacagcctcatagagattgcacttccaagtggacactttgtgggtcataatcagaacaaagaagactccaattccaagtacaacaactgctgcaccttgcaacagaagaagagggagttatcaagtgctcatgaggcccttttcaaccaacatagcctgatggaattcttggcagagtttaatgaaatgaatgaggaagataacttgatagagattgacatagccatgggttctatcaagtgctcaaggcttgtgcagcagtttgaagctgctgttgttcttcacaagcttcggatactcattaaagtgattgtattatga

SEQ ID NO: 86763 - DNA, 255 bp, Glycine max
  Peptide Sequence Number=SeqID_203541
atggattccaaatgtgctaacacctggaactcagcaacgagttcaaccttccaccaaagttaccctcactcaagcttggcgcaatatgaagaagctggaggacaagaagagctctcagagccgcatctcttaggaattattcagaaagcaaagaagggaacctttgcaaagagtggaacctccaaagatacaatttcagaagaaggtgcacttgtggatgcctattttcatactctttccgatgcatcctgttga

SEQ ID NO: 86764 - DNA, 129 bp, Glycine max
  Peptide Sequence Number=SeqID_203542
atggctgatgcgctaaaaagtgacatgtttcttagagatgcaatgattagaggcttcgtgacatatgatatcttctatcagggatacagtaaaaacatttacaatgacaaattaggatacccaaattga

SEQ ID NO: 86765 - DNA, 345 bp, Glycine max
  Peptide Sequence Number=SeqID_203543
ttgagattgcctgctatcagacaacaattgatattgcaatttaaagctgccttccattgtgacaaggacgccatagaaataccaggcttctatcagcgccaatggctaccaaattatcctgaaattgttgaatttaaaagattcggacctccactgcaatggaatgtagttgtgctcgacaaaggcattggtgataagtatgtcactctcccttggtataaattccttcaagaaggtgattttagccatggagacgagctctcattcaactataggcgtgctgagaagatatgggaagttgtcatcaggcgtgcaattgattgggatgatagtgatatagattag

SEQ ID NO: 86766 - DNA, 366 bp, Glycine max
  Peptide Sequence Number=SeqID_203544
agtgaggaggtgcaagtcttaaaggaagaacttgaaagagcacaagcggtcaaggaaaaattcaagacgacggccatcaaggtccggaaagaatgcaataaactaagagatgtcaatacgaccactgctaaagctttagagcaggaaacaaagagggctcgaaaggaagaatggggccgaaacaagttccgaggggctttgtggggtagcaacaacaagcttaagcttcgaagggccgagagagaccagtcgagagtcaaaagcatgatattggaagatgagttgaaggcttgtcaatggtccaaaaggagtttgtctgagcatttgagcaagaccaacgaaaacatgtgggccatcattgactaa

SEQ ID NO: 86767 - DNA, 405 bp, Glycine max
  Peptide Sequence Number=SeqID_203545
atgggcggcccctattgtgtgcaaattcaaaacaagcacgccttcccgccatatggcttgcctcccaactatacaccacccaatgtggcatacactcccaatgaggatgtcaataactctgctctcatactcattgagagccgacaacctcatcatgtacatgtctctcaacccatgggggagacacatgaaattccccaccataatctagccgagttcgagctttgtctcggatatgccactaaagggcaagcagttggtgatatacccctgcaaaacactttggagggctctcaatatcacccacaaccacacctcttgcattccacagcgggtaaaatccctcttattatgaaagaaatgggagaagttggatcatctagaggaaaagctcagggtcgttga

SEQ ID NO: 86768 - DNA, 657 bp, Glycine max
  Peptide Sequence Number=SeqID_203546
atgccttcgttctcgatgcttcaccacacccccattatggtggaagccatgagaaggtcaactctttacactaatagcgcttccctcgtgtgttttcttggtacagtaatctcatctgacggtggagcgttttcacaggtaagttacagggaatactgtgaaacgagattctcaaagctgattgggaaagcgggaaactttgatgaagagaacagagaagccatacaggtccgaggtggtctacttgatagttgcgagacaacgatacaaggctttcttgtttatgctgctgagagctacccaacagtgtattgtgaagatttgaaagcattagctatagaaggtgatctggagaaggtggcaactctgtctgaaaaggtgaaggaaaaggagtttgaagaaaccaagaagttgtgggatagggtgttcaatcaaccttatgagatagatggtggagaggtgcctttgatgttggaggatgttatctcaatcaaatcccctatctattgggaggattcgggcacagatgtaaatacaaaatacaggtccttcttccaagatttttactggaggtcccaaaaacatcgaggaatgctaaatcaaggaaaaattgaaaatttgcttcaactagcaacaatgaagatgatagaagcttga

SEQ ID NO: 86769 - DNA, 948 bp, Glycine max
  Peptide Sequence Number=SeqID_203547
atggaatcaccagacccaacaatagaccttttcgccacctgtcttgttggtgaagaagtgagatggatcattttgttatgtgacacactttcatcatttcaggccactatgaatgacaccttcaaactgtacttgcgaaagttcatcatcgtcttcttcaacgacatactaatttacaacaagtctttcgatgaccacttgcatcatttggcacaaacatttcaactactgcaggatcaccagttttatcttaagctttcaaaatgttcatttgcacaacaacaggtggagtgcttagggcatatcgtttttgccagtggagtcgccctagttcaggacaaggtcgtcatcgttcaacagtggccaatacccaactcattcaaagcccttaggggatttttgggcctcacagggttttatcgtcgattcatcaggagatattcagctatggcgacacccctcacccatcttttgacaaaagaacacctcgagtggccagaggaagcccaacttgcctttcaacaattgaaggaggccgtaagcacggtgccgattttgcccctaccaaatttctcttcaggaacaggaatgggtgtcattttgtcagaggatggccactcaattgtgttctttagcaagcagttctacccaaaacttttacatgcctctacttattttcaagaattatatgtcattaccgccacaatcaagaagtggaggcagtacttactaggtcattcctttatcattctgatggaccacaagagccttaaggaactcatggcccagctcatacaaaccccagagcagcagaaatatttgcttcacttaatgggttatgatttcaccattcaatacatgtctggaatttcattcatctcctccaaggggccaaaatgggcatcactaagacattggctaggtagcaggagagtttcacttggctga

SEQ ID NO: 86770 - DNA, 468 bp, Glycine max
  Peptide Sequence Number=SeqID_203548
atggcctctactaaagggctcatcgcaattgaagcggagccccttttcatggtgcagcctattcctccggcgacaagcgtttatattggatgggtggaggggaagcttgggttggtagtcgaggagcgaaagagccttgggagggggtgcgatcacgaaaagactgacacgaatcaaggagtttctcctttagaagatgaagcagctgagcaaaaagggaggagggaaaccaatgattcaattggtcaatgcctcaaacttcatgagatagtcattgactgtgcttctctgagtgagcttgaaccaggagccaaagttggaccaggacatgatttggccattgagagacatccactgaaaccaaggaagtgttgggccatccatgtaaaacgaggcaatcatcaagcgttcactatcaggggtcgcatggtagttgaagaactgggtgatcttgaagatccaccttag

SEQ ID NO: 86771 - DNA, 375 bp, Glycine max
  Peptide Sequence Number=SeqID_203549
atggtgcgtaatggcaacgagcttgattgtcttcacctttgcaacaatgtctctatccatgtccaagggcatgtcttcatcgttgattttcacgtcatgtcgttgacgggagcagacctcgttttaggagttcaatgttctttcacacaggcagggttattcaactacagggaaaccgtgacggtgacctcgactctttcaataccaagcagcttcaacaaatggtcacaactaatagcacaagcgctttcttccatatttgagtcacagctcctttccaatagtttgacggccttttccagcatcccaattccttaccgccaccacatcccaccaatcataccatcaaccttcttcgaaactccacatctatga

SEQ ID NO: 86772 - DNA, 1617 bp, Glycine max
  Peptide Sequence Number=SeqID_203550
atggttcggccagagatgcaagagaagtggcatctccaatcatctttcttccttctccattccgctgccattgaaattcaagaagcaaaggactctattgatgaagaagatccaaggcctacaagctccacatggagctacatcaagctgactatagaccggtgtgactgtggtgcttgggtgagtccagtccaagtagtgcccaagaaaggcgatatgattgtggttcataatgagaagaatgatctcattcctacactaacagtcacagggtggagaatgtgtatagactactgcaagcttaatgatgccccaagcaaggatcattttcctctgccattcatggaccagatgttggaacagctagctaaacaagttttttattgtttcttggatggctactcggggtataatcagatagcagtagaacaaaaatgcattgaagtgttcatggatgatttctcagtctttggcccctcctttgactgttgcctatccaatctaaaattggtgctatggcagtgtgtagagactaatttggtgttgaactgggagaaacgtcatttcatggttcaggaggggatagttttgggccgtaagatctcatctagagggattgaggtagacaaggctaaaattgatgttactgagaagctacctccaccggttaatgtgaaaggcattcagagttttcatggacacgaaaggcttgtgtctactctcatgatggtgcccctaaattggagccaggaatttgagctgatgtatgatgccaatgactacgtagtgggtgcaatgctagggaaatggagggataaagtgttccattcaatttattatgccagcaagttgtataaccattggggaagaataacgttgagaacatcatcaagtttcttaagaagaacattttctcctactttagggttccaaagctgcagaagatgttgggggcactacaatgtcaagcataaggttatttctccttatcatccccagataaatggccaggccgagttatccaacagagaattaaagaagatcctggagaatactattgcatcttcaagaaaggattgggctatgaaattggataatgccctatgggcctataaaactgctttcaaaattccaattggtatatcccgatttcatatggtctatgggaagacatgtcatctaccgatacatatggagcagagggcttactgggctctcaaattcctcaattttgatgcatccttatcaagggaaaagcaaaagttgcatctgctggagctagaagaaatgaagctcaatgcttatgaatcctccaagatttatatgcagaagatgaaagcttaccatgattggaaacttgttaaaaggaactttcagcctagacaacaggtgttgctgctcaagtcccgtatccagctttttcctagaaaactcaagtccaagtggtttggccctttcataatcaaagatgtgaaaccctgtggagcaattgagctgatggatccttcatctactgacccagagcatagttggatagtgaatggccaaaggttgaatatctacaatggtggcaatattgagagattaaccaccatcattcacctcaatgacccgtga

SEQ ID NO: 86773 - DNA, 537 bp, Glycine max
  Peptide Sequence Number=SeqID_203551
atgtggcatctgaagctaagcacgattgtcgcactgagcggtcttcacgcgctgagcgaggctgacacactgaacgcgactctcaagttcttcaaatctcttccttgccttctgctatatctctacaaaaaggcaacacatgaaggttgggaaatggcctatgaatcacatgtgaccaaagccctctacaaagaaaacatagagaaagttggtgaccaaaagacaattatgtacaacctcatgtgtgaaaaggtcaagatttggacaaacattcttaacaaaaacgtcctccacaagtcttgttcaaaaactactctcttagacgtacataagtttatactctttcatcttatggagaatctttcttttgatttaccacatactatctatattactattccccacaatttgagggttctcggtggacttgacgacatctactatgtagtgttgatgaacaagattctatgggatcaaggattctatcaaatgtttgataagatggacaaagatgatgatggtgaaagacttgagtga

SEQ ID NO: 86774 - DNA, 582 bp, Glycine max
  Peptide Sequence Number=SeqID_203552
atggctagagtatgtaaaacttcagaggacaaccttgttccattgaatctggagattgaagcaacctgtaggagaaacaatgtgcaagaagaagaagaaagcaatgagaagggcagacaaatcaaggagaaagaggagcctaatcctctgcatcatcctcaacatttcctgtgtatagcatggccaaaagttcaagtgaccaatatttcatatccacattccctcattcagttgattcaaggcaatctcttccatgttctatcaaatgaagatccatatgctcatctggctatatacataaagatatgtaatacgatgaagatagcaggagttctggaagatgccatccgccacaatttgttttctttttcttggctggtaaagcaaaaagatggtttcattcattcattcaagggaaacaagttcctgaagaagtttttcccagagtccaaaattgtcgagaggaaggtagaaatttcatcatttcaccagttccctgatgagtcattgagtgaagctctggaccgcttttatggtctacttcgaagaactcgtactcatgggttcagtgagcctatctag

SEQ ID NO: 86775 - DNA, 642 bp, Glycine max
  Peptide Sequence Number=SeqID_203553
atgttacttgttagtaaattcatttgcaaattgaaagtactaccccttggattgaaattgtctgtgctccttgagtcagcagtttctacaaacaattatgatccaccttacaaagtcaacggagatgataagatgaaaagtcaatcaataagagcagttgttcatcaagataacaagacaattaactacgagaaccgaactttgacaccaatacagacatcaagtgaccaaacccaagaagccctccatctctttgtctcccaatatcgttcgggtttatcccctgacaagtacaccatcccttgtattttgaatgtttgtgcttgttccgtcgatggaacaactagtgcacatgagcattttcagtgtgtcaagtctggacttgtgcgccatgttttggtaggaagcactcttgttgatatgtacatgaaaactgggaatgttagagatgagaggagagtttttgatgaaaagggtgacagagatgtggtgttttggacttccttgctcgcgggttattcgttgaatgggtttaatgatcaggtgtgggagttgttctctttggccaatcagtgcaagattgttgtaggaatgcaaatccatgcattggtcgtaaagcacagttttgaggtgaaaggacgt

SEQ ID NO: 86776 - DNA, 321 bp, Glycine max
  Peptide Sequence Number=SeqID_203554
atgtctcccaaaaacccaatacccacgaaattcatgagagaaaaagtctacccaaacctgaaatttgaagtcccacaacgtagaggtgcgcttcacgactccgaaaatggcttccttttgcaatttggagtagaaatggtgagcaaagtttggagctttaatgggcaacaatggtgggtgagaaggggagaagaaaagcaacgtgagaagttccagtgccccgcgtttctctgcacccgtcggggcccgttttcgaaagtcgttaatctggagggagacttagcacacagtacaatagagaatacagaaaaggttcaatag

SEQ ID NO: 86777 - DNA, 312 bp, Glycine max
  Peptide Sequence Number=SeqID_203555
atggaaagaaagcctcaagaggctaacattaacctctcatacttccatgggaaggacaatgtaaaggcttatttagatttggaaatgaaggttgagcaactctttgcttgccatcatacaagagaggaaagaaaggttcatttggctacccttagcttccaagggtatgccccctattggtggacttcccttgataggaaaagaaggattcatggggatcctccagtaaagtattggattgacttgaaaagtgcccttaggaagaggcacatcccctcctactatgaaagggggcttatggacaagctctaa

SEQ ID NO: 86778 - DNA, 243 bp, Glycine max
  Peptide Sequence Number=SeqID_203556
atgacactaagcaatgagcaagaaatttgggtttttcttgaattcaaagtaccaaaggtcctaggagagcactcactatttcctttttcatttcatgaagcaaccagttcccaaccttttatttatttacactacacaagtagcagcaacactggtgcaatcctacccccccaagggcattgcatagaagactccaagaagattgagccagagatgcaagagaaggccctaggattttcatga

SEQ ID NO: 86779 - DNA, 369 bp, Glycine max
  Peptide Sequence Number=SeqID_203557
cttgggaggattgatggggacccggtgttgagagaaacgaggatatgggctacgtgggagtacgtgagctcagttggaggtgggcaacaggggatgggtgaaacttcctacttttattcgttgaccacagagtggtacctagagatatgtcgcgggggtcaagagaccttggggatgtcaagtggggcgagctcctggcagtcaacagataaaaggaacaaagaccacaaagcaaggaggctggtgtggtggctggccagctttgaatcttgtgtgatatatgggttatggcctctggtaatcgattaccaagggcttgaaaacgaggtcaggaagctaggagagcttctagtaatcgattaccaaggg

SEQ ID NO: 86780 - DNA, 558 bp, Glycine max
  Peptide Sequence Number=SeqID_203558
atggatcttggggtggtgggtttggagggggtggtgggttcagaaagtggttgtgtgtttggttcttctcttgcttcagatcctgagacaaagcacaagtggtacggatctggtttgctcaagcaagagagatctgccatagctagtgaagatgatgagtggagaatttccaaagttgctaaaactgatcatgacatgccttcagcctccaaagcaatgctctttcagcaaagaaacaactctttgttgagatctaataatgcaactcttttctctgatggtcatcaccaatcacaaatgttgaacttctcttctccaaagtcagagactttattggtagacaaggctttctcaaatgccacattgcctttttcttatcatcaattgtctagttacagcaaaaatacagtatgcaaaggttacaattcaggaagcataagcatgcatggggctttggctagtgtgagagggccattcactccatcacagtggatggagcttgaacaccaagccttgatctacaagtacatcacagcaaatgttctggacaaggaataa

SEQ ID NO: 86781 - DNA, 297 bp, Glycine max
  Peptide Sequence Number=SeqID_203559
atggtggttgttaggttatgtgtggtacttaacatccatgtttatggttccaaaagggattttcaggaccagatgacgagcccaacgtcgcatccctattctacattgatgctattgagaccaagtgagaacatgatgacgtgctccatatggaccacttcttcgggttcctacattgtcgccgtaccacccgaggttgatatggtggatcttatgtcagaggatgagggagagaatctgaaagaggatatgtcctacgaggaggaagcgtctatgatgaggaggaccccattatag

SEQ ID NO: 86782 - DNA, 717 bp, Glycine max
  Peptide Sequence Number=SeqID_203560
atgaagctcatagagaacatggaggctagtgaccaagctatccttagggatagagcttacatgacttctaaaaagaaggagaaggagcactactttgcaagatttcttgatattttcaatgagttgaagatcacaatccccttcggtgaagctccccaacaaatgctactatatgcaaagtttttgaaggagttgctaacgaagaaagacaaactccctccaaagttcaatgacccagggagtgtgaccatccctttctcaatagaggacatttctatgggaaaaactcttattgatttaggtgcaagcatcaacctaatgaatctttctatgctcaagagaattggcaacttagagctcaagccaacctacatgactcttcaacttgtagaccagtccatcaaaagaccacatgtcatcattgaagatgttcttgtaaaggttcaagaattcacattttcggtttatttcatcataatggacataaaggaaaatgttgaggtaaccttaatctttgaacggccatttatgctcatcgctaaatgtgttgttgacatgaagaattgtaacttagagatgaatgaagtagatgatgtggttcaacaattcaccatgcattccactcttgagaaaactccaaatttgggggagggaaatctccatgtggagattgtaggccttggatcttcttcatcaatggagtcctttgcttcttga

SEQ ID NO: 86783 - DNA, 678 bp, Glycine max
  Peptide Sequence Number=SeqID_203561
atgtgtgatatccgatggtactttctggcttgtactacatcacgaattggcataatgaaggcatatagaggtgagattaggcgtggcagcggaacccgaccccacgggaaccgaatcgaacccgccccgactttgacgaataaaaaccgtgttgatcgggttcggggtcgggttcgggtttttctcgataactcaaaacggggcgggggcgtgcatgggattacagatatccaccccaaccccgacccgccccaaatcctacaactctcagtcctcactcctcacattgctaaacctcttgctgggaagaagctttgcaagcgaaccctaaaacttgttcatagagctgccgaacacaaatgcttgaaaagaggagtgaaggaggtcgttaaaagtataaggagaggtcataaagggtttgcctgctttctttctaactttttctttctcacaaaaacattagaaatgcttaccctaattttcttgtattgtgaatgcatattgtgtgtgattgctgggaacatatcaccaattgatgtcatcactcatgttcccattctttgtgaagagtcagacattccttatatttatgtctcatctaaagaagtacgcaaccaactccgcattccatatcttgattatgtttatgtttcatatgtctttttgctattattgtag

SEQ ID NO: 86784 - DNA, 1239 bp, Glycine max
  Peptide Sequence Number=SeqID_203562
atgattctgactcagaagcttcacaacgctttcaaaggcactgtcgagaagatcactggccccgaaccattttcggcgtcaaagaaaaaggagttctcaatgtctctaagctcgtcaccatcggtgataatctcgttgccaaatgccccacctggtcctgggaatcagtatggagtctggcaacaaagtggattgtggcctcatattgatttattattgttgatctataaatcatttaaggatctgtttttcaaactacatggactcttaatcgaaggaccggtttcaaactatgtgtttgtggatgaccctagggctagcaaacacatccaagcaagttctaagaaggttatcatcactgctcctgcaaagggtgctgatattctaatgtatgttgttgaagtaaatgaaggggactatactcatgagatctctagcattataaagtctgtgaccaactcaagagtttacacagactcggctgtagcacttaacattgtcctaaccaacactggagctgccaaggccatgtctctagtgttgccacaacttaagttcaagctcaatggaattgccctccgtgtgcctacacccaatgtttcagtcgttgaccttgttgtgaatgttgagaagaagggtcttactgttgaagaggtaaatgcaacattcaaaaaggtagctgaggggcggctcaaaggtgtattggacgcgtgtgatgttccacttgtgtctatcgacttccgctgctctgatgtttcttctactattgattcctccttgactatatggtcatgggagatgatatggttaaagtggttgcttggtatgacaatgaatggggttatagaaagtgtttttacaacatcggttttggccaaaaccgatgttataaaggcgcattcaacatctagaaagtggagaccagaagttatagcgttaagagccatcaagaatcttgattcaatgtctcttgaagagcttgttgggattcataaaacccatgagaaagagcttgctcacgacgaaggaacaaagaaaaggaagtcactagtccttatgattcaaagaccaaaacataactctacgtccaaagagttatcatccaaagcccttattgttaataatgctttagaagaagaatctgacgataatgactctgaagaaaaagatgaagcccccattaggcacatcacatttgaggatgccccactgaagcaaggctttataggccacataaag

SEQ ID NO: 86785 - DNA, 264 bp, Glycine max
  Peptide Sequence Number=SeqID_203563
atggaaccgaagtccactaagcaagctcttgctgaccctgcatgctgccataaacaactgaccatactagctgctgctaaatctgtaatatgtcctgtagtatttgttcatactgcattgcaacaaaaacaggtgggctttatgatgcaatcctactccgtaagggcattgggtagaagactccaagtagattgggctagagatccaagggaaggccctagggttctcatgagccttagggtagatttcgagtccatgggataa

SEQ ID NO: 86786 - DNA, 963 bp, Glycine max
  Peptide Sequence Number=SeqID_203564
ggatcctcctccaccaccatcgctgtaggccaacaccgccacgacacatccggtgacccaccagcaccaaatccttcttccttttcatctcccagtcagggtgttccttttgagggcactctagttgatgactggaaacatgtttattctagtcatgatgctcataaaatggtttgcactaaccatgctgatatgaccgacagattgctggctggtcgtcaaattgactgggctcatcttgttaggtatcgaataaataaggcattacgggccaatgcacctcttccgtatcctcatcttgttactttgtttcttcaccatttcaatgttcctttagaagatgaaccttttgttaaggttaacaaatcttttgctattggtgctagcgctcttacatctttcggataccgaaaagatatggatggccaatgggtgcgtaagcaagacctgccaccacccattcctgatgaaagtacaccgtctccaccaccacaatgggatacttcttccttcttattaattgaagtcctcactaagctacgggatcttagagcttttgtcagtgatctctttgatgcaatggactcctgtatcacgcatcttgaagactatcataccctaatttctcccgagacgtgtcagaaatcaaaaggaagcaggcttgcgcaatccgtgaaatttcgtaatgtggcggaaatcgaaaaaagatccttcctcaagaaggttgttgcttctggaggaagcaaccttgctcacctggacgagctgagcttgcctgggcgagctggtaattatgcgaagattctcgaccgttcttcaacattcatcgttcgttcttcgttttcttcagtcttcaacggcgcacccgtgagtctcgccctcgctcgcccgcgaagggcacgttgcgacaaagacgatatgagtttcatccgacgttgctttgatccatctgtcgattcttag

SEQ ID NO: 86787 - DNA, 354 bp, Glycine max
  Peptide Sequence Number=SeqID_203565
atgtataatactacaataacccatattcgtctccactgcagcggacactggcaaatggtcgtcattttgcctaagaaaaaccttgttgtctatgctttgaaaggacttgatgatactccacaacctaaatccaaggctggtgctaggtggattgttgttaagtgtaatagacaaaaaagaaccactgagtgtggctattacgtcatgcactggatgtccacgataatcttaggaactttcaggaataattgggaaacgtattttaatgatgttagaccattggaagtagagagattaaaggcgcttcgcatccagtgggcgcagtactatctcaaagttagaaatcaaacttag

SEQ ID NO: 86788 - DNA, 609 bp, Glycine max
  Peptide Sequence Number=SeqID_203566
atgtttgaccgcaacctcaccctctccaaggctgacccggacgtctgggccgccgtccagaaggaagacgttcgccaagagcagcacatcgagctgatcgcttcggagaactacgccagcccggccgtcatggaagccccaggccacgcagctcacgaacaagtacgccgaaggctacccgggcaagcgctactacggcggttgcgaatacgtcgacgtggtcgagcagctggccatcgaccgcctgaagcagatcttcggcgccgaagccgccaacgtgcagcccaactcggccgggccgacaccgtgctgggcatgagcctggccgaaggcggccacctgacgcacggcgcctcggtcaacgcctcgggcaagctgtacaacttcatctcgtacggcctggacgaaaacgaagtcctgaactacgcccaggtcgagcagctggccaaggagcacaagcccaagctgatcgtcgccggcgcctcggcctacgccctgcacatcgacttcgagcgcatggcccgcatcgctcacgacaacggcgcgctgttcatggtcgacatcgcccactaccccggcctggtcgccggcggcgcgtaccccaacccg

SEQ ID NO: 86789 - DNA, 735 bp, Glycine max
  Peptide Sequence Number=SeqID_203567
atgaatgcagtgaccgaaaccgtcgacctgcaggctgccccgcctgctcccctggtgttcaccgactcggctgccgccaaggtcaaggacctgctggccgaggaaggcaaccccgagctgaagctgcgcgtgttcgtgcagggcggcggctgttcgggtttccagtacggtttcacgttcgacgaagtcgtcaacgaagacgacaccgtgctggacaaggccggcgtgcagctgctggtcgaccccatgagcttccagtacctggtcggcgccgagatcgactacaaggaagacctggaaggcgcccagttcgtcatccgcaatcccaacgccagcaccacctgcggctgcggctcgtcgttctcggtgggctttttgtcgtgcgggcggcgcgcgtcaggcgggatacaaggcgcccaggatgcgcgcgccacgcgcaccggtgacgccgggcaggccggcggggcggcgcgccaggaaggcctgggccagccaggcgaacgccagcgcctccacctgttgcgccgggacgcccagcgcgtcggtggcatgcaccgggcgctgcaggcaatacgccaactcacgcatcagtccggggttgcaggcgccgccgccgcagacatagagttcgcgcacgtccgtgccggcgcgtcgatggcgttggcgactgtgcgggccgtcaggcgttgcagggtggcctgcacgtcctgcggcgccggcctgggaccatcgtag

SEQ ID NO: 86790 - DNA, 447 bp, Glycine max
  Peptide Sequence Number=SeqID_203568
atgcagagtttgtgtggtcacactagttcaatagaagcagtgacttttgactcagcagaagtgttgattctttctggagcatcgtcaggggtaataaagctttcggatttggaagaagcaaagagttcagcagatagaacaatgaaattttgggatttagaaacctttgaactgattggatctaccagacatgaggtttcgggggtacgctcaattgcttttcatcctgatggacaaatcctatttgctggatttgaggatagtttgaagcttatagagccatataatggtagcttggaaactgagaaaaaggaaagcacaaaacaaaaacttagtctccagggaagacaaatggagaaagtagaagctggtgtgggaccggcttttgggttgtgcagtatgtctgttgacaatgagtcaaaagagataaagaatgtatatatatag

SEQ ID NO: 86791 - DNA, 1422 bp, Glycine max
  Peptide Sequence Number=SeqID_203569
atggctgaagctacacgatcgaaaacaagcatggagcgttgggaagatgcgtttgcaaaactttcggcatccatgacttcaaagttcgatgaacttctcaatcgtatgaatcaattagaaaactcccacaccaacactcacgctccgccgtcgtttgcggccccagcggcaacggccaccgccaacacagcttatcgattgaaattggaggttccaagatttgacggcacggatccggagggatggatattcaaggtaactcagttctttgagtaccatgcgacaccggagcacgataggttgatgatagcatcgttttacttggagggcccagccttagcgtggtttcaatggatgtatcaaagtggccaactctcctcctggtcagcctttcttcacaccatccatgcacggttctcgccctcagcatacgaagatcctaccggagttttgtgtaagctcacacagcggaccaccgtctcggcgtacctctcagaattcgaaactcttgctaacagagtcatcggtcccccagcgccatttgtcttgagttgttttatatcaggacttaatcctgcaattcaaagggacgttcaggtgatgcaaccacattcattagctcaggtggtttccttcgtgcgcctccatgaagagaaacttctcgatggtcgccgtcagaccaggaaacctgcttcttccttaaccccgggaacgagtgtcacgcgtacatctccttccttgacctcatccatagcggattcgccactgcttccttctccgagtagacctcgtgcttcatccatccccttcaagaagataacaccatcggaactcgccatacgtagggaacaaggcctatgttttaactgcgacgaaaaatattcgagggggcataagtgcgcttcatctctattcttatttgttaccgaggatgaggatgataaccgtgagatagacccaggaccatcgcagttgcctcctccattacaggaatccgcgccggctcagattagcctacatgccttgtccggtcacggtgcgccggagacactacgtctcaccggattcatttgtgagcatcgagtccagattctgatcgatgggggcagcacccataatttcctacaacaggaattggttacattgctgcagttgcaaccacaaaagacctcaacattgcgggtcaccgtaggtaacactagcaccttcttccacattaaaatggaaccttccatggaaacaccagtaacgatagcccacccaataccggccgtccaaagactcctctccaaacacgcctccctcttccaacctttatcaactctacccccatctcgaaccacagatcacagtattaccctccttcctaactcgaccccagtcaatgtaaaaccttaccgttaccctcacttcctgatatga

SEQ ID NO: 86792 - DNA, 366 bp, Glycine max
  Peptide Sequence Number=SeqID_203570
atgaccaagagcaagggcaaggatccacttgaaggacttggagggtctatgacaagggctagagcaaggaaagccaaggaagctcttcaacaagtgttgtccatactatttgaatacaagcccaagtttcaaggagaaaagtccaaggttgttagtgggtcattactaaaatctgctgtaaagcttctatataagctgaaccattttatcaataaagacaagttgagttttattcagaaaattagagtttatctcttttatcttagtgagagtgattctcctaaattcttgagtgattcaagaacaccctggctgtatcaaaggactttcacaacctttgtgtgttgccctcgctggaaagagtga

SEQ ID NO: 86793 - DNA, 2283 bp, Glycine max
  Peptide Sequence Number=SeqID_203571
atgctcaggcaaggccatatccagcacagctcaagtccattctcctctccggttctattagttaagaagcgtgatggaacgtggcgcttttgtgtggactatcgggctctcaatgccataacagtccgggatcgcttccccattccgacagttgatgagcttctcgacgagctcggaggccctgtttggttctcaaagctcgacctgatgcagggataccatcagattttgatgagggagttcgatatcggcaaaacggtgtttcgcactcaccatgggcattacgaattccgcgtaatgccctttggtctttgcaatgctccgacaacgtttcaggcgacgatgaaaaggttgtttcagccccacttacgaaggtatatcatcgtcttcttcgatgatatactgatatacagtcacagcctggaagagcatatcaaccacttggaaatcgcgtttcaggtattagaacatggccagtttactcttaagctcaccaagtgttcgtttgcgcataagcaaatagagtacctaggccatatcgtcaccgacaatggggtccaaccagtaccggagaagatacaagcaattcaggagtggccacaaccacgatccacacgagctttgcggggtttcctaggattggtgggattttatcgcaggttcatcaagggatacgcgatgatagcccatccgctttcgcagttactgactaagtcggagctggtttggtcaccggaagccgacaatgcgttccaaaatctcaaacaggtggtcacgacggcaccggtactcgctcttccagatttctccaagccctttacggtagaaattgatgcttcgggcttgggaatgggtgttgtgctttcgcaggaaggacaccctatctccttcttcagcaaggaacttgccgccatcaccgccgcggttaagaaatggcggcagtacctattaggtcactctttcatcatactaacggatcatatgagtttaaaggagttgatgaatcaggcggctcaaaccccagaacagcataaatacctagcacgactactgggttttgattatgtgattcagtatcgagcagggaagagcaatatcgttgcggacgcactttctcggtcaggagcatcaacaactgcttcattattcattatctcagtccctcacttcgtcttcctcgaagatttgcgaagggagttgcaggcaaatcccgagttcagggaactaagaaggaagatgaccgctgaacctcacgcatatcctgatcattcactagctcaggacctcattctttatcgtggtcactgccaactagtgaagtacgaaatagccaaacctcgaggccttctatgtccgcttccggtaccatcacggccatgggaggacctttcgatggatttcatcgtaggcctctcggcgtatcgtagttacacatgtatcttggtcattgtggatcgtttctctaaaggagtacacctaggaatgctcccctctcatcacacatcacagatggtggctcaatcattcatggagatggtgggcaaattgcatgggatgcctcgcagcatcacctcagatcgtgacccgtttttcatgagcaaactgaagttgcaaatcgagtggtggagcagtatttacgagcatttgtacatcggaaacccagctcttgggggcgcttcttgctgtgggcagagtggtcgtataacacgtccgtccactcctccacggggggaggaaatgttcaatctacttcatcggaaattgcagaaggcgcaagctcgcgtgaaggacatcgtagatggacgtcgcagggaccatgagtttcagaggcatttttatggaccctttaggattattgagagaatgggccccgtagcgtacaagctagaactaccggaacactctcacattcacccggtgttccattgctcactcttgaagcccttagtgggctcgactgagtcggtgaaagtagaaacacttcctgccggagctgtggacaatcaaccactcacgacacctttagccattctgggtcaaaaaatggttccaacagaccaggggcttacacgcatggttctggtgcaatggcaaggcttgcatccagatgaaacatcatgggaagagtgggaaggcctcaaggaacagtatcaccttgaggacaaggtgctaattgaagatcgcgggaatgttacgaatagtaacttcaaacatcaggttacgaggcccaaaagaaggagcaacattcctgggcacttgaaggactatgagcttcaagcttaa

SEQ ID NO: 86794 - DNA, 639 bp, Glycine max
  Peptide Sequence Number=SeqID_203572
atggcttctcgcaggctctcatcatctatgctccgaccattcctccctcgatctccgccggaatttcaagcttcgatcccttcccagccattctctgtcccaaacttttccactggcgtttatccggtcgccattacaaaattattctcacaatttgagtccggtaatggtttagcatcagtgctgagaagctctggactgggcttgtatcagcaggctgggggggttgtaccgccttttgctagcaggtttatgtcaacagaggcaacttctgttgattcttcttctcaagatagttcgacgctggagcctgaaattttagacaaggaggctgtagaggatgtgagagggcaaagagagatacctgacataaagcctggttatattgtgcaactcaaagtggaagtacctgagaataagaggcgtgtctctattataaaaggcattgttattgcaaggcgtaatgctggactcaatactacattcagaattaggaggcaggtggctggggttgggattgaatctttattccctctgtattcacctaacataaaggagataaaggtgcttgacaagaagagagtgagaagggccaaactctactatctgagggagagaatgaacccacttaaaaattga

SEQ ID NO: 86795 - DNA, 528 bp, Glycine max
  Peptide Sequence Number=SeqID_203573
atgaagaataagaaggttgcagcagttggtgtctcgctaagtgagacatatgcgcttagtgagcaacatccgctaagcgagacatcggctcgcttagtgaataaggagaatctggaagagaattttccgtgcatgcacgcactcagcgcaccatcagctcgcccaacgagtcatttgtctcttctggcgcccagcgcgcctgactcaatagagatatacgtgagagaagcagcaggtcaagggagcaccaaaaacctcagctttcaagaggattctagtgttgtggaaagaatccctgagtttcaagaacctctggatttgaggtcaaatccttttcaagggggagggaatcatgatgtagctccatgtggagcttgtaggccttggatcttcttcatcaatggagtcctttgcttcttgaagatgaatggtagcggaatggagaaggaagatgattggagacgccacttcaaggggaagatgagtcaagaagaagctcaccataggaagccatggataagagcttga

SEQ ID NO: 86796 - DNA, 390 bp, Glycine max
  Peptide Sequence Number=SeqID_203574
atggaagctatgaagaaattcaaatggtcgaaaccattcactcggatgtccgatttaagcgcatcacatatcgagacgctcgaaatagaacaatggaagctctcgacatattccaatggtcataactattcacacggaggcgcatcacatatcgagatgctcgaaattgaacaacggaagctctcgagatattcaaatggtcttaacttttcacacagaggtccgattcaggcgcataatacatcgagatgctcgaaattgaacaacggaagctctcaagaaattcaaatggtcgaaacttttcactcggatgtccgattcaggcgcatcacatatcgagacgctcgaaatagaacaatggaagctctcgagatattcaaatggtcataa

SEQ ID NO: 86797 - DNA, 177 bp, Glycine max
  Peptide Sequence Number=SeqID_203575
atggagaattggcgaacagcgctacgcataacttcgcggggcttcagactcgaagcgttaggcaataacattcatggggcttcgaaaaaagtggagaatggagaattggcgaacagcgctatgcataacttcgcagggctccagactcgaaggtggaggatgcatgaacagtgctag

SEQ ID NO: 86798 - DNA, 291 bp, Glycine max
  Peptide Sequence Number=SeqID_203576
atgtgggatgatccaacagtgacatttagagggccaagcaaggccaggggtaagagatcaaaggtccccactacttcaacaccaccagagatagtagctccttcttcttccacagctccaatgcttcattccatgctccagagcttacacggggggcagtccattatcatgcagagccttcagggtttgggcttgccatccatcatgagcatggctgagtttgatgcacaggtggcctggccaagagcccaaccttctccttctggatggggtggggcctccgcagcctag

SEQ ID NO: 86799 - DNA, 177 bp, Glycine max
  Peptide Sequence Number=SeqID_203577
atggcgacggggtcggtctgtctttccgcttttaagctaatggttgtcctccgttcagacagcacggagaagaggaagaagtcgtcacaagggtactctcgggcgaaaggcccaaacggcaccttgttagcagtcctatcctcagtgaacgttgttagctgtagttacagctattaa

SEQ ID NO: 86800 - DNA, 299 bp, Glycine max
  Peptide Sequence Number=SeqID_203578
ccgcgctttcatccttcggatactaccatcatcatccacggttcatagcaccttccccattaatcgtggttccgcacggaggatcatcatcatcatcatcaggaccgttggttcgtccacgtggggggccacgccataatcatcctccaatgggtgcaagcatgggagaacaacagaataataataatattgttgttgatgatgctgatggtgatgttgatcttaacttgagtttggctcacagtactacaacttccaaattcaggggcaagaaaattcccaagaggaggagaacttga

SEQ ID NO: 86801 - DNA, 1486 bp, Glycine max
  Peptide Sequence Number=SeqID_203579
atggagtgtattgtttgtcttttagtgtcaaaaactacttttattattccggttggtagttcagctaagggacagagaataaaccaatataaagatttttcttttcagaataagaaaaaatatatctattttaccggaacagttctagcaattaggagacatgcattaaaagtggtgtctgatgaagcaagagcaatgtacaacggtggacaggctggtttgacgtattggagtcctaatgtgaacattttccgtgacccacggtggggccgtggccaagagactcccggcgaggacccgacattggccgcaaaatacgccgccagctatgtcaaaggactccaaggcgatggtgccggaaatcgcctcaaggttgctgcttgttgtaaacactacactgcctatgatcttgataattggaatggtgtggacaggtttcatttcaacgccaaggtgagtaaacaggatttggaggacacttatgatgtaccatttaaagcgtgcgtgttggaagggcaagtggcaagtgtgatgtgctcctacaatcaggtgaatggcaagcccacgtgtgctgaccctgatctccttcgcaacactattcgtggccaatggggcctcaatgggtatattgtttcggactgtgactcggttggagttttctttgacaatcaacactacacaagaacacctgaggaggcagctgctgaggccatcaaagctggcctggacttggattgtggcccattcttggctatccacactgattctgccattaggaagggactcatttcagaaaatgatcttaaccttgcattggccaaccttattacagtccaaatgagattgggtatgttcgacggtgaaccatcaacccaaccattcggaaacttgggcccaagagatgtttgcaccccagcccatcaacaattggcccttgaagcagctagagagagtatagtcttgctacaaaataaaggaaactccctaccactatccccttcaagacttcgtatcgtaggagtcattggacccaatacggatgctaccgttacaatgatcggaaactatgctggtgtggcatgtggttataccacccctttgcaaggaattgcgaggtatgtaaagacggctcatcaagtaggttgtaggggtgtcgcttgcaggggaaatgaactatttggtgccgcagagatcatagctaggcaagttgatgcgactgttctagtaatgggccttgaccaaaccatagaagcggaaacaagagatagggttgggcttctcttaccaggccttcaacaagaacttgtgactagggtggccagggccgctaagggccccgttatcttggtcatcatgtctggtggcccggttgatgtttcgtttgctaaaaataaccctaagattagtgccattttgtgggttggttatcctggccaagctgggggaactgccattgctgatgtgatctttggtgcaaccaacccag

SEQ ID NO: 86802 - DNA, 387 bp, Glycine max
  Peptide Sequence Number=SeqID_203580
atggtggcgccagggaaggccccaccgaacttggtgccggggcccacattggagacgccgtggagcgcctccgaccaccactcgtatccttggatgccgagcctgggcacggcgatggcattgttaacgacgagcctaattttttccggcaatgtgagcctcgctatgaggtcctgcaccctcacgtggatcggcacgtgcgtgttgcagaacttgaaccccctcgtgagcccgttcctagggtcgcatgcaaagggcaccctcccttcggtcacccttgggaagaaggtcagggtgacgcagagcactagccctagggcaaagggggagttgcgtctttcaatgggtttttggggggcacagaaacaaaagaaactacttacatga

SEQ ID NO: 86803 - DNA, 216 bp, Glycine max
  Peptide Sequence Number=SeqID_203581
atggacggcgaaaggatgagcgagatggaggagatggagtgtggtcattatgtggatcatggttacgtgagcaactggggcatgcaatgcaacagccatacgggtgaagcaccattgggaaaggacaagtcctatgaaacggagaaaaagggttcaatgagaaggatccattggttgatgaagaacgagtatgggaaaatgacccataattgctaa

SEQ ID NO: 86804 - DNA, 528 bp, Glycine max
  Peptide Sequence Number=SeqID_203582
atggggttcaccttagtagaccttcaaaaggtagaagatcccaacggttgtagatggtcagtggttttgcaaggtagagcaatttttatcggtgaccatatcgacagttcaacagttgatgtcagtgacataccgcctttcttgaaagacatgcctttcattactgatgaaaaaccaaaagacaatgtatatgcaaatcgtactgatcatgaggagggtttatgggagaactttcctttgctaatggcaacaccccctaggtccccgtcaaattcaaaaaaccctcctgaggtaacttcaaagaggaatagacaatctatcaggctcaaaagccttacaactataagcttagataatccacgactagttgttaacatcaaccctactgctgggagaggatcgggtccccacaaagaaaaatttcacagttacctaggggtggtggcaagagaaaaaataccaattgtccactccaattggaatgttgtcctggatgatctaaagaagctaatttgggaagacatcttg

SEQ ID NO: 86805 - DNA, 258 bp, Glycine max
  Peptide Sequence Number=SeqID_203583
atgtcattgcctagcgctgttcatgtgtcctccaccttcgagtctggagccccgcgaatgtcattgcctagcactgttcgccaattctccattctccacttttattcggagacccatgaatgtcggacgaaatcaatgtcttatctttgctttcctcttatctccgatgagagatactgggcaccctttgttgcacaatatgtgaagtcccgagacgtgccaaagaatcaaaaggaagcaggcttacgcgatccgtga

SEQ ID NO: 86806 - DNA, 471 bp, Glycine max
  Peptide Sequence Number=SeqID_203584
atgacatatgagaagaagtctggtagtaatgttctcatgggtaacgatgctccttttcatcatgttccacaacttaagagaaatcttgtatctgcgggtgtcatggattcgaaaggtttttcttgtgaggtcaaaggtggagttatgcagatcacaaggaaagggaagtttgtggtaatgcaagggaccaaacaaggaaatttgtacatttttctatggtccactatgacagaatctgtctttgctatttcacaatctaggagccatgtgtccagtggctcatttgataattctctatggcatttgcgtttgggaaacatgagtgaaaaaggtttggatatcctgagtaagcgaggcttacttggaaatcacaaggtcttcgagagagttccatcattgggaggggcaaggcatttcctcactatcatcgatgattactctagaatgacatgggtattcatgttgaagtag

SEQ ID NO: 86807 - DNA, 639 bp, Glycine max
  Peptide Sequence Number=SeqID_203585
atggcgatttgggttgatgcggacgcgtgtccgaatgtgattaaagagattttgtttcgcgctgccgagcgcgttcagatgccgctgacgctggtggcgaaccagaatattcgcgtaccgccttcgcggttcatccgctcgttgcgggttcctgcggggtttgacgtggcggacaacgaaattgtgcgtttgtgcagcgcggacgatctggtgatcacggcggatattccgctggccgctgaagtgctggagaaaggggcggcggcgcttaacccgcgcggtgaacgttactcgccttcgaccattcgcgagaagctcaccatgcgcgattttatggatacactgcgggccagcggcgtccagaccggcggaccggacagcctgtcccagcgcgatcgccagcagttcgctgccgagctggataaatggctgctggaatgtgacctccacagggttgtcatcccgtaccgctttgcagtaaaccatccggcatcaaggggaacacctggttatgacccaacccatctttttagttggcccccgcggctgtgggaaaaccaccgttggtctggagctggcacgcgtgtgtcatcgccagtttgtggataccgaccacaggctgcaaaccgaggccggtaa

SEQ ID NO: 86808 - DNA, 240 bp, Glycine max
  Peptide Sequence Number=SeqID_203586
atgagccactgcaagagagaagaacccaccgcggagagagtgaaccgagtgaggaagaatgagactagaagggagaacgagagtcacgcgagagaaagggtcgctggagagaaaatgaggtccatgaaagaggagaatgatcaattggtagcgacatcgatatccaccgccactgcgcagcggattccagcgggcgacaagcatcggctattgaattcacttttgatgcactattcataa

SEQ ID NO: 86809 - DNA, 354 bp, Glycine max
  Peptide Sequence Number=SeqID_203587
atgcagcaacgatgtctatattatgatgctaacatactcatgaagtactatggtctaagtactaagcagtatgagataggagtgatatctattgattctgtttgcatatgtttgcttattagtatattgcagtattgtatatttttaatagatggtggtaatcaatttgttgtcactctcatctgcagaagtaacaaatccgggaagtcttactctagaaatagtccagcaggggagattgatcattctgatctcctcctgagcatggatgaacagatatcaagagcaaaagaagaggcttctagtaggaaggctatcatggagaagtgggtgttagcatgtgatgaggagtga

SEQ ID NO: 86810 - DNA, 513 bp, Glycine max
  Peptide Sequence Number=SeqID_203588
atgtcgagatgccaagccaataactcaaaggaagaggaaaatgggagaagagaggtgccaagcatctcgacaagaggtctccaaactaatgccatcccaattcatctaggaggtggattgcaccaatggttgtcaaagttatggtcaaaaagtctaatggtagggaggaatttagaggtatatgtagatggcatggtcatcaaattcaatgacttgtcaatacacatcaaggatctagaggaagtgtttgctcaactccgaaaatacagcatgagggggaagtttctaggattgatgataacccataaaggaatagatgcaaaccttgataagtgtcaagccatttttgaaatgagaagtcacatgaacttggaagaagcgcaatggttggctagctgtataacctccttatttagattcttgccaaggatagccaagaagagactcatcatgtacctcttagtgtccgctgaagcccttggtgcagtccttaagagcatgacaatgagctaa

SEQ ID NO: 86811 - DNA, 249 bp, Glycine max
  Peptide Sequence Number=SeqID_203589
atgtcacttattacctccacattggctgatttcaatgcaatagacccagttgtaataagtgttgaaatcactaactacatgagaatagctagagaatgttacatgacaagtcttaagctaggcctcttaacgaaagataagcctcgcaaagctgtacactatgtggagattgtgacaagggatgaggggttagaggagttagaatttgatcctagaaccaatgatgataataggggccaaaccagttga

SEQ ID NO: 86812 - DNA, 483 bp, Glycine max
  Peptide Sequence Number=SeqID_203590
atgggagttgaaaaagatgggacaaaaagtggaggaggttatgttggtggttttttccagttgtttgattggagctcaaaatctcgtaaaaaattatttgcagccaagtcagatttaccagagtctttaaaactaggaagaaaagtcgattacaatgtggttgatgaagatgaaattggagtaggggcaagtgttagaggaagttgtgatcatagttatgcttcatctgttacggatgatgacgcatatggaacaagggcccctagtgttgttgccaggcttatgggattagattccttgcctccttccagtttttctgatccttattctaccccatactttgatacccggtcccttcaagactctcattacttcaagaaaaaccttggtcaccagcatgaccatcataccccatattctggaaagctggttgaaaaggttgagggctcttctaggaacttcatggatccaaagccgcaaaag

SEQ ID NO: 86813 - DNA, 1764 bp, Glycine max
  Peptide Sequence Number=SeqID_203591
atgacaggccagaaagagcatcctgatgttaaatccaaccaaccaatgaaggcaactgttcagaaaaatttacataagaaatcttctgttcagaattcttctggtgctctcagacagaataatctgaaacagaattattcaattgacagagacaaattaccatcaaagccattggttaccaattcacacaataggaaagttccgactggggattcctcttatggacgccatagaagctctagtaataaatccaatgcaaaatctaaagttgggtccagaaagtcagccatggaggtgacagatagtgaaaaggaagtcttatataccagcacaaacagttttcctagaaagaaaaggtctacagacaaggactggaatgatagggttgtggataatttgttcattgaaaaaacgcagaagcctgctaagtctaacccagtgagtaataaacaaagtagttggactgaagaagtcaaaaagaaagacatggatgtagtttccttcacatttaccacaccattaacaaggaacaatccaggttttgagacatctggacaagctggccagaatactaatggtctttcattggatcaatgcattaaaagagtgttacttgacccagacaatacaaagtctccaataggatacaatataattggtggtggtgatgccttaggtatccttttggaacagaagttgagtgaattgactaatatggaaatcacttgtcatgactcttctaaagtgaggcaacctgccatcactgcgccaatgtcagatgatcaagtagccagacataatatagttaatctcaatccaaggttgcgacagaaaaaagaccaaggtgtgttattttcagacaagttaagcagtaactatgattcagacatctccttcactggtcctcctgaattgtcattgacgcgtaactcatggattgatgagatggaatcacagttactcaattgccgacacccaagtccaatctctgttctcgagccttctttttcaattgaaagctgtgaatcttcattgagcacagatattactagtacagaaggagtcctaatacttaatctactttcaggaagcaagttaagctcatctgttcaagctcacgaagttcatggcttgagtttttcacggaagttctatccttgtgaatctgataccgagttatctgactcagcttcttcaacattagctgggaacatgatgagaaagcacacaagtacaacattttctgtcacaaggtttggaaggtcaagcacatgggagttgaactatgtgaaggatatattgtgtaatgttgagttgatgtatgtagacttttcccttggccaagcaagtgaggttatagactctcatctattcaaacagttggaaggctgcaagggagggtttaagcgcgatgacgagtctaggatgagaaggaaagttacatttgattgtgtgagtgaatgtctgggcttgagatgcaggcgttacgtagggggaggatacaaaatgtggaccaaagggtttgaaatggtgaaaagaaaagaatggttggcagaagatgtgtacaaggagatatcaggttggagtggaatgggagattcaatggtagatgagcttgtggacaaggacatgagcagccaatatggaagatggctagattatgaggttgatgcttctgaactcggatcagaggttgtggaccaaatatttaattctttggttgatgatgttgtcactgaaatgttgcaattgtatacaccttaa

SEQ ID NO: 86814 - DNA, 713 bp, Glycine max
  Peptide Sequence Number=SeqID_203592
gtggtctgtgatagctggacatttaccaggaagaacagacaatgagataaagaactattggaactctcaccttaggagaaagatctattgcttcatgagatctctaaatgagtctcttccacccattgacatggctgctataaactctgccacatccaagagaagagttcgcggttcaagaaacaagccaaccacagaagaggaaaagaacattgctttgagccaaaactcctttgagtcaatgcctagttgcaacagagaagaaggtgaagaaatttccatgatggatgcttgttatgaaatggagggcattacagttagtagcaaagctgcatcataccccagtcttgaagacagcttgggaccatatcatcattggtctgatgatgaaatcatgaaacttagtaacatgtttgaaaatggggtgcttgtgaatccatgtggtaatgatttaacccttaaggaggagcctaatggaaatgaatgtggccagatgaatgtggatgtaatgggaacagatcaaagcaagaacaatggtgtttggaactcatcaaatggagagagtggagaatggtaccccaattgttcatcagtgaattctgtcattgattatcagtggtctgattgggacatgggaggaagtgttcaatccaataatcagtggaatctttgtgatgaccaagtgatgaattgcttgtggagtactggcattg

SEQ ID NO: 86815 - DNA, 267 bp, Glycine max
  Peptide Sequence Number=SeqID_203593
atggggagatctccttgctgtgagaaagtggggttgaagaaaggaagatggactgcagaagaggataaaatcttaactgattacattcaagaaaatggtgaaggctcgtggaaaatcttgcccaagaatgcaggtttgttgagatgtgggaagagttgtcgactgagatggatcaactatttgagagctgacgtgaagagaggtaacatcactcctgaggaagaagagatcattgtcaagttgcatgctgttcttggtaataggtga

SEQ ID NO: 86816 - DNA, 183 bp, Glycine max
  Peptide Sequence Number=SeqID_203594
atggcagggtatgataaggaagactatttctctgccccgaatgccgagagtgacatagctgcacgtgtctattttcattggtgtaccgtgtacattacgttgtacccatgtactctttctagcttcatcgtggttgtaccatgttacagtcatgtcaaacaaattattgcgcgtaatatatag

SEQ ID NO: 86817 - DNA, 687 bp, Glycine max
  Peptide Sequence Number=SeqID_203595
atggcctctaccacatgtttgcttcctcgtctattattcaccatgttacaggattgttactgcttaactgttggaacagttggcgaaatcattattgatgctccatggagttatgatagttgtcctaactgtacaaccacatttgatccatcaaaaggtggctcagcttgtcgctcttgccataccagtgtggtcgatacagttccacggatggagcataatggggacaaaggaaacttcgttctctgggatgcaacatgtatcaagctgtttggtaaaactgctggagaatgtcaagatgagttgatagtggctggggatgatattaaggtatttccaacgtgtgttgatgaaatcctgttgaaaacttgggctgtcagatttaagttccgttcacaattatgccaatcatctgtgttggatgtgagtgaagaactccatcatattcaatcattgatagccacccttgggttgaaggaacaatcaaataagggaaaaggaatagctgttgagccagaaagttcaccaccaatttttgttcccacgtcttctgattacgatcctggaaactctacctgtttaactccaaccaaaaggattagttgtcagcaaaccagttctgattttgattctgatgagcatgcacagtatcagttatcaactaacaaacatatcaaggctgagtaa

SEQ ID NO: 86818 - DNA, 747 bp, Glycine max
  Peptide Sequence Number=SeqID_203596
atggagaagtctttaaaagttcaagacaaaaagagcacaaaaaacaacatctctagggatcttcttcagaaacacagaaaagaccctttacaagaagtggaacccccaaagaatgagtttcaaaagaagatctcaagggaaattgatataaagatggttgcggaaaaagttagtccacgcttatcagtttgggatgctgtcaaaaagaaagggttcaagctatactacaatgaagagatgccctcaagaaagatgaagaagctgtttcgtattcctgatgatgcttatgatgtcaagaccttctggaatcagactgtgtggatggaccctcaaaaatcctccacttatggttatgatagaggtgacaatgttgagcaccacgatgtcattcaagaattacatcctgttaggaagaaccacttttatgatgcttgtgtctgcttcacaaaggatatgctacctcagtccaagctaaagcatctactaaagttatggacgacactattgtacgtggggtcatcatttaccaacaatggggtcatgaacgaaactcctgaggaatctaatgcagccatagttgatgaagttgaacacaccgttatagaactagcatccaagttgtcaacaacttcaaatgaggctacttctagaggcaagggcgaacctgatgttgtcatcatctactccaccagtttaggccctactcctttgaactatgcacaacctgctattgttaccagggaccaa

SEQ ID NO: 86819 - DNA, 555 bp, Glycine max
  Peptide Sequence Number=SeqID_203597
atggagaatctcacctttgacctaccacacaccatctacatcaacatattgagaaacctgaagggattaggtggtctagacaacatctattacactactctcatcaacacgatgttacgggatcaaggtgtgtatcacgttttcaacaagatagacgaagactctaagcacaccttaataaataagggtttagttgttgctaaacaacaaaaatttagaaagactaagttaaaaccaatgaaggttgctttagaacaaagccataaggaggatcttttggtggatttggacaccatcaacaagaggaagctgaagaggctagccaaaaccattgctgatgaaaatcaaggtctgaatagcttcagtatctccaaaaagataagaagattttggttgagcaatagaagagataaaagacaaggaagcaatcccaaaatgaagaagaggaggaagagttacttgccagggaacataggacaaagaaaagacattatctatctactgcatccacccctatgcgtccaacagctgcaacctcagtcccacaaaggttga

SEQ ID NO: 86820 - DNA, 375 bp, Glycine max
  Peptide Sequence Number=SeqID_203598
atgcaacagggacaggcatacatccccatagttaggttccctgaccccccaactatggagaaaggcctagaagtcaagattaccttagagaagctacaaaatgaaggattggggattttctccatcgaatccttgaggaggattctgaggattccactcggactacaacgttcttcttggtgtggaggttcgtctgcaagcaacggcggctcgtggtggccatcggtggttgtgggtggtggagaagaaggtgttaggatttggatctcgcttaatgagcttgtctcgctaagtgggagtccacttttcgcgcttagtgcgacaattcacgctaagcgcaactccctctacactaattctcgcttagcatgctaa

SEQ ID NO: 86821 - DNA, 618 bp, Glycine max
  Peptide Sequence Number=SeqID_203599
atggcagggaagcggttacaaataaaacgcaaaaatatgattactcttactcaaatttggatgagcttcatcctgagtaatgttcttctgagtgatcataactctgatctgactctacccaaatgtcagctgatctacaatattatggagcatatcagtgttcatgtggttcaactcatttcagatgcccttcaccagtttgttattatagaacctcctgggcacccagtggacccagaaaaatccaacaaggcactgggttttcctgctttagtcataggtacagtaactggagcaagttcatcagcctcaggcagcagcagatgccccaccaccaccacaattgccatccttggagtccatctcagcacacctgcaaaggatggagctttagatgcacacttacatgcgtcatttagcttatcaacaagtatcaaatcacaggggctagatgcagaccctaacccttacccttggcctactcccgagaaatttagagctactgttgcatggcttgaagacatgcctatttttcaggaggaggcaggtcctgcagatgtccaagaagctgcccaaggagatggagcaagagtagaggaagatgaagacatggcatag

SEQ ID NO: 86822 - DNA, 357 bp, Glycine max
  Peptide Sequence Number=SeqID_203600
atgcattattattttgtggtctccagccataaggctgatttaaacttgagccacctttgtatgcttggtagtctccttggaagttctgttgaggtctggcttgattctacagataataagcctcattttcctgttgacaatcaccaggtgctgaatagtggctattctaatggtcaccaccacagaagtcacatcttagaacttgttgaacttgatgagcttggtgtgttttctatgatccaccttgttgatattgttgaggaagttggcctatttgtttggttaaggcctctatttgctgagtcgagagtttattctgagcaagaattgcattctaagtatctagctccattataa

SEQ ID NO: 86823 - DNA, 309 bp, Glycine max
  Peptide Sequence Number=SeqID_203601
atggtggctcgtggcggccaccgatggtcgtgggttgtggagaaggaggtgttagggtttgggtggcgttttggagaagagagtgaaaaatcgtgttttcacgctgaggaatcgggtcaattctcgcgcagcgcaattccctctccggttgaaattgcacttagcgcgcccttcatgcttagagagacatcaaaagttgttattttcaaactcccaacggccagactgtggataaatgtcttaggaagctctagacaaaatttgaagatgatccaacggttaacaaatccgggatcgcgattttactga

SEQ ID NO: 86824 - DNA, 554 bp, Glycine max
  Peptide Sequence Number=SeqID_203602
gcacaagggggaggaggggcttggtcgtccgtccgcccgggcacacacctagttagcaccaggcaggcaaaacgagagagagccgacgaacgggtttgttggagatttggaggggagggacgaatcaaagcgacaagggctgaatctcagtggatcgtggcagcaaggccactctgccacttacaataccccgtcgcgtatttaagtcgtctgcaaggattctacccgccgctcgatgggaattgcgcttcaaggcgtctcgtagggctaatccgcctcacgagggtcaccaacggcacgactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattctcgg

SEQ ID NO: 86825 - DNA, 615 bp, Glycine max
  Peptide Sequence Number=SeqID_203603
atgaaggcaaggagaggaaaacgctcagaggctttctggccttccattgtgatgaaaaaatggttaaacatcaagcctaaggtgaatgattttagtgaagatgaagtggacactgaaactgaaagtgaagatgatgatgcatctccttgtaagggccgcaagacaagacacagaagaggaaaatcagaaactctgcgtgctcagtacataaacacgaaggaaatgagggtaacaattggcacatggaatgttgctggaagacatccatgtgaggatcttgagattgatgactggctttgtaccgaagacccagctgatatttacattattggtttccaggaggtagttccattgaatgctggaaatgtgttaggagcagaagataatacacctatcccaaaatgggaggcaatcattcgaagatctctaaacaaatcttctgagcctgacagtaaacataaaagctacagtgcccccccttctccagtgttaagaacttcttctgctgctgatcttcttgcagatactatagatgctgataatccaattccaatagatatgatgattgaggagtatgtagcaacagttgataataatgagatggaacagcaggaa

SEQ ID NO: 86826 - DNA, 198 bp, Glycine max
  Peptide Sequence Number=SeqID_203604
atgtcttttgggttcattggaagaagtgggtacaacttcttggttattatcactggacacaagggaccaacgttccttgggttcgttgcaagaagtgggaataacttcttggttgtaatcactgaacacaaagaaggggattcctttgtgttctggtcgagtttagtccaacaagaggaatctgaggatgatgcttga

SEQ ID NO: 86827 - DNA, 267 bp, Glycine max
  Peptide Sequence Number=SeqID_203605
atggaagcatggggtagtgttaaagattgccctactcggtctaagtatgaggggcatgtcaagatgtttgaaataatatgttcaccatgggagtactttcttgaggttgagtctgcacattggagcttaaagaggttgattcataatagcattgggaacttgtgtaaatgttgggatgccataaacaacttgattatattgcagcatactgaaattaatgcatcatttgagaagagtgatgtgccattattttctcctatttcttaa

SEQ ID NO: 86828 - DNA, 339 bp, Glycine max
  Peptide Sequence Number=SeqID_203606
atggagaacaatggcggtttgtggtggataatggtggtcatgggtgatggagaaagtccttgggacgttagaaatggctttggaagaaagaaagaagaagaaatgacgtttttcctaagctacacgaaagcaaaggctgacacgctcaactgcaaaccaaatgtagagaagctccaacggttaacgaaggctgggcagcgtttttaccgagggtgttacactaaccaccataggaggccatggataagagcttggaggaagaaggagatgaatgaatggagaggaagagaagagcacaaaattttatgctctaaaagagctctgaaatctgaagtttaa

SEQ ID NO: 86829 - DNA, 1503 bp, Glycine max
  Peptide Sequence Number=SeqID_203607
atggagcgacgccaagaggaagagttgacaaagctaaaggctgactatggccgactagaggcttgtgccaaatgtccccaggatgatgatcaatcctcctacaccttgcctaaacgcacccaaggggaatcacacccccgacgcacaggcaacactgcagacgacctaagtccctcctacatgcaccatctagcagcacagactgtctgtcagcatccttttgtcgacctcattatggaggaagacatacccttggggtggaaaccactcaacctcgagtggtatgatgggacaacagatccagacgagcatctagacgccttcctgacacagacgaacctctacactaacaacgatgcgattctatgttgtgtcttccttagatctctcaagggagcaacattgacttgtacgccactagtaggtctcactgcatggcctcagctgccttggccggtctatgacaagcagacaatgagtctctcagaaagttcatggacagatttgggcgcacggccatccagatccaaaatctcaatcctgagacagaagcacgacaagcgcgaggcacacaccaagcctgactcgcataagttggataagaggcacaagccaaacaagcaccaacctctctccaaagggcctagcattcaacttggagttacctatccggctaccctagatgaaacctccttggcggggttagacgcaaccaaatgctatcgatatctccacggtattggtcacaacatcgaagactactgggccctgaaggacaagatagaagaacttatacatgctgagtacttagcccagtttgttaagagatcagacaaccaccaagtaggaccaagacatggaagacatccagaagagcagaacaggaaccaggaagtagacagaagaagagcagaagacaaaggcaaaccaagacaacaacaacagcggcgtgagcgacaacctccaccggaacaggaatccgcccaacacattagaggtgtaatcaatagcattgttggcggattttcttatggaggacaatccagccaggacttcaagggaattaaccccgtcaaccaagacgaccttgtggttgtctcaatcattatagaaaacttcatggtgtccaaggtcctcatcgatcagggcagttctactgacatcttgaagacactcaacgagcttagagccatagtctccacacctcatctgacaatgaaattccctacattgacatgggagatcgcaacagtcaaggttgaccaaaagcaaacacgacagtgctatacaaagagcctgaaggtaacactgtatcctcccatttgggagccttccatgcctcaccccacagcaactgaaggcactcaagtcatgacggtggatgaagggtctcaaattcgagctctgaccgtctaccaatctagcttgaacagagaatttgacatagatccacaagacgaaacctccgatagagacccaaaacccatcaaagagcttgtctag

SEQ ID NO: 86830 - DNA, 228 bp, Glycine max
  Peptide Sequence Number=SeqID_203608
atgacgaatgaagaacaatgtagaagtcgattacggtcgccattcggtagtgcctcaacctcatttttcttttatttcttcttcttctctcggatttctctcaatttctctcaatgttggaccttggaaccccttactcagcctccctcacacctatttatagcaaaagatggcataaggggtcatggcagcttgcccaggcgagccagggttcagaaaaaggcttaa

SEQ ID NO: 86831 - DNA, 852 bp, Glycine max
  Peptide Sequence Number=SeqID_203609
atggttagaactagagaattgcgtcgagctttaggcagagttataggacaaggcttaggaacacaagttagtggtgatgtggatgaagcccctcaacgtctaaggtcgatagcattcgcaactgacgcggttcatgagcaacctcgggaggcagttattaatgatgtacatgctgaagctcagggttttgcaagcgggcccccacgatacataagttttgatggaatatgttcatcatgtggcagccacagtttggaacatcctaagttgaagttgtcctctcatgaaaggaaggtacaaaaatttgaaaggtctactccaaagattgaaggcatagtagttaccacaagattaagtcctctgattgcatgttccttggacattggtgacagaggacttatatttgcttttggggagaggtggcacaaggaaactagtagtttccatcttctaccaaattggaagctactcatggggagcagctacactggtccatattgttggatctacaagcatttccctactattgtttcttgtattgttaatgaggattatcatgagaggaaaccatgcgtttgctgttggaagtctgggaaggcattatcggtgtcgacgtatcgtaagcggttagataaattgacgtctaaggttgtgtgccggattccttatggttaccaccgtacattcagagaatttgagctgatatccttattcttcggacaaatcagatggggtccatcaattgtgatacaccaaccagagagggttatgcaacagtttggttatgtgcagaccattcctccacaccctgttgtcctatctttatctataaaggagattgacgataaatga

SEQ ID NO: 86832 - DNA, 432 bp, Glycine max
  Peptide Sequence Number=SeqID_203610
atgaagctgtccctgaagttccaggctgagaatgcagccaaaggtacccatcaccatactcaacaacccctttctctcaggcgtcacagccaccgactaccccaacccacccttccttcttcctccacctcaaaccccaattcggtcatttctctctccacaaaacacccggaattctcacccatggatcttccaccacggctgttgaagggaatgtgtttttggatgggaagagatttggagattgtggaaaaggaaaatagggagatgaagcgtttgttggatgagatgaaattaggaaggaataatcgccttgaggagagcaaaggtggtggaaggaagctgagtgaaagcaatggggaggttcagcgttggagaagttacaagagtgaaagacaagagtgcaacaaccaaacaaaccgcaaagtgtag

SEQ ID NO: 86833 - DNA, 1628 bp, Glycine max
  Peptide Sequence Number=SeqID_203611
tgaaccaagctctggcaactcttgcattttttgggattggagtgaacctagtgttgtttctgacaagggtggtaggacaaaacaatgctgatgcagccaacaatgtgagcaagtggaccggaactgtttacatcttctctctagtgggtgctttcctcagtgattcttattggggaagatataaaacttgtgctgtctttcagggtctaatgtccttatccctttcatcatacctattcttgcttaagcctaaaggttgtggtaatgaatcagttaattgtgggaaacattcaaaattggagatggggatgttctacctctcaatctatcttgttgccttggggaatggaggttatcaaccaaatattgccacatttggggcagatcagtttgacgaggagcactcaaaggagggtcacaataaggtggccttctttagctacttctacctagcttttaacattggccaactcttctcgaacaccattctggtctattttgaggacgaaggaatgtgggctcttggtttctggctgtctgcaggctccgcctttgctgcattggtcttgtttcttgtatgcaccccaaggtatagacacttcaagcctagtggcaaccctctctccaggttcagccaagtccttgtggctgcatcaaggaaatccaaagttcaaatgtcatcaaacggagaggacttattcaacatggatgcaaaggaggcttccaacaatgccaatagaaagattctccacactcacgggttcaagttcttggatagggcagcgtttatatcttcaagagatctaggggaccagaaagggctcggttacaacccctggcgtctctgtcctgtaagtcaagttgaagaagtgaagtgcatactgagactacttccaatctggctctgcaccataatatactcggtggttttcacacaaatggcttcactttttgtggagcaaggtgctgccatgaaaaccaaggtttccaacttcagaataccaccagctagcatgtccagctttgacatcctcagtgtggctgttttcattttcttttaccgtcgagttcttgatccgtttgtgggaaaacttaaaaagacagattctaagggacttacagaacttcagagaatgggagttggacttgttatagctgtactggcaatggtttcggctggattagttgaatgctataggctcaagtatgcaaaacaaggatgcatccactgcaatgactcgagcactttaagcatcttctggcaaatccctcagtatgcatttataggagcttccgaggtttttatgtacgtaggccagttggagttcttcaatgctcagacaccagacggcttgaagagctttggaagtgctctttgcatgacatccatttcccttgggaactatgtgagtagcttacttgttagtgtggttatgaagatatccaccgaagatcacatgccggggtggatccctggaaacctcaacaaaggtcacttagatagattttacttcctcttagctgccttgacatcgatagacttgattgcttatattgcatgtgcaaaatggtacaagtctatacagctagaggcaaacactggagagattgatgagccagaagtataa

SEQ ID NO: 86834 - DNA, 428 bp, Glycine max
  Peptide Sequence Number=SeqID_203612
gtagccatactataggaagagcaagatgtctaagcttcaggcagaggatatatgatgcaaaagaggaatatcactatggctatgatcactacaaacgatacacaagtttcaggagaatcctgcggtccatatgccctgttgagggaagggacaataaatttgcacccttggattttcaaaccccaaaaagatttgacaatcactacttcataaacattcttgaagggaaaggcttgttaggttctgacaatgttcttatcagccatgacttagatggaaagattacagagcaggtgtgggcttatgcctctaatgaaaaacttttctttgcttcatttgctaaatctatgattaagatgggaaacatcaatgttcttacaggaaatgagggggaaattaggaggaattgtaggtttgtcaacgcttag

SEQ ID NO: 86835 - DNA, 732 bp, Glycine max
  Peptide Sequence Number=SeqID_203613
atgaaaatagcgctcatcccatcaccgctatctcgctatagcatttttggagggctgccgctctgtgctacaactcatttcacttcttatatatcttatgaagctgctaagcccttgttcttcttgcaccacagaatgaagacactagtggaatacttcaaaatatctttagattgcttttttgctgtatggtttgttgttggaaatgtatggatctttgggggacattcatctgttgaagaagctcctaatttgtacaggttatgtatagtgtttcttgcatttagctgcattggttatgccatgcccttcattctctgttcaacaatctgctgttgtctcccttgtataatttctatccttggggttagagaggatatgtcacaaaatagaggggcagcttccgaatctattaatgctttgccaatttacaagttcaagacgaagaaaaataaaagaaatggtgatagcaactcagctgctgccgaaggtggagttgtggctgcaggaactgaaaaagagcgtgtgatatctggagaagatgcgattctgccatggcatccattgccgtggtggttctcgacgttaaggactcccgcgattcgatggcatccgacggcgggaagggcagatcttgatgaagaggagtcactgcgtagacgaacattgtcaccacttccaaagacacctacacggatggagatggggatgatgagagaaagagggcagtaa

SEQ ID NO: 86836 - DNA, 252 bp, Glycine max
  Peptide Sequence Number=SeqID_203614
atgaagcttgagtgttggtctagttgtacggctcaaaattatgtgcttatgatgatgctatgggacttggataatattctacaaggctcaggaaacacacaaagaaatgaagctggaggagctgttgacagtgacgatgatgagatggatctagatgatgatccttcaaagattaataaagggaacaagagaaagaatgcaaataatgggaacgccctaggtggttcgaacaacttctttgcagatttgtag

SEQ ID NO: 86837 - DNA, 255 bp, Glycine max
  Peptide Sequence Number=SeqID_203615
atgtccatgaggaaactacatagttttggtaatgtgccaaatgggatagtaaaggatttgattaaaaccctgagagaggtcatccatgaagagtatcacgaggtggttgagagacatgatgttcgtgataggaccttattttattacaagtttctccaatacaatgtatcaatggcaaatagtgtggttaaccctgcaaagcaagcagtttcagtaattgttgatactcagggtagtgaaataattattcaatga

SEQ ID NO: 86838 - DNA, 228 bp, Glycine max
  Peptide Sequence Number=SeqID_203616
atgactcaattagtatcacgaggacatcttagagttggaccgttacgatttcttgaagcaagacttatgagtcaagtatacgaaagtaagaaagatcatgttgaaggaagaggcttagactcaaggaaaaaggaatcgcatggagacagtacaagcggaggcttcaatctcttctccgtctctctgacgttcgagaattctatcggagcagtcggaggaaaaacttga

SEQ ID NO: 86839 - DNA, 255 bp, Glycine max
  Peptide Sequence Number=SeqID_203617
atggataaaagattgtctctcatatctggaattgttgtgggcaaagttccttggaagctgaaggatcatgtaattcgtcgctgggcattgctagaatccagaattgccaaccaatttaatagcattgagatgcttctccctgatgaaaagagtgggaagattcatgcaactataaggaagcatttggtagataggtttaagaatgttcttctcgaaggaagttgttatataaatgagaacttattagtttcctaa

SEQ ID NO: 86840 - DNA, 279 bp, Glycine max
  Peptide Sequence Number=SeqID_203618
atggagataaccattatccacattgacaatgaaccctcgatctatgtcgaagatttctttgatatccctgagcctgaaaaaggaacaaaagtggtgctctccaatgactctatagccaaagccataagatgccttcataaaggtggagtggataacatctactatgttgccatgataaacaaggtgctctggaatcaaggtatttatcgtattgttgaaaggatggacaaagattccaaacacaccatcgtagccaaaggttcagttgttgctaagtag

SEQ ID NO: 86841 - DNA, 279 bp, Glycine max
  Peptide Sequence Number=SeqID_203619
atggttggatcactacgaaggggagatttcaaactcaaaagcttctgtgatgctgactatgttggagacaaagtcgaaaggaaaaacacaagtggaagctgccattccattggtggaaacttggttatatggatatgcaagaagcaaggttcaattgcattgtccattgctgaagtagaatacatgtcaactgcaagctattatgctcaactcctttggataaagaacctgcttgaagactacaacatctatgagttcccatttattgtgataaaatag

SEQ ID NO: 86842 - DNA, 203 bp, Glycine max
  Peptide Sequence Number=SeqID_203620
atggaagaacaattggcttttgtttctactgctaaggaggaaggtgctacaatccaagttgaagcttttgtgaaagttgtggatgacaacattgttaataaggtcattattgatctcataaacactggtgttatgaatgaatctccagaggtgtccaacgcagctatagctgatgaggttgtccatcaagacaaagaatatgc

SEQ ID NO: 86843 - DNA, 138 bp, Glycine max
  Peptide Sequence Number=SeqID_203621
atgatgatcaacattgtcacttccatcataccagatgaggaggccttcaacgaagactttgtaaaaggcattttacaagagagtggaaatctcaagcgggttgcttggggactagacgtaggcacagggcgtggctga

SEQ ID NO: 86844 - DNA, 720 bp, Glycine max
  Peptide Sequence Number=SeqID_203622
atggaaggtttggtgagttctgggatcaacacagttcgtgtttttagcattacaaaccaccaatctcgttttcttccttcatcaactctgcatctcaggaataatagtttgtgtggatttggaattggagttgagaagaagaataaacagtgttccgttgtggctgcttctgttgggggctccaaagtgggccattttgagaacacactcccttccaaagaggttcttgagctttggagaaatggtgatgctgtgtgctttgatgtggatagcactgtgtgcttggatgaagggattgatgaacttgctgaattctgtggggctggaaaggcagtggctgaatggactgctagagcaatgggtggttctgttccgtttgaggaagccttggctgctaggctgtctttgttcaatccctctttgtcccagcttcagaattttcttgaacaaaagccaccaaggctttcccctggcattgaagagttagtccagaagttgaaggctaatggcatagttgtttatctgatctctggtggcttccgtcaaatgatcaatgtacagagaatattgcctgttgcatcaatacttgggattccacaagagaatatttttgccaatcaactactttttggaagctctggagagtttctggggttcgataaaaatgagcctacttcaaggagtggaggaaaagctgttgctgtccaacaaatcaagaag

SEQ ID NO: 86845 - DNA, 348 bp, Glycine max
  Peptide Sequence Number=SeqID_203623
gtagatctcggtgagagccttgctttaggacttgaggtggttcagcagatcactgaaaaatgtcaaattgattcaggagaggatgagagcagcccagaattggtagccttgccaccatctctctccaatctccatagtgtcttccatatccctcagctcaaaaaatatgttcatgattcatcgcacgagatcgagttagacgatgtccaagtgaaagagaacttaacatatgaaacactgccattaaggatcgacaaccataaggtcaagcaactgagaggaagggagattcctttagtcaagtggtatggagaaatgcttatggcgaggatgctacttgggagttag

SEQ ID NO: 86846 - DNA, 1557 bp, Glycine max
  Peptide Sequence Number=SeqID_203624
atggctaaattttctccagaagaagtcactgctcttcaagcaggtggcaatgagagggcaaagcagatttattttaaagaatggaatcctctgcgccattctcaccccgaatccggtcctcattcatgccctggtgctagtagtgatgacaagaatctcagatttttatatgatgaaagcagaagtcctagatatacgcaaaagtattctaggaatgccggcctgaccaaaagtcctataaaaattgaagttgttgatgacaggttccgagacaaagaacatagaaatcgcaggctatcaaacatagaatcaaagttaaaacaaatttcaattgatgatcagaagaatgtagacaaatcacaacttcctgttgcacgtccttcgggagaaatattaagggagaaagcttcatctctacaagtctcacattctggtggcaagggttctgttgaggaaaatccatctgaacaaaaaaataataatccagaaaggtccattaatttgagtactaagtctcagcctactaattctgttgctggaggaggaccagaatcaccaccacatataacacaatcaaatgaaaataactgggccatatttggagcttcaacagaaaacaaggatcctaaatctccaaacacaaatacctcaaaaccttctacaacaaatgcagcatctgaagcagcaacacctgctaaaaatcctctagatcttttacttttcgaattgtcaggtcctgtgactccagttaccggtgagatgtcacaagccgcaagtggtactaataatgatccaacaactacaacagtagataatgcaaatatttgggactttccacctacttcagtagggaagacaggtccatcccccaacaatactagtgtttggtcatccacattaaccccagccactgagtcagcacaaccttctaatgaagttcttcctcattctgaagtttcacatgcacataaaccttcaagcatgcattatcttccgtccgtatcatcaggttgtagtaaaaccacaccactaataaattcaccagtcaaagatgtagcctcaaataaccagccatcggtagctcctagcacaaatgactctttatgggctcttactgaacaatctcctcaaactacctcaagcatgcaatgtcttcctcctgtgccggcagttgctcctagtacaaataactcttcatggggttttactgaactatcttctcaagctacctcaaaacctactcaagaaaccaaacctgatgctggctcccagctcagtaaagtggaaaccaggtctagtggaagaatggaacttccagaggaccttttcacatcaagctacttatctggccctgcatcacttgcaggttggcagaatgttcaaccttatggcatgggatatggcatgcagtattatcaaaatgcagcgcctccctcagcccttccaaatgcaccgaagtactcaaacccctttgatgtaactgatgggagaagtttaatgcatgtctcatcgcttgtttctgcaattaagcctgaagcttctgatgcaattcgctga

SEQ ID NO: 86847 - DNA, 306 bp, Glycine max
  Peptide Sequence Number=SeqID_203625
atggcaaggacgaaaaatggggctaggacgttgtcatggaagtccaatgttaactccaccatctccacaaatgttttggacaaacacaacatcaatgcggacatccactcgttggtggatctcgtgaagcttcgagtcgatcatcttccaccaatgttaaggtatgtagatttgaggttgtgtgggtatggagatctagatccaaaatgccacaaagagggaaagtcatcccagatccacgaaggatttgggaaaatgaaaaaaattggcagaatttttgccattattgtgcttttgagaagttga

SEQ ID NO: 86848 - DNA, 1302 bp, Glycine max
  Peptide Sequence Number=SeqID_203626
atggcaaaccaaaacccttcaattccaatctcaacccatgaaacaacccaaaccacttcaaccacacgtttctcattcaaagtgatcttacagaaagtgaaaaccaacttggttttacgttcaaaatggggtgaactcaacggtgccatgggtgaccttggcaccttcataccaataaccctatccctcacactttcaagggaccttaaccttggcaccacattgatcttcacaggcatctacaacatcatcactggtgctatttatggtgtccctatgcctgtccagcccatgaaatccatcgccgccgaggccttatcggactccggctttggtgtggcggagatcatggccgccggtatcttaaccggcgtggttttgtttcttctgggtgttacaaggttgatgcagcttgtgtacacgttgattcctttgtgtgttgtgaggggaattcaactagcacaagtttgtttatgttttattgttattgtgagtggtgctggtgagaaggatcaatgtgatggtgaaagtgaaagtttgggtaagagggttgaggaagcaagaaacatgagaaaaaatagagtgaggaggcttgttttctcactaccttctgctttcattgtttttatgttgggtgttgttttggcctttataagaaggcctaaagtggtgcatgaagtaaagtttggaccttcctctatggaggtagtgaagttctctaagcatgcatggaagaaaggttttgtgaagggcacaattcctcagctcccattgtcaattctaaactcagtgatagctgtttgcaagttgtcaaaggatttgttcccagagagggaattttctgccacttcactttcagtgagtgtagggttgatgaatttggttggtagttggtttggtgcaatgccatgttgccatggtgctggtggacttgcaggacaatacaaatttggtggaaggagtggtgggtgtgtggcacttcttggtgttgccaaattggtgttgggtttggtgttgggaacttctttggcacacattttaaggcagtttccagtggggatcttgggggtgttgctactgtctgctggaattgaattggccacttgctgtagggacattagaaccaaagaagattcctttgtgatgcttgtttgcaccgctttttctcttgtgggatcaagtgcagctcttggcttttcgtgtggaatggctgtttatgtgcttattaagcttaggagttggacaattaatgataaaccattttctaccatatgggtgcataaaagctccgagcaactctga

SEQ ID NO: 86849 - DNA, 285 bp, Glycine max
  Peptide Sequence Number=SeqID_203627
atggttttcctgagaaccataaccccacaaaatggtctcaatctagtgcacaagcttcagcattttgctaccatagccctcggattagacaacgacaaagcgggagtagtgaagtttgtctgtcatgggggtgctagagaagaaggagaggtcggcaagacagagggaagcgaggagggaagggggtatactgtggttggtgacatggaaggcgccctagtgggagcaagaacatgcaaggggatcttgatcgaggtagagagggagtcagagagtgagaaatga

SEQ ID NO: 86850 - DNA, 486 bp, Glycine max
  Peptide Sequence Number=SeqID_203628
atgcaaggtcaatactcccagaacgtcaaaacactcttagattccctaatgtcggtgtcagcacagaagagcttcaccgcgactacaccaaatgcactcacgagagcgtaccaatgcagaggggacttgtccaactctgaatgctacaactacatcaacaagattccaaacatgttggggcacctctgcagcgatgatgatgtggtggcggcatgggtgcagctaagcaagtgctaccttcggtacgaggtggtcgagttcaaggtcgtcccggctacacaactattgtacaagattatggaggttgtatcaagagtgttgcggaattggctttgtcttgctcgcaaccactacataaatctattcaacactccgcccagagtgctcgattgcctgcttgaacgtgctccaacaccgcctttagtagcatcgatggtgacaatattgccatttgcctcactcaccaccgatcttccgcgtatataa

SEQ ID NO: 86851 - DNA, 183 bp, Glycine max
  Peptide Sequence Number=SeqID_203629
atggccttactttcaagggacaggagcctcacttattggttggaggacccaacagaacctaatacaactctatcatggaatgtgatccatggaattggtatgattacacatgacatactttcgtcacctagctattatgttgcattgggtaatttggatgaagatgcggaggtatttctataa

SEQ ID NO: 86852 - DNA, 360 bp, Glycine max
  Peptide Sequence Number=SeqID_203630
atggttcgacggcaagcaacagcggctcgtggtagccaccggtggtcgtgggtggtggagaagaaggtgttagagtttgggtgggcatttggagaggaggagagggggaaaaatcgtgtttttcacgctgaagaacatatttataatctgcagatctcgcttagcaagttggtctcactaagtgagagttcacttttcacgcttagcgtgagaattcacgctgagtgcaactccctctatagtaattctcactcagtgcaattccctcttagggtgtatgcaggaaaaagagaaggtgttgggagagcaagaaggaaaaatgaatttgagagaaagagaaagtctagagacgtatcgtaa

SEQ ID NO: 86853 - DNA, 774 bp, Glycine max
  Peptide Sequence Number=SeqID_203631
atgatgaaaaggtcaaccattggcagcggaggttatggtactgttttcaaaggaatccttgcaaataacaaggttgtggccatcaaaaagttcaaagtagtggatcataaccaagttgagcaattcattaatgaggtggttattctatcccaaatcaaccatagaaatgtggtgaaactcttgacttgtctaagaatagcaatagaagcagcaggagctctatcatatttgcactttgatgcctccacatctataatccatagagatgtcaagaatgccaacattctattagatgaaaattatacaccaaaagtgtcatattttggagcttcaagattggttccaattgatcaagtagaattagcctcattgggacaaggaacttttggttacgtagacccagagtacatgcaaacaagccgattaactaaaaagagtgatgtttatagttttggagtagtgcctgtagagctactcacaggacaaaaagcaccttcatttcagaggtcagaagaagaaaaaaaaaataaggagatcaagaaagttgctatacttgcaagcaagtgcttgaaccttaaaggagaagagagacctagcatgaaggaagtagcaatggagcttgaggggacaagggtaacagagaatcacccatccaatactaaccttgatttggaggaggcacaatgcttgaatggcaatagcaatggcgatagaagtccttggtgtgacaatataattgagcaagtacgagttgtcttacatgtcccacgttga

SEQ ID NO: 86854 - DNA, 830 bp, Glycine max
  Peptide Sequence Number=SeqID_203632
atgggatttggagctcgttttgctctctgtcttcgttccaattcgcatttcaataattcaatttccttcttctccttcttctgctcccaatcactcacactctatgaatctgatccccaataccagaatcaccttcaaaaggttcaaaaactcgaaatcttactaaaccacggtcgcacgatcatagcaaagaagaaaaccctcattgtgtttgtcgacgttgtcgattttggtattctactcgatactgtcacttacggaaaggttgttctggcggcagtgatgttgaaggacctcaacaagggttttgagttgacgaaattcatggaaaaggatggaatgggaccttctgtattagcactcacaaagtctactaaaggagaacgagaaagcctcaagtatagattattggttccgagggtgacattggttcctagggccacgagtatgctagcttctagtgatggtgcaaggctaatgttgcttgttgaaagtggtagaatagtatgtgaggcaaaactggttgatgacatttttcaagtactaagaccttataaagttgttccagcaattgcattggataaaacaggattagcagctgttggagttagatttcagtccttgtcaaatctaggatcacggctaccatcacctagtaagacctcagtgatgtcctcttgtagttcaagaggtgttagtccatcgcagtcaaggccttcaattcctcctagaagggctagtccatctcgaatgaggccatccaattcatccaaccaatctaacaatgcattttcagtactcaacaagatgttggccctacatattgagaa

SEQ ID NO: 86855 - DNA, 405 bp, Glycine max
  Peptide Sequence Number=SeqID_203633
atgcaagatgcacaacatgatcaagcacatcttttccttagacatgataaggtgaatttctttattctcatggatttcttgatgaattattgtttcccctcaatggtctatgtttacatgcttacagggaatcctccaatcacaaggaaggttattaaggaaaatgaggtttttaaggttaaaaactgcattactgacatcgatcctaatagggaaaaggaggaaaaggagaagcgtaagaaggtgaaccaaaagtatactccagttgtggaaaggaggcatcaactttctcctgggtttttagaggatgccttggatgaggacgaagcaaatattatgataagcatcattcttagccgcattgaggatgatttggaagcggaagcccgtgcccataagtcataa

SEQ ID NO: 86856 - DNA, 318 bp, Glycine max
  Peptide Sequence Number=SeqID_203634
atgccatgcaccagtggtgccggggaggcgcgccattttggggctaggtcatctaggattgtttcaaccctattgcctaaatgcgggttgggtcgggtcgccctgaccatttccaactcaactgatgaggacatgaccaagagcaagggcaaggatccacttgaaggacttggagggcctatgacaagggctagagcaaggaaagccaaggaagctcttcaacaagtgttttccatactatttgaatacaagcccaagtttcaaggagaaaagtccaaggttgtgagttgtatcatggcccaaatggaggaggactaa

SEQ ID NO: 86857 - DNA, 165 bp, Glycine max
  Peptide Sequence Number=SeqID_203635
atgcggaaattgattaaggaaaggatggaaaataagttggttaatttcgtgggtcttaataaggtggttcttggcataaaatggatgaatgggatgaacaagggtgaagatgaaaggaaggaaatactcactctttccagcgagggcaacacacaaaggttgtga

SEQ ID NO: 86858 - DNA, 387 bp, Glycine max
  Peptide Sequence Number=SeqID_203636
atggcggttcatggcggaaagtcaaaaatctaccataaaaatatggcggatggcgcaacggaaaatggcagatcgttcgtcttcgccatcgtgctgctgttcgcgctgttgttcgtcaccgccgttcgtggtgctgctggtggctacgacgctgctgggtgtgggtgctggtcgctacttcgcggggtcgtgctgctgccggtcgtcattgctggtagtggtggctgctgggtgtgggtgctggttcgctgctgttctgtttctgttcgtggctgctgcgcttttcaaaatatattatcgggtagggttaggtcgggtcagaccaacacctaccgcgaaaaaaacaaaaaaggccgctattccgcctttcccgctattccgtcatga

SEQ ID NO: 86859 - DNA, 243 bp, Glycine max
  Peptide Sequence Number=SeqID_203637
atggtggttcttcctaccatagtcctatcaagtgcttcttgcacaacttgttctgattgcacatccagggcacttgttgcctcatcaagaagtagtatctttgggttgcgaattatggcccttgcaattgcaattctctgcttttgtcctcctgatagctgcactcccctttctccatattcagtagtatctttggataagcaaagagaagtttgctacatgaacaccagcccttttatttaa

SEQ ID NO: 86860 - DNA, 354 bp, Glycine max
  Peptide Sequence Number=SeqID_203638
atgggtttgttccatcaaagcgcgggacctcaagtttcatccaatgggaatgtggagaaggtgacacaattgagtgagggttcgtggacgaagaggaaacaggtgcttgggtggattgctcctgcgtttgggtcgttggttcgtgtccttagtggtgtgttgttggtttgttgcctgcttcctaacagttttgtttatgatgaaacatacaattacatccaaccttcaatgaactctaaaatagtaccttatatcagtgttatcaaatggcggctatggcggcgccatggcggaaaagcgtggcggaattttgtaaaaacgccaccgaataacggtggcgtggcaggttgctaa

SEQ ID NO: 86861 - DNA, 747 bp, Glycine max
  Peptide Sequence Number=SeqID_203639
atgaaggaggaagatgtgagcaaaaccaccttcagaacccatcacgaccactatgagtttcacaggatgccctttggcttgtgcaacgccccatcatccttacaggccaccaagaacagtgtctttcaaccttacttgtgcaaatttataattgtttttttcgacgacattgtgatttatagcagaacatatgaggaacacctatttcatttggagcaaacttttcagacgttactggcgggccaattcttcttaaagcaatccaaatgctcctttgctcaaactcaagtggaatacttaggtcacaagtttacatggactacagaggcccataatgcattcgagcaattgaagaatgctattagcaaggcaccagtcctgttattaccaaattttgcttttccctttgtggtcgaaatagacgtgtcaagagtggggatgggagttgtgctctcacaacaaggacaccctattgcattttttagcaaatgcttcttccccaagcttctaagctcatccacatatgtccgggaatttgcggccataactgcagcagttaaaaagtggagacaatgtttactaggtcatcctgagctaaggcttgaagggcatcagctatcgcacaatcattccgtccagccatcactccctatacacaccagggagttaaacatggaaggaatacacacaaacaaagaaccacacaacaatcacaaccatcccaaattcctactcaattactcttga

SEQ ID NO: 86862 - DNA, 894 bp, Glycine max
  Peptide Sequence Number=SeqID_203640
atggataaaagcaatggttgcagcttctctagcatatcttcaattgctgtcttttcaagtgttgtttttgttgtctccttgatttttgttcgtctcctttatgtcttatactgtagcagcaagcccttgagcaaaagggcttcaaaaccttttagtacccttattattttaggatcaggtggtcatattgctgagatgcttaatctactggcagtgttacagaaaggtaggtttaatccaagattctacattgttgttgctattgataatatgagtcttcaaaaagctcagttgttggagaattccctggctgctgagtacgttcatgatgaatcagaaactttatctgatattgatgatgaagaagttgatttgtacattcatgatgaggaggggaagcatatcaagaagatactgtgggaaacagcaaatagggagcatcttgaggagcaggcagccaaggaagcagctgcagcagctagcaagaaagcttttgaggcaaaatttgaaaactgttcggaggatatactagcggcaagagagcttgctgcatcttctactgaagctgtggcaaaatccaaaaaggaaatgagacagaaacgagcttatgaggcaaaaaatacaaggccagctcaatctgctgcagaggcctttggccaaatgtctaataaaaaaagggagcaggcagccaaggaagcagctgcagcagctaacaagaaagcttttgaggcaaaatttggaaactgttcggaggatatactagcggcaagagagcttgctgcatcttctactgaagctgtggcaaaatccagaaaggttagaggtgttcatgttagaggttatggtgttcatgttcgatttatagttatagaccattttttggctagtacctag

SEQ ID NO: 86863 - DNA, 108 bp, Glycine max
  Peptide Sequence Number=SeqID_203641
atggttggagcattcttgcaaaacagagtgaccttgactggtcttcctatgatttcacttagtgagccagcttatgatgagtctcatactggagatggagaggcttag

SEQ ID NO: 86864 - DNA, 552 bp, Glycine max
  Peptide Sequence Number=SeqID_203642
atgggattgttcttcactgcccgcatgttaaagaatcaccatcactttgggaaaatcctttctcttccacaacatcttggaagccctgtgcttagcgccaggatggtgttttaccagggagtaccactgcaattattgatagtatttttatacctccatgtagaacttcctcctgaaaatgaaacaaatggctatatattcatccatgctgaaggtggtctaaatcagcaaagaattgcgcttagactatttttcttttctgaaattcaccttgaatttgacattctcttgcatagccatcgttctcttgtagactgctgcactttagttggagaatttccttccgcttgtgccataccttcattgttttattcagaggaaatagcggttcacgacttccttcagcacaaccctattgtagagaacaaagctaaggataatagttttgacgataatgtggattttgttgttgggaatgtgaaacttattaccaccaaagaagtgtgggaccaatatttggaagaagcaaggagggatgacaaaattgtctaa

SEQ ID NO: 86865 - DNA, 357 bp, Glycine max
  Peptide Sequence Number=SeqID_203643
atgaacgctcatggaacatctcaatgtcgaccgttatcacaacccttgcattttgtaaggggagaagggccttccacagtacttgagaaggaaaggattgagcatatggaggagatgctatgcgccattgaaggaggaggaaattatgcctttgctaacatggcagagtcgtgcttggtactcgacatggttattcctccaaagttcaaggtgccagattttgataagtacaagggaaccagttgcccaaagaatcacctaaaaatgtattgtaggaagatgggggcgtatgcaaaagatgagaagttgttgatgcatttcttccaagagagttttgctggggcagctattacctga

SEQ ID NO: 86866 - DNA, 204 bp, Glycine max
  Peptide Sequence Number=SeqID_203644
atgcagacaaatgatgtccaagctccactttttccattcattgcaagttgtaagcagaatgtagaatttgaaggaagttcccagaatggtagaaagcaagggacagatgaaacggccacagctaagaatagtgcatcttatatcgggaagagattgttagaaagtttggttgcagttgcagggcttataatttggctttcatga

SEQ ID NO: 86867 - DNA, 218 bp, Glycine max
  Peptide Sequence Number=SeqID_203645
tttcacgggtgttcgatactcggttcttaccgttttatactacttgtgcgatccggtgcacttgccggaagccgaacaagttcttggcgttgttgccgaggaacttctttttatttgggaaggtggaatgaatatcttgacggcacacgatcaagagtgggaacaggaattaagtccttacgatcaatatgaagaagaaagaactccaaatcttgaaa

SEQ ID NO: 86868 - DNA, 324 bp, Glycine max
  Peptide Sequence Number=SeqID_203646
atgcttcactccatgctccagagcatccatagggggcagtccattatcatgcagagccttcagggcttgggcttgcccaccattatgagcatggaggagtttgagactcaggtggccttgccaggagaccagccctcttcttcaggacggggtggggcctttgcagcccaggagcctgtgactgaggagccaccagcaccagcactagcaccagcagaggaggagactactccagatcagaccccacaatcatctccatcctttgctcttgctcctgaggagactcagccattagcactggatcctaatgaagaccagccatag

SEQ ID NO: 86869 - DNA, 658 bp, Glycine max
  Peptide Sequence Number=SeqID_203647
gcacctgccacacattcccaggtccgatatgaccggtctaggttcagttctcttgaggcctgggaaaggtacactgatattgtggtacccagaaagatactccctgagcgaaatgtggtaatctaccacactaagtttgatgagttcaaggaagaactagagataagtaaatgggatgaggaattgaccagttttgatgaaggaagcattgatgttgccattgtgagggtgagaggccatttggtgaagtttgatgaggacacgctgaatacattcttgaagacccctgtaatcatcgaggagggggaaacattatcagcttactctagatttgcactcttgagacttgatcctcaagagttagctgctaagctctgcatcccagggaggggatttgagctgaatcttgatggtcagcctcgaaagattttaaggaagaagatgaccacactcgctcagacttggagtgttctttattgctccaacttggtccctaccttccacacttctgacatcacactggagcgggccaagtttatttatggcattatcatgaagatggacatgaatctgggctacctcatctcccaccagatttctatcattgcccagcatgactcctctaggcttggatttctagccttaatcacagctttgt

SEQ ID NO: 86870 - DNA, 258 bp, Glycine max
  Peptide Sequence Number=SeqID_203648
atggttggagcattcttgcaaaacagcatgaccctgactggtctccctatgattttacccagtgagagtgacctgacttaccagtggatggtctatcttgtcatatgcaagttcaacccatcgactgagctcaagatggggcaacagtctttaggtcttgcttcttgtgttgttaaaaggggcaatgaaaatattggatgtatggagatattatcaaagggtattaatatctctaactcaattgaactctataaataa

SEQ ID NO: 86871 - DNA, 417 bp, Glycine max
  Peptide Sequence Number=SeqID_203649
atggaaaaatgtcttgtgaagttgaagaccaaatttagagaagatccaacggttaacgaaggctgggcagcgtttttaccgagacatcttcatggttctcgagcacgttatagccatactatgagtattcagaggaggtttatgtggtctgtgtgcaaggctaaggcggatggagggttaggggaaaagaacttagcaattttcgatgctagtttgctagctaagtggcgatggaggtttctagtagagaaggatgctttgtggtgtggtttcctcactcataggtatgggcgcttagaccagcttggggagcgtcaagcccagtctgggtcaggaggtcagtgtaagggagatgtcaatggaggccaacgatcatggggtggtgtggagttggagatggcagagagctttatttga

SEQ ID NO: 86872 - DNA, 330 bp, Glycine max
  Peptide Sequence Number=SeqID_203650
atgttgattgatgttggaaatgcattggcatgtgcatgttgtgtatgttcgtggggggcactgtgcactgaccttccagggtctttggcactagcttttggccacgatcatacgtcatatggagtgtatgtcatgggggggggcttatcacctggtagggaacacctttgggctcccaggctgatcacctatgggaggggggctgttacgtgcacaaccgggtggtctcgacaaactcagcacagttccctaagtgagagtgtcgtgtggacacgcttaggctatttcctgagatttggttgttgttggtacgtaccacactgcatttga

SEQ ID NO: 86873 - DNA, 243 bp, Glycine max
  Peptide Sequence Number=SeqID_203651
atgggttttgaggcgatttccaaaagttgggagttgggacagagtcatgccaccatttattgttggataaaggcacttgtcaaatttggttcatgccagcaccaaaacattaacttttggtctaaaggtgttatcaaattagctctgaatgaaaagcaacttccttcattgatagtaactagtaagcattacgtacatgacgatatccgccaagtacaaggaccaaaagccagcaacaactaa

SEQ ID NO: 86874 - DNA, 1437 bp, Glycine max
  Peptide Sequence Number=SeqID_203652
atggcataccaaaaccctccttcaattccaatctcagatcctgaagcaccggaaatcactcctactcatactccttcaaccaccaccccactagccaatggattttcaaccaaaggagtggtggaaaaaataaaaaacaacttggtttttcactcaaaatggggtgagctcaatggcgccatgggtgacctcggcacttatgtaccaattgttttggccttgacccttgctagggacctcaaccttggcaccacgctgatatttaccggtgtgtacaatatcatcactggtgtcatctatggggtccctatgccggtccagccgatgaagtccattgcggcccaggccttatcggacactgatttcggtgtgcccgagatcatgaccgccgggttgatgcagcttgtttacatgctcattcctctctgtgttgtgaggggaattcaactagcacaaggtttgtcatttgccttgacagctgttaagtatgtgaggaaaattcaggacttgccaaagtctaaatctttgggggagaggcattggtttgggcttgatgggttggttttggccattgtttgtttgtgtttcattgtggttgtgaatggggctggggagaagagtagagggtgttgtgatgttgtggaaagtggtggtggtgatgatgatttgggtggtcaaaagaggaataatgaggttgttgcaagaagcaggacaagcagggtgaggaaggttattttctcactaccttctgctttcatggtgtttgtgttgggggttgttttggccttcataagaaggcatgaggtggtgcatgaaataaagtttggaccttcctcaatagaagtagtgaagttctctaagcatgcatggaaaaagggttttgtgaagggtgcaatccctcaacttccattgtcgattttgaactctgtggtggctgtttgcaagttgtcatcagatttgttcccagggaaggatttctcagccacttcgttgtcagtgacagtgggattgatgaacttgattggtagttggtttggtgctatgccgagttgccatggtgctggtggacttgcggggcaatacaaatttggtggaaggagtggtgggtgtgtggcacttcttggtgttgccaaattggtgttgggtttggtgttgggaacttctttggcacacattttgaagcagtttcctgtggggatcttaggggtgttgcttttgtttgctggaattgaactagccatgtgtgctagggacatgaacacaaaggaagattcctttgtgactcttgttatcactgcagtttcactcgtgggatcaagtgcagctcttggctttttgtgtggaatggttgtctatgtgcttcttaggctgaggaattggacaaggggtaaaccactttctactatttggatgcagaaaagtcctgagcaagtttga

SEQ ID NO: 86875 - DNA, 867 bp, Glycine max
  Peptide Sequence Number=SeqID_203653
atggcagaaccattgaaaaagcaaaaaggcgtttcaacttcatccgcagtcaccggaactcaaagtcatggatcatccaaggcgcagacaacccaaattcctccctccatatcatctcctacgtttttttccttggaagaacaacatatccgatacaattatctcttttcttctcattccattattgaccctaagttcgtagacttagctttctttgatgatgaagtgtttgattgctttcaagcatttcaaaattctggtttaattcagtttatctccatgaaacttcctttttacccagaattggttaaagccttttattctaacttagaaattccagaagattccttgatttccgaagtttatgggattaagatggtcatagaccagtcccttttctttgaactcactcaattatccagtgatggtgtaccatttgaggatacacttgatgatgagtggaagtttgatttttctgtttttgatgcccgtcggatggtttgtaccaaccaagcggatatgaccggaaggcttcttgccggatcattggcattcgaatgccacatcatgcacaacttgattgtgcgtatcctacttcctagatcatccaaccttgcacaggtttctgaggaagatttgataattatgtgggttttcttaaccggtcatcaaatcgactgggcccatcttgcattttcttctacacctcttgactctgagccctttgtcaaagtcaagagatccttctctatcggtgcttatgtagtcacctctttcggataccgcaaagagagggatgggtcttgggtgaagaaagacgctctagtacaggccgcagaagaccgttctccatcaccacctccttag

SEQ ID NO: 86876 - DNA, 330 bp, Glycine max
  Peptide Sequence Number=SeqID_203654
atgagtaggaaaaagagtacaacattgggtttggagtgtaggtcagatgaagtagaacttcagtcggtacgctctgttgtcaaggttagttgtgaccctgaaggggccttccccattggggtcaagctttttcactcggggatcttttctggcttcacctcggactcgccatacaagagttcttctttccatagatctttagacttgtcaagtctagtacatagggtggaggcgattatgtggggtcctgaacttcacacgtcggcttggagatgtacctttgacaggaaggggaaacctacaaaacaaatgacttcgacgctcaagtaa

SEQ ID NO: 86877 - DNA, 222 bp, Glycine max
  Peptide Sequence Number=SeqID_203655
atggatgaccatgatggtctccacatgccaacggacttgattgtctctgaaagaaacaaacctccaaaccgatcagagcaacatatatttttgaagaaaaacaatgtgactactggggaaggaaagcctgctgatagaatttctcataaccacaaatcagatttgggacatttgcatttcatctctaaaagaacattagaagaaagcactgggttcaattga

SEQ ID NO: 86878 - DNA, 125 bp, Glycine max
  Peptide Sequence Number=SeqID_203656
atgaacgaacctatgaccaaggagaagaaggagcaggagtttgttcccaagctccttgggttgaaatttgaaacagaacaggatcaggagaagaagcagtggaggagatccaacaactcaaactg

SEQ ID NO: 86879 - DNA, 1179 bp, Glycine max
  Peptide Sequence Number=SeqID_203657
atggtggcaaagcttgaggaaatgggtgagaagggccttttgacaatggagactttctccattgctatcaaagcctttgctgaagcaaagcaaaggaaaaaggaagttgggatctttgatctgatgaagaaatatgggtttaaggtgggtgttgatgtgattaatttcttgcttgatagtctcagcaccgcaaagcttggtaaagaagcacaagctgttttcgagaagctgaaagatagatttacacctagtttgcaaacttacaccatacttcttagtggttggtgcaggttaaaaaacttgctggaagcagggagggtgtggaatgagatgattgataggggatttaaccctgatattgttgcacataatgttatgcttgaaggattgttgaagtgtaagaagaagtctgatgccatcaagttgtttgaaatcatgaaggccaaaggtccttcacccaatgttaggagttatacaattatgatacaggatttctgcaaacaaaagttgatgggagaagctatagaatattttgatgtaatggtagatcgtgggtgtcaacctgatgctgcactttacacgtgtttgatcactgggtttgggaggcagaagaaaatggatatggtatatagtctactgaaggaaatgagggaaagaggttgtccacctgatggaaggacctacaacgctttgataaaactgatgactagccaacatatgccagatgatgcagtgagaatatacaagaagatgattcaaagtggcatcaaaccaacaattcacacttacaacatgataatgaaatcctattttgtgacaaaaaattatgaaatgggtcatgagatttgggatgagatgcatccgaaggggtgctgtcctgatgataattcctacattgtatacattggtgggcttataagacaggacaggtctggtgaggcatgtaaatatttagaggaaatgttagagaagggaatgaaagctttgaagcttgattataacaagtttgcttctgatatttctaagactgggaatgctgtcattcttgaggagttagctcgaaagatgaattttgttggtaagtttgaagtgtctaatgtcttggctagttgggctgacatgatgaagaaaagtgccaagagaaaagagcctacaacatctgctaggcaatttacatga

SEQ ID NO: 86880 - DNA, 231 bp, Glycine max
  Peptide Sequence Number=SeqID_203658
atgggcttgtcaatgcctttctttcagcctaagctcccagggttattgtttcatccatgcaagaacgttctatcttctccccctcttccagttttaaagactcttgggcttcaaatttatgaaggcgcgctcagcgctctggcctccctgagcacgaggttcttcttcatgctgggcgggtgctcccccaaatttgaaccaaacatctctttcaagacaatgctctcctaa

SEQ ID NO: 86881 - DNA, 288 bp, Glycine max
  Peptide Sequence Number=SeqID_203659
atggcctacatccagaaaaactattggaaccctgatgattcgtctattactttcccagggtcccgcaaggccaaggcccaggctccatcaaatacacccccagtagctcctcctcccgcacgagtagctccttccacatcatccgacaccactagtgaccagattgtactgatgctgcagagtattcaccatggcctctgcctgtccagccttcctttcttggggggggggggtgaagctcctgaggcccagggtgtagaggacacacctgatgcacaggggacttaa

SEQ ID NO: 86882 - DNA, 489 bp, Glycine max
  Peptide Sequence Number=SeqID_203660
atggtgcttgtttatgatatgggcaaacatggaataagctttactaaatcaagtctctcgaatgttccaaagttggaaggttgtcctccagagtgctctcagaccaagttctttggtatggttgatgaagcctatgttccttttgtgtgtgcacagaatgttgttgcggttgcaaaaaaggctagcatgttagattgcactaatgttgaagttggtaggattgtaaatgttgtgaaaatggttgcaagagcttgttcaaggggcaatgaacttttcagctctggcaagttttctgaatcttgttcaacttatgaggagggccttaagtatgacaactccaagtatgttttatacagcaacagggcaatttcagagggaactgaaattatgcacaagatagaagatggagaacaagataaacaattgaaggacatcatattaactctactggttgcaggccatgataccacaactattctcgttatgtag

SEQ ID NO: 86883 - DNA, 207 bp, Glycine max
  Peptide Sequence Number=SeqID_203661
atggttgtggcgttagggcaacagacgctggaggtatccactctcgtcacacccgtcgctcaagataactcgttcgattcattagcgccactatcaaatcagaggacttatcgtgacacccgtcgctcaagatacccatctctcaacaaagcaagggatgcaattatcattcaagagattcatgcaaagattatcactcacagctag

SEQ ID NO: 86884 - DNA, 366 bp, Glycine max
  Peptide Sequence Number=SeqID_203662
atgggatatgtgaagatcaagagtgttgcaaaggccaaaaagcatcaaaaggtacccataatgtccatcatgggtttgaaaaactattttggggttgaaggcaaatttgatgaaagccatagcaccggtgaagagaaaaaggctagtgttaggcagaatccacctattatggaggagcttggcaacttgagcttcaatctccaatttttgagcatgcaattatcgatagggagtattaaaataggagttgttgcatctctggctggaaaaaaggtaatacaggagaaggaggttgatccaattcaggataaaaatgtgaaggggaaaaaatcgggccacatggatgcccctaataattttgcgtag

SEQ ID NO: 86885 - DNA, 1194 bp, Glycine max
  Peptide Sequence Number=SeqID_203663
atgagttgtagattttggaagctactttacggtggaaatcattttattagaaccagcaagtctgcagctttttacctgaactccatgttttatcactcttcaaaagaggctctcaacttgcagtggtatcagaatgagtttcccaaggtgaaagagttgacccatttgctagcaaatgtggattcagttaatgggaggcttgttgatattaatagcaattcgaccgttttttgtgatgacgttgagcgtgaaatgtgcaccttcaagtcccttgttcgtgagtttgttgagtctccatttgttcatcacagaatgaaacatgttctggcctctttcatcacaaatgcaaaacatgaatcttttaccccatttggtaaagcaactgaaagagagcctatggtggttgattcgttgaccaaagttactcagcaccgcatatggactggtgcacttaaaaaagttctgaatggttttgcagttgatttggattctttggcttcccggggcctagacaacaatgctttgttgggtggccaaattgttcatagctgcttgaggtttctgagtgaaattggtgactttttggaccccgagtcttcttcttggatgaagctttcaccttctaaaactgtttattcctctaattccaggaaatggaaagatgttcttgtgatgttcaatgatctggccaaatgctgcagaaatgaaaggaggttaaagatgaatgtagctaaggctgagatcatgaaggaggggcttttgcacataagggatgttttagttgacaacaatgttggatacaaggaagcacagcatcaagagagcctagtgaagaagaagctttccaaaatgttgggtcactcgtctcgttgcttattcactctattactgtattacctctatggaagggtggcagatattgaagtagacatgtgtggtggggtttatgcaaatggaagtgatggcaagttctgcttgtttatgggaagaattttgacttcagatagtgagaagatgatcgggcgtggcgtgaagcaattggaccaggcacttgggattttcaagtttgtgtggaaaatggctggaatgaaagggcatttggacttgcaggggcatatgtggtgtgttggagcagacaataggatgcttaggtatagaggaaacaaatactttgtgcatgaaatttgcctttga

SEQ ID NO: 86886 - DNA, 576 bp, Glycine max
  Peptide Sequence Number=SeqID_203664
atgcattatgctattggcttttctctctttcaagacatctatggaaagactcctccttccattcctgcctacattgtcggttcgtcctctgtggcaacttgtgactcgacccgtatctctcatgatgaagattttacactttttcgtatcaattttctcaaagttcagaatcacatgaagaagtgggttgatcaacatcgtcgtgaggttgaccttccagtggaatcatgggcttacgtcaagttgtggccttatcgtcaaacttccttgttcggagcaaagtatcacaaactagctaagcatttttatggtccttatttgattctggccaaaatcagtcttgtagcctacaagttggatcttccttccacttccaagatccataatgattttcattgttccgctctaagacctctggatgttgttcccactcgtcaaactttagtccaatggcttggattgtctttggataacacttcttgggagaactgggatgaattgtgtgttatccacaaccttaagaataagtttgcttccgatggggcgagtattgatatggatcagactagtagttaa

SEQ ID NO: 86887 - DNA, 423 bp, Glycine max
  Peptide Sequence Number=SeqID_203665
atgcactctcgattctctttctcctcccacctgaaatctgccagaaaccgctcggtcgacacccacattgccccacattcatttcgatactatcggaaaccgctggctggaacccacagaacctcctatcgaagaaaagtcgaagaaaaccctacactgctgttggaactgtgtgggtcgaaaaaaccctacactgctcttggaacagtcgtggatgctcaaagctcaaagctttctacgctgccagttaacaagttgattgtgctttttttggttttcaagcttgacgagagtgacacgccgagaaaagtttccatccgtgccggtgatggttttcacaacttgaaggagattaagactgtggaactcatgaaggcaactgggtgggtttatctatccttgtctggagctcatcctaggtaa

SEQ ID NO: 86888 - DNA, 267 bp, Glycine max
  Peptide Sequence Number=SeqID_203666
atggataagagctttaagctaaaatttaaggaagaactttcggatgtgtggaagataaatgacaactatagaaatgttcaagaggataatgtaataaagactaagacagagatcctgatcctgcaaaatggatggggtcaggttaccatcaacaatgaagtgaatgaggataaagagatgacaaaatttagagaagctttgactaaggatacagctacctgtagcaaaattaacttccgcaaagagtttgctgcatttattcattag

SEQ ID NO: 86889 - DNA, 741 bp, Glycine max
  Peptide Sequence Number=SeqID_203667
atggtcatgaaagacagcaaatcagataatgaagaagagccacactcaacattgaattggcaatggatgcatgagccccatgttcaattgaaagatggccaagtccttggtttagtttctcgtaaggctgctcaacttttggatcaaaaggttgtcacaaatgatacaagtgattacttatggtacatcacaaggttaccatatggtcaaaatggaaaatattcattcacctatgaggcaaagatcaagctgaagaaaggcacgaatgagataagtcgacttagtggcactgatggtttacctaactatggtgcccacttctccaatgtgtcagttggtgtttgtggtccagttcaattagtgacactacaaaataacactgaggtagtcaaggatatcaccaataatacatggaattataaggtgggattacatggtgagattgtgaagctatacagtccagaaaacaataacggatggaacacaaatggtcttcctactaatagagtatttgtttggtataagaccttattcaagagtcctaagggaactgatcctgtcgtggtggatttgagagggttaaaaaagggtcaagcctgggtaaatggtaacaacattggtaggtattggacaagttatcttgcaaatgagaatggttgcacttctacttgtaattaccgaggaccatatagttcagacaaatgcatcacaaagtgtggaagacctacccaaagatggtag

SEQ ID NO: 86890 - DNA, 366 bp, Glycine max
  Peptide Sequence Number=SeqID_203668
atgacttgggcacttttgttgttaagttttacattagttaacttggcaatcaatgcttttgaagtttcatatgattcgagagctataacaatcgatggcaaaagaaaagttctattctctggttcaattcattatcctcgtagcacagctgaaatgtggccttctttgattaataaagcaaaagaaggtggacttgacgtaattgaaacatatgttttttggaatgctcatgagcctcaacctcgacagtatgatttttctggaaatctggatctcgtcaaatttattaaaaccattcaaaaggaaggactttatgccatgctgcgcattggtccatatgtatgtgctgaatggaactacgggtaa

SEQ ID NO: 86891 - DNA, 351 bp, Glycine max
  Peptide Sequence Number=SeqID_203669
tgctgtaatccaaaagatccttccacctaagcacaaagatcctgggagtgtaaccattccttgttcaataggagaagtcaatgtggaaaaggctctgattgatctgggagccaacattaatttgatgccactctccatgtgcagaagactgggagagttggagattatgcccactcgattgactttgcaattagctgaccgctccattaccaggtcctatagagtgattgaagacatgttggtcaggccgttcatgttgactgcaagctgcatagttaacacggggaagagaaagctagagttaggttttaaagaccagaaaattgatttcgacttgtttgtggaagacaa

SEQ ID NO: 86892 - DNA, 525 bp, Glycine max
  Peptide Sequence Number=SeqID_203670
ggttttgtgaagggtgcaatccctcaacttccattgtcgattttgaactctgtggtggctgtttgcaagttgtcatcagatttgttcccagggaaggatttctcagccacttcgttttggtttggtgctatgccgagttgccatggtgctggtggacttgcggggcaatacaaatttggtggaaggagtggtgggtgtgtggcacttcttggtgttgccaaattggtgttgggtttggtgttgggaacttctttggcacacattttgaagcagtttcctgtggggatcttaggggtgttgcttttgtttgctggaattgaactagccatgtgtgctagggacatgaacacaaaggaagattcctttgtgactcttgttatcactgcagtttcactcgtgggatcaagtgcagctcttggctttttgtgtggaatggttgtctatgtgcttcttaggctgaggaattggacaagggataaaccactttctacaatttggacgatgaaaagccccgagcaagtttga

SEQ ID NO: 86893 - DNA, 199 bp, Glycine max
  Peptide Sequence Number=SeqID_203671
tgctgctccgggtggtggttatttagagcaacataagcatcgttgtttgccgctgtcagagaatgctccaaccatgtgggatcggcacaagcttaaaggagcacttaaaccgggtgtatttacccctaaggcctacactccgaagagtccgtcagggcctttccctcctgattcaagtccaacccagaaaacattttaa

SEQ ID NO: 86894 - DNA, 441 bp, Glycine max
  Peptide Sequence Number=SeqID_203672
atgattgggaatgaacacttcccagcttctctattggatcttccttgcgttgttgaatcctataataagacttatgatgataactctttgactaagactgccgatattggacagatgattatggtgagggaatccggtgatgctgcaccagatgttattgagtacagacatggcctcactccacccatgagagatgctcgcaagcctgagcaagaggaaggggatgagaatgcccgcggtgccaataaaaaacctgcacctaagcctgcaccaaaacatgatgctccagagaatcttactaatgcaggggaacttgacaggagtgattctaaggaatctgatgactcagtcagaccaaatgaatatttatatcacaatgatgaaatgaaaatctgtatagtgtacattttgcagttaaatttgaattccatccactcttaa

SEQ ID NO: 86895 - DNA, 1458 bp, Glycine max
  Peptide Sequence Number=SeqID_203673
atgaagcttaaaaggtggctcgggagtgttttgttcctcattgttgccacagtgagcaatgccgcaggtgcatttgtgggggtaaacattggcactgatgttactgatcttccatcagcttcaaacgttgttgctattctgaaatcacatcaaattacacacgtgcgtctctataatgccaatgggcacatgctacaagccctttcaaacactggcattgaagtgattgttggtgtcacagatgaagagatactaggcattggagaatctgcatcagttgctgcagcatggatcagtaagaatgtggcagcatacatgccatccactaatatcacagcaatatcagttggcagtgaggttctcacctcagtcccaaatgttgcacctgttcttgttcctgccatgaaccatcttcacacagcacttgttgcttcaaaccttaacttccgtgttaaggtttcaacgccgcagtccatggatgtaatctctaggccttttcctccttccacagccacctttaactcctcatggaactccacaatctaccaactccttcagtttttgaagaacacaaattcctcttacatgttaaatgcttacccttattatggatacaccaaaggagatggaattttcccaattgaatatgctctattcagacccctttctccagtgaagcaaattgttgacccttacacactattccactacaacagcatgtttgaggctatggtggatgctacctattatgccatagaagccttcaatgtcaataatatacctattgttgtcacagaaactggttggccaagttttggtggagcaaatgaaccagatgctactacaaagaattctgagacctacaataataatttgattaagagagtaataaatggttcaggtccccctagtcagccaaagatagccatcaatacctacctatatgaattattcaatgaagataagaggaaaggtcctatatcagaaaggaattggggtgttttttatgctaatggaagtagtgtttattccttgagttttagtgcttccaacatgagtaatgcaaattctcaaggatcattttgtgtggctaaagatgatgcagacactgataaattgcaagctggattgagctgggcttgtggacaaggccaagctaactgtatagctattcaaccagggagaccttgctattcccccaataatgtgaagaaccatgcctcttatgcttataatgattattatcaaaagatgcataatgctggtggaacatgtgactttgatggtacagctacaacaactactgaggatcctagtaagtccattgctaacacaagaaatggtggaagaagttcatcttctacagcacttggacttggacctgtaagtccagttggagctgatctctgtgccatcttgtatggtctatatggggtcattgtagcttatattctctag

SEQ ID NO: 86896 - DNA, 468 bp, Glycine max
  Peptide Sequence Number=SeqID_203674
atgcagaaaatgcttatttcaaacatatccaatatccatctcctcaaacaacctccaaatgttcttaatctccaaaagtttagggtgattcggtgccttgtgagcgttgtgctagcaatcccgggtggagctggaaggaaatcccagttagagctagaaggaggcggcggagacgacagctttgagccgaaaaagccatgcggcagagaaaatacgaggataggggaatggggcagcaggacgaatgtggagttggtggcggtggtggcaccaaggagaaggtggagcaagggtaatgggaagaggagaggggaggaggatgagaagacaacgagcgagtggggagaggaacagacacgagatttgtggagagaggaacgagcacgaggaaagaagaggaacctacgcgaggggttaaaaattaaaatggcccgcattcaaagacgatttttgcgaaaccgaccttga

SEQ ID NO: 86897 - DNA, 203 bp, Glycine max
  Peptide Sequence Number=SeqID_203675
tgctgccttgctacactggtggagatccgcaccacaacgccatcaaagatgtgccctacatcctcctcaagtcttggcgcaatacaaacggactacaacccaccatcgcgagatcgaagaaagaagcaaaagtgaaaatagcattgtttaaatcaacaatgacaatcagagaaggtagtggaagcgttgagcagagaaattaa

SEQ ID NO: 86898 - DNA, 120 bp, Glycine max
  Peptide Sequence Number=SeqID_203676
atggctatcaaatacctatgtgataacacaagtgttcttcaggaaataaaggatgagcattttgcaatccaacaaaagaaaatgcccgaggaacggatcacaacatgttgtttggagtag

SEQ ID NO: 86899 - DNA, 1077 bp, Glycine max
  Peptide Sequence Number=SeqID_203677
atgctgaggaagaggaccaggtcaatccagaaagatcaacaccacactggtcaaatggcaatctctgataccaattctgagtctcatgctttggggagcaatggcaaaagcaactcaattttcaattcccctcttctgtttgtgggcatgggtcataagggcttgttggattctgattcagttaagagccccacttcaccattagattttggtttcctttcaaacctaagcaacccctttagaaccccaagttcattgtccaatgagggacaacataggagttggaactgtgccaaagtaggtctaagtattatagattctttggaagaatgttctaagttttctgggaaaattctccaggcttcagagagcaagaagactagtctttgtcctccaatgattactaaagccccaaaatgtaaatcctatatggattctgctcaggcatctaaatctttacctaaagatttttgtaagattacttgtactcaaaatggttctattttccctaagggtgagtccactgttctttctgagattggagaggcccctctagaatatgagtcctttgggaaaactgtgtctttttcattggactcttgcagtccaattagaaatctgtctggtttaactggttccgactttgattctgactctgagaattttgcattgaaacagatgtgctcccctcctcattttattggaggaagccaaaataacacaaaatttttgctaccttctgaggtacattcaaaccctgtagctgcagtctcttctaatgaatttatcgagtctctatcggctagtgagattgaactctctgaggattacacctgtgtgatttcccatggttctaatccaaaaacaacccatattttctgtgactgcattttggaaagtcatgttaatgattctgaaagacattataaggctgaagaggagggaacgggattgccccttttcagtgttaacattttgcatactccaagccaatatccttctcatgacttcttaagtgtctgtcaccattgcaacaagaagttggaagatgggaaagatatttacatatataggtag

SEQ ID NO: 86900 - DNA, 651 bp, Glycine max
  Peptide Sequence Number=SeqID_203678
atggaagataaccgtattgggattatcctaattgcttttgggaagtttcagaaaatgcaagtgttagacgtaagtgtaaacaagctatcaggagagataagagccttcataagcaatcttagtcaattgtttcatttggaaataggtgaaaatgtgttaggaggaaatattcctccaagcataggaaattgcctaaagttacaatacttaaacccttcacaaaacaaccttacaagaaccataccactagaggtttttaatcttttctgtttgacaaacttgttggatttgtctgacaactcgttgagtagtagtataccggaagaagtgggcaacttaaagcatatcaatttgctagatgtctctgagaatcatctgtctggttacattcttggaaacctcagagaatgcacaatgttggattccctttatttgaaaggaaatactttacaaggaatcataccatcgtctttggcatcactcaaagaatatttcaatgtattctttaacatgttgaatggtgaggtgccaactgaaggtgtctttcaaaatgcaagtggatttgtgatgactggaaatagtaatctttgtggaggtattttcgaactgcatctgccaccataccctgtcaaagatgagaaaaaagagtaa

SEQ ID NO: 86901 - DNA, 171 bp, Glycine max
  Peptide Sequence Number=SeqID_203679
atggactggaacccggatgatcccatgatcacttttccggggacccgcaaggatcaggctcggggaccttctgatggttccacctctgcccccgcttctacctcagcaccaacaccagctcctgctccagtccctccagcgatcacagcgccaattggcccctactcttag

SEQ ID NO: 86902 - DNA, 369 bp, Glycine max
  Peptide Sequence Number=SeqID_203680
atggttattataaactccgaagtgtgggatctgcgcaagttcagactgcttcatagtgtaccttcattagatcaaagaacaataacatttaatgctcatggagatgtaatatatgctattctaaggagaaatattgagaatgtaatgtcagcatttcatccatgtaatgctcttgattttgcaactgatccaacagattcgtttgttgggtttgttactataacgaagcgtggtaactatgttgaaggtagagacgaagagggcacattgggctgtgtcagaatctttgaattggtcatcgaatacccaagtaaagaaaggatgaccattgatgatgaagatggagattttatcatggatgatgtatag

SEQ ID NO: 86903 - DNA, 1179 bp, Glycine max
  Peptide Sequence Number=SeqID_203681
atgagccccatgtttcagatgaaagatggccaagtccttggttcagtttctcgtaaggctgctcaacttttggatcaaaaggttgtcacaaatgatacgagtgattacttatggtacatcacaagtgttgacattagtgaaaatgaccctatttggtcaaagataagagtgagcaccaatggacatgtgcttcatgtgtttgttaatggagcacaagcaggttaccaatatggtcaaaatggaaaatattcattcacctatgaggcaaagatcaagctgaagaaaggcacgaatgagataagtctacttagtggtactgttggtttacctaactatggtgcccacttctccaatgtgtcagttggtgtttgtggtccagttcaattagtggcactacagaataacactgaggtagtcaaggatatcaccaataatacatggaattataaggtgggattacacggtgagattgtgaagctatactgtccagaaaacaataaaggatggaacacaaatggtcttcctactaatagagtatttgtttggtataagaccttattcaagagtcctaagggaactgatcctgtcgtggtggatttgaaagggttaaaaaagggtcaagcctgggtaaatggtaacaacattggtaggtattggacaagatatcttgcggatgataatggttgcactgctacttgtaattaccgaggaccatatagttcagacaaatgcatcacaaagtgtggaagacctacccaaagatggtatcatgtaccacgctcattccttcgtcaagataatcaaaacacattggtattgtttgaagagtttggaggtcaccccaatgaggttaaatttgccaccgtaatggttgaaaaaatttgtgcaaattcatatgaaggaaacgtgctagaattatcatgtcgtgaggaacaagtcatctctaaaattaaatttgccagctttggtgtgcccgaaggtgaatgtggatcctttaagaagagccaatgtgaatctcccaatgctttatccatcctgagcaagagttgtcttggaaaacaaagttgctctgttcaggtttcacagagaatgcttggtcctactggatgcaggatgccacaaaatcaaaacaagcttgctatagaagcagtttgtgaatctatagccaagaaatattag

SEQ ID NO: 86904 - DNA, 336 bp, Glycine max
  Peptide Sequence Number=SeqID_203682
atgagtttcttaggtgtcgatgaggttgaaaacgttggtgccccctacgagcctggtgtagttcacagagggaatgggtacgcccatgtaaggcaacatgtactacgtgttatgcatgtcgcatccaggtttactttggtggggtacgacaagcagggcaacattctaagctaccgcatgggtccagtgagcatagctaaagttatcgaggatagaggagaccattttgatataacaatcgaggagatagagttgttcaaagaaatattgtgtcaattagagcacttgtccaaggaggaatatcacgattttcctaaggtcatgccctcaatatag

SEQ ID NO: 86905 - DNA, 222 bp, Glycine max
  Peptide Sequence Number=SeqID_203683
atgtctagggtttctagagagagaaaggtccaagttccagagagttttgagagattttgctatgtgaagatctgcagagaccagagctggaagcaggagctggaaccggtcatgtacgattaccatgagaaagaaagagctccggatcttgaaagtattttggcagacttcatgacgtaccaagcaagctataaaggatattgttattctatgcaacagtag

SEQ ID NO: 86906 - DNA, 1183 bp, Glycine max
  Peptide Sequence Number=SeqID_203684
atggcccagtctaactcttctagacttgggttccctgctgttatcacaactctatgtaggtccagaggggttgcttctgacaacctggtcttcgaacgcttgagcccggtcattaacttggcttatatcaggaaaaactattggaaccctgatgatctgacagttattattagaggggccaggagagcgagggcaaggcctgctgaggctccttccacatttgcagctcctcctccagcacgtacctcagcaactccttctaccccaccttctgcacgaacctttcacttaaaacgcacccgtgagtcatgcgtcgccctcccgtcgaaggagcttcacgaattgcctaacgatgggtgccaagtacctcgaagcggtcaaacgagagtcgcatcccaacaaacgggtggtcctcggacaaaattagggtatgacaatgtcctcatcatcagagggctacacgtcctcgcctttagaggactacacatccttgccttcagaggactacacgtccttgccaacagagggctgcacgccctcaccttcagaggactacacgtcctcacctttagaggaatgcacgccctcaccttcagaggacagcacgccctcgccatcagagggctgcacgccctcgccattagagagctacacgtcctcaccttcataggactacaggtcctcgccttcagaggactacacgtattgccatcagagggctgcacaccctcgccttcaaagggctacataggactagacgtcctctccttcagagggctacacgtcttcaccattagaggactacacttcctcgcctttagaggactgcacgtcctcgccttcagaggactgcacgtcctcaccttcagagcactgcacgtcctcaccttcataggactacacgtcctcacctttagagggctacacgccctcgccttcagaggattacatgtcctcaccatcagaggactacacgtcctcaccatcagaggactacacgtcctcgccatcagaggactgcacgtcctcgccttcagagggttgcacgctctcgccttcggaggcctacacgtcctcaccttcattggacaacacgtcctcgccatcagaggactgcacgtccacaccatcagagggctactcgtcctcgccattagaggctacacattctcgccatcagaag

SEQ ID NO: 86907 - DNA, 222 bp, Glycine max
  Peptide Sequence Number=SeqID_203685
atgggtacaactactgatagagagctatccaaagagcttaaagacctagaaacacttcatgagttgaaggggtcaacaatggtggttcttgaatttgcatccgaaacaatccgaaccaagtgtccatggcttggattgcatcaactacaccataatccgagctctaagggtttagccaaccatagccataatatagccaaacaacatacaagattgcattga

SEQ ID NO: 86908 - DNA, 138 bp, Glycine max
  Peptide Sequence Number=SeqID_203686
atggagcaggttaaagagttccatagaagagatggttttgaggtagcaagtacaataattgttgttgaagatgacaagggagctgaaagaggaatgtcgagcttcaattctgagttacccaattccaattcatggtaa

SEQ ID NO: 86909 - DNA, 309 bp, Glycine max
  Peptide Sequence Number=SeqID_203687
atgggtcagacactttatggacctgtcatgactgttactttcttctcctggaatgcacgtttgcaggcctttgtgttgcaccttaccatagtatttggctggagaggagagaatagctatgaagcatggatacctcttttgttcaaagtgttgccgtgttgggcaaattcatctgaggaaatacctgttttgtcacctttagtcccagtttcattattgggtagttcaaaaggtgaagaccagaagcagaaagttgttactaagcaagtaaaagttcaagcggtattaaaggcaataaaacatgtttga

SEQ ID NO: 86910 - DNA, 306 bp, Glycine max
  Peptide Sequence Number=SeqID_203688
atgcatgctaaagtgaacataagtatcatcacaaagtctaaagaaggtcaacttggttgctgctctggttcgtggtacctgcttgttaaagatgcatcgatgcagttggaattgacaataaaacgagcagcaaaaactgtatatcagggaattctgatctcaaattgtccacggctatgcagcgaaattcttgacaagttgaaccacccttttctacctgcattatctatatgcttccttccagaggagaactattcctgcttcttgatcggcaaccaactaaggttctcaaggaagatgccgtga

SEQ ID NO: 86911 - DNA, 135 bp, Glycine max
  Peptide Sequence Number=SeqID_203689
atgtgtcacatttatgatggagttgcaaccagcccgtctaatgatcctttacatgagattgaagatcctatgacaaggtcaaagactaagaggatgaaacaagcattgcaagacctgattctaaagatcaaatag

SEQ ID NO: 86912 - DNA, 408 bp, Glycine max
  Peptide Sequence Number=SeqID_203690
atgatagttccagatcttcaaatcatccaatcagcccttgtgaaagctggtttaggacatcctttcatcagcctctactcagaccgtagttttcctattgactatgccttcttcaatggctttcaatctcccataaatgaagatggaaggatttatgacaatgtctttgataccaaccatgatactctagtacaggcactatggaagaatggttttggaaacatgcacataattgtaagagaagttgggtggcctgcatatggagagagaattgcaaaccttcgatatggacaacggtttaaccaaggcttcatgtcgtgctacatcggaaaggggacaccaatgaggcatggtcctatggatgcttacttgtttagtctcacagatgaagataacaaaagcatttag

SEQ ID NO: 86913 - DNA, 345 bp, Glycine max
  Peptide Sequence Number=SeqID_203691
atggagcaggttaaagagttccatagaagagatggttttgaggtagcaagtgctgacaagatggctaagtcatgcatggtttattttgaaatgcatctatccctaaggaaaaaaataattacaaaagcttttaatggtacaataattgttgttgaagatgacaagggagctgaaagaggaatgtcgagcttcaattctgagttacccaattccaattcatggtcaagttttgtagaagggaattggaaaggaggattgatgtcataccttgaagaatttgagtcaagaagcaaggggtcaaccacaattggagcactattgagtgaaacatcaaagatagaatag

SEQ ID NO: 86914 - DNA, 198 bp, Glycine max
  Peptide Sequence Number=SeqID_203692
atgggtttagtggacaccgttgttgaactgcattatccaaagacggaaaatcgaaaagaaaaattggattcgaggccagcacctccagacaaggtaagagtggaagttttgaattgtataatggttttttttaagagtgtctattatgctaatgaaaaaggatacgttcactgcacattcaaaattcatttatgttaa

SEQ ID NO: 86915 - DNA, 420 bp, Glycine max
  Peptide Sequence Number=SeqID_203693
atggggtgtggaaagcttagggggtgccttgttcttgtgttatttggtgcactgttggtgggtttagtgagtggaattggaattaattggggcacacaattaacacaccctttgccagcatccactatagtgaaaatgctgaaggacaatggtattcagaaggttaagctttttgatgctgaccctgatattctaaatgctcttaagaagtctgggattcaggtgatggtgggtataccaaatgacatgctctacacactagctaacagtatgcaagcagctgaaaaatgggtttccaagaatgtttcagcacatgtctcggtggacatcagaagaacaattttagaagaaatcattgcaactggaagtggaatactccacggaatcctttccaatgtgttgggaataattagaaagtag

SEQ ID NO: 86916 - DNA, 252 bp, Glycine max
  Peptide Sequence Number=SeqID_203694
atggtggaaagaacccacgtggcgcaaaagaaagtggagactgggtcacgacggagcagccaaacagcgaagacccacgacggtgcagtagcggtctcgatgatggacataacgacgaacagcgcgttacactacccagtgagaaattctggatctgtcaatggtaggatgatatacctcacggcatcttccttgagaaccttagttggttgccgatcaagaagcaggaatagttctcctctaggacaataa

SEQ ID NO: 86917 - DNA, 264 bp, Glycine max
  Peptide Sequence Number=SeqID_203695
atggtggaggttggatctggattcgtggaggagatctgggtttgtgggggaggttggtggcgtgacgatgcacgatggtggtggtgcttgtttggattgaatttatggaggttggtggtggctgagtttatggaggaacttggccataaacgcgacctgtcggtagaaccaaagttatcaaaggagtgtgaccttaatcgcgacttgccggtagaaccaatactatcaattcttaacccaacaacaaggaaaaagttaaaataa

SEQ ID NO: 86918 - DNA, 663 bp, Glycine max
  Peptide Sequence Number=SeqID_203696
atgactatcaattcacccaaagaaatttgggattatttaaaggaagagaatgaaggggatgagtatgtttgtggcatgcaagcgctaaacctaatgagggaatttgaggtgcaaaagatgaaggaatccaaaacaattaaatggtactcggacagattgcttgacatcactaacaaggttagattgctagaatccagaattgttgaaaaaattctggttacagtgcttgagagatatgaagcatcaataaccactttggagattacaaaggatctgaccaagatctctttgacagagagaagattgaagagggaagaatcaacagttgaaggaactttaccaaccaagcaccagaatgcgatcaaatacaagaaaaacaggaactttgatggaacgggatcaagttcaacatcaaacgcaaaaggaaattggaagaaatcttatccgccttgccaacactgcagaaagaaaggacatcctccattcagatgctggaaaaggcttgatgctaagtgctatgattgtaatcaaatggggcatgaagctattatttgcaaaaacaggaatcaaccacacagtgaagctgcaaaggctgctgatccggaggaggagtacctgtttgctactacatgtttctctagtattgaatcaagtcaaaattga

SEQ ID NO: 86919 - DNA, 1101 bp, Glycine max
  Peptide Sequence Number=SeqID_203697
atgactattctgggaaatgaacctttcttgtcaacttacaatggtacctttgaagccacaacacttccagctcttcaaaacatccaattagcccttgtgaaagctggtttaggcaatcaggttaaagtcacttgccctctaaacgctgacgtgtatcagagcgcacaagtaccttctgatggcgacttcaggcaagacatccatgatctcatggtgcagattgtcaagttcttgagccagaacaacgctccatttactgtgaacatctatcctttcatcagcctctattcagaccccaattttcctgttgactatgccttcttcaatggctttcagtctcctataagtgacaacggaaggatctatgacaatgtctttgacgccaaccatgatactctagtgtgggcattgcagaagaatggttttggaaacatgcctataattgtgggagaagttgggtggcctacagatggagacagaaatgcaaaccttcaatatgcacaacggtttaaccaaggtttcatgtcgcgctacattgccggaaagggaacaccaatgaggcctggtcctatggatgcttacctgtttagtctcatagatgaagatttcaaaagcattcagccgggtaattttgaaagacattgggggttgttttactatgatggacaacccaagtaccagcttaacataggatcaagagccaatggcttagtagctgctactggggtggcatatctgcccaaaaagtggtgcattttgaaaacctcagcaaacctcaatagtgatcaagtggcaccaagtgtgtcttatgcttgtcaaaatgcagattgcacaagtcttggatatcaaacttcatgtggtggtttagatattcgtggtaatatttcttatgcattcaatagctacttccaagtgaatgaccagattgacagtgcatgcaaattccctggcctttctgttgtcactgacaaagatccttcaactggagattgcaagttcaaaatcatgattcagacagattctgctggtctacatgggaatgggagaatttggtctctcagaatagtactctttgtacttttgtttttcactcttatgtga

SEQ ID NO: 86920 - DNA, 162 bp, Glycine max
  Peptide Sequence Number=SeqID_203698
atgaaacatacagcaggaagaaggttggaaactgcggtgcctgatgatgtaatggctactgctggaatatcatctcaccatcaaaccaagtcttgtgcattcttcaacaataagcgatgcccaaacagtgttaatattggcactttctttcagggagtttga

SEQ ID NO: 86921 - DNA, 522 bp, Glycine max
  Peptide Sequence Number=SeqID_203699
atgactactaaagaacccataataagagataatgttagcgacttcagtgatgatgagcaacaacatgattttgatgaacatggtgaaccaagcaattatatagtgagtaaaagcattggaggagggacattggaggagggacttgagaaactgaaggaggctctccaaatcttgaattctccttccccttcttccccaactggattccttaggtttcaggtggcgctccctccctgtcctaagaccttcactttgttttgctcccaaccccactcctcctcggtctttcctctcatttatgtttccaagaacgacgccgactctaaatcactctatgtcaatttggatgataatgtgagtcaccagaaagaaagccgctcccagattgagttagatgagctggaaagtgtttccattctgtcaatgacccttgcatgggatgaattttccttctctacttttcaagaagcccattattcgcttcaagattctctagaccaggtgcctgacatgcctttttga

SEQ ID NO: 86922 - DNA, 207 bp, Glycine max
  Peptide Sequence Number=SeqID_203700
atggagcatcaccatgaggatgagttgagaaagctaaaggctgaccatgatcagctagaggctcgtggcagactactcgttagcatccctttgtcgaccacagactaccttctttatcgctcaacctcaagcggtatgatgggaccacagatccagatgagcacctggattccttactgttggatcaagtggcctcaaaataattaa

SEQ ID NO: 86923 - DNA, 450 bp, Glycine max
  Peptide Sequence Number=SeqID_203701
atgattcttttgcttgaatattggtggtttgtcggattcatggattggtggcctgtcacaaattttgatgagatcccttttcactttattgattgcatacataaccatcttcgctccaaaataaagatggaaggaatcacttcttcaaatccttcatctggctcatctttgaacactcctggcaaaagtgcaccaaatggatctcaggcaccatcatcaaatccagtaagtgcacagcatagcgtggatggacttaagggtattgataaattgattatggactacctggagcagcattcagatatgtcagatggacgtggaatacatgttgatgaactatcacgggagctcaagcttccaatggaaaagatcaagttgtcgttgaagactcttgcagatgatggagaaatatactccaccatagatgacgaccattacaaaaaagcttga

SEQ ID NO: 86924 - DNA, 1620 bp, Glycine max
  Peptide Sequence Number=SeqID_203702
atggggttaattatccctgtgggtagaagggatgtggagatagtttggaatctgggcttgtactggtctaacttggtgtatgatttcctggttggaagggatgaagaggttgttccgtatcgtgctcgacagcttaggaatctcttgtgtgatcttgggccttcctttattaaagctggtcaggttcttgcaaataggccagatatcattcgagaagattatatgaatgaactgtgcattcttcaagatgatgttccttcatttcccaatgaagaggatctgggtcaaccccttgaagctgttttcagcaaaatctcatcagagacaatagcagctgcaagtttaggtcaagtttacagagctactttacgtgcaactggcgaggatgttgctatcaaggttcagaggccagggatagagcccattatatatcgagaccttttcctattccgcactttggcttcattcttaaacggcattagcatacagaaattgggatgtaatgctgagctgattgttgatgaatttggtgaaaagcttttggaagagcttgattataccctggaagcccgtaatcttgaagactttcttgagaattttaaaaatgaccctactgtcaaaattcctcaggtttacaaacaattttctggtcaacgtgtgctggtaatggaatggattgatggtatcaggtgtaccaatccacaggccatcaaagaagccggtattgacgtagatggatttttaacaattggagtgagtgctgccctacgacaattgttggaatttggattatttcatggagaccctcaccctggaaatatttttgccatgcgtgatgggagaattgcatatgtagactttggcaatgttgctgttctcagtcagcaaaataaacagattttaattgatgccgttgtccatgctgtgaatgaggactatgctgagatggctaatgatttcaccagattaggcttcctgaccccagggactgatgtgactcctataattcctgctttggaagcaatttggcagaactctgctggaaaaggactgtcagattttaattttcgtagtgtcacagatggccttttccagtggaaacggcttgaaaaccttattgttcttgcaaaggaaaatgtggccaagatgagcaacaatccagcattgcaagtgaaaaacacgcaaagccagagagacttaaaagttgaaagaaaactggacctcacaggcacaatcaaagatggagctcgccttttctttgttgatgaaggaatacgtagacagcttctccttgctttgactgaagattcaaagcttcatattgaagaggtttatgatgataatatgaccctttccacttccttaaaagtccataatcttgtgctggagaattctgacttgtgttctttacagcttgtcgatgtgtataggttggttgaagatcagatagacataccttctgtggctgtagaagtagctagagttctcgaagtgttttccccgtatagtcacttagatttttgtttggtttatctgttgagtgtctgcatggctctaaaaaacgaggaatcaaatgcaaaatgtgtgatatttaaagacgggaatatagacaagtcatga

SEQ ID NO: 86925 - DNA, 306 bp, Glycine max
  Peptide Sequence Number=SeqID_203703
atggtgtcttcacttaggttcaccgctggattagctgcagctatgctgttatggccaacaatcacagaacacattcacctgacacgcaatgtgcaccagaatctcagctatgaatgccctacagccaaaactggtctcctcggaggtggcgcctttctatcccttgattcatctctcctttggttgattgcccttatgttagctgacaatgctcgtgaggatttctttggagaagaagaagaagatggtgacaagggtgaatttggcgcagcctcctctgattcaggactgaagggtagtgcctga

SEQ ID NO: 86926 - DNA, 396 bp, Glycine max
  Peptide Sequence Number=SeqID_203704
atgaattacaccatcaagcaagttttgagaaaacaagaactcagaggaaggatgttgggaagcagggcagagatcatcctcgaaggccccaacaatatcaccctagagcaagccctcaagctcaactttagagcctcaaacaaccaagaagagtatgaggcactcatgcagcttgtccaaggacaggttgccaacatataccagaccaaggaaatagtgttgctcaagtattatcacattgcaaagactctcattgacaatttcgaatgtttcaaactgtactacattctcagggaaagcaacaccagagcggacctattctctgagctggctatcaccaaaaaggccgggcacctcaagactatcatccaggagaattctaaacacccaccatag

SEQ ID NO: 86927 - DNA, 992 bp, Glycine max
  Peptide Sequence Number=SeqID_203705
aactctatggacaaatagaaagactagacaaccggctgaatcaaaatgttggacaaccttatggtgggaacacagggggcaatgatggacccaggcaaaacagaatgaagaggcagaacagaattcagggagtaaaactcaatatacctcctttcaaaggcaggagtgacctagacacctacctggactgggagatgaatattgagcatagaaatgctaagaaaggaagggcgagagatagatacatggactgggatgaaaagggttatgcgaaagagtactacaaagagatggagatgacactagtgagggccaacattgaagaggaaactgaggacacaatggctcattttctaaatggtctaaatcctgatattagagatgttgttgaattacaagagtatgtggaattggatgacttgctgcttaaggcagtacaggttgaacaaaagctcaagaggaaaagtgcagcaagaagaaactcatccaatactttcaaccagaactggaccaacaaatccaagaaggaaggaggtaactcatccagtccatcaacaatgtccctacatggaaagtcaacagtgtccaatgctagaaccaaacataattttgccttgtccaacattggtaccagaaaagatgatggagaaatcatcagtgaatatgaaattagtgaagaagaagtggaagaagagctcaaggaggaagctatgcaggatgatatgctaatggtgagaaggctgttgggaagtcagatacaaccattggatgacacccaaagagaaaatattttccacaccaagcgtaccattaacggtaagatttgctctttaatttttgatggaggaagttgtaccaatgttgcaagttccaggttagtgtccaaactgaatttggaaactaagccccatcctaggccatacagacttcactggcttagtgaagatgaaggacgaaggcccagaggcactccaaagaatcttgattgctga

SEQ ID NO: 86928 - DNA, 273 bp, Glycine max
  Peptide Sequence Number=SeqID_203706
atgacacatttactagtggagcctactcatatggaattagcagaaccgtcaataagagatgcttttgaatcttgcattgaacaaggtgttcatcacattattgtttgtccctttattctctttcctgggaggcattggagtcaggatattccttccttaagtgcagaggtagtgaaggaacacccagatgtgtcatacaatgtaactgcacccgttggactacatgaactatttgtggcacaaggaaagaacatagatagtaaggtcttctga

SEQ ID NO: 86929 - DNA, 200 bp, Glycine max
  Peptide Sequence Number=SeqID_203707
atgactattctagatactggcagtcatcagggaagtttgtgtttatatgaaatggttattcgtccaagtaagcagaatacatactcagacattgtggctgcatacaagtgtctagaagagagttatagagccaagcaggaaggcataatcgtttataggcaatctgttggcagtggcccaactttggatcttgcagctag

SEQ ID NO: 86930 - DNA, 231 bp, Glycine max
  Peptide Sequence Number=SeqID_203708
atggaaaaacccgataagatgaattttaaagagaagaaagaaaagaaaggatatatcacttgggaagatgatgtcataaattattcaagtgattcagagaagaaaatcataagtctggatatcatgatgaaagactatgaaaatggagaagagcaaagtcgatacattgatagcaatttctccaaacacatggcatgcatcaaagtttattcatatttctctctaagataa

SEQ ID NO: 86931 - DNA, 444 bp, Glycine max
  Peptide Sequence Number=SeqID_203709
atggttaattcccatattgatgacaatagaccacctgagggaacaatatccaaatcagattatgctggtattttagaatcatggagtgaatcaagctataagccagatttcacagtggcacaggatggttcagggacacacggaacaatccaagcagcagtaaatgcacttgctgcaatggggcacaaccgtcctgcaagagcagtaatacatgtaaaatcaggggtctatcatgagaaggtggaaattggacagaaactgcataatgtgatgcttgtaggagatggcatagacaaaactattgtcactggcaacagaaatgttgttcaaggttctaccactctgaactcagccacatttggtaagactatgaaaattttgtctaacgatctaaccaaacagaacaagaatttaattagaatagatatagcaaatgttttttaa

SEQ ID NO: 86932 - DNA, 225 bp, Glycine max
  Peptide Sequence Number=SeqID_203710
atggcagacacctactccgcccccgaagagattcatgggcttctcggctatttattggcgatcgaaattgccattccctgggttatggggttgaaccaagctcatgctttttcgaaaaaagttcatcaaatcaagttgaagaatggaagtaactatcttgcaaaaattggggcaaaagatgaatcgagtcacatcactgcttcgtctactgccaaacatatttag

SEQ ID NO: 86933 - DNA, 395 bp, Glycine max
  Peptide Sequence Number=SeqID_203711
ctttcaaaattgccccatgtgtggcatctcttgtcaatgtcaggatttacacacgattctcctcaaatttcagccagcatcaattagacctcgcaccctacacttcagagccctacaatgctcaatggaacgccctggggcttctccgtgacaagcacacgttgcgttcgagtcgtattctcgaagaaatggaggttgatgaaccttggctagggttatggctaccattgaattatcaagtagatatgggatcaagtttagcatatgacaacggaatttggggtgaaccctacaggctttttgctgcaaaattcctttttgttggtgttttttttttgtttgtgctaaaagtggtcttcgtcattggaagtgcggtagacagactttgtggttga

SEQ ID NO: 86934 - DNA, 222 bp, Glycine max
  Peptide Sequence Number=SeqID_203712
atgttcgaggaagaggtggcagcaataggagaggagttcccacaagacccgccaaatttcgttcggccatgccatcccgattcccaagtggggaactggcgcgtgataagccagtcagaggttagctcgcctgggcgagcaacccctgcaccaaattataaaaaacgagggaggggaacgttttctgcacccaaaaactcccccccccccccccccatttaa

SEQ ID NO: 86935 - DNA, 189 bp, Glycine max
  Peptide Sequence Number=SeqID_203713
atggtgattttcaaccatggagttgcagcggaagataaaggagaagagcctagcacatgggaagcttccttcagaagcaaggaaggtagcttccttcggaagatagaggaagaaagcttccttgagaagctagagggggctactcacacccgtccaatagctaagctcaccctatgccaaaatacatga

SEQ ID NO: 86936 - DNA, 906 bp, Glycine max
  Peptide Sequence Number=SeqID_203714
atggcttctgcgtcctgcacgtcttgcaccctaggcctaccatttccgaaactcgccagtcaaacctgcggtttcagcagcagtgacgaactcgtcagtgcaagtggcgagatgcccttccacgtgaagtcgccagcagtgttggcggtttgcccagacatgtgtcgtgttgcagccaaattgctattggcaatggtgctttcgggtccaattcctaaagctctcaaggaaaagacagatttgcaattaagtctcaatgacacggggatcgaagtcatcgaggtcttggatctggatctggaggacttggtcgtagcaggagatggatctgtcaacctagtcgagcatggagaaggtgtcgtcgagctgcatgtagctggagaaggcggcgagggcgtgatcggcgccgcgttcaatgtcggggacttggatagagtgtttgaggacggggacggcttcttcgaagcgtccgaggctgcagtagatggcggcgaggacgtggaggctaatggcgaggtcgaggttgggctctccctcgacggcgcagcgctcgaaggacttggaggccctgatggcgaagttgagggccttagaaggcccatcgcccgaggcaatggtgtcatgggccaacctaagagaagcggaggggtttctagagttttctttttagaggagcgagaaggagatgtggtgggtggccgtggctgcacactgcttgctctaactagaatggcaagggaagctgtcatcaatggagaggatgagcaatgcaagctaggaaatgccacggtgtcatattctaagacggttatttataactgccttagaatgtacgacgtaaaaacaaatttttgttcccctaattacaaaattgtcaccgtgccatattctaaaacggttctctag

SEQ ID NO: 86937 - DNA, 423 bp, Glycine max
  Peptide Sequence Number=SeqID_203715
atggttctttctgtatcccttatgcaactcgggtgtgtctctcttcttcacaataatccctcatcatcacctgtgacccttttgcccaaatccctctttccttgtggaatttccctcaaactgaaagggttggtgttttggtgtaaaagtagttcagtgtgtggaagaagaagaagaagaagagtgagagttgggagtatcagtgtcaatgcctctttggttgaggctccagttttgtgggctggaaggctcttcatcttctatgccctcctcaaggctggcttggctggatctcaagccaacccacttgtcttagatttggaaattggggacactaatgatgaatctgctgctgctgctactgacttgggattctctaaatgggcccaggcaatactaggaaaaccacgtctgtccaattaa

SEQ ID NO: 86938 - DNA, 576 bp, Glycine max
  Peptide Sequence Number=SeqID_203716
atggctctgtgcatatggctcaaccaatacagagttcatgccgccaacaagctcgagtcgcgccacccgcgcgtcgcgctctgcgagctgcgcgagcaggcgctggcgcatatgaccagcaaggctgacgccgctgctctctgcctcgcctgcgaccgcgatatccactccgccaaccgcctcgccagctgccacgagtgcatccccatcacactgttcttcgagtccgaacactcagtcaaggcctcctcgccgatcaacttccaccaccgcttcttctccgacattgacgctgacgctgacgctaacgtcagcatcgaggaggctgaggccgcgtcctggctgctagctaatccgaagacagatctaaattcgtctcagtacttgttctctgaaaccaaactggttccttacatagatctggattacgcggccatggatccaaagacggagcagaaaagttccgccaccgccgacgacgtcgttctgatgcagagcaacttcaagtcgttcacctatgagcaccaaacttctttcttcacagctacttctctcgatctagaaccttcggagtga

SEQ ID NO: 86939 - DNA, 714 bp, Glycine max
  Peptide Sequence Number=SeqID_203717
atggacgaagtcggtgaacccgaccttaaacctgtcgtcttccgggacggccacggcgggcttgaagacggcgaggcccctcggggtgacgaagccatagtagacggcaccatcggggccgtggaagctgtcagtgaagtggaagaagaagcaggagagggcacaaacaaagaggaggaagtggatcatgagggtgtgaacgtgggtgcactggccgttcttgtatatggaggggaggaccatctcaaaagtgaggagggttcctgtggggaggaagtttccgaggagggagggttggaagaggggttcagtgtttcatgttcgggtggtggagttgcattgttgttgtacactttgatgccgatttgttgttcgtttagatccatattccttccttgggtaacttttgctcatgtcattggattaaagagctttggtagtgcactttgcatgacttcaatatcactaggaaactgcgttagtagcttgcttattgcaattgtgatgaagatttctgccactgatgagatgccaagatggatcccaggaaagttaaacaaaggacatttggatatgttttacttcttcttagcagcactcactacagcataccttgtaatttatgtactaatggctaggtggtataaatatatcaaatttcaagggaacaatgataatggcatcaacaaagaagacactgaagtaggactatag

SEQ ID NO: 86940 - DNA, 450 bp, Glycine max
  Peptide Sequence Number=SeqID_203718
atgtcacaccatgctgtcaagtggtacgacactagtgttttggaaaccagtttattggttgagtggaccactgaggagaaagcaaaggaagctgctaatggaaggaaactggttagcaaatggcatcccacaacaaagggtacacttagaaggaactatagagtcccatccaagcccgaggggagacgtcttcttaaagctattgcatctctattatcagatgatgaccactttgttgatgccacctctcacaagggttgccaaatccgtagggaaagtgctcatggagaaagtgtgtgttgcaacaatgtgagagctctttttgatgagctcccaacaccccatatcattgtggaaatcacaccttttcccgctggaccccttaatgacaatgattacattaaagctgagaagcttgagaaggttctcagatctagtccttctgtttga

SEQ ID NO: 86941 - DNA, 189 bp, Glycine max
  Peptide Sequence Number=SeqID_203719
atggtatctagcaatgttctaaaacaagctattgcttgctgcaactcccaagttgcttcctacaccttctttataacttccagaataaacaatgcagaatgtttggctagtgcttgcggcgtcttgaacgtgctcattctcaaggtgtcacaagtgtttgcttctctcgtgatggaagccagttattaa

SEQ ID NO: 86942 - DNA, 746 bp, Glycine max
  Peptide Sequence Number=SeqID_203720
ataaagcagcatttatcacatcaaaagatttggagcagctagaagagaataaatgcaacccatggtgtctatccaccgtgacacaagtagaagaagtgaagtgcatactaagactactctcaatttggctatgcaccatattgtactcagttgtttttgctcaaatagcgtcactctttgtggtgcaaggcgatgctatggccactggaatttcaagtttcaaaatccctccagcaagcatgtccatattcgacattttgggcgtggcattcttcatcttcatctataggcacgcccccgacccttttgtggccaaagtaacgaaatccaaactcacagagcttcaaaggatgggaattggtctagtccttgcaatcatggccatggtctcaacagggttgttcactttccattttctggcaagtgccaccttcaatgcacaaacacctgatgaattgaaaagctttggcagtgcactctacatgacatcaatatcactaggaaactatgtgagtagttttcttattgcaattgtgatgaaaatctccacaaaaggtgacatacttgggtggataccagggaacctaaacttgggacatttggataggttttacttcctcttagcagcactaacaacagctaatcttgtggtttatgttgcattggctaagtggtataagtatatcaattttgaaggaaacaatgaagaagatatcaaaaaggaaaatcatgaggttatggtgtag

SEQ ID NO: 86943 - DNA, 465 bp, Glycine max
  Peptide Sequence Number=SeqID_203721
atgatacgcggagataccttacggttattcgcacccttttgtcatccagaggcggcgggcccgatgatacgcgaagatccttacggttatccgcacctttggtcatccagaggcggcgggcccgatgatacgcgaggataccttacggttatccgcacccttgtgtcatccagaggcggcgggcccgatgatacgcggagataccttacggttatccgcacccttgtgtcatccagaggcggcgggcccgatgatacgcggagataccttacggttatccgcacccttgtgtcatccagaggcggcgggcccgatgatacgcggagataccttacggttatccgcacccttgtgtcatccaaaggcggcgggcccaatgatacgcggaaatacccgagttgttatccgtataaacattcttttgctatctgtaagacagaacgcttgatagcatgcagaggctga

SEQ ID NO: 86944 - DNA, 243 bp, Glycine max
  Peptide Sequence Number=SeqID_203722
atgtcccatgctgtcaaggacaatcgagggaagtgggccccgaactacgaagggcctttcgttgtgaaaagggcttttaccggaggagccctggtacttaggaacggacgcaaatggaggatagggtcacgaccgaccgatagtcatcccttcctggcgttggacaagcagagaacgtcgctacaaggcagcccattatcctttgaattcacagtaattattactattgtttgttttaaataa

SEQ ID NO: 86945 - DNA, 267 bp, Glycine max
  Peptide Sequence Number=SeqID_203723
atggaagcggtactctcatttgaggtagaggttccttcccagaagatattagtggaatcaggcctagaagaatcagagtgggctcaaacacgctacgaccaactcaaccttattgaagataatcgagggaagtgggccccgaattacgaaggacctttcgttgtgaaaagagatttttctgggggggctctggtgctcaccgacatggatggtgaggagctaccctcacccgtgaactctgatgttgttaagcgatattacgcttga

SEQ ID NO: 86946 - DNA, 408 bp, Glycine max
  Peptide Sequence Number=SeqID_203724
atgggtgaagtggaggaggtgcaagagcagataaaggccaacatggaggccatgaaagagcaaatggccacaatgatggaggccatgaggagcatgaagaagataatggaagccaatgtggttgcagttgctgctacaagcgttgttgctaaggaaaacccgatgcccccatctggcctcaaccaaatgaatcatccaacctcagctatgcgtacactcccagtgaggatgacaataactccgctcccatactcattgagagccgacaacctcgtcatgtacatgtctctcaacccatgggggaggcacatgaaaattccccaccacaatctagccgacttcgagccttgcctcggatatgccactgaagggcaagcagttggtggtatacccctgcaaaacacttag

SEQ ID NO: 86947 - DNA, 507 bp, Glycine max
  Peptide Sequence Number=SeqID_203725
atgggggtctttccttcagtaacgggagaaatcccttattctaagaaatctcagatttcccatcaaggttcagctgaattcgcaaagaggttcaggctacagtaccctatgaagagattttccactttttgtagagtagggttaccgcgctctctatctagaatcggccatgttagaagtcttaaggaggtggacgcaggattggcttcggtctgtccacaggaactctcagttaagaggtgtattctcttaaagccggaagtgacgcagaacagctacaccgctagcaggaggggatattctttaaccaagaccggcattttagtggaagggcgtgctcctcaactcctatacccggaagtgggaactagtaagatggttatcccctctcaaacaacaaagagaacacagaatcagagcaaccattcgaggcttctgattcaactcaaagacaagacaacaaggaagggcgacctatcaaggaagtacgaactaggatacttctga

SEQ ID NO: 86948 - DNA, 357 bp, Glycine max
  Peptide Sequence Number=SeqID_203726
atgggggattcacaagaaaataacaaaggaaagagtagagacaaagataattatgtatcttggactatggaggataccaatgagttgttgcacctcttgatggatgctatgaataggggattgcgtgatgccaatgggtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaag

SEQ ID NO: 86949 - DNA, 725 bp, Glycine max
  Peptide Sequence Number=SeqID_203727
atgactaccatgatggaggccatgatgagcatgaggaaaatgatagaggtcaacgcagctgcagtcgccactacaagtgctaccactaaggtagacccgactcacccatctggtatgaatcaagtaagtcatctagtcccgaacatggtaggccagggaggcaaagtattgggaagtacgggcggcccccattttgcgcaggtccagagcaagcatccgttcccaccgtatagcctgcctcccaactatacaccacccaatgttgcacacactcctgatgagaatgtcgacaactctgctcccatacctattgagagccaacatcttgaatctggtcatgcacaagtctctcaacccatgggtgagacacatgaagcaccccgagaccacaatctagttgaattcaagcctcacatcggatatgccgctaaaggagtccctcctgctatggtggaaagcgaaatattagatcatatagaagagaggccgagggctattgaaggaggcggagattatgcctttgttgacatggcagaactgtgcctagtgcccgacgttgttatccctctgaagttcaaggtgtcggatttcgataaatacaaggggactacttgccccaagaatcacttgaagatgtacagtaggaaaatgggggcatactcgaaaagtgaaaaattgttgatgcatttcttccaggaaagtcttactggggcagccgtcacctg

SEQ ID NO: 86950 - DNA, 270 bp, Glycine max
  Peptide Sequence Number=SeqID_203728
atgtctcccttttgcccacggctacccgccatgtgggacttacaacacacccctctatttaggggtgaccacaatttagatggcttttctaacatagaagttgctcttgttcatttccttttaattctaaactattgttttatttcttctctggtagattctgctgcaaatgtccaacctgaaaaggttgaagacatttggaaccttagaggtattttaaacacttcatggcatcgagtgaaagttcaagcgagttactcaaacctgtaa

SEQ ID NO: 86951 - DNA, 300 bp, Glycine max
  Peptide Sequence Number=SeqID_203729
atggctcgcctgggccctcaaaagacttcaggactaagtctcagctcaccagggcgagctgtcatggtcctaaatgcctttttttctataaataggcgtgaaggggagctgaggaaggggttccaacatttagtagtgaaggaattgagaaagagagaaagaagaagaaaaaagaagaggaaacaaagtcgaggcgttaccggatcacgactgggatcaatctctacatcgttctttgttcggtgttcttcgtgcgactgccataaatctcattttttgtcaatcttaaccgatcactag

SEQ ID NO: 86952 - DNA, 450 bp, Glycine max
  Peptide Sequence Number=SeqID_203730
atggtgttgaacgccagttacagtgcaaagcaaggaaccattcagtgtttcgatcaggaatgcgaaaaataccaaaaaaagaagggcaaaagggtcttttcattgagtttcctggaccctaactcgcccaggctagcctctagctcgtatgggcccccaaattactttagggtgaaggaaccagctcaattgggcgagccagttacttcaggagtaagcatcaactcgcctgggcaagctgccattgccctaagtgcccattttcccataaatagtcatgctaagggggttgaggagaggttccaaggttcagtacttgagggaattgagagaaataagagagaagaagaagaaagaagaggaaacgaagccgaggcgctgttgaatcgctactgtgatcaatctctacatcgttcctcgtttggtgttcttagtgctaccgtcgattag

SEQ ID NO: 86953 - DNA, 534 bp, Glycine max
  Peptide Sequence Number=SeqID_203731
atggcagagctgtgcctagtgcccgacgtcatcatacctccaaagttcaaggtgtcggattttgacaagtacaaagggactacttgccccaagaatcacctaaagatgtattgcaggaaaatgggggcatacacgaaggatgaaaaactcttgatgcatttttttcaagagtttggctggggcggctatcacttgctacaccaatctagaatcttcccaagtccgttcctggaaagacctaatggttgccttcctcagctgcagaacatgtttaaaagggagcatgaatctctcaaagaatacgtccaaaggtggagagatctggcagctcaagtagcgcccctaatgatggggagggagatgataacaatgataatggacacgttaccggtattctactatgagaagatggtgggttacatgccttcaagctttgcaaatttagtgtttgctggcgagaggatcgaagtgggtctgagaagaggcaaatttgattatgttgctttaatgaataagaagcctggggcaaattga

SEQ ID NO: 86954 - DNA, 459 bp, Glycine max
  Peptide Sequence Number=SeqID_203732
atggagaagatgaatgtgcacaaagaaacaagggagacccctaagggaaaatgggcacttagggcaatggttgctcgcccaggcgagatgatgcttactcctgaagtaactggctcgcccagaactataatcaaaaggaaagaacgtgctttacgacgcctttaccgaatccatgccaaagctagagtgatgagtgaaatagaggaggtacaggaacagatgaaggccgacatggaggccatgaaagagcaaatgaccacaatgatggaagctgaagccaagatgagtatgagaaaaatgatggaggttaacacatctacagtcgttgccgcaagtatcgccattgaggtggacccgactcacccatctggcctcaatcaactaaatcgcacagtctcggataaggtcggtcagggaggcgaagcattgggaagtacgggagggccccgttttgtgtaa

SEQ ID NO: 86955 - DNA, 168 bp, Glycine max
  Peptide Sequence Number=SeqID_203733
atggctaccattgtattattgagtagatatgggaggtggtgttttgcctcggatgagcaccaggtgggttttgtggctgatttaggggcaacctttatggatgattgggtgttcttgactggtagggtgttcttgactggtagggtgatgggtaataagaaggactga

SEQ ID NO: 86956 - DNA, 177 bp, Glycine max
  Peptide Sequence Number=SeqID_203734
atgaaagaaaggattagagaggctcaaagctgtcctttcgggttttcaacctaccgggtgagaacttctgatctgcccctaggttcgctcgaggctcatgctgttggaccttgttgcctcaataatcttaagagggataggcttagaatgcagaagaagcaacaacaatcagtttaa

SEQ ID NO: 86957 - DNA, 591 bp, Glycine max
  Peptide Sequence Number=SeqID_203735
atggagagccgacaacctcaatctgatcatgcacatgtctctcaacccatgggcgagacacgcgaagtaccccaccacaatcttgctgactttgagcctggcctcggatatgctgctgaagggcaagcaattggtggtgtacccctgccaaacactttggaggaccctcaatatcacccacaatcacaacccttacattttgcgatgggaagagtccctcctgctatggtggaaatggagaaattggatcgtatagaagaaaggctaagggttactgaaggaggaagagatcatgcttttgctgacatggcagagttgtgcctagtgcctgatgtcaccatccctcctgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgcatttacgcacggggaagggtgtttccctttgctcctacgtattcctcaatttgggatgagaaaatcagacctacgtag

SEQ ID NO: 86958 - DNA, 312 bp, Glycine max
  Peptide Sequence Number=SeqID_203736
atgactccacttaaagaaatattggttgtcattcaccaccacggtcagattgcaaatgacttggttcatggatcagcgtactcatgtgaaaacacaatatttccatacgtgagtaggtctattgcagtggttgtggagatgatggttgtggtggagccatgggtggtgtttggggatgtgagtgggaaggctatgagagttagtaatagaggttacttttgtgaggatgttgttatgtgtgatgcattgtcaaatggtgggattatatatagggtgagaaagtttggtaggagagttaggtgggaggattag

SEQ ID NO: 86959 - DNA, 489 bp, Glycine max
  Peptide Sequence Number=SeqID_203737
atgtctttcctaagaagattcctcatggactgcatagaacaacatcctcacaaaagcaatccccaagagactcaacgtaaggatgcacatgccaaagttgagtatgtgaaaagattgtatgatcaagtgaaggtgcaaattgcaaagaagaatgaaagctatgccaagcaagccaacaagaaaaggaaggaagtggtacttgaacccggtgatgatcctggacagttgaggacaaatacttatcaaggtaatctttgtggcgtctaccctgacttatcttccttcactggaagtggcgtctaccctgacttatctttcttcactggaagtggcgtctacccggacttatcttccttcaccggaagtggcgtctatcctgacttatcttccttcaccggaagtggcgtcatccaaaccttcgtagcctgtatcaaacgatccgttcctactcaggttcacatcagtaagcgatgcggaatagtgcggtga

SEQ ID NO: 86960 - DNA, 261 bp, Glycine max
  Peptide Sequence Number=SeqID_203738
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgtgaacgtgaggacccattccatccaggcctctttgttggggacgctggaggatttcaaagtcccacacgtgaaccac

SEQ ID NO: 86961 - DNA, 992 bp, Glycine max
  Peptide Sequence Number=SeqID_203739
atgaggggggcgccaacagaagagagtctttcgcctttccttgtgagagattttggcgcgcaaagtctcaaggttatacaaagagtccacaaggcgtggagaagtccgttgaggaaagacaaagagcttaggggcatccgtaatggcatcatcggtggttatcatggatggctaagagttcatacgcgtgggttagattggctccccaagttgaaagttatcaatgaggagaacttcgaagctccggaggaagatgaagaagtccaagctctgaaattagagctagggaaggcaagactcgccaaagaaaagtttaagtcaactgctacaaacatccgaaaagagtgcaccgatagcaacaatgagctcaagctccagagagaggaaagagaccagtcacgggtgcatggcatgatcttaaaagaagagttagctgcttgcgcaaggtccaagaggagtttggctcaacacttggaagccacagagcaaagcatgctagctatcatagggcagtacaaggaagagttaaaccagtctgtgacccatgaacaaaagctagtagaggatttcgcacaagtgtacaccgaaaaggaagcaagagggagggtgattgacgcattgcatcaagaagcgactatgtggatggatagggaattcaccataactaagaaagcacaaaggcacccctataacactcgatccagaaaaatggacaatgaagagggcgtgcaagaacagatgaaggccgacctatcggccttaaaagatcaaatggcttctatcatgaaggccatgctaaaactccagaaaactatagaggataatgccacgacgaccgcctccaatgcagttagggaagcggaaccggtgctacagcccgcaataaacttgggccgagatagaaacacaacggtgttcggtcggaggtatagtctgcaagcttacccttatggcttgcctccagacttcactccccgtgccgctccggaaga

SEQ ID NO: 86962 - DNA, 159 bp, Glycine max
  Peptide Sequence Number=SeqID_203740
atgcatatgacacagatgcaatttacgaatacgggagcccgagaaactgtctccttcttagatacaacgtctaggggtagcaaagtgccccaacaggggatcaagacagaacccatgttcgatgcatatgcgaaaggcgcaacacgggaatgtacatag

SEQ ID NO: 86963 - DNA, 258 bp, Glycine max
  Peptide Sequence Number=SeqID_203741
atggctgctttaagatgcattcaggtttatattgattttacatatacttcatatcataatctgttaatggaagcatgtagtcttacaagctacctttttcaaattcctatatttgagaagggctatgaaaaagatcatgtcattgtatctaaagaatcaattcgggaagctttgtgcaatggttcagatgtgattatagttgatacagttgactttgactttgtgcaatggaaaccactccagaggatggcaccttga

SEQ ID NO: 86964 - DNA, 162 bp, Glycine max
  Peptide Sequence Number=SeqID_203742
atgatgattcggaaacaacgtgcaaaattagtcatggccacagccaggtgggcactcaagcatcctgtttatggcattgtgatactacggacgaagttcctaaatgaaaaactctacacggttccggaatttcaacaaacactattgaaaacaacgaagtaa

SEQ ID NO: 86965 - DNA, 186 bp, Glycine max
  Peptide Sequence Number=SeqID_203743
atgaaagcaaaatgcaaccaaatgtggcttgggggagcaaaaaccgggaaacataagcatggccctctgcgggttggccctcgcttattcgaacccactcaagcggcgtttttcgcttgcccagagctgggaagggacgacaatcggtcggtcatgaccttagcctctatttgcgtccgttcctaa

SEQ ID NO: 86966 - DNA, 561 bp, Glycine max
  Peptide Sequence Number=SeqID_203744
atgggaggatacgtaggagcaagagcctcgcttttgtcgaccacaccaccttttgttgtcatgaccgaagagctggtagcccgcggagacaccttacggttatccgcacctcgtcattcagtgaccccaagtgtgattgatgagcaaaggccaatatggtcatctgcgccctttccggagatgtcaacatcttccggtggagactttttcaagtctcacaagatacgtaggagcaagagccttgcttttgtcggccgccccacaagatctttcatactgaccctgaggtcatgtgacatgcggagacaaaatttggtcattctgcacccctttgccattcagacacagtcgtgtccgatggcgcgcagagacaaaatttggtcattctgcaccctttgtcatccagaggcggcgggcccgatgacatgcggagacaaaatttggtcattctgcaccctttgtcatccagaggcggcgggcccgatgacatgcggagacaaaatttggtcattccacacccctttgccattcagacacagtcgtgtccgatggcacgcatag

SEQ ID NO: 86967 - DNA, 658 bp, Glycine max
  Peptide Sequence Number=SeqID_203745
gttatgacagagtcactgctgttgttattcatgatgataatggtacacttgagaatgctatcagtcaaaatgatgagattaaagaatatgtggattgcagatatatttctccatgtgaatctacttggagaattttttgttttccaatacatgctagaaagcctgatgtggagagattacattttcatattccaggacaacacaatgttttttatgaagatgatgatgatatagatgatatcctgtcaaagccaagtattttagaatcaaaattcttagcctggatgaatagcaacaaatgtttttcagagggtagaaatctcacttattcacaatttgtttccaaatttgtctacaaccaaaaggctagatcatggaaccttagaaagaaaggcaatacaattggcaggttaatatgggttccaccaaccactggtgaattgttttatctaagaatgatgcttactgcatgtaaaggagctacttcatttgaagatattagaacagttgaaaatgttctataccctacatatagagaaacatgctttgcaatgggttttttgcaagatgatagagaatttgtggaagcaatcaaagaagctaaggaccagggtgtccttactaaacctgaagaactctggaatcagacatggaattg

SEQ ID NO: 86968 - DNA, 258 bp, Glycine max
  Peptide Sequence Number=SeqID_203746
atgtgggtttatgtactagagacttccagtaaaattttcgagtcgatccaacggttaacgaattggaacgaaggaaatgttactggggtctttaaagttttctgcgtttgccctgttttcttggttgtgatacttcagaggattgatggggacccggtgttgagagaaacgaggatatgggctacgtgggagtacgtgagctcagttggaggtgggcaacaggggatggtgggtttatgcgcgatttgtggatgttga

SEQ ID NO: 86969 - DNA, 336 bp, Glycine max
  Peptide Sequence Number=SeqID_203747
gggcagattattttgctgcaaagtctccagctggtagcacctccaaacttcatccctacagtagagcaatttaatgaatgggtagcctggcccgggactcagcctcctcttcacagggacgacgaggatcccgccgctcaggtaccacatcagccagcggatgagtcatcagagtcttccactcctgagcccttgatcaggaagaggagggtagttgtaactcaggaagccgcagccactcctgaaaagtctcatgaggccactccagagcctccggcaccagtggcagataccacttctccacagcagtcctgtctccaaacacctctcctgtag

SEQ ID NO: 86970 - DNA, 261 bp, Glycine max
  Peptide Sequence Number=SeqID_203748
atgtcaactgttcagccaactgatgacaagaaagagaggcaactgatgcacaagctgttcattaaagaaattgccacttggcagagagagggtgatatctttggatcagacacactggggatgacacttggagaaatagagggtaagatggaaagtgacccgacgtcgcatcacaaacactcggcaatcttcaatggggatgatgccactagggcatatcaaaatagtgacggggtaaagcccggcatatgcagcaactga

SEQ ID NO: 86971 - DNA, 222 bp, Glycine max
  Peptide Sequence Number=SeqID_203749
atgaaaacaatctacaatgctatacatatcagttgtacatactttctatctaactttcccacgctcttaaatagcctcagttttggtcaattggatatctacccggtacccatggataggccgtttgtcaacaaggagtggcagtttatatcaaggagtggcagtttgtcaacaaggacattggagtcaagaaaccagggaagatattcgaacaacaactga

SEQ ID NO: 86972 - DNA, 384 bp, Glycine max
  Peptide Sequence Number=SeqID_203750
atggaagcgcatacacgaactccacaaacgcgaactcgacaatgtggttgcagtcacggaagcgcagcccagtttgcgacaaacacgaactcaggcagaaggagaaacaacaataacgccctgggagtaccctttccgggactctttcctttcctacttttcttcgacctgcgaaatcacggaagcgcaggccagtttgacacaaagacgatctcaggcagaaggagaaagaagaagaacgatagggttcaagagcgtgggttgtgcaatttcagaagtttaatatataatgataacaacatcggttttttaaaaataaccgatgttaacatcaactacttaacatcggttttaataaaaccgatgttaacatcgactcgataa

SEQ ID NO: 86973 - DNA, 1688 bp, Glycine max
  Peptide Sequence Number=SeqID_203751
atgagaggggggcctcaacttagtatggaacagagggaacaacttgtagcccccattaccgaccaagaaatccgtaaagcgttgaatggcattggtgacacaaaaagcccgggaatagacgggtttggagcaaaatttttcaaaaccagctggaatattatagggaaagatgtggtggctgctgttagagatttctttgagaatgatcggatctacaaggctttcaattgtactttggtaattctcattccaaaaaatgaggaagccaaaactattaaggaatatcgacctattgcggggtgcactacaatatataaaataatttctaaaattattaccgctagaatgggtagggtgatggatagtatcgttggtaagaaccaagctgcttttgtccccggccaaaaaattcataatcacattctacttgcttacgaactgattaagggttactctcggaaaggtgggactccctgctgtatgatgcaaatagacctccagaaagcttatgatatggttaactgggatgcactggaatgtattcttaaagagattggtgtgcctcaacaatttatcagatggatcatgatagctgtgaccactgtttcttaccgtttcaatgtcaatggttgtcactctaaccttttgcaggctaagcgtggactccgtcagggagaccccatgtcccccctcctctttgttattgttatggaatatctgaatagaattctgtatgacatgcagaagaatcctaattttaaccatcatgctaaatgtgaaaagcttagtattactaatctggcttttgcagatgatttacttcttttttcgagaggtgatccaatatctgtggatcttatggtgaaggctttcaagaatttttctgagtccactggtcttattgctaatcctagtaaatgtaagatttactttggtggtgtgggggacgataacaagaggaatattctcaatcttactggttttaatgaaggccctcttcctttccgttacttgggggtcccgctcactagtaaaaaactttctattcaccactatatgcctttagtggataagatagtggggagaatcaatcactggagcactaatctcttgacttatgcaggctgtgttcagcttataaggagtgtgacgtttgctattgcaaattactggatgcaatgctttcctatcccgaagtatgttgttcacaaaattgaagctatttgcagatctttcctctggacaggagggcaagagataaagagaaaaagtctagttgcttgggactctgtgtgcaaaccgaaggattatggagggttaaacatcattgacctttcggtctggaataaggtaactatgctgaaactcctttggaatcttagtggcaaatctgatagtctttgggtgaagtgggtaaatgcctactacttgaataaggacacactgatgaatgtgagtgtaaagattcacaactcttggattatgaaaagtatcctgaagcatcgtagtagcattttggatatccaatctatatgggatagcatgctagagaaaaatcgatttggtatgaaggaggtttataaaagtctttgcaccaacacttcaaaagtgcgctggcgtaatctgtttcgggggaatacagcgaggcctagagctctgatgactctatggcttgcttgtcatgggcg

SEQ ID NO: 86974 - DNA, 219 bp, Glycine max
  Peptide Sequence Number=SeqID_203752
atgaagaccacgggcaaacgggtcacggcacgagctccactgcacacaatagacgttgccgagagagtgaggtttcgagggagtttcaggggtatggtgtttaagatagggagagatgggtttgagggagagcgagaatttatccccctaattataaaaatgccaccgcgccatatactaaagcggttcttcagaaccgtcgtagatctcgcatcttaa

SEQ ID NO: 86975 - DNA, 594 bp, Glycine max
  Peptide Sequence Number=SeqID_203753
atggagttcctcctccgcagttccgtccccaattccttcatcaagaaaaccctaaccgccctccctctctcccccgttgaaccccgcctcaagaaaaccctcctcctccgcatcctccaaaccctccttcgtacaaccacagtatcagaaattgtgctcgacatcctcgaagacctctcccctatctctaacgttaacaccgcgcgtactgcgcaatcgccatggagtgcaccgtcaagtacctcgcctcgtgccttgacattatcgatggcgagtacgccggcaccgtacggtggatttggcgcggcaacatggcagcgctgcaggcgtgttagatggcacgatgagatagaggatgcgcttggggaggattccaaggagactcgtgagaggctagcggggttgaatagtcggagggacgcgatgaatgaggtgagggtgtatttgaaggaagcgtgggaaatgatggggccttcatttttggaaacggttgcggcaacggagaagaagaacgatgatggtgcatgcatggaggatgtggcaatgcattatgagaatcaagaaccattggaagagagtgttgatgtgaattga

SEQ ID NO: 86976 - DNA, 489 bp, Glycine max
  Peptide Sequence Number=SeqID_203754
atggacggagatgccattttgggtttgagagtgtgcataaacgatgctttaacggatgatgatgtgttgcatttgattttggggagggtggagaggcaggaagacaaggaagtgttcagattgtccttggccaaatactgtggtaacttggagaccttactcattggtggtggcctggatgtgtctactgatgtgatagagtggctggttattgcttttcaactgaaaatcttatgggtggaatattgtcaaaacatttcttattctacagtgagatgtatattaagtcaatgcagaaaccttgaggcactgagcatcagtggcggtatagagttaactgatgccacttttcaacttataggcaatgaggaggctgggttgagtttgaaaattttggatgttagtcattgtccaaataatacagtgacctctataggaattcttatggataaatgcagttcccaggaatacttggatgtgaccatttaa

SEQ ID NO: 86977 - DNA, 291 bp, Glycine max
  Peptide Sequence Number=SeqID_203755
atgcagtccgtcgtcgagcgcgattactctaactacaaggaggttagcggcgcaaacaatgatgaaggactagcgatcgcgaatctcaggattgctctgcagatcatagatgctctggccaagaaagggattgcggagctcttccccattcaggttgacatggctaacattcagaagaaaaaggaagaggcgaaggcgctaaaggagttgaaagccaaggcgcaacagaagggaagctttgaggttttgggctcaagaaaagtggaaagaaataagggctctttatcatga

SEQ ID NO: 86978 - DNA, 258 bp, Glycine max
  Peptide Sequence Number=SeqID_203756
atgattatgaagggccaagacatttatagtagccaagacgaggttactacttcaccttcctctagtgaaagtgaagaagcaaaaggggaagaatctagtgaagaaattgactcccaagaagaaagggaccttttaatggtcagaaggcttctaggaggtcaatcttgtgacttggtaaattggattgatgctattaaacttcacttaatttccaagttttacttgcttttgaacgattcgaaagtcattttcaattaa

SEQ ID NO: 86979 - DNA, 363 bp, Glycine max
  Peptide Sequence Number=SeqID_203757
atgggaataatagtccggttgaaagaagctactactgatgacaaatttggcccacttgttgtagatgtgtctgatgtagcaagattattgccacagtgtcaactaaatggtgaaaaagaaacaaagtttagatatgaaagtaaaaatcttaaggtaagagaggcactaaaccagatgctctttttgattgcggtctcactgacatggacaaagctctttcaaatgaaaagtgacaggatgtatggaaggcaggaactttggaaaaggctggacaaattgcaagggaaaagccaatatgagcaaaattttgaaaagtctatggaggtaaaaggagaactggagaggctcctaaagcaagagtag

SEQ ID NO: 86980 - DNA, 327 bp, Glycine max
  Peptide Sequence Number=SeqID_203758
atgataaagcgaaacagactatttttgaaaattgatggattcaccgacaatgttgtaactcaccttcttgctggtctaggagtagaattttgtgcagtctatgctggctcccctgttgatgtgagtatgctttcaaggctgttaaggccactgaaatcacctcaattggtgtctgaggaaaggattcgatttgtgttgttacttagaagaaggttccggatgcttactttggtatgctcaatgcaggataagcttttggacaacacaagtgttacacacctctttcccatcaccaaaaagatattttgccatcattactattactag

SEQ ID NO: 86981 - DNA, 285 bp, Glycine max
  Peptide Sequence Number=SeqID_203759
atgggttgcatgctcagtacgttggtgctaattttactccccatatcatcactgttaattctggagagtcaatcagcatgtgctctcactggaaagtatactcctgataaaccaccaagtggccgggccaaggggcagaatttatactccagaattacggactcgtcttccccacaggagcctcagcatgcctctcaggcaccaccagtttctaatactaacaagaatcataatcaagaggtttcgttctctctctctaataattttgttagttgcataacttga

SEQ ID NO: 86982 - DNA, 525 bp, Glycine max
  Peptide Sequence Number=SeqID_203760
atggagccaacccaatcctctgaaatgctggttttcaacatgggaacgggtctggaaagaaagaaccgatcaaataagcttcaggggcaaccctccaagaatctaatggcggagaggagaagaagaaagaggttaaacgaccagctctcgatgctaagagcaattgtccccaaaattagtaaggtatgcactatgcaaacatctatacttggagacagtactattgattacatgaaagaacttctggagaagatcaacaatctgcagcaagaagtagaagtagattcaaacatggcaagcattttcaaagatgtaaaaccaaatgaaatcctagtgagaaattcacccaagtcctgcattgatttttatattttcctatattggtctttgcagtttgaggtggagaggagtgtggacacccggtcttcatgctcagaggaatcggagcaaaggacgatgctgagttctaaagacataaagcaagcgttgtttagaagtgcaggatatggaggaagatgtttatga

SEQ ID NO: 86983 - DNA, 1968 bp, Glycine max
  Peptide Sequence Number=SeqID_203761
atgtatgaaccaaaaaatattctcattactggagcagctggattcatagcctcccatgtcactaccaggctaattgatagttaccctagctacaagattgtagctcttgataaagtagactattgctccactttcaagaatttgcagtcatgtgcttcatcaccaaacttcaaattcatcaaaggtgatatagccactgctgatattgtgaatcacattttgatagaagaggagatagacaccattatgcattttgctgctcaaacacatgtggataattcatttgggaactccatggaatttacctacaacaatatctatggcactcatgtgcttcttgaagcgtgcagggttaccaattgtgtcaaaaggttcattcatgttagcacagatgaagtctatggtgaaacagacttagaggctgatattggaaaccatgaggcatctcagcttctaccaaccaatccttattctgcaacaaaagcaggtgcagaaatgttggtcatggcttatcacaggtcttatggtcttccaattataacttctagaggcaataatgtttatggtcccaaccaatacccagaaaagcttgttcctaaattcattcttcttgccatgaagggtgagaaattgccaatccatggagatggatccaatgtgaggagctacctccactgtgaggatgtggcagaagcctttgatgtcatacttcacaaaggagagattggccaagtttacaacattggcactaagaaagaaaggagtgtgttagatgtggcagaggatatttgcaagctctttaaattgaatcctaaagatgtcattgagtttgttcaagacaggccttttaatgataagcgatatttcctagatgatcaaaagctcaaacaacttggctgggaggagagaactccttgggaggaaggacttaagatgacaattgattggtacataaagaatcctgattggtggggtgatgtatccactgctttaaatccgcatccgcgtttttcggctatcaatctctctgatgaagctcaatggtcctttcaatatggatactcgaggcttgcaaggtcatatactgaagttggtagaaaaaattcaggattgaagtttttgatatatgggaggacaggttggataggggggttgttgggaaagctttgtgaagaagagagaattgattgggaatatgggagaggaagattggaagataggaaatcacttatggaggatatgagaagggtaatgccaacccatgtgttgagtgcagctggtgttactggaaggcctaatgttgattggtgtgaatcacacaaggttgaaactataaggactaatgtagtgggaactttaactctggctgatgtttgcaaggaacatggcttatatatgatgaattttgcaactggttgcatatttgagtatgataaagagcatcctctaggatcaggcattgggttcaaggaggaggacaaaccaaatttcattggttccttctattcaaagaccaaggccatggtggaggaccttctaaaaaactatgacaatgtctgcacattgagagttagaatgccaatatcatcagatcttagcaatccaagaaacttcatcacaaagatttctcgttacaacaaagtggtaaacatacctaatagcatgacagtgctagatgagctcttacccatatccattgaaatggctaagaggaacttgaaagggatatggaacttcacaaacccaggagtcattagccacaatcagatattagaattgtttagggattacatagacccaaaatttaaatgggagaattttgatttgggagaacaagcaaaggtaatagttgctcctaggagtaacaatgaaatggatgcttccaagctcaaaaatgagttcccagatttgttgtccatcagagattccattatcaagtttgtctttgagcctaacaagaaaacttga

SEQ ID NO: 86984 - DNA, 669 bp, Glycine max
  Peptide Sequence Number=SeqID_203762
atgaaagaaagtgaatctgtcaaagagatcactgatagacttttgaaggtggttacacaaatcagattagttggagaggagctaagtgatcaacatgtagtggagaaaatcctagtgtgtcttctagagaggtttaagtcaaaaatctcctctctagaagaaaataaggatttctctcaaatatctattccaaagcttgtgaatgttctacaagccactgaacataggagatctttgagaatggaagaaagcatggaaagtgctcttgtggcatacaccaaaggcaaagcccaaggccggagcagtcctagtaaaaagtcatatggtggaaaagaaaaggaagaagaagcaacaagaaaggaggagctagatcaaacttacttctccaaagtcaccataggcaatggagggcatgttgatgtcaaaggaaaaggagttgttgttgaaactccttcaggtggtgagggacaaagtttgaggggtgtggttggagaattagcgaagttgttgcagcttaatggattcatttgtcctacgccatcaacccctcccgcctcagactcacctacgaggacgtgtggctccaatccgatgatggtgttcggcttcacgcttggttcatcaagctcttccctaattgtcgaggtcctcttccttctcttctcctag

SEQ ID NO: 86985 - DNA, 499 bp, Glycine max
  Peptide Sequence Number=SeqID_203763
gggctgaggagctgaagggtcaaggaggagagaggcttacgctcacagagcctcaagaggttaaggttgcttgcatggattgtggtgagggtcgggtgccggtgttgcgtggtggtgctggatttggatggaggtggaggtgtgcggcggtgctgcaggataagggtggggacgtggagcacatagaatttgaaatggctgagcagcaaatgaccaatgttgttgcttcttcctctaactcttcttctatgttgtctcttgaaaaatatgatgttttcctaagctttcgaggtgaggacacccgtaggaacttcacaagccctctttatgaagctttgttgcaaaagaaaattgaaacctatatagactaccaacttgaaaagggagatgaaataacaccagcactaatcaaggccatcgaagattcttgcatatctattgtcattttctcaaagaactatgcttcctcaaaatggtgcttggatgaactcagcaagat

SEQ ID NO: 86986 - DNA, 618 bp, Glycine max
  Peptide Sequence Number=SeqID_203764
atggcctccaacttgcagatgagtcctcaggtggagcagatccacggtgaaatccgcgacaactttcgagccctcgcaaatggcttccagaagctggataagattaaagatgccaatagacaaagtaatcagctggaagaactcacggacaagatgagggagtgcaaaaggttgataaaggagtatgatcgtgagattaaagatgaagagggaagaaatcccccagaagtgaataagcagctcaatgatgaaaagcaatcaatggttcatatttcttccatttctgcctttgacacaattgcttcttttgaaggttatggaacaaatcagattgccaataccggagcaagtgtatctacagctgaagaaaatgttcaactggcatcagaaatgtcaaatcaagaacttatcaatgctgggacgaagacaatggatgaaactgatcaggctattgagagatctaagcaggttgtacatcaaacaattgaagttggcacccaaactgctgctaccttgaaaggccaaactgaacaaatgggtcgtattgttaatgagcttgattcaattcagttctcaattaagaaggcctcccaacttgttaaggagattggtagacag

SEQ ID NO: 86987 - DNA, 777 bp, Glycine max
  Peptide Sequence Number=SeqID_203765
atggaggttatgaagatacatgctcctcttgctcatgctgtgggaactacctacttgtcactggaattggaagatctctcgtttcagtacttgtttccttattcatatctttatgtggattttttgtggttgcaaagtcacgagactgggggtgtatctctaattgacatctacaaggaggaattgctccagaatctaaaggctgatcccttgcttgctgaacttgtggatgatgtcttgatcaaaggtcgctataagagtcgttatagcacaatgaagaagctgctgaaggatggtcggaagccagaagatgtgaatgatatcatccaatctatgtggaaggaagtcccttatcggacaaaggattatattgccaggccaaaagcaaatggatataaaagtttgcatttggcagttgaagtgattgaaaatggtaagacaagagcattgatggaaatacagataagaacaactgaaatggacaggctagcagttggtggaacagctgcttattcattatacaaggctggccttactgatcctgaggaagttggaattgaaattgaccagagagatagagtgtttcgccttcttgacaagaacggagacggtaaaattagcattgaggaacttacacaagtgatggaggagcttggtgctccaggagaagatgcccgagaaatgatgcagctccttgactcaaacagtaatggccccctcagctctgacgaattccatatgttccaagaacagacctatgatggagatcaagattaa

SEQ ID NO: 86988 - DNA, 774 bp, Glycine max
  Peptide Sequence Number=SeqID_203766
atggtccacatatcagatattaaactgataagaacagatactacacttgatcttagccaaaaggccgagaaaggtttcttgttgcgtaacacttttaatattgacgaaaaggacaacaattctgagcaattgaggctgaatttaccaatagtctttacaagaacactctccattactaaaatagtggaaacggctcctatctcttattattatatcataatcataaaccttggagatcattttacttgcttggtgacaatctttacagaccctcagattcttggtgacgcgaagggtctctcctcgtttggtcttcaacaaaccataagcaactgcaagtttttcactatggtagaacaggggattctccctttcctcctcaacaagatcatgcaacacaccatccgtctaacgagtaacgacccaacaaccacaaacatagttgtggtcgtggtggagaagaagagagaaaccaagcaagctgaattgaatgaatggaggtgttgcagttgctgggttccgattttacccttcgccattccctttccaagcccaccgtctcccttcctcccactcattcactctccggcggcgctcggtggtgggagcgttcaacgagttgacggagagaatgaacgtgctgtcgacgagctctccgcgtcttctgttcaagtgcctcaaactttccattcccatcttgcagagttctcctctcgctcccgatggtcgttcccttctctccaaagccatatccgtcgctatgctcctcgctga

SEQ ID NO: 86989 - DNA, 534 bp, Glycine max
  Peptide Sequence Number=SeqID_203767
atggggtgcatgtcgtgcgggtgtttgagtttcttgacggtgctgtttcggtgggtggtgttgtcgttttccattggtggtgaccttccagataaagtttccgccagagtttgtgatgaaggcgttgccgtggtggtcgacgatgacatcattggcagcatcgatctcttcggaggggagggaggagaggaagaggcggcggcgggagcggaggtcgtaggtgacgagggcgttgaacggagggatccgaggaggaagtgctgcggtggtggtgtgggtggtgttctgttttctggtaaccttttattatgttttcttcgagtcaaagattacaatcaaggttctccatgcctagcaggaaatatattggtctataacaagtcccaaattgttacaattagaaaaaacattgacagaaatagttcttattgctggcgtcagcataatttggtgcttctccgtgattcagggcaaaggttcttgcgaatcccccaaacgagacaaatggagatatgcgtcagtccctgcaaataa

SEQ ID NO: 86990 - DNA, 240 bp, Glycine max
  Peptide Sequence Number=SeqID_203768
atgaaaactgaggttgtgtttccgcaacaccaccgaacgattgctggcttgcagaagtatcagtgtgatgaccctgaaaaggatactaatacatcggtgtcggatactcagcaaatgtttgtggcgtgtaatacattccatggccacgctccggcattttttgggaatattcttccccttcaacagtctcccttcgaaattgacgctcagatgcaggaccatgtgacactggctcagtga

SEQ ID NO: 86991 - DNA, 390 bp, Glycine max
  Peptide Sequence Number=SeqID_203769
atggtgattataaaccttgtgaagaagaagaagaagagcgagagagaaggaatgcgacttgggaaatacgacttgggtaggactcttggtgagggcaattttggcaaagtcaagttcgctaggaacactgattctggccaagcttttgctgttaagatcattgacaagaacaccatcgtcgatatcaacatcaccaatcaggcatccaaaggtaaacacatcgaaggtgaaggtagaaagctgttccaacagttaattgatggagtgagctactgccacactaaaggtgtcttccccagggatctcaagcttgagaatgtactagtggataacaaagggaacatcaaaataactgattttggtcttagtgctttaccccagcatcttagg

SEQ ID NO: 86992 - DNA, 4584 bp, Glycine max
  Peptide Sequence Number=SeqID_203770
atggttgaccctgaatccacgtcactctcgccggacaagttggaagatgtcctcagtcgcctcactaaacagcagctatatcttggagagtccgttaacgccatgactctcaagattgatgaactcattcaacgaatctccccggtgttctccaccaccccacctactccaccaccattaccaccacctgtacctacacccatccacaggttgaaattagatgtgccacggtttgatgggtcagacccacttggctggatttacaaaataactcaattttttgagtaccatggtaccccagattcagacaaactcaccattgcttccttttatatggaaggtcgcgcgctcgcctggtttcagtggatgaacacctctgagcaatttccgtcatggcctgccttcttacatgccctgcgcacccgctttgcttcttcccaattcgaggacccttcaggagctctgagtaagcttacccaaactgggacagtgacgcagtacctttcggattttgaggacctcgccaaccgcacgacagggttgccttccaccttccaccttcctcctcagttgctttatctccggcctcatcccggagatacggcgggaggttcaagcccaccagccggccaccttggttcaagccgcgggcctcgcgcgcttgcaggaggagaatgcccaccttcagggtttccttccttccctcaaatcaaccctaattccccagtatccttcccacctctttcccctatcctcaagacaccctctccgccgcccccttcggccttaccccctctattaccacccccgcccccgcgaccaccgccccaaacctggaaacggttgtccccggaggagattgcctctcgaagggaacgtggcctctgtttcaactgtgaggagaaattccatcgagggcaccgctgctcctctaggttttttctcctcatatcagatgaggacgacccgcccctttctcatatacctaattttgacccgcccatcacattaactaatgacccgatacctacccaacccaccgatccacccgaaagcccaccttcatactcagcccaaatatcacttaattcccttgctggccacgttgctccggagaccatacgcttcatcggtgccatctccgaccaccctttgctactactggttgatgggggcagtacccacaactttgttcagcaacaattagtgacccaattaggcttatcctgccgaaccacttctcctctgcgtgtaatggtgggtaatggccaatatttggagtgccattccatatgtgaagccatttccgtccaaattcagaatcacaacttcacggtcgacctccatgtcctcccaatctcgggtgccaacgtggtcctcggggttcaatggcttaaaacactaggccctgtgttgactgattactccaccttaagtatgcaattcattcacaatgatcaattaatcaccttgcagggggatcccgaggctagcctgagttccatgtcttcgtcccaattccgccgtctctgtcggacccagccccagggactttattttcagatcacgattctagctaatgacactccaccttcttccccagacaccttacccccttcccttcaagctctgctcaccaagtatgccgtcctcttccaaccatctccgacacttcccccaccacgtcccactgaccaccacattcatttattaccctcatcaactccggtcaacgtcagaccgtatcgttacccccattttcaaaagcaggaaatagaattgcaagttgaatcaatgcttcagaagggtttaatccaacccagtactagccccttttcatccccggtcttattagtgaagaagcatgatgggtcctggagattttgcgtcgattaccgggcactgaattccctcaccgtcaaggacagatttccgatacccactatagacgaattactggatgaattggggggtgctcaatgcttttcgaagctcgatcttctccaaggttatcatcaaatccgcatgcattcagaggatatccctaaaacaacatttcgaactcatcacggacattatgagttcagagtgatgccctttggcctctgcaatgctccatcttcttttcaggccacaatgaacttcattttcaggccttttcttcgtcgcttcgtcatcgttttctttgatgacatacttatctacagcagctcttttgaagatcacctgcgtcatctggacttaaccttccaggttctccttgacaaccattttgttcttaagaaatctaaatgttcttttggtcaatcgcaggttgaatatttgggacatttagtttcccagcgtggtgtcgaacccatgtccgataaggttgctgccattgttaattggcctcaacctcattccaccagagctgttcgaagcttcttagggctcgccggtttttaccggagattcattcgaggctatgctatgattgctgaaccgctggtcaaggccacgtcagaccctttccgatggaccccacaagctcaacaagcctttgaagctcttaaatcggccttgtccaccgctcctgttctttcacttccagactttcaggagcctttcacagttgagacggacgcctccggcaatggcatgggtgccatactatcacagagaggacaccctattgcctatttcagcaagccattccctaagaaactcctccgggcctcgacttatgttcgtgaattattcgcgattacttcggccttgaagaagtggcgccaatatcttttgggccactcattcaccattgtcacagatcatcggagcttgaaagagttgctcactcaggttattcagacacccgaacagcatatgtacttagcaagactaatgggatttgattatcaaatccagtatcgctccgggaagcataatcaagcagctgatgccctgtcacggtcgccggacttccatccttcactctcgctgctcttatccattccttgtttgacctttcttgaggaattacgccagcagttagccaacaatcctcaatattgtcagcgccaacaagacttcatcaattctccggcctcctaccctgatttcactcttagtcaaaatttcctcctctacaaaggaaaaatttggttaccccgcgagcttcctcttattcagacactcatgcaggaatatcacgcgactccgatgggtggccacatgggcgtcgccaagacgacggctaggttatcggaaaatttcatgtggccgggactccgttccgatgttgctacctttgtggctaattgcacagaatgtcaatttaccaaatatgagacgaaacgcacggccggtctgctatgtcccttacctgttccctttcggccatgggaggatctctccctggatttcatcacggggctcccctcatatcaaggcaaaacggtgctacttgttgttgtggaccgcttttctaagggcattcatttgggtatcttacccactgcgcacacggcacacatggtcgcctctctcttcattgacatcgtggtcaaacttcatggtcaaccccggagcttagtttccgatcgcgaccctcttttcatgagtaccttttggcaagagctttttaaattaagtggtacacgacttcgaatgagttcagcctaccatccacagagtgatggtcagactgaagtcatgaacagagtcatcgagcaatatttgcgggctttcgtgcatcgccggccgggaacctggggccgcttccttccttggattgaattatctcataatacctcctggaacgtcggcacgggctctacaccatatgaaataacgtttgggcgcaaacctttctcttttccagactatattacggggtcttctaaattagatgcggtggacgacattctgaagcaccgcgaggaagtctttctttgcatccgtcagaagcttttaaaggcccaggctgccatgaagcaaactgctgatgccaagcggcgtgaagttgagtatgaggtgggtgcttgggtgctcttaaaactccgcccatatcggcagcgttccgccaaggaagctccggccaactccggcaagttagctaaacgcttctacggtccctttctgattctcgaaaagattggtaaggttgcttatcgattgaaactacccgagggcgcgcgaattcaccccgtcttccactgttcacttttaaaaccttttcatggtgcctccgtcaccagtgatacaccttccctgccggaccaattcctcaataaccagcccattatctctcctttagctattttagatacacgccgtgctgcgacacccgaggggtcatgggaagtcttagttcaatggaagggattactacctgacgacacttcttgggaagattgggaacagctgaagcagacccatcaccttgaggacaaggtgattctccaagggccacgggaagatgatagtaacagagcaacaccagaagaagaaatagagaaagcagcagacatgaacacaggggtacaaacagcaaaaccaaaaaggaggattaccaggcccgcgtatctcagagattatgcttga

SEQ ID NO: 86993 - DNA, 1923 bp, Glycine max
  Peptide Sequence Number=SeqID_203771
atgtacgcggcagaggttttccgcgtcttcgccgtgcgcggcggcaacgcttctccggcggtggctcccaccaccaactgcttaaaaatcgcagctttcagcacacccactttccgtaacagcgtgaatgcgaggtgggcgaaggctttgacgctctgtcgctgcagtgttgactcaaagtcctccgtcggcgacgaagttttctcggtgactcagtcgaacaagtccgacgtggactacctcggagagagcaccaaaggtgatttgaacgtcaagttggagcatcttgaggcttttggaattgatggtcatgcttcattagatggtccaattgaggaagtggctagatcagaggcaagaaaagctgaggatttgctacaagacttgggcattccgagcccttcttcatcgagaaattcgcctcgtggaatattctgcagccgtacattgaatttgcggtccattagtgccattggatatgacatggactataccttgatccattataatgtgatggcttgggaagggagggcttatgactactgtatggaaaaccttaagaatatgggtttccctgttgatggacttgcctttgatcctgacctggtaattagaggccttgtcatagacaaagagaaaggcaatttggttaaagctgatcgatttggttacataaaaagagctatgcatggtaccaaaatgttatctactcgagctgttagtgagatgtatgggagagaactggtggacctgcgaaaggagagtcgatgggagtttctcaatacactgttttctgtgtctgaagctgtggcctacatgcagatggttgacagattggatgatggaactataccggcagatcttgctcttgattataaagggctatataaggctgttggaaaagctctcttctgggcacatgttgaaggtcgccttaagagtgagatcatgtctaagcctgaactgtttgtggagcctgatccagaattacctttggcacttttggatcagaaggaggctggcaaaaaacttctactaattaccaactcagattatctttacacagacaaaatgatgcggcattcttttaatagattccttcccaacgatatgggttggcgagatctatttgacattgtaatagtctcagcaagaaaaccagagttcttccaaacatcacatcccatgtatgaagtggtcacaggcgagggccttctgcgtccatgcttcaaagctcaaactgcttttggatctgctgctgcctactttacagaaatgggaatggagggtggtttgtactcagggggaagtgcacaaatggttgaaaattccctagatattcatggagatgaaatattgtatgttggcgaccatatttacactgatgtcagtcaatcaaaagtccatctgcgatggcgaacagcattgatttgtcgagaactggaagaagagtacagtgccttgattggtagccgtggttatagagaatcattggtggagcttattagtcaaaaggaggttgtaggggatctctttaatcaacttcggctggctctgcagaggcgaagtaaagaccgtcctgctcaaaccctagcagcaactaatctggatgatgaagacctcactgatagcatgcaaaagctacttattgttatgcaaagactggatgagaaaattgctccaatgctggaggcagatggggagctcttcaattcaaggtggggttttctatctcgtgctgggctgtgggataaaagccacttgatgagacaaattgagaaatatgctgatatttatacatctagggtgtcaaattttttgtattatacacccttcatgtatttccgctctcaggaacagaaccttgcgcatgactcatacacatactattgttcacaactttataatgagaattcttcctag

SEQ ID NO: 86994 - DNA, 852 bp, Glycine max
  Peptide Sequence Number=SeqID_203772
atggatccgattgtttcatacgcagattgtgtggaagtggaacatggtcatggtgtgaagcccattcaagattggtataagtggcgcctcgttttggcttatgatggaaccaaatacgcaggttggcaatatcagcagtctccccctactgtacaatgtactttggagaaagctttaactcgagcaacaaagcttcaaaggaaggatttctgtttggttggtgcgagcaggaccgatgcaggagttcatgcttggggtcaggttgctcatttttttacaccttttaactatgacaacttggaagaacttcatgcagctttgaaccgtaagatttaccattacaagatatacaatgatgccatcatggatccattccaacggcactttgcttaccatagtgtgtataaactcaatagcgctgttatgagagaagctgcaaaatattttgttgggaagcatgatttctctgcctttgccaatgcatccaacaatgatggggtaccggatccagtgaagcatgtattccgatttgatttgaaagaaatgggagctcttttgcaaatagaagttgaaggctcaggtttcttatatagacaagtccgaaacatggtggctttgttgcttcaaattggtagggaagctatacctcctgacattgttccacatattctggcgagtcgagatcgaaaggagcttgcaaaatactccttgtctgcccctcctcatggcctttgtcttgtttctatcaactataatgaaagtcacctgttgcctccaccggggtgtccccctgcaaacagttttggtaggcatcataccataaggaaatgcaaggttccattctttttgtaa

SEQ ID NO: 86995 - DNA, 204 bp, Glycine max
  Peptide Sequence Number=SeqID_203773
atgccgatactcaagatgatcctcccattggtggcgcaattcttcaaagaaaagagggtaagggacaaaaaggctcatgtagaatgcattggaaccacgcgagcgccctgccttccatgtaccgatggtgatggtggaggtgttggagaagaagatgacgagaggatgagagtgacacgattaaggagttcatcaattttctga

SEQ ID NO: 86996 - DNA, 999 bp, Glycine max
  Peptide Sequence Number=SeqID_203774
atgccgatatccgccgcccgttcggcgatcgcctgcgcgatggctgggctgggcagctcctccagcgcgatgtcggtgtacgggtgcagcaccagaaaatccgccagcagttccggcagaaaagcgtcggcggcgacggcgttcaccggcgggcgtcgcctggacgccgcgcggattgcgcgtcagcagcgccacgccggcctgttgctccagcccgcgcatgcgtgcgctggcggcggccagcgacagcccgacgcgctcggcgccggcggtgatgctgccggtctcgagcaccgccgccaacagccgcagatcgataaagcaggctctgccattgccgcattgtgccgcggcgcggcgccggccacaatcgggccgttgattcgccataaggatagacgcatgtcgctgacgggcgatcggtttggggttgccgacggtgtcgatggggctgctcagcctgatgatgccgccggggcaggccgccgcgctgctgctgttgccctcattgatcaccaacctgtggcaactgctgtgcgggccgcggttgggggcgctgtgccgtcggctctggccgatgatgctgtgcgtcacgctgggaaccttgctgagcgccggcacgctcaccgccatcgacggccgcctggcgccgctggcgctgggcatttgcctgaccggctatgcgctgttgggttttacccgtttcgactggcgcgtttccgctgcggcggagccttggctggggccgctgtgcggcctgttgaccggcgtgctgaccggcgccaccggcgtgttcgtcataccggcggcgctggggctgtcgttcaccgtctcgacgctggcgctggccgccggattagcctggcatcaggcgctgcccggcgcgttgctcggcgtttcgctgttggcgctgctgccggcgttggccggcatgtggctgggcgggatcgcgcgtcgtcacagcagcccgctgatttttcgtcgccttttctttattgg

SEQ ID NO: 86997 - DNA, 489 bp, Glycine max
  Peptide Sequence Number=SeqID_203775
cgatctgcgggcgatggccaactatgtgatgtcgctgagcaccaaggcgacgctgaatgtggaaccgcaggcgcagttggcggcccgcgccttgccggcggcggggcaactggccggcgagcggcctgccacagcgccgccgccggcgggccgcagctgttcggcgtcagtcccgatctggccaataacaccaatatcttcagcgatcgccccgataacctgatcaaggtgatcctgcaagggatccccaaaccggctaccgccgaattgggctttatgccgggctttaaggacagcttttccgatcggcaggtgacggcgctggtgaattatctgcgccaacgctatgccggcgacaaaccggcctggcgcgacgtggaggcgcaggccaaggttccggcgattattctgtgtcacggcttctgcggcattcaggagctgttgctgccggcctttgccgaggccttcgtcaacgtcggttttgcggcg

SEQ ID NO: 86998 - DNA, 1035 bp, Glycine max
  Peptide Sequence Number=SeqID_203776
atgtcttcagtcatttacgctttcaaagactacaatgtcttcggtcatttacgctttcaaagactacaatgtcttcagacatttatactttcaaagacttcaatgtcttttgtcatttacgctttcaaagattacaatgtcttcagtcttttacgctttcaaagacaacaatgtcttcagtcatttacgctttcaaagactacaatgtcttcagtcaattacatttacaagactacaatgtcttcagctttttacatttacaagactacaatgtcttcagtcatttacgctttcaaagactacaatgtcttcggtcatttacgctttcaaagactacaatgtcttcagacatttatactttcaaagacttcaatgtcttttgtcatttacgctttcaaagactacaatgtcttcagtcttttacgctttcaaagacaacaatgtcttcagtcatttacgctttcaaagactacaatgtcttcagtcaattacatttacaagactacaatgtcttcagctttttacatttacaagactacactgtcttcagtcatttacactttcaaagactacaatgtcttaagtcatttatgctttgaaagactacaatgtcttcattcatttacatttacaagactacaatgtcttcagtcatttacgcttttaaagactacaatgtcttacgtcatttatgctttcaaagactacaatgtcttcagtcatttacatttacaagactacaatgtcttcagttttttacatttacaagactacaatgtcttcagtcatttacgctttcaaagactacaatgtcttaagtcatttacattttcaaagactacaatgtcttcagccatttacgctttacaagacttcaatgtcttcagtcatttacgctttcaaagactacaataccccaactcgcccaggctagcatctggctcgcctgggccatggaattacctcttggctaagcaaccaactcgcctgggcaagcttcagctcgcctgggcgagctcattacttcaaggctaa

SEQ ID NO: 86999 - DNA, 351 bp, Glycine max
  Peptide Sequence Number=SeqID_203777
atggatgggcaatggttgaagaaggacgccaaacctccgcaagacgaatgtactccttctcctccgcctcaacgagatgactcctcaaccctcatgttctttcggagttacgaggcctccacacctatgttggtgaacgctttgattccttggatggtcgtatatatgccattgatgctcgctttgaaggaatggatacccgcatcactcagcttgaggaggatgaaattaaattgtcatcatcaaaaaaggggagattgtagaagcaaagactttgatgttttgatgatgccaaaggatcatgcgcttctcaagtttaattcaagaggatcatatgcttctcaaggttaa

SEQ ID NO: 87000 - DNA, 294 bp, Glycine max
  Peptide Sequence Number=SeqID_203778
atggacaacataatgagcaagctcttcaacctcgatgtgtaccctgaaatcaatgaggatttcttcaacctctcgctctatggtagtgtcatcacacttgtttcctccattctcatgttcttgctcttttactccgagctccaaaggaagagagagaggagatgtcacttcaaggagaagatgagtctagaagaagctcaccaccagaggaggccatggataagagcttggaggaaaaaggagatgaatgaagggagaggaagagaagagcacgaaattttgtgctctaaatga

SEQ ID NO: 87001 - DNA, 834 bp, Glycine max
  Peptide Sequence Number=SeqID_203779
atgtcaaataatacaattaaacttcaggaggtacaacttctagagacaaataataagaaaaatcaagaagaaaaattctatccttttcacttttacatcacttatgtaataaaagaacaaccagccgagacacctgtcacactctcgattttttcacaattttatattacttctacttgccagtttcaccaataccaagtggttgggagggctcttcccatggaaccagatcagcaccctaagatctaccgaatgaagctctggtccatcaataaggttcgcgccaagtccaagttctggtattttctgaggaaattgaaaaaggtgaagaagagcaatgaccaagtgtttattatcaacaaggatttttgtaataaggttggaaatgtcttgaggcaaagtgttgctttcagcacaaaagcacttgtttcatccatgcttaattacattcgctgcatgttttcaagcaagcttttcattggaggcctttcatatggagttgatgatcagtctcttaaggatgtattttctgactttggagatatggttgatagcctaactttagcttctgcttcacacggtatggcaaacattctgtgttgtgtaattgatttctttgagatcttccatgatttaaatgaagaagtaagggctacggctgcaagaggccatggtcttatggctcgtgttaaacagcttgagaggttgaagttccttcattggagaaggcttttttttctcaaactcatattcctcattctatacaaatggatgttagatttctctttacagagtcccattgtaatcattaggtgtaattgtcccttttgctaa

SEQ ID NO: 87002 - DNA, 411 bp, Glycine max
  Peptide Sequence Number=SeqID_203780
atggtgaacgtgcctgagtggggtctcaaacttcacatgttggcttgtagagtccagctgttaagggccaggcgtccacgctcctataataggactgacatggaggctttgaatcagcttgcgggtgaaagaggttgtccagtgctgaaagaggtttcttgtgtcgagggaatttgtcccgtgttgagggagtgtggcaaccttgatgagtgtaaaaggattgcaggtcgatacgacttgtcaagccccagagcctgggcaagtgttgtccgggctgcttctgtcaagttatctgtgatgaacatgtctttggtgtgtcaagtaagcaagcatgtgcagcgcatgcgctacactcttacatacatgtcattcatggagtgggcatgtactggagtggcggttcgtgcgtga

SEQ ID NO: 87003 - DNA, 429 bp, Glycine max
  Peptide Sequence Number=SeqID_203781
atggcagagaggaacgatcgtgccattgcttatgctcttcgggctctaactcaggttatggagaatcataatggaggaggtggagttgttaggtttaacaagctaaatagaagggatcatgatccttatcatgcatataactggttgcaagagatcgagaagatctttagggctatggcttgccctgattatcagaaggtgactcttgatgaaaaagctataactagccctaaggaggtggtggaatctattcgagaagaagaaggatctactgaggatgtctcaagagttttaaagtggataaaaaggaagacattgtggtggacggaagtacctttggaagttggaggaagaagcaagggaaatcgaaagccaaaaaacacaagaacaagtgaaaaagtacggaagcaagaagacagtgaacagtaa

SEQ ID NO: 87004 - DNA, 243 bp, Glycine max
  Peptide Sequence Number=SeqID_203782
atggctttaggagctatgcaaagcttgctagagctcagagttgtgctagaggacataagtcatcatcaactcaatgcaatgagctttgcaattgttggaggagggcttaacaattgggtgcaactcagacatagagacctaggaagaggcctgacaaggatggtggcaagaaaggtggtaggggcggttgattattgtattattatcacatcgtttgctgtagaggacaaggatttcatctag

SEQ ID NO: 87005 - DNA, 354 bp, Glycine max
  Peptide Sequence Number=SeqID_203783
atggcaaagaggaagagctggtttggatgggtaaaaaggctattcacttctgagtcaaaggacaacaaaaagccaaacagatgggggtggagttttggaaggattaagcagaaacagtatcctacaattacagctccaaataggacactgattgaagcaagtgaagagcagagaaagcatgctttaaccgtcgctattgcaactgcagcagctgctgaggctgcagttgctgctgcacatgctgctgctgaggttgtcaagctcactggcacttctcgctcttactcatatctttccaagggagacaaaagtttagctgccatcaagattcaaagcacgtaccgtgcacatctt

SEQ ID NO: 87006 - DNA, 204 bp, Glycine max
  Peptide Sequence Number=SeqID_203784
atggaccgtttaaaaaaattggttcattacctgcacggaccgtgggccctgcgggccagtccatggacccgggcccatttacccatccctactagagataggcccagttttcaggcaggggcaggacccgcagggatccccgaagataaagatggagctcaggaagatgatgacatggctgatgtgatggacttcttcctttga

SEQ ID NO: 87007 - DNA, 348 bp, Glycine max
  Peptide Sequence Number=SeqID_203785
atggtggctgaggccggcttggaagcagatatgacttcaaccaagacgacaggatcaacgagtgatcatccaccagctcaaggtcctgaaaatacccaagaaattgaatacatgcagcaggattgcaagaagaacaaaatgaagggtgaaagcaataaaacagtacccttttacaaacttttctcatttgcagactcttgggattgtcttctgatggtagttggggcaataagtgcagttggtaatggaatctctatgcctttaatgacaatacttattggagatgcgattgatgcttttggaggaaatgttgataataaacaagcagtagttcatcaagtttccaag

SEQ ID NO: 87008 - DNA, 1105 bp, Glycine max
  Peptide Sequence Number=SeqID_203786
ttaccggctgcacttatgtctcactctcaatggagaaagaatgtagtgggaagtttgcaaggcaatggcgtttatgtgaaggggaaacaggaacatgaaaggacacaaggaaagggttctggtggtagacagaggaaaaagtccaagtctagaaaatgcaagaaagagaagagtgttacaaacgcaaccaaaaggggcatttcaataggtaacgacagagagtgtgttgttgttggaatgagacaggtgcagattgctatggataatgaactgatggagatcgagataccctcagagtgtgtaaggggtgagcatgagatggtggagcttcataagagagggctcttgaaaggaattcagagttgcaagctgaataggccccttactgaaagggctcagcgtctgaggttgcaagctaatctttctaaaggattttgggcaaaagtggtgaatatgggtgcagtgtttgatgagcaatccacgttaccagagatagttgagacaactatgtcagtgtctactggagctttccccaacttcattgaggttacacctatacctgagtcaggatcggtgagtctaggtggaccacatcaggagtaccatcttgtcaaagataaagatcactgcagcattaaacccgttgtccaatatgggtttgaagaattggctaatttggttgcttttgcacttttcactagtgcgagatccttctaccatgagaaagacaatatggtgaaggaaatgaagtctttgcagaagaatcagacaaaggatcaagttgagcttcctgcaggcaacaaaaccatgggatatgctaatgggtgtacaagaggaaacctctacaaaggggcagtgctagcctcggtagccaatcgtgacatgcacttggagcaaatggatgtgaagacaacctttcttgacaatgatgtctgtgaatggattgaagcaatctccaaggcagttgtatggaagaaattggagagtcaatacatgtcaaaacccttaaggtttgaggttaaggtgggtccatgcatggaggctaggaagcgggtcccgcatgtgttgtggcagcacaaggtactagagcatgttggtggaaatg

SEQ ID NO: 87009 - DNA, 1479 bp, Glycine max
  Peptide Sequence Number=SeqID_203787
atgatgtgcgtgtttcttttgcaggccattgctgtagcttcttgcatacaggacttgtggcctgttctcataattgcaccgtcttcgttacgcttgcaatgggcttctatgattcaacaatggctgaatattccttcatcagatatacttattgtcttatctcaaagtggtggatcaaatagaggaggtttcaatatagtatcttcaagtgccaaaagcagcattcgtctggatggactattcaacattatctcatatgatttggtgccaaagctacagaatatgcttatgacacatgactttaaggttgtgattgctgatgagtcgcattttctgaaaaatgctcaggcaaagaggacaactgcttctcttcctgtcataaagaaagctcaatatgcattattgcttagtggaacacctgctttatcacgaccaattgaattattcaagcagttggaagctttgtatcctgatgtatataggaacgttcatgaatatggtaaccgttactgcaagggtggagtttttggagtttatcaaggtgcaagtaaccatgaagagttgcacaacttgatcaaggcaacagtgatgattcgcaggcttaaaaaggatgttctttctcaacttcctgtaaagcgcaggcaacaagtcttcctagacttggaaaacaaggacatgaagcaaattaatgctctatttcaagagttggagatggtaaaagccaaaattaaggcagctaaatcacaagaggaggctgaatcactcaagtttgctcaaaagaatcttattaacaagatatatactgattctgcagaagctaagattccatctgttcttgattatatcggaactgtcattgaggcaggttgcaagtttcttatatttgcacaccatcagccaatgattgattcaatacatgagtttcttcttaagaaaaaagtgggttgcatccggattgatggaggtacacctgctgcttctaggcaacaattggttacagactttcaggaaaaagatgctatcaaggcagcagtgctatctattaaagctggaggcgttgggttaactttaactgctgccagcacagtaatctttgcagaattgtcttggactcctggtgacctaattcaggctgaagaccgtgctcatagaattggccaggtgtcttcagtaaatatatactacttgctagcaaatgacacagttgatgacatcatatgggacgtagtgcaaagcaaactggaaaatttggggcagatgttagacggccatgagaacgtcttggaggtctcagctagtctgccggtgaatagcccttcaaagcagaaaactatagaccagtatgttagaaaatctgataacatgggtagtttggtgagtagcccttcaaagcagaaaactctagaccagtttgttagaagatgcgataatacggataggttggaatatgagcccaaccccaaacgtccccgaagctga

SEQ ID NO: 87010 - DNA, 1731 bp, Glycine max
  Peptide Sequence Number=SeqID_203788
atgaagcaaaaaacgccttcttcaccaaccactgcaagaaatgcgtcgaagatgcaaggtgacaagtccctgcagagtcctccaccaccaccaccaccacgcctcagagcttcttctaaggctccgaagtcaccgccagagattgtaaatagggaatccatttcatcaaccagagctaaatcagtgcctccagacttgaagaacgtttcaagggccaaaaggggtgttgtggtgaacaagcctaagttgaatgaagaggctaaggttgttgttgttgctaggccacggcggagggttggggattttgatctgcaaaagaatgaagacgatgatcctgatgggaagaagaagaaggagttgcaggagaagctagaggtgagtgagaatttgatcaagagtttgcaatctgaggtgcttgcattgagggaggaattggatagagttaagagcttgaatgtggagcttgagtctcggaacacaaagctcactcagaatcttgctgctgctgaagctaagatatcaactgttgacattggcaacaatggaaagaaggggccaattggagaacaccagagtcccaaatttaaagatatacagaaactcattgctgaaaaattggaacggtctagagtgaaaaaggaaggtactcctgaaataatttttgctaaagcatcaatctcagctccaacaccaagttatgccattcctgaaactacaagtataggaagaaaatctccacccaatacatgcctgcagccaccgccaccagttactagtgtaggaagaaaatctccatccaacacatgcctgcagccacctccaccaccgccaattccgactcggcctttggcaagattagccaattcccaaaagtcccctgcaattgttgaactatttcactccttaaagaataaggattggaagatagactcaaaaggatcagtgaatcatcagagaccagtagttattagtgcacacagtagcattgttggagaaattcagaaccgttcagctcatcttttagcaatggtaacaactgaccatcctttccagataagggcagacattgaaacaaaaggagaattcattaatgaccttataagaaaagtagtagatgcagccttcacggatattgaagaggtcctaaagtttgttgattggcttgatgtcaaattatcatcattggctgatgagcgtgccgtcttgaagccttttaagtggcctgagaagaaagctgatgcaatgagagaggctgcagttgagtatcatgagcttaaaatgctagaacaagagatttcctcctacaaggatgaccctgacattccatgtggagctgccttaaaaaagatggccagcctattagacaagtctgagcggagcatacaaaggctaatcaagctacgaagttcagtcacacattcatatcaaatgtacaacattccaactgcatggatgcttgattctggaataatgagcgagataaagcaggcttccatgactctggtcaagacatacatgaaaagagtgacaatggagcttgaatccattcggaattcagacagagaatccattcaagattctcttctgcttcagggcatgcattttgcatatagggctcatcagtttactggaggtttggactcagaaacaatgtgtgcttttgaagagataagacaacgtgtaccaggacacctagcagggtctcgagaacttttggccggcataccataa

SEQ ID NO: 87011 - DNA, 774 bp, Glycine max
  Peptide Sequence Number=SeqID_203789
atgggcattgaatttgaatactggtcaggcagggaccctagtcaagaagggaagaaaaattttcacgtttacgaaagagaaaaggaaggaaagaaaaagagagctagcattgcatttgagagagcatccatggaagtggaggacgactgggatttgagcgcagaggacctcgattccctcgaaagagacgctttccagaaaattgcccaactacgcaaccctactccttcttctccgcatcaacgccaccattctgcaactgcaacaaccaaccaccttcctccgaaaccccttcccgattcgcgtccccaaactgctggtactttgtctcaagcagcaagagcattgcccacgtcattcaaatcagggacaaacaacgacaagcagtcaaaagagctgccaaagttttcagtcaaattttttcttcattccagtggaaatgttgcagccaagtttcaatatgaccaggtagtaattgctgcttttcgaagaatccctagatcttcttggaatgcaaaggaacggttatggatattcccactatcttcattgttagaagcagagaaggttcttggagaaatacctagttatagtgttcagatagataacttagatcccttagtgaaacgtgctgttgctgcagcgtctgcagttccagatcttcaaggtctgcaaatgctcgaggtatatatttgtgttttcttttttctgaaaaataatgaagttgctatttttgtccgctttactgaaagatcgataccacaagatccctag

SEQ ID NO: 87012 - DNA, 885 bp, Glycine max
  Peptide Sequence Number=SeqID_203790
atgaactcacggcaagcctctccgtcgccctgcgacatctgcggcgccacccaaaccctatctttgaccatccacaacatccgctaccgcgcccacacctgccgctactgcaccaactgcgtcctcaagcagcaccctggcctcttctgccctctctgcttcgaactccacgacgactctcccctccctccccaccaccgccttatgtgcgtccgctgccccgccgtcgcacaccgttcctgtgcgttcccctccaccaacgtctccgctgcacctgcgccagcaccaccgtttttctgcccttcttgtctcgattccaacttcacctacttcaaactccctgatcgcaagtccggagccgtcgacgtccagtccgccaaggtgctcgttactgctgcccggatcgctgccgtgtccatgagcaaggcggctgccgcggcgcggtacgacgcggaacgccgcgccagggaggccgccgtggccaggaagagagcgaaggacgcgctggagcacctcgcggagatcctcgccagggagcaggcggagcaagacgaggaggacattaatgagcagaacggcatcgtttctgctggccgaaggcgtggcgcgtttttggttagggcaagtgattgcatcgttgcatgccatgttgtgatacttatgatgcacttattatcatttaaaaagttcaccggtaattgtgtgtctggttacctccaactcagacctgttgcagttggagttggaaaaatttgcggcatgcattccaatgcaaatccaacggataaaagcaacatgaatgcaagagcaaggatcctgatccgttggcaaaatttattttgcctcaaatgtaattctgcaatggattcccaaacatgctcttga

SEQ ID NO: 87013 - DNA, 237 bp, Glycine max
  Peptide Sequence Number=SeqID_203791
atgaagggaaaaatcaagaccacatatagaaagaggattcaataccagcagtttatgtgtggttctcaatttgcagttatctggtcagacagaaatgctagaatctttatcggtcatcagttgactcttgagtccattcaagatcaagcagttcagtcgactgagagacagtgtctaaagatcccaatcaactgcatatccctttctacagatctcctctaccacattgtagcataa

SEQ ID NO: 87014 - DNA, 657 bp, Glycine max
  Peptide Sequence Number=SeqID_203792
atggcggatgaggttgtgttggtgaatttcaatctgagtatgttctgcataagagttaggattgcattggaagagaaaggggtcaagtatgagatcaaggaagaggatttggtgaacaccaagagtgcactgcttctgcaaatgaatcccgttcacaagaaagtccctgtctttatccacaatggcaaacccatctctgaatccctcattattgttgagtatattgatgaggtctggaaggataaggcaccacttttgcccactgatccataccagagagctcaagccaggttctgggctgattttgttaataacaaagtgcatgaagttgcaaagaggatatggactgggaaggtaggtgaacatgaggcagaaaagaaggagttaatagagaatgtgaagcaattggaggaggtgcttggcgacaagccatattttgggggtgagacatttgggtttgttgatattgctttgattcccttttataaatggttctctagttatgagaaagtaggcaatttcaagctgcactatccaaaactcattggttgggcaaacagatgtttggagagagagagcgtgtccaaatccgtttctgatgaaaaagatgtctatgagtttgttctgatgtacaggaaactgatcggggtggactga

SEQ ID NO: 87015 - DNA, 264 bp, Glycine max
  Peptide Sequence Number=SeqID_203793
atgacagtcgctgtatggttggttgcagggttctttggagattttttcttgggagcatgtgattcggagtttgactatggcaatctgcctaaaggatttactgaagctgcgtacttgtgtcattactatgctaaattatcccctcggaattcctatgccattggacctcttaatttcttgattaacaaagtaacagtcggtacttggcccgacatggggatgcaaaaagaaaagggcaaatgcaggataaggcaagggatttaa

SEQ ID NO: 87016 - DNA, 501 bp, Glycine max
  Peptide Sequence Number=SeqID_203794
atgtatctggttttgatggtttggtttgtgattgaacagatgcagatctttgtgaaaactttgaccggtaagactatcacccttgaggtggagtcttctgacagcatcgaaaacgtgaaagctaagattgaagaaaaggaagggatcccacctgatcagcagaggcttatctttgccgggaaacaacttgaagatggaagaacccttgaagactatgaaatccagaaggaatcaacgctgcacttggtgttgcggcttcgtggtggcatgcaaatttttgtcaagaccttgacgggaaagaccataactttagaggttgaaggttctgatacaattgaaaatgtgaaagctaagattcaggaaaaggagggcattccaccggatcagcagaggcttatttttgctgggaagcaattggaagatgagcgtaccttggaagattacgatattcaaaaggaatccaccctgcaccttgtccttcgccttcgtggtggtttctaa

SEQ ID NO: 87017 - DNA, 447 bp, Glycine max
  Peptide Sequence Number=SeqID_203795
atggagggtaataaggagactaagcaatatggccttgactctgccacttcttggtttggaagttgcatttcttcatgctcatcatcagaaaaagtgggaactcacggaaagcttcctagaactgcttccgaatcatcaggaatgaaacattctgagaggttggctgtgtttgggttatttgccaggttcatggtgtatttgacaagagaatttcacttggaccaagtttatgcttctaacattatcagtttatggtttgggatctcaaactttatccctcttcttggtgcctttatttctgatgcctatgttggtcgtttccgaaccatagcttttgcatcctttggtaccctttcggtgaggagttatctatgtggctgcctcagtcatattttacggttagattttcagtataaaagaaaaattacactcacttgccttttgtag

SEQ ID NO: 87018 - DNA, 408 bp, Glycine max
  Peptide Sequence Number=SeqID_203796
atgacatggaccatcccacagcttttcttgaagcctctccaggttatgtgggatgctaccgtgtttggggtgtttaatccagacttcctattgtacatcaagcatgaagatctctccgaaattgcacatggtgggaattccgatgtgtatagattcctcaagccacagtccattcagagatctgggcaatcgcagtttgaatcggaaagttacttgaagtgttggatgcagagttcaaaacgcgatgtctaccttggagcctacctgaatgggccagacaactaccttaagggaatagttaacagtgctttgaaaggacttcatgatactccacaacctaaatccaatgctggtgctaggtggattgttgttaagtattttaacgatgttagaccattggaagcatag

SEQ ID NO: 87019 - DNA, 954 bp, Glycine max
  Peptide Sequence Number=SeqID_203797
atgggtgagattgaacttgtagagaaagttgtaattgctcccgagcaacctacacctcgcaagagaatgttcttgtcaaacattgacctgtcccttgttgtttaccaagactctgcctccttttttgatcctccaagcacccaaatgagctttggtgagatttgtggcaaattatacagtgcacttggtaaaatgcttgtgcagtatgactttatggctggcagactagtgccaagtttggaggagactcatcggtttgaaatagactgtaatggtgctggcattgtcgtagtggccgcaagaactgacagaaaattgagtgaatttggtgtgatttctgcacctaatcctgagttgagggaattggttgttttcttgcaggaagagggtgatcaagaaactgacatgaaagaaaggtcccttgcttccttacagctgactcagtttggctgtggaagtttggctcttgcttctcgctacaaccactgcacactggacggttccgcaataagagattttgaggtaaatttaggagcattaacacgcggtggagacctcatcatagtaccaaatgctgatagaacacttctgagagctcgaaaccctccaaagataagccatccacattttgagtattcaaaatccactgaaacacacaacttgttcactatccaaggcaaaagtggtaccaatgctacgcaatcagcgccccaaaatcaaattcgtgtgcttcatttgtcaccagaaaaaatagccagcttcaaaaagaaggccctgaaggaaaacaccaccttaaagaacatcacaacttttcaggttgttgctgcaaaaatatggaaggcaagaagcattgcaacaaagatgttagaggaaaaagtgtccacaatgctgtttccagtggatgttaggaaaagggttgttcctgaactcccaaatggctttgcaggcaattga

SEQ ID NO: 87020 - DNA, 300 bp, Glycine max
  Peptide Sequence Number=SeqID_203798
atgcagctaggatctactcttctcagtttgagtctgaataacttggagcctccacaaaatcatgagcaacagcacctgaaccaaagggacagcaggcaagaagacatggagaaaccagtgttatcctcctgcagccagttcttaaatactgaaggtaaattcaataaacaagtaacaacatcacaagaagcaaaaaccatagaagagcaagcatttgaggcttcttgcaagaaagctagagtgtccgtaagagcacgatcagaatcatctttggtatggatttctatcttatttttgtag

SEQ ID NO: 87021 - DNA, 426 bp, Glycine max
  Peptide Sequence Number=SeqID_203799
atgggtcagatactacaggaccaaaccttgtgggagttaaggaatgatggaagaaaagaaataaaaaaaaaatgggacaaaaggattgatcgcgaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 87022 - DNA, 285 bp, Glycine max
  Peptide Sequence Number=SeqID_203800
atggcttcaactgggtttgatgaagacggtgataacagaggcggtatgtgggttttggaacagaagattgaccagccaatggatgaagaagctgaaaggctcaaaaatacgtacagagaaaaagctttagagctattgagtgagaaaatatgtatatataaaaccattcctgggcttccatctaagctgaagcttttagggagtgagttggtccttgacatggtattgaagcttatgcaatttggtggtggagccgcagtggggcagcaaggattagacttctga

SEQ ID NO: 87023 - DNA, 156 bp, Glycine max
  Peptide Sequence Number=SeqID_203801
atgcaagttgtgccaacgagggaggttgcgtcgatgaggaaggttgtgtcagtgagggaggcaactgttgtgaggagaggaggttgtgttaggatttggtgttgtttggctatatggttgtgctacaatggtagagaggttgaagatgaattgtga

SEQ ID NO: 87024 - DNA, 234 bp, Glycine max
  Peptide Sequence Number=SeqID_203802
atgacaatagcagggtgcagggacgacgaggcgggtcattacactgcctgcattctctccctcacccaaattcgtgcactatgtgtttttgctttctttttgcatctctatgcatcttcagtaatcaacaatccaaacgaactcgctaagcgcacctaccacgctaagcgagttcatcttttggggatgaacattcatcttcctgaggagatacttgtggctaagcggggctaa

SEQ ID NO: 87025 - DNA, 306 bp, Glycine max
  Peptide Sequence Number=SeqID_203803
atgaggtacgaaacatgggcaccatcaagtgcaatgaccatggataaactaaagatcctaagccatccatctcaagagatgcttagattctttaactgctctatttcccccactagggacatccgacaaggtcaaagcaccccccatgaacatacacaacatccaacgtatgaaacatggcatcatcaacaagcaacggcagctcatggcgaccactggtggtcttgggtggtggaaaatgaggttttaggatttgggtggcgttttggagaagaggagagtgaaaaatcgtgtttttcacgctga

SEQ ID NO: 87026 - DNA, 1752 bp, Glycine max
  Peptide Sequence Number=SeqID_203804
atggatgactttgcttggaggcctctggtgaagcaagtcaaacctgttggtgggactgtgccacgatctattgttgttcctcctactggagaagggggtcaacttgttattgaggttggccatattgttaaagttgctaagactatagggttgacacctggttcaggtcatccctcaagtttgcaagatttgcctccaactccatcggtcgtcaaggcttctgctcctactattgctcttactcctccaccgcttcctattttacctgttcaggaggtcactcatactgctaaagttagtgcaccagccgctttagctagtcctgttgtggctcctttgtccaccgtcgatgcacctttgttgagtgccagtatggccaccacgagggctcctgtgatgccaccttcttcagctccaccggttcttcactctgctacattggcgttggtgttaacttccaccttttctcaccccgtgtttctttcgaccacatctacacctctagcgataatgattcaccgtggagtgtggaatggacaaaggcaccaagaggcgctaaacaaggtggcatcctttgaggctaagcaccctaagatagctaatgccactgtcgcctttgttgaagctgtgaagttgaaccaccaattgcctcccaagattggtagtgttcttgccaagttgctacgcaccagattggatggaaatgaggtgtttgagcgctacaaggtcttgaagaaagagaaaaaagacttggctagcaaggtggagcgcactacggcagagaaggacaagcttgccatggtggtggcagacctcgaggctcaactaaaggagtcgaagtccaggctggaggagtctgagctgcggctgttcatggagatagaggttaataggaagcttgaagaggagctgctgatgtacaagaaggagactgtggaacagcatgaaaagggctttcacaaggcccttaacttgggtctttttgaccctttcaaggacatgaaggacggtgttctgcttgacgaggaagatattgctgctgaggatgaggctggtgaggagcaaggcgatgattccaatcataagaagcaagaacttgccatagtgaggaaaggtcgccttgacaagagtcttttcactcatctggtgatgcttcctttcactttgcggagcttctcccctgattcttgtcttgcttatcaatctggtggtagttcatttaaacttgtggaacatggacctttgattgtggttgtcgtagttcccaaggatgcgtaccaaggatggaccttgggttttgtaccaagggcagaccttaggggcttaccacgggtggaccttgggtttgatgagcctttggagaagcaagactcgccaaggacaaaccttgggttttacaatcctttggagaagcgagactcaccaagggcagaccttgggtttgacgagcccttgttctcctcgttgtgttgttcctggaaaagtagcctccttgtcgacggatccccaacttcaatagggatcatagcatttgtgttgtatgtaagtcggaaaggagtttcattggtcatttctaagggccttaaggctgacactattggctacctctgcctaaccattggtctaaggatgatcaacaaagggccaaggggagctcaagctatgaagattgttaggagtggtgcgcagaacgtcaatgaattcttggcatcatctgcaccgcttggtgaagttgagggtgtcgaccaatag

SEQ ID NO: 87027 - DNA, 714 bp, Glycine max
  Peptide Sequence Number=SeqID_203805
atggctcgtgcatctagtgaggctgatagttgctccaatatagctttatctatcctcttcaccagggctatcaaccacaacatcagtagccaggaccttgaagaaatggtccttgaagcggtgaaacacgttctaatcaaactcaaacaacttcttggacacactattcaaggagacccaatcaatcttgcttgggcacaagatctcaaaggccctcaccatggcccaactattgggatgaagttaagaatggaccaagttcaagtgctcaagcagagcacactggaaggaggagtcctccagattggccaacttcacttggcactgcagagcaatgacactcgttgcagaagtgagagaggaccgatatttcagaacatcgtccttcacccattcaaagccaacaacagcaggggggataatgaaacagaaggggggagaattattgtgatgggaacaaattccccaaccagagaagtagtggaaggttgcgccctcccatggagaggattcattgttagaagccccacgatgagtatcctcttaggaggaaccaccaatagagatgacctttcagtccaccaggggtttctgaatcgaacccctggagtcactaccacctatgcttatggaagaggtcacatgcgtctcaaagctttattcaagacaaagaaattaaagatattcaagatggatgatcaagacagtctctag

SEQ ID NO: 87028 - DNA, 285 bp, Glycine max
  Peptide Sequence Number=SeqID_203806
atggttgttggaggaggattggagccttcgaaaggagtctcgaatctgaggtcatatcgcgtgctaaccatgggtgaaaaagagagactatggggtgggctcctagatctcgcacatcggatgatgaatggcctttgtaaagaggacaagaggggggactttccaaacaaaggactctggcgctcaagtagaatggcagcggcaaaggcaaactgtgacagtgcggagatggacaacgcaaagtcctattgtaggagccccaaggagaattacgaaaatatgtga

SEQ ID NO: 87029 - DNA, 429 bp, Glycine max
  Peptide Sequence Number=SeqID_203807
atgagaaagctaaaggttgaccacgatcagttggaggctcgtgtcagacgccccaagggcgacgagcactctgcttatacattacctgagctcactcaaggggaatcacaccccttcaccgaccgaatcatggaagctgacataccccaaggttggaaaccactcaacctagagcggtatgatggaaccactactgatccaaatgaacatttggatgctttcctcacccaggcgaatgtatacaccaatgataatgcaatcctgtgtcgtgtcttcccaatgtccctcaaagaggtgacattaacctggtacaatggacttcctccaaggtccatcggtagattcgacactcttgtcgagcatttcaatgtgcaatatgcacagtatgacatctgccgctctggccagtctacgacaagcagatgctaa

SEQ ID NO: 87030 - DNA, 294 bp, Glycine max
  Peptide Sequence Number=SeqID_203808
atgccatatccacgtcgtataattcctcttaattccatcacacaacatatgctctcgtgtggccctatcccatttgggaagaccgtcttttatgctctcttggaaaccttgagaaggaactgcatagggagatgttcgattccgcgaagattgctagggaagggtaaagggaggaggtggagcatgaggcggtttcttggtcttctttcttctcaagtagctggaatgggaacttgttctaatggtggtggtggtggtggtgatggtggtggagatcctcgcatcccaccatga

SEQ ID NO: 87031 - DNA, 255 bp, Glycine max
  Peptide Sequence Number=SeqID_203809
atgagtttagtgcctgcttatttcaatgactctcagcaaaaagctactactgctgctattgcatatggcattgacaaaaggactaattccattggagagaaaaacattttcatctttgaccttggttgtgatgaatttaaaaagaagaacaaagtggacattagtgagaaccctaaggagggcattgacttctactcttcaatcactcgtgcaaagtttgaacaatgtatgcaaagatggacaagagcagtgtag

SEQ ID NO: 87032 - DNA, 396 bp, Glycine max
  Peptide Sequence Number=SeqID_203810
atggatattttagatcagctcgagataaatgttcctaatgatcgaaaccctacgttgagagcttgcaacagctcttctcacttgaaaaacactgcaagtgactcttataaatcatcatcatcatcagaagaagaagtagaagagagaataagtgttatgggggctaagaaatcatcatcttctttctccttttgtggtatgttcaaggcttgtttctcaagcagcaaagatgattactactgtaattacgatgatagtagtagaaggcattttgcaagtgatgaggatagaggccgttgggttgctgagcctggtattgaccggaaagcttctgctttcatcgctagattttatgcctcacgagtcagtgattctgagcaccaaattgcatcttga

SEQ ID NO: 87033 - DNA, 183 bp, Glycine max
  Peptide Sequence Number=SeqID_203811
atggaggagaaattggggaagaaagaaaacaaagagttatcaaatctattgtgttttcatttcacaaaggagcaaaggaggttgttgacgaggccaacagcgaggggcccaattggaatgcggcaatcatcgaggagaggacaacaactcagcatcccaactagatgtgataatgatgtgtga

SEQ ID NO: 87034 - DNA, 471 bp, Glycine max
  Peptide Sequence Number=SeqID_203812
atgaccacttttacatggatatggatgacgttgctatttagtaacattctgcccggcgaccacagtgtcgatctccccctgcagatgtatcggaatcgcgcccacaagacgcccagtgagcccgaagaagtccaacagggccctggggtttccagctctggttacgggcctctgtcagtcctacagggtgcccgttcccccagcgaggaatcgcacccacaaagacacccagtggacccggagaagtccaacagggccctggggtttccagctctggttacgggcctctgtagtcctacagggtgcccgttcccccggcaaggtcatggcatagggaccgcacctgcaagacacccagtggacccgaagaagtccaacagggtcttggagttgtcaagctataattatgggtctctgtcagttctacggagtgcctgtcacctccagcaagggcatcaggccccctactaa

SEQ ID NO: 87035 - DNA, 279 bp, Glycine max
  Peptide Sequence Number=SeqID_203813
atggctaactctaaggctactagtgatgaggacatgaccaagagcaagggcaaggatccacttgaaggacttggaggacctatgacaagggctagagcaaggaaagccaaggaagctcttcaacaagttttgtccatactatttgaatacaagcccaactttcaaggagaaaagtccaaggttggcgcaattggcaacctaggcatcaggcttttgggagaccaaatggtggctggcttgatggctgttgggggtgacttttggttgccacaattttag

SEQ ID NO: 87036 - DNA, 465 bp, Glycine max
  Peptide Sequence Number=SeqID_203814
atgaaaaccacgatttcgtgtttctacagaaaccccgtcaagttcagaatgccaactgcggagaacttggttcccattcgattggacatcgaaatcgaggggcagagatacaaggacgcgctcacttggaacccttctgatcccgattctgaggttgtcgtctttgcaaaaaggactgctaaagacttgaagctccctcccgtttttgtaacacaaattgctcaatcaattcaacttgatcttcgtgttaatcatacgctcgtgaaggaccagtttttatgggactcgaacaactttgagagtgatcctaaagagtttgccagactcttctgcaaggacacgggcattgaagatcccgaggttggaccagctattgcctttgctatcagagagcagcttaatgagattgcaattcaaagtgtggtttcagcaagagaaagcagaatgagcaagaagggtcgttga

SEQ ID NO: 87037 - DNA, 225 bp, Glycine max
  Peptide Sequence Number=SeqID_203815
attcaagcgagtcttgctccaccatctgctgactaccactggaactggtatgaatgcagaaaaaattatgcacgttgcagtgcaccacagatacagtatcttcaagctgtaactgggattgcggagtctgttgggaactggtattttgatcgagttagtgtccaggccattggctgcccttacccttgtgacaaaacatgccataatttggtatttaagagatag

SEQ ID NO: 87038 - DNA, 1686 bp, Glycine max
  Peptide Sequence Number=SeqID_203816
atgggagcctcggatattaacgatgttgttggatcacttttggatttgaaagctgaggctgaggctgaggctaacgttggagatgttgagtaccaagcaaggaagactccgagacaaggaggatatagagccacatatttcatctttgtctgttcaacgaaggcaaattcattggttttaactgcagcaatgatgttgctggataacattggctttgtggccaacatgggatattccctacttgtgattcaatcccacgacaagacacttcagcctgatccatgtttaaaatcaacatgtgtgcatggcactaaagctttgctgttttacgcttcaatatacttgctggcacttggtggtggtggaatcagaggctgtgtacctgctcttggagccgatcaatttgatgaaaagaaaccaaaagagcacgcgcaactagccagtttcttcaattggtttttgtttagcattacagttggggcgagcttaggagtcacctttgtagtttatgtgagcacggaatcccaatggtacaaaggttttatcatatctatgtcatgttctgctgttggtcttattttcattgcctcgggaaagagattctatcatgccagggtgccgggagagagtccgttgttgagggttttacaggtgctggtggtcacagtaaggaattggagggtgaaagtacccttggattctgatgagttgtatgaaatacaaagtcatgaatctagtttaaagaaaaaactcatccctcacactaaccaattcagggttctagacaaagctgctgttctacctgaaggcaatgaggcaaggagatggaaagtctgcacagtgacacaagtggaggaagtgaagattctgacaaggatgatgcctattcttctaagtacaatcatcatgaatacatctttagcccaattacaaaccttctccatccaacaaggtaccttaatgaacacatacattggcaaactgaacatcccagcagcttccattcccataattccattagtattcatgacccttttgataccggtttacgaatttgctttcataccacttgtccggagaatcactggccatccgaatggaataacagaactacaaagagttggggttggccttgttttgtcagcaatctcaatggtcatagcaggggtgatagaggtgaaaaggaagcatgaattcaatgatcacaatcagcaccgaatcagcctcttttggctctctttccactatgcaatctttggtatagctgacatgttcacattggtggggttgttggagtttttctacaaagaagctcctcaaggcatgcgttcactttccacttcgttttcctttctttccttgtccattggttactacttgagcactgtttttgttgagctcatcaacttggtgactagtaagattggcaagagcaagaaagggtggctagagggacgtgacttgaaccgaaaccatgttcaattgttctactggtttttggctatactcagcctgattaactttctcatttatctgatgtgtgcaaaatggtacaaataccaaagtgttgtaccatttgataagggaatgttgctcaaagatccacctcctcgtaatgatgaaaacgtgtactctactagttttgtatccacggttcaaaacattccccagaatgaagataaataa

SEQ ID NO: 87039 - DNA, 1290 bp, Glycine max
  Peptide Sequence Number=SeqID_203817
atgaacagaacaccgaagcggggttttagcttgattgatttcgggtgcagagactttaaagcacgcataagcaggagtggaaacgacgtcgttggtggcgagaaagcgtgggaagtggggatacatatggccgatgtggacgacgctgttgctccacttcactaccggttttctcctcaccggaaccgagcttccttatcagagccactgctcccacgtgtcccattaaccgtctcctcatcgtcgttctcgatgctctcagaatcaaagccgtggatggataagcgagttttgaagaacgtggcatctacacgacctttgtccgccaggattttcaaagccattgctgatcctcctaccacaagtttgcagcgcttgaagggattgacaactggcggacttccaacttttgtggatgttggtaatagcttcagtgcaccggcaattgtggaagataacttcataaatcagaaagttgttatgatgggcgatgacacatggactcagttatttcctcatcattttgaaagatcatatccgtacccttctttcaatgtcaaagatcttcatacggttgacaatggatgcatagagcacctattactatccctatacgaagaagattgggatgttcttattgcgcattttcttggagtggaccacgcaggacatatatttggtgtggactccaccccaatgatagaaaagttggagcagtacaataccattttagagtctggacctgggagctcacatgaaaatactatgcttgtggtcatgggtgaccatggacaaaccctaaatggtgatcatggtggtgggagtgctgaagaggtggaaactgccatttttgccatgagttttaagaagcctctttcttttgtgcccccggaatttgattcttgttcttgtcaactggatctgagcattgggttccttattttgagcactttgtgccgatttgcaattgaagttgggctgtccaagcaggctgccacatctgctttcatgaaagactttacctcatggatcatcaacatagcctcaggtttacctgtatgggactatgcagctgaagttataccaatggtagttctgattctgctggcagcttggctttacaaggccgccagtggcagcttctttgattggccatggaagtatgttatactgggcactatcttgagttatatgctaataattgtgcattggatcactgacagtggtggatttggtggtgcattgatgcctcaaagcattggaagaagttatatacctagaatcatttaa

SEQ ID NO: 87040 - DNA, 330 bp, Glycine max
  Peptide Sequence Number=SeqID_203818
atggcgagtatgagaatgaggatcattctgaattatacaaaatggatacgatatggtgaattgccagacatgtcaatagtgtctcacactgagccgattgatgtagacatcggagattgtatagagtgttttcagcaagcacatgcacctttttatgagaaattacaaagtgattcaaagaagcccttgtatccgaggtgcacaaccttcacacggttgttagcagtgttagcttttgttaacttgaaagcaagatttgggtggagtaacaaaagcttcattgaattgcttgtggcattgaagaagatgcttcttgaagataacacgtaa

SEQ ID NO: 87041 - DNA, 351 bp, Glycine max
  Peptide Sequence Number=SeqID_203819
atggcagacatattgttgcgaggatactatggatggaactcacgacgtgccctccaaatcctttatcaagtttttccaaagcttattatcctgcctacattatataattttctgtatcccacttcccaggatgctgcaacacagccttctcttgtgattgtttattttggaggtaatgattccatgggtcctcatttttctggcctaggccctcatgtgcctcttcatgaatatattgaaaacatgagaaagattctgattcatattcagggtctctctgaaaagacacgtatcattgttctcagttgtcctccagtcaatgaggaaaaagtgcgtgcaaacactaggtag

SEQ ID NO: 87042 - DNA, 2487 bp, Glycine max
  Peptide Sequence Number=SeqID_203820
atggcgacgagtaacaacgcgtcatgcccagcacccatgaaggcaacgtcgaatggggcgttccaacatgagaacccgctcgattatgcgcttcctctgttaatcctccagatttgtttggtcgtcttttttactagatttattgcattcctctgcagacccctcagacaaccccgagtcattgctgagatcattagatgggaagggaaaaatgtggtcaaagtggatacgaagaaaagtttgggaggaatactacttgggccatctgcaattggacgaaatgagaagtttctgaacacggttttcccaaagaaaagcataacggttcttgacacactaggcaacattggtcttttgtttttcttgtttctagttggtcttgagcttgacatgcgtgcgattcgtcgtactggtcacaaggccttaggcattgccctttgtggaatcactgtgccttttgttcttggcattggcacttcttttgctcttagagccaccgtgtccaaaggtgctgagccagtttcctttcttgtcttcatgggtgttgcactctcaatcactgccttccctgtccttgcaaggatcctagctgagctcaaactcctcaccactgatgttggtcgcatagcaatgtctgctgcagctgtcaatgatgttgcagcttggattcttcttgcacttgccatagccatttctggttctaatggatcccccttagttcctctctgggtcttgctctctggtgttgcttttgttctctttgctgtatttgccattaggccattgcttgtagctatggctaaccgttcccccgagggtgagccagtgaaggaggtttacatatgcatcacattgacactggttttggcttgtagctttgtcactgatactattggaatccatgccctctttggggcttttgtgcttggtaccattatgcccaaagatggttccttttctggggtgttgattgagaagatagaagacttggtgtctggccttttcctgccactgttttttgtgtctagtggcttgaagactaatgtggcaagtattagtggaggactttcttgggcaatgttggtgcttgttatattcaatgcttgctttgggaagattgttggcacaatcgttgtgtcgttaatctgcaaggtgccttctcatgaagccgtggcacttggatttcttatgaacacaaagggcttggtagaactcatcgttctcaacatagggaaggaccgtaaggtgttgaatgaccaagcatttgccatttgtgttctcatggcattgtttaccaccttcatcaccaccccaatagtaatggctgtttataaaccagctcgcagaggagcaccttacaaacacaaaacaattcagcgcagagatcctgacactgagcttcgaatgctaatttgcttccacacctcccgcaacatccccacgttaatcaatctcatagagtcttcccgcggaattcgaaagagaggaaagctttgcatatatgcaatgcacctggtggaactctcagagcgatcttcagcaatcacaatggttcacaaggcacgtaggaatggcatgcccttttggaacaagaaacaggatgacaaagatcaaatgatcattgcttttcaggcttatgagaaactaagcagtgtcaatgtgcgccccatgacagccatctctgctctcaatagcatccatgaggatatttgtactagtgcccaccgaaaatgtgcagccatgattatccttccattccacaaacatcaacgtgtggatggatcaatggagtcactaggacattcattccatgtgatgaatcagcttgtgctaagccatgctccttgctcagtgggtattttggttgatcgaggttttggagggacaagccaagtcccagctagtgatgtgtcttataaggttgttgtgcccttctttggaggacgtgatgatcgtgaagcactttgttatggtatgagaatggctgagcacccggggattttgctcaatgtggttaagtttatgcctccacctgggacatcattggcctttggtgctaaattggttggggtgtcatcaaacaaggacaagaaagcattcgaagtggttggtggcaattattatgatgataaacaacaagatgatcaattgtggagtgagtttttaagtgcatgcaacaacaacaaccaagagtcaatgaagcatgagcaaaaactggtggcaagcaaaggtgatattgaagcagcattaaaggaaatgaataggagcaatctaatattggttggtagaatgccatcagtagcacctttgattagcagaagtgattgtccagaacttggacctgttggaagctacatggcttcttcagatttctccaatgttacatcagttatggtaattcagcaatataatccttcaactgacattcatccactagttatggaggaatctgattacccagatatgccagacacaccaacgagttaa

SEQ ID NO: 87043 - DNA, 201 bp, Glycine max
  Peptide Sequence Number=SeqID_203821
atgacaagaatgggcaatgcggttaagaggaagatggggaggatggggaggaaaagagagtgggcgagaggtgagggggagaaggcgaaaagggaaagaaagagaaaatcatgtcaacagcagaagctcctccttctttccaagaagcagcgcgatgcgttgtctgcaattgcagtttcaacactttcagaagaagggtaa

SEQ ID NO: 87044 - DNA, 240 bp, Glycine max
  Peptide Sequence Number=SeqID_203822
atggttggtgtaggcatactggtcacatatccagtcccgctgaaattggttgatgaaaagtcaaaggaagccaaaattgctagaaatgccttgttttccaagcatccagagatgaaggactggcctgaggatcaccactttcaagtcttcaaattagaaattgaaaatatatttctaattaattggtttggtggtccaaaaccactcacagtggaacagtacttacatcccaaaatgtga

SEQ ID NO: 87045 - DNA, 384 bp, Glycine max
  Peptide Sequence Number=SeqID_203823
atgggtctagacaaagcttttgctgcaaagaagataggatttgctgcgagcaaaggtaagaacttgagcatggctagagaaattcaaacccttgggaaaattcggcatcgaaatctgacaccaccactaaccttagagtggaatgtcaggaataagataactgttggaattgctcatggattggtttatctccattatgactgtgatcctcccatattgcaccgagacatcaagccaagcaatatacttctcgactctgatatggagcctcacattgttgactttggtattgccaaacttctggatcaatcttcttctgcttccgatgcttcttccatttatgttccgagtacaattggttatattgcaccatgttggaattga

SEQ ID NO: 87046 - DNA, 505 bp, Glycine max
  Peptide Sequence Number=SeqID_203824
atggccttcagaggaactggaacgctgattttggtgagtctcttatggcttttcttcctctgcgccaccattgctttctttcagctccacttggtagacaaccgaaccagcaacccttcctctcgcagtaacttcattgcaactcaacatgatcgctcagatacccctttggaacaggatttggagggtgtcactcacaaggtgtattttgatattcagatccatggcaaagtagcaggtcgcatagtcatgggcctttttgggaacacagtaccaaaaactgcagtaaaaactacaaatttgaacagcatcacatttcaggagagaaaggagtgggaagaagtgggaagtctcttcattataaagggagcacattccataggattatgccgagctttatggtccaggggggtgatttcacccgtggtgatggaagaggtggagaatcaatctatggtgataagtttgccgccccccaactttaagctgaagcatactgggccag

SEQ ID NO: 87047 - DNA, 687 bp, Glycine max
  Peptide Sequence Number=SeqID_203825
atggggacactgtctaggattagcttatttaacaatgaagcccattcgttgctaatgaatggacaaagaccaactttcagaaaattcttatttgaacttctcaaagttgttggtgataatccagatgaactattgataggagagaatgacatcatggagcaaatattaatacaagggcactgcaaagatcaaagaacggcaatggagacagcaaaaacaatcattttcttgggacttcttgaccaaactgaaatccctgcttcctgcaaaagtgcttttgatgttgcttgtttccgcatggaggagaggttatcatacaccagcacagaaaaggatatggtgcttttgcatcatgaagtggaaatagaatacccagatagccaaattacagagaagcatagagctactttacttgaatttgggaagactcttgatgaaaaaaccacaactgccatggcccttactgttggtattccagctgctgttggagctttgcttttattgacaaacaaaattcagacaagaggagtcttaaggcctatcgaacctgaagtatacaatccagtcatggaattgcaactgccattctatgcaactgtcagaaatggaccacacggtaccagcatagttaaaacacttaggcagatgccaatttcaattgcagcagtacaatccaaccagttatga

SEQ ID NO: 87048 - DNA, 4398 bp, Glycine max
  Peptide Sequence Number=SeqID_203826
atggccggaggtgccgccgggggtttcgtcactcgagcattcgattcaattctcaaggagtgttcttctgccaagaagtttcccgaacttgagaaagctattcagaattacacagatataacgaaagagctcagccagaaaaagcagagtgaggtcaatcaagctgccccttcagctgaatctgggagcatgaatgaaactgaaggtggagtggcaactaggacagaagcagatcagtcacagaaggctgagcatgcttcagatgacagggctaagattggaaacattaatgttgttttggctagtgctgggaatacacttgaaggagctgatgcagagcttattttaaatcctctccgtctcgcgtttgagactaagaacttgaaaatccttgaatctgctttggattgtcttcataaacttattgcgtatgaccatttggagggagatcctgggttagagggtggtaaaaatgttccattgtttacagacattctaaacatggtttgcagttgtgttgacaattcatcacctgacagtactattctccaagtgctgaaggttcttcttactgcggtggcttctactaaattcagagtacatggcgaacctttactgggagttatcagagtatgctacaatattgctctgaatagcaagagtcctataaaccaagcaacgtcaaaggcaatgctgacacagatgatcagcatcactttcaggagaatggaaactgatccggttgaagcgtcatctggttccggtgggcatgcaatttcaaaggcagcttcagcagagaatttaaacacaaaatccgatgaatcttcaatgggagactcaaatgaaaaagaaatgactttaggtgatgcacttagtcaagccaaggatgcatctccaacatctcttgaggaacttcagaatcttgctggaggtgctgatataaagggcctagaagcggtactggacaaggctgtacatactgaagatggtaaaaagattacacgtgggattgatttggagagcatgagtatagtacaacgtgatgctttgttggtattccgcactctttgcaagatgggtatgaaggaagataatgatgaagttacaacgaagacgaggatattgtctcttgagcttcttcagggtttgctggagggagtcagccactcatttacaaagaacttccattttattgattcagtgaaggcatatctttcatatgcattgttacgagcttcagtttcacaatcccctgttatatttcagtatgcaactggaatattcttggtgctgttattgcaattcagggagagtctcaaaggtgaaataggcatcttctttccattgattgttcttagaccactggatggattagaatttcctgtcaaccaaaaacttagtgttcttcggatgttagagaaagtatgtaaggacccacagatgcttgttgacatctttgtgaattatgattgtgatcttgaggcaccaaacttgtttgaacgaatggttactactctgtccaaaatagctcaaggaactcaaaataccgatccaaattctgctgctgtttctcaaacagcttcaattaaaggctcatcacttcaaggtcttgtgagtgtgcttaaatcactagttgattgggagcaatcacataaggagttggaaaagttaaagaataatcaacaagaagggatttcagctggagattcttctgaaataagatccagggaagatgtaaccagtgattttgagaaggctaaggctcataaatccacattggaggctgccattgctgaggctacaattggtgactatttaggtcaacatgaagagtttccccttgctgtgatgcatgcttatgtagattccatgaaattttctggatttaaatttgatactgcaatcagggagtttcttaaagggttccgacttcctggggaagctcaaaagatagatcgaatcatggaaaagtttgcagagagatactgtgcagacaatcctggcctttttaaaaatgcagatacagcttatgttctagcttatgctgttattatgttaaatactgatgctcataacccaatggtgtggcccaagatgtccaagtcagattttgttcgcatgaatgccagggatgatccggatgaatgtgctcctaaagaactactagaagagatctatgattccattgtcaaagaggagattaaaatgaaagatgacacatctttaataggaaaaagcagcagacagaaaccagagggtgaagaaggacgccttgtcagtattcttaacctagcactcccaaagaggaagtcatccggagatgcgaagtctgaaagtgaggacatcattaagaaaacacaagctatattcaggaataaaggggtgaaaagaggagttttctacactgcccagcagattgaacttgtaaggcctatggttgaagccgtcgggtggcctttgcttgctactttttctgtaactatggaggaaggtgaaaataagtctcgtgttgttttgttgatggagggatttaaagctggcatacatattacgtttgtgcttggaatggataccatgcgttatgcatttctaacatctctggtcaggtttactttcttgcatgcccccaaggaaatgcgcagtaaaaatgtggaagctttgcggacactgttggttctatgtgactcagacatgaactctcttcaagacacatggaatgcagttctggaatgtgtttctcgcctcgaatttataacgtcatctccttcaatttctgccactgttatgcatgggtcaaaccaaatctccaaggatggtgttgttcaatctctgaaagaattagctgcgaaacctgcggaacaaattttcatgaatagtgttaaactacctagcgattcagttgtggaattcttcactgctctctgtggtgtatcagctgaagagctaaaacaaactccagctcgtgtcttcagcttgcagaagcttgttgaaattagttattacaatatggctcgtatacgaatggtctgggctagaatctggtctgtcctagcaaatcactttatatcagcagggagtcatcatgatgagaaaattgctatgtatgccatagattctctaagacaacttagtatgaagtatttggagcgtgctgaactggccaatttctctttccaaaatgatattcttaaaccatttgttgttcttatgcggaatagtcaaagtgaatccaaaaggaggctaattgttgactgcattgtccagcttctgcagatgatgaaatggaatcaattgttgatagtgcatttgaaaatgttgagcaggtctaagtctaagtctactattgcatttgtggtgtatctaacgcatggacattttacagtcatcttagaacactttgatcaagtagtgggagactgtttcatggattgcgtgaattgtctgatcaggtttgccaacaataaaacttcgcatcgtattagcttgaaggctattgcactcctgcggatctgtgaggaccgtcttgcagagggtcttattcctggaggtgctttaatgcctattgatgctactttggatgcaactttcgatgtaactgagcattattggttcccaatgctggctggtttatctgatctaacatcagatcaaaggccagaggtcagaagttgtgcacttgaagtcttgtttgatttactgaatgaaagaggtagcaagttctccacagcattttgggagagtatttttcatcgagttctatttccaatttttgatcatgtgagacatgctgggaaagagggctttgtttctcctgatgatgattggtttcgtgaaacaagcatacattcgcttcagctgctatgcaaccttttcaacacattctataagattactcatgaggaatcttgtttccaggaggtttgttttatgttgcctccactactgggtctgctgttagattgtgccaaaaagacagatcaaacagtggtctcaatatctcttggtgctttggtgcatctcattgaagttggtggacatcaattcagtgaaaatgactgggatacgttgcttaaaagcataagagatgcttcatacactacacaacctctagagctgcttaatgtgttaagttttgaaaatctgaggaaccatggaagcattattagtgattctgaaggcaacacaggtgacagtgggaccacgaggtctattgacaatgaggtaattggtgaccatcaacttgatgtcaatagtaatgagaaattgtccccactggcatcctcaaatacaaatgctgatggagtggaagattctgtatcacagacaattgtagatcagtctgaagttgggtgcgtatttaaacatgtgcatgtctttagtcagataagtgagaagtga

SEQ ID NO: 87049 - DNA, 1506 bp, Glycine max
  Peptide Sequence Number=SeqID_203827
atgggactccaacattttactgcgtgcgttttgttagctctttgcattctaagccaaggtttggcaaagggtgctaatggctttgcatgcaactggggaacgcgtttaacacacccccttacacctcaaataaccgtgaaactcatgaaggacaatggattcaagcaagtgaagctctttgaggctgatcccgcagcactcaaggctctaggaaattctggaattcaggttatggttggcataccaaatgacctcttagcaacccttgcttccaatgtcgacgctgctattgcatgggtcaaccaaaacgtgtcctcctacatatccaaaaatggggttgatataagtgtttgcaaaattgctaggtatgttgctgtggggaatgaggctttcctcaaaacttacaatggccggtttgtgaattcaacctttccagccatccaaaacatccaagcagcccttataaaagcaggattaggcaggcaagtgaaggtgacaacccctctaaatgctgatgtctaccaaagtgacagtggtcttccatcaggtggaaacttcaggccagacattcaagaccaaatgatctcaataataaagttcctaagccaaaatggtggccctctaaccttcaacatctatccattcctcagccttgatgctgatccccacttcccaaaagagtttgccttctttgatggctcagctgctcctgttgttgatggctccataacctacaccaatgtgtttgatgcaaactatgacacactcatcacagccctcgagaagaatggttttagccaaatgcctgtcatcattggagaggttggatggccaacagatggaacagccaatgccaacataaaaaatgctcaaaggttcaaccaaggcctaattgacagaatagtgaaaagacaaggaagccccaaaagaccttccccaccagatatctacttgtttggattcatagatgaggatgccaagagcattgagccgggcccttttgagaggcattggggtgtcttcaactttgatggatccataaaataccctttgaatttgggtggtggaaagcaactagttggtgcaaaaggggtgaggtatttgccaaagcaatggtgtgtgatgtctactcaagcaaatgttgaccctaatgctttagctgagagcatgagcaaagcatgcacgtatgctgattgcacaagcctctctccggggtcttcttgcagtggattagacacaagaggcaatgcttcatatgcattcaacatgtactttcagaccatgaatcagcaaaaagatgcatgcaatttcaatggtctctctgtcatcactaacataaacccttcaccacctcaaagctcttgcaaatttgagatcatgattgatcttggcaagcatgaaaagaagtccacaccttcttcggttgctccagaaaggaaactacactcaatggtcatgctggtctcaagcttcattttcactgtcatgttcttgctttgtgtttag

SEQ ID NO: 87050 - DNA, 525 bp, Glycine max
  Peptide Sequence Number=SeqID_203828
atgacaaatgaactgaagtcatacagtatgtttatgtgcagaatttgttctatgtttaacgttggtcatgtaactaatggtacctcagacagaccccagattgattatgaagttactggagagggtttaagagaagcaataaaaaatagtgacgttgctgctgttaagaaacttcttaatgagggtgtggatgcaaattacagggacaagcaaggactgtctttattacatttgcaaaattgtggaatgcaaaacctaactgactgtttcttattcaggagaaacacctttagattgtgcaccagctaccttgcaatacaaaatgcgaaagaagatggaggaaggtggagcagtggaccaaagcatttgaacaatctattacttttatcagtgttctttttatgcagtcctcccaaagagagcttcaaatattaccactgtctaaagctcctctgttaccagaacaaaaaatttcgccttctgtataattgtgacagaggagttcaattcatcttggcagactaa

SEQ ID NO: 87051 - DNA, 741 bp, Glycine max
  Peptide Sequence Number=SeqID_203829
atgttgttgagggtttttgagtcttcttttgtgggaaggaaatccgttgtcaaggaacgattctcaaagaagtacaggcatccaactttagattcaaaattgaccctcaagcgcttaaatatggaggctaggtgcatgaccaaagcaaggcgacttggggtttggactcctgtgctgtatgctgtggatcctgtgttgcacactttaacatttgaatatgttgagggcacttcagtcaaagatgtgtttcttgaattcgggtcacatggtgttaataaagagaggctggatgatattgcattccaaattggtgatacaattggaaagctacatgatggtggtcttattcatggtgatttaacaacatcaaacatgttactaaagagtgatacaaagcagttggttcttattgattttggtttgagcttcacttcaactctacctgaagacaaggctgttgatttgtatgttctagaaagagctcttatttcaatgcattcatcatgtgggaatgtgatggatcagatacttgctgcatacaggaagtcatcaaagcagtggtcatccacattgaacaagctggcacaaggttatgccctccctctcatactttgtttaaattcaacgtattttcttcaagacatagtacttacatacattttcacaacttgtagtgcgacaaagaggacggaagaggaccatggttggatgaatctttatcgaatttcattagagatataa

SEQ ID NO: 87052 - DNA, 1557 bp, Glycine max
  Peptide Sequence Number=SeqID_203830
atggttcttgataaactgatttttcttattaaaaaccactactcacatttgcatatcttagtcaattgcatgtattgggagaaaagatttcctcaattgctgagctataagcagatgcaagacttaatgggccgggggagcccccttgttggaatagctgacataacgtgtgatatagggggttcaattgagtttgttaaccgcagtacttcaattgattcacccttcttcagatatgatcccttaacaaattcctaccatgatgatatggaggggaatggagtgatatgcttagctgttgacattcttccaacagaatttgcaaaggaggcttcccaacattttggaaacatactttcccaatttgtcgtaaatttggcttctgctacagacattacaaagttgcctgctcacttaaggagagcttgcatagcccataaaggagtgctaacctccttatatgattatatcccacgcatgcggagttctgattcagaggaagtatcagaaaactcagaaaattctctatctaacaaaaggaagtataatatatcggtgtctctgagtggtcacttatttgatcagtttctgataaatgaggccttagatattattgaagctgcaggaggctccttccacttagtcaactgccatgtgggtcagagcattgaagccgtatcattctctgaacttgaagttggtgcagataacagggctgttctggatcaaatcattgattctttaactgctattgctaatccaactgaacatgatagattttcaaatcaagattcaagtaaaatttcacttaagcttggtaaagttgaagagaatggcatagagaaggaatctgaccccagaaagaaggctgcggttttaattcttggagctggtcgggtctgtcaaccagctgctgaaatgttatcatcatttggaaggccatcatcgagccaatggtataaaacattgttggaagatgattttgaatgtcaaactgatgtagaagtcattgtgggatctctgtacctgaaggatgcagagcagactgttgagggcattccaaatgtaaccggaattcagcttgatgtgatggatcgtgccaatttgtgtaagtacatttcacaggttgacgttgttataagtttgctgcccccaagttgtcatattattgtagcaaatgcttgcattgagctgaaaaaacatcttgtcactgctagctatgttgatagctccatgtcaatgctaaatgataaggctaaagatgctggcataacaattcttggagagatgggcttagacccaggaattgatcatatgatggcaatgaagatgatcaaccaagcacatgtgaggaaggggaaaataaagtctttcacttcttattgtggtggacttccatctcctgaagctgctaacaatccattagcatataaattcagttggaatcctgcaggagccatccgagctgggcgcaatcctgccacctacaaatggggtggtgaaactgtacatattgatggtaagcttttaagcaacaattctgacatgtttccataa

SEQ ID NO: 87053 - DNA, 507 bp, Glycine max
  Peptide Sequence Number=SeqID_203831
atgaaaaacaaagtagcctcatccacaacatcccaaaggtgctctcattatttctccatcgaaccaaacaaagctggtcatccaagggctaagagaaaaaccatttataagccttctcccacagttgtctcttcaccagtcatagaaagttttagttgtcattccacaaacaattggattaagccaaatcaacctcagtctccagactattatctctcctccttaaagagttcttctgaatcaaacaatctccatgaatatgtttcatctgggtgtgataagttcactgttcctaaattgcttaatgggttagcctctaaatgcagttgtagagttagttcttccaccaatgacatcaacattgacatgaaaagtgaactgctcactgcaaattctggaaatcttgatggttttgatacaatttcacagttaggccttgctccaatattgacaaagccagtgaagtttgatgataaggccattgaagccactgagttgagaagatga

SEQ ID NO: 87054 - DNA, 619 bp, Glycine max
  Peptide Sequence Number=SeqID_203832
gctcttggtgtatcagtacatgaagaatagagcgctgtatgatcatttgcatgacaagaacaatgtggagaagggtagcactatgttgaattcgtggaaaatgaggatcaaaatttctttggacgcttcccgtggaatagaatatatacataatcatttatattctattcacggaaatatcaagtcctccaacattcttcttgatgccacttggacggcaaaagtatctgattttgggaaggtatcagcaggaactagacatgtattgacagaaaagagtgatgtgtgtgggtttggagttgtactgctagagcttttaacgggaaagaaacctatactcaagaatgaggaagatggaagcacccgattacatgtgatagactttgcagagcctgctattttggctggagaactggtgaaaattaaggacccaagggttggaccacccggtgtgaatgaagcaaaggcactggagttagtggccgatacagctatccattgtgtgaaaagggaagggaaagatagaccaaccatggctgacattgtgctcaatttggagagggctttggctacttgtggtagtgaccatcgtagccctgagaaaagaatggctctttaa

SEQ ID NO: 87055 - DNA, 210 bp, Glycine max
  Peptide Sequence Number=SeqID_203833
atggtacaagagccagatgcagaaaaatcagttcggaagtggcgaaaaaggcgggaacaggttctagaatccaaggaagcatcaaaactacagaaccttgctgatacgaaactaacagaagaagcaccagctacaggggtgcaaaagggagaagagaccaagagcaaaagaagaattgtgaagcccacctaccttgaagattatgtttga

SEQ ID NO: 87056 - DNA, 1455 bp, Glycine max
  Peptide Sequence Number=SeqID_203834
atgttcgacgatgtggcttcaaggagttttcatgtaataaaccctgttccaagtttttggattgtggggttcaccgttgcattgaactttgccaccctggcgcttgccctccttgccggacacgtggcgtgtacacgtgccggtgtgggaaggtcaaggaggagagggagtgctttgatcgtggttttcagtgtgagaatccgtgtgagaagaggcttggctgtgggaagcatgtttgtgagagagggtgccattctggtgagtgtgctttgtggggctacctgtgataagatgttgccctgtggctaccacaggtgccctgagcggtgccaccgtgggcagtgcgttgagacttgcagggttgttgtgaagaagtcttgtcgatgcgggagcctcaagaaagatgtaagtgcttactgcttttttgaatttggatgtgtatcggtttatggtagtgaaatggttgtgatttggcgtgcgaaaggaagtgtcagaggatgcgtgactgcggtcgacatgcttgtaagcgccgctgctgtgatggggattgccctccttgctctgagaggtccttgtgctccttgcccaataatggtgacaatttcatgtgcatgtggagagacacgttttgaggttccatgtggtactgaaatggaccaaaagcctcctagatgtcctaagccatgtcctatcactcctttatgccggcatgcatcaaatatcaaggtatcatttgatactgacttgtgtcatggtgctaggcctcctcctaatccagagttttctcttaaaccaaagaaaaagaaggttatacaacaaagtgaaggtgttcctggcactccatgccctccttgcccagaacttgtgtggagatcatgtgttgggcaacacattggagctgagagaatggaaagagagccagcatgtccacatcactgccctaggcgatgccatcctgaagactgtcctccatgcaaggtgctcattaaacggtcatgtcactgtggtgcgatggtccatgtgtttgagtgcctatattacaacagcttgtctgcaaagggtcaagagactgtccgttcatgtggtgggccatgtcacagaaagttgccaaattgtacacatctatgcccagagacatgtcatcctggtcaatgcctaaatgctgagaaatgctgtaaaaaggtcactgttcgatgcaaatgcaaaacattgaaaaaggagtgggtttgtcaagatgttcaagcagcatatcatcttgctggttgccatccaatggatattccaaaaattcaatttggagttggactcattccttgcaattctgattgtcagagtaaagtgcaggttgttgagtcagaactacagttacgtaaaactagagttacggagactgaagaggtggaaatagcgggtattaggaatattattcaaaggctaggtcaagtgaatgagtga

SEQ ID NO: 87057 - DNA, 1413 bp, Glycine max
  Peptide Sequence Number=SeqID_203835
atggattatgaaatcgctgagagcactgacaaggccgatatcactgttgatgcaaggagttttagttgggcagtggacagtgcgataaagagtgagactgcgtcaattttgggagaatcccgaatccatagtttttgttccgtagtggacaatgccataaggagtaggactgcatcagatttgggaacatctccttcccctgtccatagtcttgcttcggcagtggccaatgcaatgagcagcagtagtgctgcaccattttcacaactggaaacgtctccttctcctgtccagagtcttgcttcggcagtgcccagtgcaatgagcaggagtaaagctgcaccattttcacaactggaagtggtgcccaacgccactagacatgttcctgcacgattattcacctgggctgagcttaaagcagccaccaacaatttctcacctcacaaccggattcgtcattttggaacctttggctttgggtacagaggcaaactcgttgatggtcgtgaggtcgcaatcgttaagggaacccagtttggtaagtctgaatttgccatcttttcccgtttagaccataggaacttggttgggctggttgggtactgtgaaaacagagatgaaaggctgtcagtttacgagtatatgaagaatgggttgttgcgtgattgcttgcatgataagaacaatgtggacaaggatagcagtgtgttgaattcgtggaaaatgaggatcaagattgcttgggatgcttccttgggaatacaatatctgcataattatgcaaatccatctattattcacagggatatcaagtcttccaatattcttcttgatgccagttggacggctagagtatttgattttgaattgtcgttcatatgtccagaacctgacgatgaatacgatgagattataatgggaaccatgggatacatgtgccctgagtacatgactcgaggtgtgttgacagcaaagtgtgatgtgtacgggcttggagttgtattgcttgaacttttaacgggtaagagagctatactactcgagtctgaggaagatggacctccattttatttggtggactttgcagtgcctcctattttggctggagatttggtcgaaattttggattcaagggttggaccacccgatttgaaagaagcagaggcactgaagatcctggcccatacagctatacgttgtgtggaagaggaaccgaggcaaagaccaaccatgaatgacattgtggtcgatttggatcgggcttttgctatttgtggtagtagcctatatgatgagaacttttcctattccattgcattaccatcacatgagtccaatcatatgactccggatcctcttgatacggactcatgtgatattccaatctacgaagagaatacgaactcatga

SEQ ID NO: 87058 - DNA, 873 bp, Glycine max
  Peptide Sequence Number=SeqID_203836
atggagttaactccaagaggaagaactcaaggtcatgtgttgacctttgagagagatgcagattcctttgtggaggaagataaggagcttcagtccaagtgggctgctatagagaaactaccaactttcaaaaggattaagacttcttttgttgatgtcagtcaggaggagggtgcaagcagcagcagcaccgtcatcacgttgagaagcggaagcaaaagggtggctgatgtttccaagcttggagctgtggaaaagcgtttgttcattgacaagctcatcaagcacattgagaatgataacctccaactgctgcagaaactaagagaaaggatggacagagtcaatgtgaagttacctactgtggaggtcaagtacaagaacctgaatgtaagagcagaatgtgaggttgttcaagggaaggcactgccaactctttggaactctttttctagctcactttctggtttcatgaagactatatcgtgtacttctcaaggagcagagataagcattctgaataatgtcagtggcatcataaagccctcaaggcttactcttcttctcggtccaccagggtgtgggaaaaccactttgttaaaggcacttgctggaaaactagagcaatctctcaaggtttctggagaaatctcttacaatggttacaagctaggtgaatttgttccccaaaaaacatctgcttacataagccagtatgacctgcacgttccagagatgacagtgagagaaacgattgacttttcggcacgctgccagggtgttggaggcagagctgatctagtggctgaaatcagcaggagagaaatagaagaagggatcattcctgacccagatattgatacctatatgaag

SEQ ID NO: 87059 - DNA, 240 bp, Glycine max
  Peptide Sequence Number=SeqID_203837
atggcccacatatcagatattaaactgataagaacagatactacacttgatcttagccaaaaggccgagaaaggggaaatttcttacaatggacacatgctagaagaattcattcctcagaagtcctcagcatatgtaagccaatatgatctgcatattccagagatgactgtgagggaaacacttgatttctcagcacgttgtcaaggcgtaggaagccgatccagtaggtacacttaa

SEQ ID NO: 87060 - DNA, 708 bp, Glycine max
  Peptide Sequence Number=SeqID_203838
atggctgctgagaaaaatagccaacaagatgtgttcaatgtatttggtgcaatgtactctgctgcactattctttgggataaataactgctcaacagttttaccatatgtggcaacagagcgcactgttctgtaccgtgaaagatttgctggaatgtactctccctgggcctattcttttgcacaggtgctaattgaggttccctatatattcattcaagctgttgtatatgtgataatcacatatcctatgttgagctatgattggtctgcttataaaatattttggtcattcttcagcatgttctgcaatatcttatattataactacctagggatgctcattgtctcattgacgccaaatgttcaattggctgctatcgtggcttcatcttcctacacgatgcttaacttattttctgggtactttgtaccacgactacgaattcccaagtggtggatttggatgtattatttatgccccatgtcttgggcactgaatgggatgcttacttcccaatacggagatgtaaacaaagaaatttcagcctttgaagaaaagaaaacaattgccaaatttttggaggattattatgggtttcaccatgattttcttggtgtagttggtgttgttctcattgtcatccccattgtaattgccattctatttgcttattgcattggaaacctcaatttccagaagaggtaa

SEQ ID NO: 87061 - DNA, 2485 bp, Glycine max
  Peptide Sequence Number=SeqID_203839
gtttcatgttcttcaagagtttgatgaaggcaagagaagttgtcgaaggcgtttggcaggccacaataggaggaggaggaaaactcatcctgatgtttctgttgttaatgaaggctctctgaacgatcaaaggggcagtaactatctgttgatgagtctgttacggatactgaccaatttacattcaaatggctcagatcatacaaggaaccaggatattctctctcatctgctgaagaacctggcaagtctggctggtccaaataatggtggaaggttagcacccttactggaggaatcgaaagacttggtaaatgctgggacgcccggagctgctcaggataaacccaaccttaactcaaatgctcctgaagcttccaggccttcttctttcatcaagacagacaatgtcatcatcactcaggaccctacaatgccggtggcgcagtatgaaacacctgctgatggcaggacacaaaaatgtatagcttcaggtgatggtggagtaggaaattcaaaacctccttcaagaccactgttctcaaatgtatgtcaaccaagggacagccttccatcccaattaactacagcagagactaaagtaggaaggggaaacttgaataacattgaccttaataatggttacaatgatatacagaatactgttgagaatcataagaagccttatcctcctgtggcttcagtgatggggtctattgaccgtgcctcatggttgcagcgtgattctctcaaatcaagtcctccacagacaagtagaaactcagattcaacctctatccaatcaccatccagttccagtggagaagctcagatatctttactgataaagatactattttgccaaggtgcagcgcctctttgcatatgcaagggtaaggctgcgtacaacatccctcccccataccttcgcatagcgaagagcctctggacaatggggtacgaagttttacttaatgatttggatagaagtatgagtcgcacagatcgaattgtttttaaactctttggcaaggatccatctgattttccccttcttatccgatcacagattctcaactggttatcccacagtcccacggagatggagagctatataaggccaggttgtataatattaacgatatacctccgtcttgaaaaatctgcatgggaggagctctactgtaatctaggatcaagcttgagaaagcttcttgccgaatcaaatgattcattttggagaacaggatgggtatatgcaagggtgcagcactctgtagcttttctgtataacggtcaggtagtcttagatgtgcccttgcatctcaaaagcccacaacattgtaggatttcatgcattaaaccacttgctgttcctgcaagtgctagtgctcaatttattgtgaaaggtttcaaccttttccagtctagcacaaggttgctctgtgcacttgaagggaagtatctggtacatgctagctgtcatggtttgattggtggagctgatgcacccattcagcatctaagcttctcttgtcatataccaaatgtaactgggagggggttcattgaggtggtggaagatcatggtcttagcagctgttcctttccatttatagttgcagagcaagaggtttgttcagagatctgcaaactagaaaatgtgattgaggcagctgaaaccactgatgacatccagataaaaaaacaacaaatggaagaaatgactagagctttggatttcttgcaagaaatgggttggcttcttcatagaagtcatgtgaaagttaagcttggtcccatggctcctttccgtgatctcttccaattcaatcggttcgcttggctcgttgacttctccatggaccatggctggtgtgctgtgatgaacaaactcttggacattatatttgagggtggtgttgatgcgggagagcatgcctccattgagcttgcattgttaaacatgggtcttctacacacagctgtaaagagaaattgtagacctatggtagaactactgttaagatttgtgccagttaaaacctcagatggtgcagacagtgaagtgaagcaagttgacgaagcctctgacagattcttgtttagacctgatactgttgggccagctgggttgactcctcttcatgttgcagcaagtatgagtggcttggaggatgtgttggatgcattaaccgatgatccacgaatgttaggaattgaggcatggaaaagttcccgggacagtacaggtttgacccctaacgactatgcatgccttaggggctattactcctacattcaactagtccagaagaagaccaacaaaaaaggtgaaagacagcatgtggttgatatcactggcattgttgtagatagttacacgacgcagaagcaatcaaatggacataggacatgtagagtttcaagcttgcagactgagaagattgaaacaacaacaatgccacgtcaatgtcgggcatga

SEQ ID NO: 87062 - DNA, 714 bp, Glycine max
  Peptide Sequence Number=SeqID_203840
atggcacagctggcaggtgcggatgagatagagtctctgagaaatgagttagcagagataggaaggagcataaggtcctcatttagaagtcatgcctctagtttccagagcgtttcaagcatcaatcctgtgcaacaagaagttgataacaacgccggagaagcgttacaatgggctgaaattcagaggctacccacctttgagagaattacttcagctttgtttgatgtttatgatggcatggaaacaggtgagaaagttgaagggaaacaggttgttgatgtcagcaagcttggagctcaagaacggcacatgttcatagagaagcttattaaacacattgagaatgataatcttcgattgctgcagaaattcaggaacagaattgacaaagttggtattaatttgcccacagtggaactgaggtaccaaaacctgtgtgtggaagctgagtgtaagatagtccaaggcaagcccatacctacactgtggaataccctaaaagaatggatctttgacaccactaaattgccagttctgaaatctcaaaattccaagataagcatcatcaaaagtgccaatggaattattaagcctggaaggatgaccttactgcttggcccaccggcaagtggtaaaacaacattattgttggcgttggcaggaaaacttggccattctctcaaggttctcaatctcacggttttttcctag

SEQ ID NO: 87063 - DNA, 2421 bp, Glycine max
  Peptide Sequence Number=SeqID_203841
atgaattttgctccatgtatgaaagaactcctgatggaagtcagtagaaaggagaaagagggaggaatagtcccagacccagatttagatgcatatatgaaggcaacatcaattaacggactcaagagcagccttcagaccgactatattttaaagatacttggtcttgatatatgtgctgacacattggttggagatcctataagaagaggtatatctggtggtcaaaagaaaaggttaactacaggagagatgattgttggaccaacaaaagcactctttatggatgaaatatccaatggtttagacagctccactactttccagattatctcttgtcttcagcatctggtgcatatcacagatgccacggcattaatttcactccttcagccagcaccagagacctttgatctctttgatgatgttattttgatggctgaagggaaaattgtgtaccacggaccgtgtgattatatacttgagttctttgaggacagtgggtttaaatgcccacaaagaaaaggcactgctgactttcttcaagaagttatctctaagaaagatcaagcaaagtattggaatagcacagaaaaaccttacagttatgtttcaattgaccagttcattgagaaatttaaggattgcccttttggtctaaagctgaaggaggagctctcgaagccatttgataagtctcagagccacaagaatgcccttcttgtcattgttgcatttgtagcaatgactgttttcattcgaacacgaatgactgttgatgtgctccatgggaattattttatgggttcattgttttattcactcatcatacttctcgttgatggatttccagaactatctatgactattcctctttcattgttggaatctttcatttggacaacactttcttattatgtcattggttacagccccgagattggcaggttctttcgccagttccttctcttatttatcatacatgtgacttcggtatccatgtttcgattcattgcctcagtttgccaaactgtggttgcttctgtgacagctggtactgtgaccatactagttgttttactatttggtggcttcatcattccaaaaccatatatgccatcttggttgcagtggggattttgggtttctcctttgacatatggagagataggcttaactgtgaatgaatttcttgctcctaggtgggaaaagatgtctggaaacagaacattgggccagcaagtacttgaaagtcggggactaaactttgacggctacttttattggatatcaattgctgccttaattgggttcacagtgctgtttaatgtaggttttaccttgatgttgactttcttgaattctcctgcaagatctcgaactcttatatcttctgagaagcactcagaattacaaggacaacaagaaagttatggtagcgttggtgctgacaagaaacatgttggttctatggttggaagtactgtacaaaccagaaaaggaggactggttctaccattccagccactagcagtagcatttcatgatgtccagtactatgttgattcccctttggaaatgagaaatagaggttttactgagaaaagacttcagcttctttctgatatcacaggttcactcagacctggcatcctaacagcattgatgggagtcagtggagcagggaaaacaactttgatggatgtcctgtgtggaagaaaaactggtggtattatagaaggagagattagaatcggcggctacccgaaggttcaggaaacatttgctagagtatcaggttactgtgaacaaaatgacatacattctccaaatataacagtagaagaatctgtgatgttttctgcttggcttcggcttccttctcaaattgatgcaaaaactaaagctgaatttgtaaatgaagtcattcatactattgagcttgatggaatcaaagattctttagtaggcatgccgaatattagtggtttatcgactgaacaaagaaaacggctgaccatagccgttgagcttgttgctaatccttcaatcatatttatggatgaaccgactacaggtctagatgcaagggcagctgcagttgtaatgagagcagtgaagaatgttgttggaactggaagaactgttgcatgcaccattcaccagccaagtattgatatatttgaggcatttgatgagcttattctcatgaaagctggaggtcgcttaacctacgctggcccacttgggaagcactcaagtagggtcattgaatactttgagagtataccaggagtgccaaagattaaagacaactataatccatcaacatggatgctagaagttacttcaagatctgcagaagctgaactcggaatagacttcgcccaaatttatagggagtcaaccttatatgagtaa

SEQ ID NO: 87064 - DNA, 3198 bp, Glycine max
  Peptide Sequence Number=SeqID_203842
atgacaggagaaatgattgtgggtcctataaaagctctttttatggatgaaatatcaactggcttggacagctccacaacctttcaaatagttacatgtctccagcaattggtgcacatcactgatgcaactgcagtgctttcactccttcaaccagcaccagaaacctatgagttatttgatgatcttatattaatggcagaggggaagatagtataccatggcccccgcagtcaagcactccaattttttaaggattgtggtttctggtgcccggaaagaaaaggagtggcagactttcttcaagaggtaatctctaagaaggatcaaaggcaatactggtaccgcaatgatattccttacaaatatgtttcagtggatgaattctctcaaatattcaaatcaagttattgggggagaatgttaaatgatgagctctcacggccagatgataaatctgaatcccataaaaatgctttatcatttagcaagtactccttgggaaaattggatttgtttaaagcttgtatgaagagagagattcttctcatgaaacggaactcatttatctatgtctttaaaactgcacagcttacaatcacagctatcataacaatgacagtcttcatacgtactcagcggactgtggacttgataggtgcaaactatttattgggttcattgtactatactcttgtccgcctcatgactaatggagttgcagagttgatcatgactattactagactccctgttgttgataagcagaaggaattctatctctatccagcttgggcttactgccttccatctgccattctaaagattccattttcagttcttgattctatagtttggacatccgtaacatattatgttataggctacagccctgaaataacaaggcaattactcatgtctcatggagttatatttactgcagcatcactaccacggtggttgaggtggggattttggctttctcccatgtcatatggggaaataggaataacactaaatgaatttcttgctcctcgctggcaaaagatcaaagtgggaaatgtcactgaagggagggaggttcttaggagtcatggtttagactttgacagccacttctattggatatcagttggcgccctacttggtttcaccatactatttgattttggatttgtcttggcattatcatacataaaacagcctaagatgtctcgagctttagtctcaaaagagaggctctctcaactaagggaacgagaaacaagcaatagtgtggaactgaagtcagttactgttgatgttggccacacaccaagggaaaatcaaagcacagggaaaatggtcttgccctttgagccactgtcaatagcatttaaggatgttcagtattttgttgacattcctccgatttttaactgtcattctgaacaggagatgaaaaaacatggttccgatgagaaaaggctacaattgctttgtgatatcacaggagcctttaggccaggaattctcactgcactgatgggggtcagtggagcaggaaagacaactctgatggatgttctttcaggaagaaaaactggaggtatcattgaaggagatataagaatcggaggctaccccaaagtgcaaaagacatttgaaagagtttcaggttactgtgagcagaatgacatacattctccatatataaccgttgaagaatctgtcacatactcagcttggttgcggttgccaacagaaattgattctgtcacgaaagggaaatttgttgaagaagtccttgaaacaattgaacttgatggtataaaggattgtttagttggcatccctggccaaagtggcttgtctaccgaacaacgtaaaagactaaccattgcagtggagctggtttccaatccatcaataatattcatggatgaacctacatctggtttggatgctcgagcagctgcagttgttatgcgtgcagtgaagaatgttgttgccactggcaggacgacggtttgcactatacaccaaccaagcatcgacatatttgagacttttgatgagttgattctaatgaaatctggaggacggattatttatagtggaatgctaggccatcattcaagtagactgattgaatattttcagaatatacctggggtgccaaagatcaaggacaattataatcctgcaacctggatgttggaagctacctctgcatctgtagaagcagaacttaaaatagattttgcacaaatatataaagagtcacacctttgccgggatacccttgaattggtgagagagttgagtgaaccaccgccaggtacaaaagacttgcacttttcaactcgcttcccacaaaatagtttgggacagtttatggcatgcctttggaagcaacacttgtcttattggagaagtcctgagtacaacttaactcgtttcattttcatgattgtttgtgcaatcatgtttggagcagtattctggcagaaagggaataaaataaacaatcagcaggatttgttcaacgtacttggatcaatgtatattgctgtaatattcttgggtctaaattactgttcaacaattctaccatatgtggctactgagcgtgctgtcttgtaccgagaaaaattcgctggaatgtactcttccacagcttattcatttgcacaggtggccattgaaataccatatatcttggtgcaatcaattttatatgtggctatcacatatccaatgataggtttccattggtcagttcagaaagtgttttggtacttctacaccacattctgtacatttttatactttgtatatcttggaatgatggtaatgtcgatgagctcaaatctcgatatagcttctgtattgtcgactgcagtctacaccatattcaatctcttttctggatttctcatgccaggaccgaaaattcctaaatggtgggtttggtgctactggatttgtcctactgcttggtccttgaatggcctcctaacttcacaatatggagacatagagaaggaggtactcgtatttggggaacgaaaatcagttggttcctttttaagagattactatggcttccggcatgacagattaagccttgtggctgtggtgctcattgtgtacccaattgtctacgcttctctgtttgcctatttcataaagaaaatgaattaccaaaagagataa

SEQ ID NO: 87065 - DNA, 1095 bp, Glycine max
  Peptide Sequence Number=SeqID_203843
atgcgatcagagaagaaaccatggtcgccactcctctgtgaggaactcatcgaggaaatcttgtctcgtcttcccgtgaaacctttgatccaattcaagtgtgtgtgcaagggatggaactccctgatgtcagatccctatttcatcaaattgcacctaagcaaatctgctgcaaaggacgatttggaacaccttcaactgatgaaaaatgtctgcctcggatccatccctgaaatccacatggaatcgtgtgatgttaccatctggtcggtccatgtaatgggttgcactgtggggtctagcgaaatactagaagaataccgtgtccgtttctggaacaaggcgacaagggtgatatccagagaatcgccaacgctgtctttttccccaggcattggtcgtagaacaatgtttgggtttggctatgatccgtcaagtgacaaatacaaggttgtagcaattgcattgactatgctctcacttgacgtatttgaaaagactgagatgaaagtttatggcgcgggtgacagtagttggagaaaccttaaaggttttcctgttctttggactttacctaaagttggtggagtgtatctgagtggaacccttaattgggttgttattaagggaaaagaaaccattcattctgaaatcgtaattatttctattgacctggagaaggagacttgcagatcactgtttcttcccgacgatttttgcttttttgatacaaatattggagtttttagagactcgctgtgcgtttggcaagatagcaacacccatcttggcttgtggcagatgaggaagtttggagatgacaagtcttggattcaattaataaattttagttatttacatcttaatattcgtcctaatgaagaaaaatcgatgattttaccattgtgcatgtctaacaatggagacttcttcatgatgaaattcactagaaatgctgatgatgaataccaaacaattctgtataaccagagggatggtaagtctcaagtttctgtcgtttcctcaggtagtttcagaactttgttgtggcgcaacctcaagatttttaccaaaagtttggtcataccttattga

SEQ ID NO: 87066 - DNA, 948 bp, Glycine max
  Peptide Sequence Number=SeqID_203844
atgaattgtaatttagccgaaggagagcatcataaggacagttgttattattattctataaataattttgaccggaaacaggaaccggtcatatatgattaccatgagaaagaaagagccccggatcttgaaagtattttggcagacttcatgatgtaccaagcaagctctaaaggttattgttattctatgcaacaacagggaattcaatttgaaaggaaccagtcttctgcaggttatcaatgggagtcattccggcaatctgagtatcacaataaagcagaaggagttcttaatctggatgatctgttaatacaattcaaagatacggtagaatcaatacaacaggcctttagaaggactgaaactcagattagtaagttggttgatgacatgactaacgctgcgaccataaaagaggaagagcgtacagagattgaaacacatcaagaaagcatttgtcaagttacctcaatcaatcatcaattgaccaacaaagaggaaacacctgaagtctccagtactccagaatatccctacttggatactgttggctatgtaggagggaaagataaaggtaggttggaactcagcataaaggttgaaaagatcttttttgatctctttgaggccatgaaacacccagatatgggtgatgcctattttgaagaagaagaggtggagcaggaaataacattatcaaccgcaaccatggtactacaatctcccttggaaaaagaacctggctatgggagagattgcttagcttgtgatgaagagcttgatgattcaaaagacagttgtgttgatcaggtggtttttgaagaattggaaaaactaagaccagcagaaaagcccaaagcagaattaaagacccttccggcacatttaaaatatgtatttttggaagaagatgagaccaacctgttatcattagcaactctttga

SEQ ID NO: 87067 - DNA, 753 bp, Glycine max
  Peptide Sequence Number=SeqID_203845
ttttcatcagatagcagctttactatgttcaattcatgccaagatattgatgaagagggaacctccattttgtcacatatagaccagcacttactttattctcacactttatgcaacatgggaccccagagaaggaagcgacggagattcatagaaggtagccatgaattactgaggaagaatcctgtacaaagagctccaaatgtgagtgaggaagttaggataatgcaacagagaatacggagtggtgtcattctaccaaagaaaatcagagaggactcactgttatcagcagctatctggagtagtttacttgatcagtcaataaagaaaggtaattgttgtactagggagttaggagtgcttcttcctgggactaatgatgtttcccagatattgaaatccaaaagggtgttgcataggataaagaagatgctgtttgattgtgtgaaagatattaccataacccttccagcacaagacgacagaaagaaaggtagcagacaattcatggggcctctacagattgcaaaggtccttcctcagagaacaaaaaaatggggccaacaagctggtgatggagaaaacctcacctacttactcgctttggattacttgaattcaatcatggaatggaacaagttcgaaccgcacgtgaaggacattagtgttgagatcactgatgcaattttagataacatccacaatgaaattgtatttgaaatgataggaaatttgacacgaaatacataa

SEQ ID NO: 87068 - DNA, 1305 bp, Glycine max
  Peptide Sequence Number=SeqID_203846
atggaaaaggaaaatgctgcagaggaacaccgccggaatatagcagaatatagaaaatttctggagtcctgtgactatgtgaaggcgaatagtcattggcgaaaaatccaagatcggttagaggatgatgatagatacttgcgacttgaaaaaattgactgcttgctagttttccaggactatattcgggacttggagaaagaagaagaggaacaaaaaagaatacagaaggatcaaatccgtcggggtgaaaggaaaaaccgtgatgcatttcgcaagttgcttgaagaacatgttgctgctggaattcttactgctaaaactcaatggcatgaatattgcttgaaggtcagggatttacctcaatatcaagctgttgcgtcaaatacatctggttccactccaaaagatttgtttgaggatgctgcagaggatcttgaaaaacagtatcatgaagacaagacgctcataaaagatacaattaagtcaggcaagatcactgtagtgactacatcagtatttgaagagtttaaggttgctgtcttggaagaagctgcatgccaaacaatatccgagatcaatttgaagcttatattcgaagagttgttagagagagccaaggagaaggaggagaaagaagccaagaagcgccaacgccttgctgatgactttactaacctgttatatacattcaaggatattactgcttcctcaaaatgggaggattgcaagtctctttttgaggaggctcaagagtacaggtcaattggagacgaaagctatagtagagaaatttttgaggaatacatcacatacttgaaggaaaaagctaaagagaaggaacgcaagcgtgaagaggaaaaggctaaaaaggagaaagaaagagaagagaaagagaaacggaaggagaaggagaaaaaagaaaaagatagagaacgtgaaaaagataagtctaaggaacgtcataggaaggatgaaacagatagtgataatcaagatatgactgatggccatggttacaaagaggagaagaaaaaagaaaaggataaggaaaggaaacatcggaaaaggcatcagagcagtatagatgatgtggattctgaaaaggaagagaaggaagaatctaaaaaatcacgaaggcatggcagtgaacgcaagaagtctcggaagcaagcagactctcctgaatcagacaacgaaaaccggcatagaagacacaagagggagcactgggatggttcaaggaaaactggggggcatgaggaacttgaagacggggagctcggggatgatgttgagaactag

SEQ ID NO: 87069 - DNA, 453 bp, Glycine max
  Peptide Sequence Number=SeqID_203847
atggaacacaccaattacaatgatgttcattgtgtagaaactatagtaaacgttcctttctcatgggaacacaaacctggtctctctaaagtcactactcatggccaccacaatggcactagcatggtgcttcagcctcctccatgttcatcatcatcatcaggatctggaagtgatcacaaacacaaagtggaggaggaatctcagattcttcgtgccgtgcaaacgtcgctcagaatcagctcttttaggatggagagtcagaaggaagaagacccttttgttgaagcttacaagaaatgcacacgaagcccctttatacatcaacagagtaatagggtccaaaagaacattagatctaggcctaacatatggaagtacgtgaattttttttcttgcaagcactctgatgatgtttgtggtaacaaagctgtccatacctataaaagttga

SEQ ID NO: 87070 - DNA, 838 bp, Glycine max
  Peptide Sequence Number=SeqID_203848
atggctacagcaaaagagtacagcgataacgtgcagcgcgaagtgaacatcgacgtggacgcgctgctggaagcgattcagaaaaaaacgtcaggtgaagtgcaggagtttatgcaggctgaagatgcgcaccgcgtgaaggtgaatggcgaagcgtttgactcctacaccgaactggccgaggcgtttgaactcgatattcgtgatttcaccatcactgaagaaaatcttaacaccgcttcagagtacgccttagctgaaccgcttcggtatctggcttatgttttaagaattatcctggatagtggccgcgccggcggcaaggaaaagtgtgatcgtgattacgctattatactgattacacgtcgctttacggatgcctttgggcgtaaggagtgtattgatgatcccgccgccagcgagtggctggcgcgtcttaagcagcaacagattccgctggtgatttgttcgagtaaaaccgcggccgaaattattccgctgcagaagcggctgggcatcgccggtgcgccctttatcgcggaaaacggcgcccgtgtcgcctttggcggggaagcgcagatcgccgaagagcccggtgccgattatcttgcgctctgtgccacgctcagcaccctgcaggcggattttcgcttcaccggctttcatgactttagcgacgcagaagtggcccgtttcaccgggctgacgttgacggaagccagccagagccgactgcgcgatgcgtctgaagtcatcgtatggcgcgatgatgaaacgcggctcgacgccttccgcgcggcgctggcgcagcatcagctggccctgacgcagggcggac

SEQ ID NO: 87071 - DNA, 300 bp, Glycine max
  Peptide Sequence Number=SeqID_203849
atggcaatggggggaggaggagttggttcaacaattgggtcatgtttttggacaatggtgcttttctggttggagatgagcatgatgtttggctttggggatcttgtggtgcattctcgggtaccaactccagatgccttattgcgtaggggagttgctattgaagatgttcattatgcgttttgtggatttgttattgaagatccagttcttaattttgcatgttgtaacttgttgaaggccattttcaatgaagtagtacctgatgttcacattgctcgagtagcatttcttttctga

SEQ ID NO: 87072 - DNA, 1995 bp, Glycine max
  Peptide Sequence Number=SeqID_203850
atgagttcctcggataagcttgatgaggctctgcttcgcctctctaaccatcaggccctccttggtgaatccatgaataccctcactcagaagattgacgaccttctgactcgggtcaccccatgttttcgtctccttctagctcatacacaccaccccaccacctgtacctacacaaagccacaaattgaagctcgagctctccagacacgattcgccccatcccaatatgatgatcctacgggggcactatttaagctcactcagagagggtcagtgactcaatacctctccgagttcgaagaactagcaaatcgaaccattggccttcccccgccgttcttgctcagttgcttcgtctctgggctcaccccagagatacgccgcgaggttcaggcgcttcagccactcactctggtccaagctgcagtgctggcgcgcctccaagaggagaaactcttggacaaccgtcctccaccgcgaccaagacctgttccgccagtcccaaccccagccttggttccgccttccccaccacctcattccccacgccctacaccattaccacccctcctccctactcccacccgcactgcaccacccccaatacgccgtctatctccagacgaaatcgcctcacgacaggaacgcggtctctgtttctattgtgatgaaaaattccatagaggacacaaatgtgcctctaggatttttttgttgattgcgaacgaagaagacaaccccactcctcatataggatcccctaacccgccccccgacccgccagaccatattgatattactaacccgggcccggcccaaattagcctaaattcacttgcgggtcacctcgcctcggaaaccttacaactcatgggccaactttccggccaccctgttgtggtgctcgtggacggtggcagcacccataattttattcaacaggagctcgtcactcaattgcgccttccctgtcagcccactccttcaccattacgtgttatgacaacagagacagacctgtattgccatatctcccttattgagactgactccatcacatctcagaacttccatcaggatagtcaaaagctcctcaccaagtttgcgagcctgtttcagcaaccaaacaccctacccccggaatgtgaaattgaccatcacattcatcttcttcctcactcagctcccatcaatgtctggccatacagatatccccactttcagaagtgtgaaatcgaaacacgagttgacgcaatgctccaaaaaggtctgattcaaccaagcaccagccccttatcttccccggtgttgctggtgaagaagcacgacggcacgtggcggttatgcatggattaccgcaccttgaatgcaattacgattcatgatcgtttctcaatcccaacgattgatgagctcatggatgagcttggtggtgctcgctgcttctctaaactcgatttattgcagggatatcatcaaatatgcatgcattccgacgacatcccgaagactgcctttcacacccatcatggccactacgagttcagagtgatgccatttgggttgtgtaacgcgccttcatccttccaggccacaatgaacgccattttccgcctttacttgcgtcaatttatcattgtgttcttcgatgatattctcatatatagtccctgctttgctgaccattttcttcacttagaactcgcctttcaggtactctctgctcaccactttgttctgaaactcaccaagtgcttctttgctcaagatcaggtggagtacttgggccacttggcgtcctatcgtggtgtggagcccctcgcatcaaaagtggcggccatccataactggcctatacctcggacaactcgagcagttcaaagcttcttaggattggctggattctatcgtcgttttatacgagggtatgcttctattgcagcttctatagtgtggtttttacacttttctgatgttgttagattaagctga

SEQ ID NO: 87073 - DNA, 474 bp, Glycine max
  Peptide Sequence Number=SeqID_203851
atggctagtgtggtaaaggagcgttcaggggcagagatagtgtatggttctgaagagtgttatcgccactccatagagctcttagaagagttgggtttcccaaagggtgttcttcccttgcaagacctggtggagtgtggtagggttagagaaactgggtttgtgtggatgaagcagaaggcaccttatgagcatttctttgagggaaccaacacgagggtgagctatgctgttgaggtcactggctatgtggagaagtttaggatgaagaaaatgagtggcattaagagcaagcagatgatgctgtgggtgccaataactgagatgagcattgaagatcctaaggggcagaagatactctttaagacccctatggggattggaaagtccttccctatcctggctttcatgaccccagaggaaaaggaaaagcacctgctgttgcagtataaggagattcaagaaaacagttag

SEQ ID NO: 87074 - DNA, 1512 bp, Glycine max
  Peptide Sequence Number=SeqID_203852
atggcatccgatctaaattcggggttgtcccaggaaacgtctgtttttgggttgaaagcatgggaattgatggggataatagttgggttgttcattataattattctcgtggtgatatcaatatgtcttacttcaagaaagaaatctagaagagtcaatggcatgcttccccttagccatatgttatcggtttcagatgagatcaaggaaattagagttgatcaagtttcagccaataatcatcctcagaatggagcttttgtgagtctgtatgacaggtttagtgacagggattctgaaaaagttttgatccaaacaaataacggggaaaatagcagtcaatcaggctcatttgttcatcttaagaaagatgatggctctcaatcaggcgaagaaagtggtgctaagtctgtttctacttacaggtcttcttcacatcctataactgcaccgtcccccttgtgtggtctgcctgaattttctcaccttggctggggacactggtttacgttaagggacctagaacttgcaacaaacaggttttcaaaagacaatgttattggtgaaggtggatatggtgttgtttatcagggccagttaatcaatgggagtcctgtggctgttaagaagctactcaataatctaggacaagctgaaaaggaatttagagtggaagttgaggctattggccatgtgcggcacaagaatttggttagacttttaggctattgcattgaaggcactcacaggttgctggtttatgagtatgttaacaatggcaatttagagcaatggcttcatggagccatgcggcagtatggttttcttacttgggatgctcggattaaaattcttcttggaacagctaaagcgctagcttacttgcacgaggcaattgagccaaaagttgtacatcgagatattaaatcaagcaatattctaattgatgatgacttcaatgccaaaatatctgactttgggctggcaaagttattgggtgctggaaaaagtcatatcacaactcgagtaatgggtacttttggatatgtggctccagaatatgccaattctggattactaaatgagaagagtgatgtttatagctttggggtattgctcctcgaagcaattactggaagagacccagtggattatagccgaccagcaactgaggtaaatttggttgactggctcaagatgatggttgggaataggcgcgcagaagaggtggtagaccctaacattgagaccaggccatcaacaagttcccttaaacgtgcccttttgactgctttgaggtgtgttgatccagattctgagaaaagaccaaagatgagtcaagttgtccgcatgcttgaatcagaagaatatcccataccacgcgaggatcgaagacgccgaaagagccaggcaggaaatatggagctggaggcccagaaggagacctccgacacagagatgactgagaatccagattccaagtccaatggcagaaggaaccaaaggaagtag

SEQ ID NO: 87075 - DNA, 1104 bp, Glycine max
  Peptide Sequence Number=SeqID_203853
tgggttttgtctccaaagtactttaactttccgcttccaataacactcaccatgattcacatgggcttttctggggcagtgacgttttttcttgtccgggtctttaaggttgtcactcctgttaaaatgacatttgaaatatatgctacttgcgtgataccaataagtgccttctttgcatcaagtctttggtttggtaacacagcttatttgcatatttctgtggcttttatccagatgctcaaagctctgatgcctgtggcaacattcctcatggctgttatgtgtggcaccgacaaagcaaggtgtgatatgttcttcaacatgttgctggtcagtgttggagttgtcatttcctcctacggagaaattcattttaatgtagttggtacagtttatcaggtcaccggcatctttgctgaagctttgagactggtcttaacacaagtccttttacagaagaagggcttgagtttaaatcctattacaagcttatattacatagctccatgcagttttgtgtttctctctgtgccctggtacctgctggaaaagcctgttatggaagtttcacagattcagttcaatttttggatcttcttttccaatgctctatgtgctctagccttgaatttttccattttcttagtagtcggtagaactggcgctgtaaccatacgggttgctggggtgcttaaggactggatattgatagccctttcaactgttatatttccagagtctacaataacttggctgaatataattggctatgctattgcactatgtggagttgtgatgtacaattacataaaggttaaggattttcgagcttctcaatcaccagatgaaattattccagatcgaatcaccaagtttattgatctggtctcgtcaaattcgattgacatacaggactggaaattcgagaagaggtcatctgatttttatgtgccagataatgttagtagcaataggggaagtggtggaggcaatggttctctttctgatatgaaaattgatgaagaagcaccgctaatttcttcatcaagggtgtctcatattggacgtatgcagctagccaaccatgcaacaggaaaatga

SEQ ID NO: 87076 - DNA, 207 bp, Glycine max
  Peptide Sequence Number=SeqID_203854
atggaggcacgggcggaatctgaaaacaaacaccactggtttccaaaaagaaaagaaaaaaccacaaaaaatacaagaatgaaaaagaaactggatgtggcaaagtgcaaggaatctagaacaagcatcatattacaaaataaccagggaaggatatggctcggtggccccagagcctgggcaattgcccagggtagccgggcctaa

SEQ ID NO: 87077 - DNA, 867 bp, Glycine max
  Peptide Sequence Number=SeqID_203855
atggttgctgcagctcattggattgcaaaactctgcactcctgcactacttaaggctctcaatgaatctccagactcagaagtcaaggagtcttgcccattattgctaagacctttcgctattgtcatttttgcagctgcttgtatgacatgggagttagctgaatcagggaagcactttatggtacccacattatcagcttcctctgttgatgatcttcgctctgaggtcgctgcgtcatcttggttgagtgatttatgggatcaggtggagcatacaaaagttctgaaagtcgtccaccactcagcaactgcacttggatctcacttaaaatccatatctgttgcaaaagacaaggtagctggtgcaagtgctattgtacggcctgcgaccagtggcacccagcaactccttgatgttaacaagcacattacctcttctgtggtaaatgacattgctgaaggaaaattgtggtatgagctggagaaggaacttgaaaaacagaattatatcctgaacatccgggcgcaggtagaagaggcagctgtagaaaaagagataactgaagaagagaatcagcttattgatgctgcacaaggcagcaattcaatcacaccatctcacaatgtagatagctatcgtttttatcccccaggtaaaatcatgcatattatctccgcaccttcgtcagatgactctagttcaaactccattgaggaacatgtcaaactatatgaaacacctagacagctgtatagcaagctcagactttcaagaacgatgataaatgatcattacatgcccacatataggaagatgatccaaccattaatccaacaactagagaaggatataaatgtgaaatag

SEQ ID NO: 87078 - DNA, 390 bp, Glycine max
  Peptide Sequence Number=SeqID_203856
atgtgggggatgtgggatttcaccttacacttgtactccaacaccgagaacgtggagggtgaagccagctcaagcactgacaatatgttggaatcgattgcgacgttattagagatgttgaggttcacttactcggagactattgggaaatggccaatcgccgacaaagccttcggcatcaattacttcatgcgcaaacagaaaagcaacaacaacaatgaaggagtagcaacacaatgcacaaaaaataagtatgataaggccaacaacaaaggatcaggagccaccggcaagaaaaaccacaaacagaggaccaacatgcatgaaggaagaagaagaagcaccaatagagtgaaacgacacaggaaaaaggaagaagaagaaccatag

SEQ ID NO: 87079 - DNA, 294 bp, Glycine max
  Peptide Sequence Number=SeqID_203857
atgggcatcgtgcacaatataggtgaacaacaaaagttagatgtactttcaattttaaccaaaaaattgccacaacaggcattcctgcaaggagttagatgtatcacagaattctcagtggcagtgtcatgtgcggagttaaatgtcggaggcactgcagaattcttggtggcagagccatatggggtggtggcgaccaaagggaagcggaggtgggtcttgaggttgacattgactttagatccaacccaacaatctaaggttgatggcaaccaggcagaggtcggaagatag

SEQ ID NO: 87080 - DNA, 258 bp, Glycine max
  Peptide Sequence Number=SeqID_203858
atgtgtaagactagtttgcatgttgtggttaccatgtttactggctatcttctcggatatgcagcatttagagcattgtttaatcacagtcctgccatgaatgccgctggaggaattcttgggttggttggtgccatgtttgttgaaactttccttttcattattagaagttccaatgcagatgccgacaaaacaagaaaatccagtcagaaaccgagatcatccttttcaacatccaggattaagaaaaaccagtag

SEQ ID NO: 87081 - DNA, 606 bp, Glycine max
  Peptide Sequence Number=SeqID_203859
atggccaaaaagaagagctggtttagtctgctgaagaggctctttatatgggggacacattccacacaagataagaaggagaaaagaaggaaatggatatttggaaggctaaagagtaagagattgccttcaattaaagctccactaccctcaaaaggaacaacactaagtgaggcagagaaagaacagagcaagcatgctttaacagtggccattgcctcagcagcagttgctgaagctgctgttactgctgctcatgttgctgctgaggttgtttgcctcactgggcaatgcaaggaaaactcagaagaatctcaacctgttcaaactgcatttcggggttacctggcaaggaaggctttgaggctcacccaaaaaggagtggcggctgatataatgctagatacaacgatgagaggatatatatggagcatacaggatgaagacttttctgcactaagcttcgaaacgatgaaaaaaagccctagaagaggagctaaggtggaactactgatttgtacaagagatgctagggatgctaaaactgaaccaaattgtgtgagaattaaacagaactggaaaaacgattctctcaagctaaattaa

SEQ ID NO: 87082 - DNA, 1749 bp, Glycine max
  Peptide Sequence Number=SeqID_203860
atggcgactggattcgacaccgcccatgagaagaagaagaagattgccgttctgagcgtgtcttccatcctcctggtggcgatggtggttgcggcggccgtcggcataagagacggcgccgaagtggtcgaggaaggtggcgacacgatcgcgaaatctcaaaggaaccagcaagtgatatgcgaatccgcggaatacaaagaaacatgccacaagagtctggccaaagcctccggaaccagcgatctgaaggagctcatcataaccgcgttcaacgccacggccgaagagatcgcgaaccaaatcaaaaactcgacgctctaccatgaactcgccaccgaccacatgacaaaacaggccacggacatctgcaaggaggtactaggttacgctgtcgacgacattcgccgatccgttcacacgttggaaaagttcgacctaaacaagttgaacgattacgcctatgacctcaaggtctggatcgcgggtactctagctcaccagcagacatgtttggatgggttcgagaacacgagcagcgaggctggaaagaccatggctaaggttctgaacgcgtctttggagctcagcaacaacgcgttggacatagtcaacggtgtttcgagtctcttcaagggtcttaacttgagttccttcagcgtcaacagcaacaggaagcttctctcggaggaaacggctttggtggatgggttccctacgtgggtgagtgaaggacagaggaggcttcttcaggctgtggaccccaaacccgacgtggttgtggctcaggatgggagtggacaggtgaagacaatccacgaggctcttaaattggttcctaagaagaacaagaagccttttgtgatttacatcaaggccggtatctacaatgagtatattatcatgaacaagcacttgacctatgtcaccatgatcggagatggccccaccaagaccagaatcaccggcagcaaaaactacgtcgatggcgtccaaacttacaacaccgcaaccttcggtgtgaacgctgctaacttcatggcgaagaacattgggttcgagaacacagctggagctgagaagcaccaagccgtggccctgagggtaacagcagacaaggcagtgttctacaactgcaacatggacgggttccaggacaccctctacacgcaatcccagcgtcagttctaccgcgactgtaccgtgacgggcaccatcgacttcgtgttcggcgacgccgtggcggtgttccagaactgcaagttcatcgtgaggatgcccctggaaaaccagcaatgcctggtcaccgccggtggaaggtccaagatcgatagccccagcgcactcgtcttccagagctgcgtattcaccggcgaacccaacgtgcttgccttgacccccaagattgcttacttgggaagaccatggaggctttacgccaaggttgtcatcatggactcccaaatcgacgacatctttgttcccgaagggtacatggcgtggatgggaagtgctttcaaggacacaagcacctactacgagttcaacaacaggggtcctggtgctaacactattggtagaatcacctggcctggttttaaggttcttaatcctattgaggctgttgaatactacccaggcaaattctttcagatcgctaattcgactgagcgtgattcttggatcctagggtctggggtgccctattcccttggcccacttattgcgctgccattcccaacagcttaa

SEQ ID NO: 87083 - DNA, 237 bp, Glycine max
  Peptide Sequence Number=SeqID_203861
atgaaaactcaagaagcagaacatgctaacattggacttgggtcctctggccagcagaagaatttttggaacctttcatcagagcctcaaattctgtgtcaatacaaattttatccaacgtatttgactgctaaggtcattcagatgaaagtagaggacgtgaaatgcaatgaagctgcttcaagattcatagctgaaaacagaacagagttgccacaaagaggcttggttgggtga

SEQ ID NO: 87084 - DNA, 546 bp, Glycine max
  Peptide Sequence Number=SeqID_203862
atgtcagttggtgaaattactaaattgtattctgtccgtgatcagaataatgatatcgaaacttcaccagcagaccgggagccgagccgtccctgcagccacaattccccttcaacaacaccctcaaaggtcccattagccaatggagcaaaaacaaaggtactatcaagttcaaggggtggttcatgggggggtgatggtgactcaaaaagcatgttcagcaaaaacttagaaaacactcgcaggcacagcattggagtgtctcaagtgagagatgatgagagcaattcaagctcatcaccgtctacaaaggtcgcaaccaaggtaaagtcatcatcatcatcatccaaagtgagaagtgcatcgtttggtgtacatagaaatggaacacctgaaaaagcaacttctgctcccctaaagaagaggctttcttcccctgcttctccagccggtataagaaggtatgctgtttcaactaggccgggaaatgtggcttccaacaagagtgttgctaatgctataccatctctgatgaggagaaagtga

SEQ ID NO: 87085 - DNA, 153 bp, Glycine max
  Peptide Sequence Number=SeqID_203863
atggctacttataggaaaaagccattttggggcaggggaagctcacccagcaagctgatgcttagccctaaaggaatgagctcacccaggcgagctggttgcttaggcatgaagctatctcatggcccttttacccccttccttggtaagtaa

SEQ ID NO: 87086 - DNA, 286 bp, Glycine max
  Peptide Sequence Number=SeqID_203864
atggaagagatgcccaagaatgaagtgcaacaagagagccaaatcatgaacaaaaggaagattatcaatgaaatggtttggagaaagaagatttttgttgggggcttaccttctggcatatcagaggaggagttcaagaattattttgagaggtttggcacaataactgatgtggtggtgattcaagacagtgtcacacaccggcctaggggatttggattcatcacatttgattcagaaaaattggttgaaaatgttatgctaaatagcttccatgatttgaatg

SEQ ID NO: 87087 - DNA, 414 bp, Glycine max
  Peptide Sequence Number=SeqID_203865
atggcagcactaggggtttcaacttttttcacttctctgcaatggatttgtgtcgataaagttctccatgctgtgtcccgtgatgacaaaaccctcaaagatattaatgttgaacctaaaatatcttgtactacaaaggcccatgaagatactcgtgatgtctccatagtgtcttgtgttgataaggcaatgaaagacacccatgttatacatgacaaggcactcgaagatgaaatcctaaaagatatccatggtgaacctgagatatcttttgttaatgaaaagacccttgaagacattcatgttgtctctacaatatcttgtgtagataaggtcatggaagacactcatgttgatgtactacatgataaagcactcaaagatcaaaccctagaagatatatatctatgttga

SEQ ID NO: 87088 - DNA, 123 bp, Glycine max
  Peptide Sequence Number=SeqID_203866
atggaaaaaatggaaatattggattttaacatcttgttgagagaatttgtaatgaagcctacaattggaaacccggataatactattaaagcgatgagcaataacctttactctattccttaa

SEQ ID NO: 87089 - DNA, 981 bp, Glycine max
  Peptide Sequence Number=SeqID_203867
attaagaagtgccgcattgagaatgagcttgggcgccgcatggacttcgtcctcgacgccatcaacaccgaccacatatatataagcttccactccctcggtatcaacggcatccccgacatcacccagaaagcagagaagaatgaaggaggagttggtggtgcaagaagggtactgtttcaaaggtgtacgatagccccggtgtggagtacctcattgaagggtgcttcccatagcggtgctgcaaggttttcaatgccgctaaggaacttgtggctcagattcgtcgcaaagtggaccccaccaccagcgttatgctcgggaaggaagtcttttggctttgcatcaagcctgcttttgatgcggcctctgaaagggtatgttctactcactgatcatttaacttatttgacgagttccactacattccctgttaccattatccaacagtgggggattaaggttttcttgaaccttcttgatcaatcttggacacttcgtttatttttctttacggtcgacaaaaatgggaatggtggcttcgctgagtttctttcagcgactgagaaaaatgggaaatccatagctgtttctttctatgaggttgatgatcgggagcgggccatggatttattaaatctagagaagccaccaattttggtttttgaagatcgtggcagaattcaatttaaaggactaagtcaggttcttgtgaaatccattgctgaatttcagaatttgtactcctatgcatgctttgcactgaagggagctcccaaaaaaggaggatgtgaacatgttcgtagaagccacatgggattaattgtccatatcttttcccaaaatggtagtcttgtaagcaaagtgaattttgttgacttggcaggttatgaagatgctagaaagaaaagtagtgatggatcctaccttgctgagattaaaaattacacgcatgcgacaggattcgttgaggggaactag

SEQ ID NO: 87090 - DNA, 1884 bp, Glycine max
  Peptide Sequence Number=SeqID_203868
atggtgtcagggagcgacccagttgagtcttttttcaattccgttcaagttgtgaaggattcgctgtcgccacttgaagtgggtattcgcaaggcggcgaaggatcttgagcattgtttggcagggtcaaagaacaaggtaaacaatggtgtttgtttgattgccccagtgagggaaagtggtgcatttcagatctgtgatgtgaagaagaagaaaggtttgtcaatgaaggttcccttgaaggctttctggggcatgttttcacagaattcagggaatggtaatggtaatggtagtagtaatattagagctcaagtgggcaaggaagatggaccctcttgcaccaattgcttgcagtttgctgtgacttggtctttgttggttaatggattccttcagtctctgccacttcctttcaaatctgggaagaagaagtgtcagaaagtgtgtgatgaagacaagctgtgttcttgcatgaagcctactgtttcatcatgtgaggtgaagcagaatgaatccaaggggggtcagtttggtagagcagttagggagaagggtgtgaggaagaaggatgggaaaaatgtttcacttgagtgccttataggttttatctttgatcagctatctcagactcttcagagtcttgatcatcatggggtgcaagataataatgatgaccttgacaatgggaaaactagtctgccccaaccttctttttctcattttggtcatgtgaatgcactcgcaggtttcttggaggagcacaaagtatatgtgaatagcttcttggggaatttgaggtttgcaaaggtgggtggtgtgccatcaagtgtgcctggagaagaaagcccttcaactaacggagagggagatattagtagtgacaatggtaatggtaataatgaaaacaaggatgaaaccggaggaaattcgccgcagaaggttgccaacaacatattcagtattcctctctcgaatgtggagcgtctaaagtcgacactttccacagtttcattgacagaattgattgaactgctaccgcagctggggagaacatctaaagaccatcctgataagaagaaactaatctcggtacaagatttctttagatacacagaagctgaagggaggaggttctttgaggagttggatagagatggggatggccaagtaactctggaagatctagaagttgcaatgagaaaaagaaagctgccacgaagatatgctaaagaatttatgagccgtgctagaagtcacttattttccaggtcttttggttggaagcagttcttatcattaatggaacagaaggagccaacaattcttcgtgcatatacttctctatgtctaagcaagtcagggacactgaagaaaagtgaaatattggaatcactaaagaatgcaggactccctgcaaatgaagacaatgctgttgctatgatgcgatttctgaaagcagatacagaagaatctatttcatatggacatttccgcaatttcatgcttctacttccctccgatcgtcttcaagaagatcctaggagtatttggtttgaagctgcgacagtagttgctgttccaccagctgttgaaattcctgctggaagcgttctgagatctgcattggcaggtggcctttcttgtgccctgtcatgtgcgttactgcatccagttgataccattaagactcgagtacaagcatcaacaatgtccttccctgaaataatttctaagctgccagagattggaaggcggggtttatacaggggctcaatccctgcaattcttggacagttttcgagccatggcttgcgaactgggatatttgaagcaagtaaattggtgttgataaatgttgctcctacactgccagaactccag

SEQ ID NO: 87091 - DNA, 324 bp, Glycine max
  Peptide Sequence Number=SeqID_203869
atgggtacagggttatttgtcatgcctaggcccaaagaagtaatcacaaagattgagatttgtggggagatgaaatgttccactagtatgaaatgtttgctgccaaatggtggggaatggttcctcaagatgaagaggaacaaggggatggaacttggaaggagcctgttttggatcaggcctcattgctttggatctggaaggatctcatccaatgggaattttggccagcaaatggtacagctaggcacctgggtcagcagggaagatagtgtggggttggcactgactaacctaagtgaagaggtgaaggtcagggtttag

SEQ ID NO: 87092 - DNA, 282 bp, Glycine max
  Peptide Sequence Number=SeqID_203870
atgatgaccaaattcatatctaaaaatggaagtttaaatcaagaaaaagaaagggagaggatgaacattgatagaaagtgggcaactgaatcatgtgaaggattggttctcggggtcaagatgcatgaccatgtatggtcttcatcaggatatttggattctgcaccttcccttttaaattctgcacctcccaattttcaaaaatccccaaactaccctgcaaggctgtatcctgtcactggtggcattttgcttcctcttcctgagcatgcttctccatga

SEQ ID NO: 87093 - DNA, 444 bp, Glycine max
  Peptide Sequence Number=SeqID_203871
atgacacctgctctattctgctttacactcactaattggatacatttttgtacatcaggttatgcactggctctggatatgactgctagggaccttcaagctgctgctaagtctgcaggtcttccatggagtttggcaaaaggccaggacactttcaccccaattagttctattttgccaaagactgcagtgccaaatcctgatgatctagaattatggttaaaggtagatgaggaaatacggcaaaagggctcaaccaaggacatgatctttaagatcccatttctaattagctacattagctctgtcatgacattgtttgaaggggatgtcatactaactggtattgcactaattctccatcatattgtctgtcgactgtcgtctaaactatcatttgggccaatgaggattggttcagctaataggattgagcattgttga

SEQ ID NO: 87094 - DNA, 264 bp, Glycine max
  Peptide Sequence Number=SeqID_203872
atgactgagatgaaggagtctaagatgaaacacagatcatggttgttctttactggcacctccttcacctctttgtggggaatatttgactgtgaagttctgtctttctcccttgcagaggcatccattcctctttctggattgatttacaggcttctggttctaacaactaataacggaggacaatctttcatagactgttctaaatatgaaatcatttggcagtggaaggaggaattcggtgctagttttgggagctactaa

SEQ ID NO: 87095 - DNA, 1479 bp, Glycine max
  Peptide Sequence Number=SeqID_203873
atgcaggtattggaggaagcaaagagaatgacagacatagggttcccaatagcagccatgagccttgtggggtacctcaaaaacatgaccttagttgtgtgcatgggaaggttgggaagcctggagttagctggaggttctttggccataggcttcaccaacataaccggttattctgtcctctcaggtctagccatgggcatggagccactctgcacccaagccttcggttctcgaaacttctccttactctctctaactttgcagagaacaattctcatgctactgctattttctctccccatttctcttctttggctcaacctcgaatctctcatgctttgtcttcgtcagaatccagacataacccgagtagcaaccctctattgctgcttcgccattccagacctcattgccaattgcttcctccaccctcttcgtatctacctacgcagcaaaggcacaacttggccactgttgtggtgcactttactatccattcttctacaccttccaaccctcacttttctaaccttcaaacttaaccttggcgtaccgggaattgctatttcatcctttgtagccaattttagcaaccttttcttccttcttttgtacatgttctatacgcgtgtccgcaaggagtccttacacgtgccgttactaatgcctcgtcacatgtcacataatgtaacaacatgtagcagcactagtactattgccaaggaatggggtgtgctaatgaaattttcgatacaaagttgtctagctgtttgcttggaatggtggtggtacgagttgatgacaatttcagcaggttaccttcataaccctcgtgtttctctagccactgctggcatagtgatacaaaccacgtctcttatgtacactttgccaacggcattaagtgcatcggtgtcaaccagagtaggcaatgaacttggagcggggcaaggtgaaagggcaagattgtcaacggtggtagctataggattagcacttgtaagctcaatttttggtttgttgtggaccacaatgggaagagaaaggtgggggagagtgttcactagtgatagtgaggtgttacaattgaccatggcagtgttacctataattggactgtgtgagttagccaattgtccacaaaccacaagctgtggaatcctcagaggaagtgctaggcctggtgttggggctgttataaacttttgctcattttatttggtaggagcaccagtggctattgttttggccttttattggaaacttgggatggtgggtctttgttatgggttgctggcagcacagatcgcatgtgtggtgtcaatttttgttgtggtgtacaaaaccgattgggaaagagagtcattgaaggctacatgcttagtgggaaagagttcatgtggcacatttgcatatgaggaccaaactgccgtcaaatgtgaaggtgttgtctttcttcacaactccgaaaagtga

SEQ ID NO: 87096 - DNA, 408 bp, Glycine max
  Peptide Sequence Number=SeqID_203874
atggtgggtcttagcgtagtgctggaagcccagaagagttgcatcaacaaaaagacaccccaagtcattaacaaaacctccatgatgcttagcagcatccacaacaaaccctcccctcctcttcctcaaccttcttctctttttcagccacccacttttcttgaccaatgctttctttgtgggaagagactcttgccagggaaagacatctacatgtacaaaggggacagggcattttgtagcgtggattgcaggtgcaagcagattttcacggacgaggaagaagctattcagaaagagaagtgttctttggctgccatgaggcccacatcgtctagtgcttccacctcaacggcaagtcatcaccaccggaaaggaacaagaaaccgaggtggtgcttgtttttag

SEQ ID NO: 87097 - DNA, 219 bp, Glycine max
  Peptide Sequence Number=SeqID_203875
atgaagtttatctcttccgttttattcattgtgcttattctttccattgggattggaaatgaaggtccattgagagtgacagaggcaaacatttgtgatgtaaaattgtactattattgtgaagaagattgtttcactgattgtcccaagaagtatggaaagaaagcccaaggtatatgcaatgaagcaagtgagtgcatatgtcgttggcaatgttaa

SEQ ID NO: 87098 - DNA, 114 bp, Glycine max
  Peptide Sequence Number=SeqID_203876
atggtgcccattagggacaacttagtagttggaggtttggatattgcacaaagtattaggcagatcgccggggcggctggcttcaagccaagtaataaaggaggtggttgttga

SEQ ID NO: 87099 - DNA, 117 bp, Glycine max
  Peptide Sequence Number=SeqID_203877
atgtggcttgcttatgcacccgtgaagaataatgctgaggatgctgctaagtttttcgaaaggaaatccataccacagtgcaatttcttgacaaatggtcatctatcatgcaaataa

SEQ ID NO: 87100 - DNA, 3628 bp, Glycine max
  Peptide Sequence Number=SeqID_203878
atggcagagaacacacacagtcaagcttccctttgtgagatggaagaacgtctcagcagcagaatggaatcaagatttgttgagctcactgcttccatgcaacaaacaatacatgaaatgtttcagcagaggcaacaagattctccagcagcaagcaatccacctagaggaaaagcactgcagtggcatagtgcgtacataaaatctgtaggattggagaatttgccatcgtggaatgaatatcagatcttgttacttgatcgttttggagatgtttgtgaagatcccatggtggatttaatgaagctcaggcagacaagatctatcatagagtatcatgaggagtttgactcaattgtatcaagagtggatctttctgatgagcatcaacttagttgttttttaggaggattaaaacaagaggttcagatgattgttcgaatgtttcagccaaattctgttcgaaaggcttattaccttgcaaagatgtatgaatcttccttctccaatacacaagccaaaccatttgtcaagaaccagaaatcttcctttgttcctaaaccacccctacttccaaaccctccaagatcaaccaatcctttaaccatcaatccctctaccaaaccacaaacacctaagcacctaactcccgcatacatggctgaaagaagagtgaagggcctatgctacttttgtgatgaaccatttacacctgaacatgaccttacacataagagattgcagatccatgtgttggaaattgaagatgaagagaagggccctggacctcaacaacctgatgctaatgtggttactgaacctgattcagaacctttaatttttgtgaatgcattaactggagtagttaattttcgaaccatgagagtcactggttattgtggaaagaaacctctccatattttaattaatagtggaagcactcataactttctggacttacacatagctcagaagatgggctatcaaacagaagctataaacattgtttctgtcaatgtagcagatggaaataaagtccagatttcttcaaaggaaccatctggtcttcccccttgtcgagttggccatgatcacaagattcctttaatgcaaggagctaaccctgtcaacaagaggccctatagtccttatgcaagtctagtggtgttggtgggaaagaaagatggggcctggaggctttgtatggattatagggatctcaataaggcaactgtcaagaacaaattccccataccattagtagaagaccttctggatgagttgtatgggtcaaccattttttccaaaattgacttaagagttggttacaatcaagttcaaatggatgcagctgatattcacaaaactgctttcagaactcatgcgggccactttgaatacttggtgatgccctttgggcttaccaatgctcctgccacatttcaagggctgacgaattcagtttttcagcattacttgagaaggttcttacttgttttctttgatgatatactcatctacagcagcagtatggaggaccacctttctcatctatatcaggttcttcttactatgagaactcattgcatgtatgctaagaaatccaaatgctactttgctattgacaagcaattaaggagtttcttgggtcttgcaagttattacagaagatttgtaagtcaatatggtgctattgcaaaacccttgactgatatgttgaaaaaggataattttagttggtcttctacagcaaaagaagcatttcaggaattgaagcaaaggctagtagcatcaccagttttagccctaccagatttttctaaggaatttgtggtggaggtggatgcttctggcctaggcttaggtgttgtgttaatgcagaatcaccacccaattgccttcatcagtagaagtttgaacacacaacaacagtccttgtcaacatatgagaaggaattattggcaattgtgtttgcagtccaaaaatggaggcactacttaccccccaagaagttcatcattagaaatgatcatagatgtttgaagtacatcctagagcaaagattgtccacaacattccagcaaaagtggttggtaaagttgatggaatttgatttcaacatagagtatagagagggtcgagaaaatatggcggcagatgctttgtctagacttgattcccctgagatcatggccttacaggtttatcagcctaattctagcatgctctctaggatccgacagtcttggcagaaagatcctatcttacaacagcttgttagtgacttaaaaagcaatccctcttctcaaaaacattatacttgggtccggaatgagctgaggaggaaaggcagattagtcattggctcagactcccaactaagacaggacattctctcttggattcatgcttcagcttgtggtggccattcaagtagagatgctaccttgcaaaagatgaaaaatgtggtttattggagaggcgtgtccaaggctatcaagcttagtaaggcagctcatttcatggccttatcgcatccttatactgttgcggatgtggcccaatgcttccttgataatgtctttaaattgcatgggtttcctcacaccattaccaatgatagggatcctatttttgttagccacttttggaaggaatttatgtccttgcaagggattcaggctcctcctgttcatttaccttatctttcaggggaatctaagattgctttggttgatagaagtttgcagaaacacgaggaaatgttaaagttactcaaattccacatgaagagagtccaggacagaatgaagcaacttgcagatagaagcagatctgataggagttttcagattggtgacttggtttatgtaaaattacatgattatcgtcaagtttcagtgcaagccagaaccaatgcaaagttggcccctaagtactatagcctatttccagtagaagacaagattggtgttgttgcatacaagcttaaattccctcttggatcaatggttcataatgtcttccatgtttctcagttaaagaagtttaatggtactactactgttggggactttagtccttcacctttattggatacttctcagaaggaacctgcagctatcattgacagaatgacagtcaatagaggcaatcgtgctataaccaaagttttggttcaatggaagcatcatctacttgaagatccaacttgggaattcttttatgacttgaagcagaaaacttcgaatgccttagctgagttcctagttctgctacatcaaaaagctaatgatggttaccggattgttgagagtgtgggacagggagtgactgaattcaaagaggaggaccatgtgctaatagtattcattggagaatctatgtcatgcaggcagtgcacatctggaaaaagcaacacttgtgaaattttgggattggaaaggaggggtttaatgcatagtgatcagaagacacgcttctcattaaaagggaagcttgtttacaattattgtgcagtttcaagtttcagtgaatatacagtagtccattctggatgtgttgtgaaagtcagcccccttgcacctcttgagaaaatatgtcttctgagctgtggggttgttgcag

SEQ ID NO: 87101 - DNA, 351 bp, Glycine max
  Peptide Sequence Number=SeqID_203879
atgtcgcagcaattagggttcacaatcgagctatacctagaccctacattggagaatcaggttctgaaagcatggaacattcttgagatcgaggaaagtgataatggaatttggccagaatttcttgctagtagtacgggtaaagagtttgtggctggagaatttggaggcattgctgatataatctcaggttacccattagacacgttccgtatgatgcaacaaagctccaacaatggctctgctgccttcaccatcctcagaaatttggtggccaaggaaggaccaactgctctgtaccgtggcatggcttcacctttggcctctgttacacttcagttaactaattaa

SEQ ID NO: 87102 - DNA, 171 bp, Glycine max
  Peptide Sequence Number=SeqID_203880
atggccaaccataccactctgaaaaccaccactgaaaggctggaggaggaaatttcccacttgtccgacaaacactttgacttagctagcaaagtcaaggacacctctaaggaggaacgcatcacgatcgtctctttctacatggatggccctgcccttagttggttctag

SEQ ID NO: 87103 - DNA, 432 bp, Glycine max
  Peptide Sequence Number=SeqID_203881
atggggacacatcgtgacatgaatgagagtaacctttcaatcaaatatcatgtggatttgggaagacaacatcagaatcaaataaagggtaaagaagagagtccaaactgcccaacttgcatttggttgaacagagaaaaattggcacatctaaccacatttccacttggcttcacgggggatcctcacaacagacaaccaactgcttccaaaacatttcaagttacgtggaaatcgccattttgtcatcatttgatgaaatgcaacattgatggggctgctgctaagggtacccctgatccagctattttcaaggactatagaattacttatatgggtggtttctcttccaacttgagtatttcttttgctcttcatgatgaattggttcgggtcatgatatttatagagatagcttttactagagggtag

SEQ ID NO: 87104 - DNA, 345 bp, Glycine max
  Peptide Sequence Number=SeqID_203882
atggttttacaaaaactgtctttgaatgatgcgtataacaacaggtcaaggataaccgccgtagaaatgaaacttcaacgatgttttttaggaacactgtcgttgaatacgcgtcatttaaggtcacgtgaaccctttcttggatcgagtcaccctcgtgccctcagtcactcacccctttctttgcgttgtggttgtgccctcactgaactcacgatcttcgtcagtcagcgactgtcatacgtgtttttcgtgccgccctgcccagtcatcgaaactttttgttttctgccatcattgtctatcgccgtcatcgtccaactaaggaaacttataaacaattaa

SEQ ID NO: 87105 - DNA, 222 bp, Glycine max
  Peptide Sequence Number=SeqID_203883
atggtcgtcattttgcctaatgaaaatattgtcatctggttttgttccttgcacaataggccagacaactacctaaaaagaattattaacagtgctttgaaaggatttgacgacactccacaaagtaaattgaaggatgctactaggtggattgttgttaaatatttcaatgatgctagaccattggaaccagagagaatgaaggcgctttgtatccaatag

SEQ ID NO: 87106 - DNA, 438 bp, Glycine max
  Peptide Sequence Number=SeqID_203884
atgttcttccacgaagaagctgaagcggttcattcctcatacttcccggttcttgaaaccatgttcactccaagtgaaatagaggagctattttccctcgttaacgaaccggccagccccgggttgggatccggttcacaaggttcgaaccgggaagtccggtccatgcacgagagaaagcttaggcgaatgcagtcgaaccgggagtcggccaggcggtcccgctggagaaagaagcggcatttggagaacctcacgaaccaactgaaccggttgagaacggaaaaccaagaatacaaaaaccggttattcttaaccatgcaccagaatcttctactttccgtgcagaatgaacgtcttagatccgaatccgtgacccttatggctagactctcggatctttatcaaaatttaggcaccatgatgatttcacaatag

SEQ ID NO: 87107 - DNA, 351 bp, Glycine max
  Peptide Sequence Number=SeqID_203885
atggtgttaatgttgaagatgatgattcactcattgataattatgcaaatggctacaccacccaactcactccttcccccacctactgatttagcatcacattctccttctaccttgaagtggacaagaaaaacgacacgactgagatcattggctactagatcagttggggcagagaaatccctgaattggaaacaagtccctgttgcccagaaggatttgatatgggaagatattcaggcacttacaatcaacaaggacgatgtcgatgacattgtatgtgaaaagtacgacattagcaaggagaagtggacccaattttgtcagagccgtagagaccctttgtgggag

SEQ ID NO: 87108 - DNA, 363 bp, Glycine max
  Peptide Sequence Number=SeqID_203886
atggaaattacaaattcaaaagacactcagaagaagttaccttgtcaagctatcaaagtgccaagtaataaccaaatagtgaaaaacatgattaagaaatgtggtagaattggagtgattgagaaatacacagggaaacctaaaccaagggatgctcaaaagagttttcaaaagtccaagatgcttaaaatcataaaagaagcaaccacgtacctcaacggatgctcacaagagttttcaaaagtccaaggaatgctcataatgagaaaagaagcaaccacgtacctcaatcgccgatgtcagactccaacggatgctcgaactcgcagcagtgatgaagcccaactcttcgagcagttgcag

SEQ ID NO: 87109 - DNA, 345 bp, Glycine max
  Peptide Sequence Number=SeqID_203887
atggacctagcgtgcaagcaagcactggtgctaagcgcacaacacgctctaagcacgaaaacatgcatctacgctgagcgagcagagcgcgctaagcaagaggccgacgaggatgaggaggagggagaggaaggtgaggttggaggggcatggctggctgcgaaaggaggtgtcggcgaaggcaatgaggagagaggtgatagatggaaagacaatgaaggtgtcaaagttggcatggcagaggagattggtgttggtaaagatggtgagataaaagatgagtgtggtggggaagaattttttggcaatggggaggatgaaggggtcgtggtggagaaaccttaa

SEQ ID NO: 87110 - DNA, 774 bp, Glycine max
  Peptide Sequence Number=SeqID_203888
atgggtgcagggattggccttgtctcggtgacccagattcgaaatttgtcaaaatcccagcaccatcaaaatcaaaaccaacaacaacaacaaaaaaccctaactccacctctcatcttcctacaccctcatcatcaacaacctgttggatgtggaatccaagggaccatgaagatcaagatgagtcctgggagcttctgtagaagggagttccgttcagcacaagcccttggcggccacatgaacgttcaccgccgcgaccgcgctcgcctccaccaagcttcagtagtaccccacaacaacaacaatagcaataatagcaacatcaaccccatctcctctttttctaacacaccctcttttctcaacatctctcatcatcatcaggacccttttgttgcaaatgggggcttgtgcctgttgtacccctttccaagccctaataacaacaacaatgatccattttcctctcttgcccacaacaataatgcatgcggtgacttaccttccactgttttttcagtttcttcttctcattcccaatattcatcccttcagtactctccaattagggtgcctagttgctcagctacttcctttgatttctcggtggctcaacctgctgctgcttcagggaggaataatgctttctcttcttcttattctgggaaagtggaacaagaacccataatctcctcttccacacatcatggcctccaccatgaggagcttgatctagagctccgcttgggaaataaatcaacatcaacctga

SEQ ID NO: 87111 - DNA, 213 bp, Glycine max
  Peptide Sequence Number=SeqID_203889
atgcaagatgaaaatgaaactacagtactaggggttgggtcatcgtcgatgacgaagacggtgcggtttgggtttggatccagttcggttcagcgtttcttgggacggagcaggaacggcgttgaggggccttcttcgtcggagaggatgatgaggtccatcgtcaccgtctcggctccactgtggtgtttgcttgtttccgtctttgaataa

SEQ ID NO: 87112 - DNA, 2583 bp, Glycine max
  Peptide Sequence Number=SeqID_203890
atgaagaaaaagagaaaaagggtcgtagcagagcccgctctatccatccatcagagaatcaaaaaaatggagaagatctgcgtcgccgttcgtcttcgcccactggtttcccaagactcttcttcttcctccgtcggaactttctggaaggtcgaagataaccgcatctctctccacaagatccatggcactccactctctgcttcttcttacgctttcgatcacatatttgacgaaagaagcaccaatgctagcgtctacgagcttctcgccaaggacatcattcacgccgcgctcgacggcttcaacggaactgcatttgcgtatgggcagaccagtagtggcaagactttcaccatgaatggttctgaaactgacgcaggagtgattcctcgcgcagttggagacatatttgcgacaatggagatgatgtctgatcgagagtttctgatacgagtttcctacatggagatctacaacgaagaaattaatgaccttcttgttgttgaaaatcagaaattgcaaattcatgagagcttggagcgtggagtatttgttgcagggctgaaagaggaaattgtaaataatgctgaacaagtgctgaatctcattaaagcaggggaagttaacagacactttggtgagacaaatatgaatgtaaggagtagcagatcgcacacaatatttagaatggtgattgaaagcaaagcaaaggattccaattcttccaatgattgttcaattaatgatgttgttagagtttcagtcttgaatttagtagatctagctggttctgaaaggattgctaagactggagctgatggagtacgtttaaaagaaggaaaatatattaacaagagcttgatggttttggggaacgttatcaacaaactaagtgagggttcaaagcaaagggggcatatcccgtatcgtgatagtaaattaactcgtatactccaacctgctcttggtggtaatgccaaaacgtccattatttgcaccatagcaccagaagagattcacattgaagaaacaaggggaactcttcagtttgctagcagagccaagcgcatcacaaattgtgttcaagtgaatgagcccatacttggcaaagcccatgtcttgacagttagaatttcacagatattgacggaagcagccttgttaaaacggcaacaattagagatagaggagctacgtaagaagcttcagggatcccatgctgaggtgctcgagcaagagattcttaaactcaggaacgatttgctcaagtatgaaatggagcgtgggaagcttgaaatggaactgcaagaagagaggaaatcacgtgatcaatggattagggagcaacggatgaaaattgaaaattcttgcactactaaatctttctcagattgtgggacgaatgacaatcagggatcgggatgttttaggcgcggatttgtggaagagtacagtgacattagtagtagtatatctcaaggagatattttcaaatctcctaaggtagatcccaatgcttttgtagccaggcgatcaaagaattcaacattgccagatcacagcccccttccagatgctttctgtaatgtggctgatgaagatatgtgggtgaaaatgaacaatggttatattgcggaccttgattcccttcaaactactcctcccaccaaccgaaaagttcagtcattcccgacaagtgatgcaactgttggttgtacaagtgaaattgagaagtatgaacgagaggttcaagatttgaggaaacaactggaactagctaaagaaagaataaatgaactcgagcaaaagcattcagaagaagtgccatcaagcaagcaattaatcgttgagacacccaaacatcaacaagaaacacgactaactcatgaattacctctgaggttatctgaatctgagggaaacttcaaagatagctttgaggaggctttgtcagtaatgcagagatttgcatcgggtggcacattatcaactgcgaagatactttcaaccatgagtgaaattggagatcatctatttgcaactttggaaggtcattttgctgtgaatacgggtggtgaaaggtcttccaccggaaacagtgctctaatcaatgaacaccaaaaagagtttcgtcagaggattgataacataattacatcgttggagttatccgaaacctcaataacaggacaggagtggaaacataagtgcagctgtgaacccaagggctctgatttgggaggtgaaactgcaaaggatgatttaaatgaaagatatgaaaacctagaaagggagttactactgttgaaggtcgaaagagactctttgctgcagaagttctctgaatcatcagagaagctatcaatggtttccagccaaaaggaaaatgctttgaaagagttaaatactgaagtgctgagaaggaaaaatatagaaggggaagttaagcagattgctgcagcttttactaatcgtcagaaatcactcatttcctttcatagtgatcttaagaccaaaattgagaattggagagcccagactacaatcttggtgcccaaatcttttggttttaaggactag

SEQ ID NO: 87113 - DNA, 111 bp, Glycine max
  Peptide Sequence Number=SeqID_203891
atgagcctcagagctcaaaaactgccaaagcttccttatatggctactgctctcaaatatgcactgtctatcatcgttttaactgcaacatcttctatactccttccttag

SEQ ID NO: 87114 - DNA, 441 bp, Glycine max
  Peptide Sequence Number=SeqID_203892
atgatgacaactctggtattggctcttccaaacattactttgccttttttcctggagaccgatgcttttggaatttccatgggtgctattttaatgcaatggggtcatccccatgcattttttagcaaatctttctcccctcgtttgttacacgcctccatatatgtgcgtgaattacatgccattaccttcgccgtccataaatggcgtcagtaccttcttgaccacaagttcaccattttgactgatcattgtagccttaaagacctaatggcccaactcatccaaacaccagcgcaacaatatcatctcactaagcttttgcggggagctctttgggtgaaccccgacaaccctttcatctcggccttacttacaaaattttactatactctcattggtgaccatttgggcatcaaaaagaaccttcatcgtctttag

SEQ ID NO: 87115 - DNA, 396 bp, Glycine max
  Peptide Sequence Number=SeqID_203893
atggagttgaatttgagaatgatggactcaattgcgaaaatggggtggattgtggatgtggttgggtcgggaaaggattcagaggcaggagatgggtcattgtgtacatcaacgcaaatagctacttgttggcccaagtgggtgaagtgcatggacatagccgtttctgaccatcacacagagaggggaagtggtttccaatgggaggttaaggaacttggtgactcacggttgcataaaattgtgagtactgttgttgtcgacaagtacagtgagacaagcatggttgatatagccaaagatacgaaaggtgtcgatggcggggaggccagacatggcattcaagcttatatgaggggtaagggagggagattcaagggaagcgaaggtatatga

SEQ ID NO: 87116 - DNA, 426 bp, Glycine max
  Peptide Sequence Number=SeqID_203894
atggccttcaaagtggctacagttttcattgatatagtctctcggtacaaatttttggctcctaaagaatggtcgcataacacatcccaacattttggtaccgatgtcaccccttacgagttcggttatggtaaacctccaccttttattccatcttacatgcacaaattctctaataatgaagttgtggattccttgttggtcacccgcgatgctattcacagttcacttaaatgccagttgaccaaggccgaggatgccatgaagtactatgctgatgagaaacacagagacaaaacctttgaagtaggacaacaagagaattataagcaattgggcttgaatccagaattgagcttggacttgaagagagcagacaattttattctaccaaatcttatcttatccagattttatctcatctag

SEQ ID NO: 87117 - DNA, 359 bp, Glycine max
  Peptide Sequence Number=SeqID_203895
ggtacatcctttgtggtacaagtagagagtacatctacttgggttgtactactgagaacaagagagggtacatctcttgtggatcagttcaagtggagggtacttccacttggttgttcaaagagaacaagggagggtacatccctagtggatctttgcttgtaaaggattttacaaggttattggaaatctcaagaactggtggttacttggggactggacataggcacggcgctccgacagagagcattgttgtggctcttatcagaagcgtagtcgccaatcgtggcacattgagccgcgatgctaagagttggcttgtgccatatcaagttcctcgacaaaggattggacagtga

SEQ ID NO: 87118 - DNA, 144 bp, Glycine max
  Peptide Sequence Number=SeqID_203896
atgaaggagaaattgatgttcgagcttgctacactgccatttctagattcttattggaaccaggttgcaagtgttttgaacattttggatgatgagctaatcaagaatgttggagactacattttaagcttggaggcaatgtag

SEQ ID NO: 87119 - DNA, 228 bp, Glycine max
  Peptide Sequence Number=SeqID_203897
atggcttcactctttcctgcggaggaaaacaatgacaaattattaaaaaagatagaaggaagggaaaaaagagtggaaaagagacatgcacaacagtcccaccttgaactgcagaagcaacaaaagaggaagaagagagccaaacgaataaaacccgaaatgaccaacccaaaagcacaacctcacaccaagaacaaaatcagcagagcatgtggcagcagaaaataa

SEQ ID NO: 87120 - DNA, 1044 bp, Glycine max
  Peptide Sequence Number=SeqID_203898
atggcggcattcccagaacaatttaaagtctcaaggtgccctctgactctctcagatgagctctttgatgggatcaagagtgcatgtggtggtgccaaaagtggtgctgacatggagctccaccacaccaggtggtgtccagtgcttacagcatggttgtattctacatattctgccactacactaggcagcatgagatgccatagccatagccatagccatctagttgagcaatggtttgtaattcttgacagatttaggggaatatttcaagaacactatgcgaagattgtgattgtgtgtagagcagtagaacgtccatatggagctacgttgttgtcatcatcttcatttcttcatggtgattacagatcatgcttgggtgaaattgaggaaagccttgtgaaaaccaagcctgatacttccatatgtaatgtcaatggtgatgatgatgatcagagaatcattaacttggatgatgacaactttgacaattttaccctaagccaaattaaagcaagttgcaaaacaaggaagcgaaaacaatcacaaggtcttgactcctctaaaataaacatgaaagttgaagattcatcattcctggaggactacagaaagaagcatagggaaacaaatgattatgatttcctggagactttcgatagcttgaaatctaaactatcaaagaatatgaaggcgaaaaagaaaaaattctttgaagaaccaagccctactgatacccaagagattatgttagtcatcaaatttgaacctcaagagatcctaaacaaccaagagctcccaccctctagcaaagaaatcctagactatcatgagttctcagcttctagccaagagatccaagactatcaagagttctcaccctcctgtgaagagatccaagacggtcaagagttcccacccattagtgaagagataaaaattgatcaagagatctcattctttagtggagattcaatttcccttgttgaagtgaaatctgaggttcctaaagctgattgctatggcgagaataatctgtaa

SEQ ID NO: 87121 - DNA, 3690 bp, Glycine max
  Peptide Sequence Number=SeqID_203899
atgccaccaaggaagaacactgcttcaggagaaccagcagttgaggagtacggagacacgagagtggagtttgtagcaggagaggaagccgctgataatcagacgcagctgctcaatctcatgtcgaccttttcgaagggatttgaggaagagggcgaaggtcaggcatcggtgaaacgggggcaaccgagtactgagacaaggaaatctggtaggaatccgagattgaaaccactcgaaggcgatgatttggcggagtttcgtcaatcgatgaagaaaattgaactaccgtcattttacggtgatgacccaatagggtggattgcgagggccgaaatctatttcaacgttcaagaaacgcgcgaagctattcgtgtgagccttgctcaactctgtatggaaggaggtacaatacactcttttcattctctgttgaatgagtatgaaaatctgtcatgggaggatttcaagaaggagatgttggagtggtatggtggaaggggagaaggaatagtttacgatcaattggcatcgttgaagcaatcagggagtatggaggattacattcatagctttgaatgtttgattgcccagggattgaaggatgaaatccatgcgagaatgcgaagcctgcacattgcgaatcctttcactaggggacgaataatgaacgttgctcgtgcaattgacgtagaaatctctagacaatgcagagtgtggcagggaagaggcgaaatacgtggagttggcctaattgtagaaaatgatgggggtgagaaaagcaaaaatggacccaaagataaaggggctcgtcacctttcctatcaggagttattggatagaaaacagaggggattgtgttttaagtgtggagggggcctgtacggcattgagtctctgttcgatgaagaaggagaaggaggaagaaccatgaacgatgaagttgcgaggcacaaatctgaaacgcaaggtgtatgtcgtgggattaaggtggagtttgatgaaagggaatttgtaattgatgcttttctcttcgaattggaagacatggacttgatattcggaatgtcgtggttgaccaccttaggggaaaccttggtggattggaaaaatcaagtgatgaaaatcaaaacagatcgaggagagaggtggttaaaaggagtaccccatgaagattcgttgttgaattttgttgatgtatttgctgaaccaaaggggctaccacctgtacgtgcaaaggaacacaggatcatccttcaaccagggcaaggtcccattaatgttagaccatacaagtatgcatatcaccaaaaaaatgaaattgagaaacaagtaagggaattgatggaggtgggtcatgtgaggcatagccagagtgcatactccagcctagtcattttggtgaagaagaaaaacaacaaatggtggatgtatgaggattatagagcactaaataaagccaccataccagacaaatttcctcttccagtgatagaagagctcttggatgagttacatggggctaggttcttctcaaagctagatcttcgttcaggataccatcaagtaaggatgaaagaggaggatattccaaaaacggcttttaggacacatgagggtcactacgaatatctcataatgccttttgggcttatgaatgcccattctactttccaagcactcatgaatgaagtctttcgtgctttgctaagacaaggaatattggtgttctttgatgacatacttgaaagcattgagtacttgggccacattatatcaatccaaggagttacagttgatcctgtcaaggccagtactgttgttgagtggcatgtccctaagaatgtaaagggggttcatgggtttttgggacttacaggatattatcgtaaattcatcaaggattatggtaagatagccacagcaccggtgttgcaattaccaaattttgatgaagagttttctttggagtgcgatgcatgtgggactggaattggggctattttaatgcaaaacaagaaaccagttgcttattacaacaaagtgttgagtccctgtaatttaactaagtcagcttacgaacgagaattgacggcgcttggaaaggagaaccgaggagttgatgctctgtcccgtagtagagatgaaatggaactgaacaatatgatttacttcccagtatggctggattgccaagaaatcaatgctgaggtgcacgcagatgagaagttgagaaaaataatcgaagaagtgaagaaaggacagggggaaaatatcaatgctagatttgtatataaacaaggggtactttattataaaaatcccctagtcatccctgagaaatcaacttggattccaaaatttctggaagaattccatgctactcctcaaggtggtcattccgcttgtgacacgtgccaaagacaaaaatatgttacagcagcccctagtggtctcttgcagccattaccaattccggagagggtttgggaagacattagtattgacttcatcactggcttaccaagatctagaggatttgaagcaatcttggttgtagtagatcatttgacaaagtattgccattttgtgccccttaaacatccttatactgcaaaggctcttgctgaaatttttgtgaggggggtagtgcgactccatggagttccaaattctgttgtgagtgatcgagaccctttatttatgagtttgttatggaaagagttctttaaaatgcagggaacaaaattgaaaataggcacagcttaccatccgcaaatgaatggacagactaaggtaacaaataggtgccttgaaatgtatctacgatgcttcatcactgaccaacccaaaacttggttgatttggatgccttgggctgagttttggttcaacacaacttaccatggatctacaagaatgactccttttgaagcggtgtatggaagacaaccactcaaacttggtttagtggttcaaggggaagtgagagtggaggttgtccagcaggatcttatcgagagggatgaagccttaaggcagttgaaatctcatctacttcgagctcatgacaggatgagagctcaagcaaataagcatcgtaaggagaggtattttgttgtgggtgatttcatatttctgaagctgaaacagaatagacagcattttgtaatgaatagggtcaatcccaagctgagtgctaaatattatgggccttttgaagttgtggagaagataggggaagtggcatatcgtttgaaattgccaccatctttgaaaattcatcccgtgttccatgtgtccttattaaaaaaaaaggttatggggaaatacaaggtggaagaggttcttcctattaggttggaggatgatagaactaaattaatgacacccgaggctatcttggctgctaggaatagtacaaaaaggggggagaccaaaaaacaagtgttgaggcattggaaggggcaagctatggatgaggctacgtgggaggatgaggttaccattcgcagccaatttccaaaatttgggcttgaggacaaggctctatttcaagaaaagggtattgatacagacccaaatgctactgggcctagagagtccttgatccaagaagagaaaggtaagaataggtggagcagggtgtatgtgaggaaaaggcctaggaatgatgatgtggcacactag

SEQ ID NO: 87122 - DNA, 219 bp, Glycine max
  Peptide Sequence Number=SeqID_203900
atggcacagcgggagctggggtcaacagacgactcgaggtacaatactgatgccacggtgggagcttcggtcaacacgacagtgatgagcgccacaacgagggattatgatcaaaatgacagtgataagctcgcgccacaacaagggattatgatcaaaatgacagtgataagcttgtgccacagctttctaggacggtgttgcagtaccagtcgttga

SEQ ID NO: 87123 - DNA, 168 bp, Glycine max
  Peptide Sequence Number=SeqID_203901
atgaagggattatccatgaacctcttttgcttcacatcacttgctagagccaccactcagccaaacaaagctatgaactttcattttgtcaacaatgaagccaacaatacttacactatactgccatcaccgcttggacacaatattgttgcattggctacatcataa

SEQ ID NO: 87124 - DNA, 249 bp, Glycine max
  Peptide Sequence Number=SeqID_203902
atgaaagagcggagtgagaggacggaatccaaatcggcgagccctgggattcgcgtggaaggagttattgaggaatcaatgagtgcagggagcgagggagcggaggatcgagatctgcggtgcaaaatgagcgttgcttgtaattttctcttgctttggtgtgtgagtgaagggaagaagataggcgtcgatgatgatatacttccagaaacacaaaggcatacgtcaatggaaaatttttacggataa

SEQ ID NO: 87125 - DNA, 1251 bp, Glycine max
  Peptide Sequence Number=SeqID_203903
atgattcatagaacacaaacaccagatctccctaaccgcacctcagattcaccgccaaaatcaacgaaccgcatcggttacatgtttcgcgagcgcgtgccgttcctgctcgtgggcgtggccattgccagcgtcttcttccagctcctcccttctcgatccatagtgtcggctcctcacgactcgttcctcgagaccgagttggctctgccgactcggcgggtgctgttggaagggtcgacgactcaggagaagaagggaagggtccctctcggggtgagaggcaagaagcagaagagggtcctggtgaccggtggagccggtttcgttggaagccatctggtggaccgtctgattgaaaggggcgacagcgtgatcgtggtagataacttgttcacgggaaggaaagagaacgtgctgcaccacatggggaacccaaacttcgaactcattcgccacgacgtcgttgaacccatccttctcgaggttgaccagatctaccacttggcttgccccgcttctcctgtccattacaatgtgcacaagacaaatgtggtgggcacgctcaacatgttgggattggcaaagagagtgggtgctcgttttctgattagtagcaccagtgaggtttacggtgatccacttcagcaccctcaggctgagacctactggggaaacgttaatcccattggtgtaaggagctgttatgacgagggaaagcgcactgcagagactttggcaatggattatcacagaggtgctggtattgaggtaaggattgctcgaatcttcaacacttatggaccgagaatgtgccttgatgatgggcgtgtagtcagtaacttcgtcgctcaggctttgaggaaggagccattgactgtttatggcgatggaaagcagacacgaagctttcaatatgtctcagacctggtagaaggcttaatgcggctgatggaaggtgagcatgttggtcctttcaatctcggcaaccctggtgaattcaccatgcttgaactggctcaggtggtgcaagagactatagacccaaatgcgaagatagagtttagacctaacacagaagatgacccacataagaggaagcccgacatctccaaagcgaaggagcttcttggttggcagcccactgtgtccctccgtgagggacttcctctgatggtctctgatttccggcaaagattgtttggtgactcaaaactcactggcggcaaaggtgcatccgaagcagcatag

SEQ ID NO: 87126 - DNA, 561 bp, Glycine max
  Peptide Sequence Number=SeqID_203904
atgactacagttgcttcactttctttcgtggttgaaaaccttggtttaaaggtacttcaaaataagggcctagaagttagattgtctgggtctgctgccaaagggaagcctcctacaacattgttgcttgttgattggagatgtatggtcccacttatttcaggatcatcaatgttctatactgagttttctttgataaattttaatgtttcaagtctttctaggagtagagtccaacaaatcattggtgctacaaataatttgcatcggcattcatggaatgttttacctccactagtagacgatcctaaacatacgtcatcagccaccaaattagtgtccaaaagtcctttagataaatatgagaaccagattaaaggatttgcttcagggttaggtgtgtatcggcatgatttcaatattgatgtgcacgacttatgtttagggttatcgtctattagcattaatgatcatctagaagattcatacttcactcctgattcaggcagattaccttttactcttaactcaatcaagtcctctctatggcagcatttgtag

SEQ ID NO: 87127 - DNA, 789 bp, Glycine max
  Peptide Sequence Number=SeqID_203905
atgtttatcattgatgtctaccaggctagctatattgtagatgaagtaaaggacaagactggaaaagatattgatgtaagttcttggaaaaaagaatttgttgaagaccttcctgagcagcagaacgggtatgattgtggggtgtttatgatcaaatatgccgacttctatagcagaaacttggggctatgtttcaaccagattgtggactggactgattatacatatcatcccgatatccagagtccctcatatcagatacagcgggggttcctccaggtgtggggtcgtataaactcaaattgtgatggtgctgtttctggtggagttgctgcgtgtgggagagtcctacggaatcaggctggggcagtagtcgtctttgctcataatctgggaatgtgttcaatatctcaagctgagatatgggctattactatgggagttaagcttgcttgggataaaggttttacaaacttgtatgtggaatctgatttcaaatatgctattgagatgatggatggtgtctgtgaattctccaacaactgcttccagttgttcttagaaattgtcaaaatcaatcttacgttgaagcttttatatataattgcagctttgttgggggagagcatgattgatgatggtagctataaggatggggctactgatcccacattgctgtgctttgcatttgctttgtgggaggtcaagtgcactcacaatctacaccttttgaaagtttctcaagcttatgttcttgaaagagatatgtcatctacaccttttgattaa

SEQ ID NO: 87128 - DNA, 2370 bp, Glycine max
  Peptide Sequence Number=SeqID_203906
atgggtggccagatgcagcagagcaatgccgccgccactgctctgtatgaccacgccggcgccggatccctgcactatgcggcagggccggccaccgatgccggcgatgccgtcatggcgcgctggttacaatccgccggcttgcagcatctggcctctccattggcttccactgccatcgatcaacgtctcctccccaaccttcttatgcagggttatggagcacagtccgcagaagaaaaacagaggctttttaagttaatgagaaacctcaattttaatggggaatctggttctgagccatatacgcccacttcccaaaatttaggtggagtggctgtatcagatgggttttattctccagacttcaggggagattttggggctgggcttttggatcttcatgccatggatgatacagagcttttgtctgagcatgttatttcagaaccatttgagccatcaccctttatgcctggaggcagtagaggttttgaagatgacttcaatccaattaacagaaagcaggaaagaggagaagcagattctgatgcgtcacttttcttacctacaaatgaaaaagacaatacaagagaaaataatgttgctaagattaaagttgtggtacgcaaaagacctttaaataagaaggagcttgctaagaaggaagatgatattgtaactgtatatgacaatgcatatttgacggtccatgaacccaaactaaaggttgatttgacagcttatgtggagaaacatgagttttgttttgatgctgttcttgacgagaatgttaccaatgatgaaattgctaagtggctgtgttcgtgtgctgtgaacagaaaactctgcatgagagaagatggacggcagcaagtgtgtattgtaggactgcaagaatttgaagtttctgatgtacagattgtcaaagaattcattgaaaaggggaatgcagcaagaagtacagggtcaaccggtgcgaatgaggagtcctccaggtcacatgctatcttacaactggttgtaaagaggcacaatgaggtaaaagagagcaggcggaaaaataatgatgtaaatgaggcaaaaagtgggaaggttgtggggaagatttcttttattgatcttgctggaagcgaaagaggtgctgatactactgacaatgatcgtcagacaaggattgaaggtgctgaaatcaataagagccttttggctttgaaggaatgcattcgtgctttggacaatgatcagatccatattccttttcgtggaagcaagcttacagaagtgctccgtgactcctttgttggaaattcgaaaactgttatgatctcttgtatatccccaaatgctgggtcatgtgaacacacacttaataccttgagatatgcagaccgagttaaaagtctatccaagagtggaaatcctagaaaggaccaggccacaaatccagtaccaccagcaattaaagaggtttcatccacatcttcacttccagctagtgttggtgcagatgattttaatggtcaatgtcaagaggtaaaaacaatggacatgggcaggaaagttgtcgaaaaggaaagttctttgtacagctccgctgctgatgttgacaaacaatcaagtttttcttctagttatccattcaatgggcgagaggaaaaaagctcaacttctgccccaatagacagggaaaggtttgaagtaaagaattcttacggtggtgattctaccagtcaaaagatgaactcttattccatagatgttacaaatgagaaagtgcaaagggtgtctcccccacgcagaaaagggactaaggaggagaaatctgaaagatctgtaaattgggtaaaacgggatgccaatggttctgatcattccactgcaagctccaagcagcagagcacaggaaattatagcattaccactggatcggggcagtctgaaacagaatcctcttctgatgtgaatatcagtgcaatacttgaggaggaagaagcactaattgctgctcataggaaggaaattgaagacacaatggagattgttcgtgaagaaatgaaactactggcagaagtggaccagccaggaagtcttattgacaactacgtaacccagttgagtttcgtgctttctcgcaaagcagctagtctcgtttcagtcatcggaatcgtcgccgccgaagatggagaggcggcggttgaacaagaggaagagaatgaggatgaggaagagtgcgacgccgaagggggagccgctgaggcggtggatggtgtcgggttcgccggtggagaagagggcggagacgaaggagccccgatcggaggagaggaactgaatggtgagaaggagaaggatgggcagaaggagtag

SEQ ID NO: 87129 - DNA, 2607 bp, Glycine max
  Peptide Sequence Number=SeqID_203907
atggaggagcctcagtaccgcgaacatcccaaagccaaaatcgccaccattccgccgtcgcagcactccgatggcgccgcggccgagttgcgcggtgtcgattgcaacctggcttccctctgcgagcatgtccaaatcgaaggcttcaattccggttccttctctgatatcgttgtcaatgctatgggttccacttatcgccttcatcgtcttatcctctctcgcagttcgtatttcaggaacatgcttcatgggccttggaaagaagccggtgctcctgttgtgactcttcatgttgatgataagaatgttaatgatgaggcaattgcaatggctttggcatatctatatggacaccaccctaagcttaatgataataatgcatttcgtgttcttgctgctgcttcctttcttgacctgcaggatttgtgtggaatttgtacagatttcattatatctgagctgtggacttcaaacttcttggcttatcaggtgtttgcggagaaccaagactatggcattcatggggagcgtgttagaactgcatgctggggctacctctgtcaaagtggtggcatggaattgaaagaggtgcttcctaaactttcatctcaaacattacatgcattactgacttctaatgatctgtggatacccaatgaagagaaacggtttgaattggctttgcatacattcctggcaaaaagtgctaattgcaaggttgaacatcatgcgcatggaatttctggtactgagtctgcaaccagtgtccatgctgattctggtagctccaagggaaaaagtgtgactgatagctgcactagtaagaggttggaaactggcatggggaaaatgagtcttaaaactgatctagaggaccctagcacacctagtcttctagtcaagcttgcagatccagtggcagacttcaacgacggggtttctgtttccaatgaacgggttcaacaagcttcatatgccagttcaccaaacctgaatccaagatattcttgtgacatggaaggaccgtcattgagtaattcattgcctgatacagatgggatgagaacatcgtgttatgttgagatgcctcttggtgctggagctactggtatgggagccactgaagtgggtattgaagggccatctgaagaaggaccttgctaccatttggagaacaatagttggttagatagagatcaatcaagacattgcttttcatcgaattcttgtaatgagctcacatccagtgattggggaagatatggaacacctttattttcatggaatggccaggttgttggcagaagacagcttaaatctcaccccagaggaaactacagaggtcatggagatgaatatgatgcatttttcaatatatttgaagggggttcccttttatattgcaatatgtcttttgatgcacttctaaatgccagaaagcaacttgaagaattaggtttcccttgcaaagctgtaaatgatggtctttggctgcagatgcttcttagtcagagggtacaagaaattgctgctgatacatgcaaagtttgctccctcatgagtatggcttgcacttgtcagaagcaatttgcattttcacatggagcttctaccactggatcttacgcacaagaacataatcagaacattatgcctggcaatgcgggaaatatatatgttgctgaatcttctgcaggcgaaagaaatggcctttttagacctgtacgagtacatgttagaggtgctattgatgggcttgcaggtattggccgtggaactacatttgttccagcatctgcttcgccacctacacgttttgtcttttctcgtgtaccatttggtgttggcaacagaaactatcctcagtctgcagccaatgatgattcagagacacgtgctgacccaaatggagacctggctggagatggcttgacagctttagttgggctaagcctgggagggagtaatggaacaaatgtacatacagagctaacacaaaggggatatgaaatgggcttgcaaagcagcatgtctggaactactgctggaggtgcaagtactggtggcattcccatgcagatgttagagacaccggaacataccattggtatagaatgggacaatgtcaacagtagttccatatcactggatttgaaaacacctttaagccatttccccccttttcgctttggtgtacgttttgaggatgtgcataggcttggtgatggccaggtcaagcattctccagaagttttctatgctggttctttgtggaaggtcagtgtacaagcttttaatgatgaagacccccagggacggcgaacccttgggttgtttcttcaccgtcggaaggcagaggtaactgatatacatagaaaggtgcatatgtatgttgactcgcgggaaaaggtgactgcacgctaccagttgaccgtcccatccaagagagaaatgacggtgtttggaagctttaaacaaacaggcactcttctacctaaagctcctaagggatggggatggcgaactgccctgttatttgatgagcttgctgatcttcttcaaaacggtgccctaagggtcattgctgtagtgcagcttgtttaa

SEQ ID NO: 87130 - DNA, 1128 bp, Glycine max
  Peptide Sequence Number=SeqID_203908
atgaagagagacaatcgcagaggattaaggagaaggaacaagaccgtgtttctgccacaggaattgatcattcaaatcttgttgaggttgccggtcaagtctcttctacgtttcaaatgtgtctctaagtcgtggctctctcttatcactgaccctcactttgcaaaatcacattttgaactagctgccgcacgcacacacagacttgtgttctttgacacttcttctcttataacccgatccatagacttcaatgcatcccttcacgatgattctgcttctgttgcattaaacatcaattttcttattaccgatacttgttgtaatgttcagatcctaggttcctgtagaggttttgtacttttggactgttgtggaagtctatgggtgtggaatccatccacatgtgcccacaaacaaatatcttactcacctgttgatatgggtgtatctttttacacatttctatatggttttgggtatgacccattaacagatgactacttggtggttcaagtgtcctacaatccgaactcggatgatattgtgaaccgtgtggagtttttctcgctcagagctgatgcgtggaaagtaatcgagggtgtgcatttgtcttatatgaactgctgtgatgatatcagacttgggttgttcttgaatggtgtcattcactggttggcttttcgccatgatgtatcaatggaagttattgttgccttcgatacagtggaaaggagtttttcagagatacctctgcctgttgattttgaatgtaactttaatttttgtgatttggccgtacttggagaatctctcagtctacatgtttccgaagcagaaatatgggtcatgcaagaatataaagtgcaatcatcttggactaagactattgatgtgtctattgaggacattcctaatcaatacttctccctaatttgctctacaaaaagtggtgatattatagggacagatggaagagctgggttgacaaaatgtaacaatgagggacagctgctagagtatcgatcctattctaatagttcacgtggacaacaccaggtggctgtgtattcagactctctactttcactcccttgtgacagtgagcaagctgaagaagatgcgtaa

SEQ ID NO: 87131 - DNA, 1173 bp, Glycine max
  Peptide Sequence Number=SeqID_203909
atggccgtcgtaactagcaacggcaagcgccgccaacattggccctccgcgaattaccactttccatctcccaattccaaaagacccagacttccaacaatgtcccaaaaccacgcgcaatccgtgttatcctccagtagtatcatttctagaatttctacgtaccccgaaaccaagccacccctccatagggaggttcacgccccgtgtagaccacgtaagtttgattctcctgccttcaatagaagtgctcattattatcgcaaggaagagattagtcacgatgtgggcaacttgttaagtaaaaattaccaaagggcgaaaaattccgcgttagctagcattaggtttggggaaaagggcaaggaggtgatagaagtggatgctgatagttccaaggatatggtttcggaggaggattcgagtgtggaagaggttcgttttgtggaagaagatggacgagaagtgcgctccgtggtgacggagcacaagtggcaagagggtgatttggttgtgactgaggttaaggatttggatgctaaggatatgtgtggtggccctcagcagcagtcaacttcatccgtggtttctgagttgactaatggtgatctgaatgtggttaatgctgagaagatgttggacattctttctttgactccggatcatgatctttcctccgttcaagcctacaagaagttgctcgatgctcttggccagcgaacggatacccttaacaggctggaggctgaaattaaagttaacgagaagcgtatgtccacgtttgaattgttgcgcccgaagaaggaactagtagaggaagttccattggaaccttttattcctcttactaaagaggaagaagttgaggttgcacatgccttttctaccaaccggaaaaagatcttggtttcccatgagaaatctggcattgagatctcgggagaaaagtttcaatgccttagaccgggtgcatggttaaacgatgaggtaataaatgtgtaccttgaattgctgaaagagagggagagaagagagccacagaagtttctgaactgtcattttttcagtacctttttctacaagaggtgcttgcacacacatgcacctgtccactgtgctttgttaggtttcatttctttcatggaaagtaacagtaatggaaatgctttctga

SEQ ID NO: 87132 - DNA, 726 bp, Glycine max
  Peptide Sequence Number=SeqID_203910
atggctgatttaagagttaagaaaggaagcaacaagaagcatggatctgtgtctgtcaccaccatcaaatctcttccgaaggagttgcaagtggagatttttgccaaggtggccactcgctccatatttgaccactgcatgataaaactatgttgcaaagaatttcttcacgccgccgaggatgattacgtgtaccgtcacgcctccatggagaattttgcgttggtgccgctgccatggttcactggcaataaagaatcctcctttctgaagcgttgcagggagagcggtaactcggagattttgtaccgtgaaggaatgcttcaatatttcacttcttcaagggtagaattgggtctcaagaatttgaaagaggcggcgctggagggtcacgatgatgccaaatatgtttattgcatgcttttgatgtgtggtgaagatgaaggacaaagaaagcaaggttttgatctcttttgttccttgaaagagtccacgtctgttatcagatgcagaaagagggtcaaatcttttgttcgaagcatgtggctgaaaaataagccaaatggcaagtcatctttctgcggttctggtacgtgcgatagtgagagacagaagcagctttcaaaaagatggtcgtcttttgaggataaagatggtggtatttcatgccaacgctgcggtgctgatcatgaacttggtttcttttgcaacatgtttggagtctaa

SEQ ID NO: 87133 - DNA, 1140 bp, Glycine max
  Peptide Sequence Number=SeqID_203911
atgcttaattctgaaggagatttaaaaataagttttggctataaatgcaatagcgatagaggtattccttgtgaagttgccagtggctgcaaaatccttcctggagtacgtagaacaagcagtttctcctgcttttcaggtgcagccttaagtgcaaatgctacattagcaaacacaaacatctgcaatgtctgtcttactgatgaggacatgagggttcatatcacttaccttagctgcagtccttctactacaagtgatatccttgaatatgactcttgcacattaaaatccatgagtgatccttccagaagtgaaggttttcttaatgctaaggaagtccaagtagcaggaggagctgctggtgaagatagagttcaagcagtttgttctgaagaaaatgggtggctcttctgtgcaatatatgacggctttaatggaagagatgcagctgactttctggctggtaccctgtatgacaccatcatatcttactttaacaagttaatttgggaattggagccgggttccgtcaaagcttacgatgatggatgcttgggtggatccctgcaatataagttggatgatagtcttatttatcacgaggatcaatctctgtcaagatttaagggaataaacgattctaatcatggttgttttgcaaagtgtagtccatctactaagtcagaagtatcatgtgattcattttcatatggggtacttgatatccttgaacgttctattagtcaggctgagaatgacttcttgtacatggttgagcaggaaatggaggaacgtcctgatttagtttctattggatcttgtgttttacttgtgcttcttcacggcaatgatttgtatacccttaatctaggtgacagcagagcagtattggcaacatgcactacagttgatcgaatggataagagagagagactcgaggctatacagcttacagataatcatactgttgataatgaagttgaaagagctagacttctggctgatcatcctgatgatcccaagatcgttataggaggaaaagtgaaaggtaaattgaaggttactcgagcttttggagttggctacttgaaaaaggttagtattctctcttacacttcagccaataggtttctataa

SEQ ID NO: 87134 - DNA, 915 bp, Glycine max
  Peptide Sequence Number=SeqID_203912
atggagctaggcctcatggataagaatccaacgaagctggaacactttgatgacatgtggaggctcgaatccactgccacactattatctcacttgaagggggatgatggtcgacatgtcttgacattggatcgtacaatattctatccgcaaggtggtggtcaacctgcggatactggctttgtactcattcatggctttgataacaacaaatttctggtttctgatgttcggtccaaagatggaattgtttttcactatggtttctttgagaacctgggcggggaatttgagcctacactcgagaaagggaaggaggtttcactctttgttgatcagcccaggcgaaaactcaactccagattgcattcagcaggacatttgcttgatatttgtttgccaagaataggattgggaaatttagagcctagcaaagcctaccattttcctgatgggccttgggttgaatacaaaggtacaatttcacaaaatgaaatgcagagtaagcaaaaggatttagagctggaggccaatgcattaatttccatgggaggaaaagtttctgttgatatattaccatatgatgaagctgctaagctttgtggtgggtgtcttcctgattatgttcccaagcgtcaggaatattccagctcatacagtctcttccattggtctctgatgctgaaattctacgtgggacaggagattcacgcttatggtgttctatccactttgtactttgtagaagtcctcataagtcataaatatgaaattgttttcatgaaaatggaagaaactctcatttcagtcattgtgaaatatgaaggtgataaaatcatttcaagccttaatatcagtgtgcttgtgtcagtcagtctgcctgcctgccctacatgcatgtatttactggcatag

SEQ ID NO: 87135 - DNA, 294 bp, Glycine max
  Peptide Sequence Number=SeqID_203913
atgcagaacgaggagggaaaactcactgggctatatgttcctaggaaatggtactacgttgtcacgttttttcgaattgtgcacgtacgttgcaactctgccactaacagactcataactgcaaaggaccatgcctcggttcagataaacattggccatttggatgagaatggtatctataatggtcatttttccacttctgctctctctggcttcgttcgagcacagggtgatgctaacagtgcattagataggttgtggcagaagaagaaagcagaagttaagcaacactag

SEQ ID NO: 87136 - DNA, 621 bp, Glycine max
  Peptide Sequence Number=SeqID_203914
atggctgaagagatttccacctctgacctttgcaatgttaaacaatgttgcgaagagtttcttgatgccgcagaggacgatcatgtataccaacaggcgtccctggagaagtttgcgttggcgtcattggcatggttcaccagcgacagcgaatccttgtttctgaaacgttgcaaggaaactggcaacactgagatcgtgtaccgcgaagcaatggtggagtacttcacttcttcgagggtggagtcaggcctcgaaaatctgaaaaaggtcgccatggagggtcacgatgaggaaaaaagtgcatgcttttttatgtgcagtgaagacgaaggagagaaaaaacaaggttttgatattttttgttcatttaaagcgtccacatctattattatgaaatgcaggaatagggtgaaagcttttgtccaaagcatgtgggtcaataacaaagcagtgattcgaaatcgcaagacatctttctgcccttccgtcacgtgcaatagtgagaggctgaacaagctttcaagatggacgtcatcttctgaagatgaagaagctggtagcaatgctatttcctgtgaatgttgccgtgtggattatgaactttggactgttttgtaa

SEQ ID NO: 87137 - DNA, 349 bp, Glycine max
  Peptide Sequence Number=SeqID_203915
atggggagctcaaccttctgtgccttcttcctcctgtgtgcaatcttggccgtccacgtggcacaatcctcatcctccaccctcgacctggacgccttcttcctccctctcaagtccggctgtcgcggatccgtcgccgagtgcagcctcctcgccggcgacgacgccgagtttctgatggagtcggagagcaaccggcgcattctagcaggaaggagctacataagctacggtgcgctgaggaggaacactgtcccttgctcccgacgtgatgaaagggaggtttggggattattgatggcggtgactacagatttggtactctacatgccagtgtttggtttgaaag

SEQ ID NO: 87138 - DNA, 411 bp, Glycine max
  Peptide Sequence Number=SeqID_203916
atgtcgcagaggagcaatgcatcatcatctcgaacaagagtttcatcacaagttgttcttttttgtggttgtggtagaagggctgttaggtgtgttgctggaacaaatattaacagaggaaggacatttttcacttgttcaattaataaggatttctatttggggcttttcaagatgaagttggatattgtggcatttggagttgatgattcacttgggacattttccatagaacaaagaagacaatttggaagagaggaagataagacaatgtggaaggctcaagttaactcaaagcttgattgtatggggattgaaatgaagatgtttagaacaattgtctatgaaatgttcttaatccaattgttgtcaatggtggtgtttgtatgtaactgtcattttagtccctga

SEQ ID NO: 87139 - DNA, 324 bp, Glycine max
  Peptide Sequence Number=SeqID_203917
atgtctttggggattcaaataaagcaaataggaggaggggtgatagggtattgggtcgggctagtgggtttggttggttgggttgtgaaaggtggtgtgggtggttactgggtggtggatttggtggtgttgaggttagttggtggcggcggctatggaaaatgttggcttggaggaggaggaaagggaagggatggacatatttgtccattcatgtttttaatggggtgcaagaagcaattgccaagaatttgtggctcagtacaccaaaaacaattgaggtccggtttgaattttgggcatctattctccgcaaaacaataa

SEQ ID NO: 87140 - DNA, 456 bp, Glycine max
  Peptide Sequence Number=SeqID_203918
atggttcatcattgccctacatgtgtgcaggcttcgaccatgactctccttattatcgctttcaatcgccacccttcgaaatcttcagtgatgagaatgccaacggagggaaaaatcgagcttatggcatatacgttgtgctctgtccttggattttctaggggctcactttgctgcatttactactccaacactgaaatatgcccaaccttaccttattttgatcttttggaccaagctgtaaataatattctaatatggacccttttaatatttcatgtcatgtgtattaatatgatgtatgctgcaaagagatggaagataaagataagataccgtgtcaatgtcatgcccaaagggcattccatgaggactgtggtgtggctgttccagcaaagtagaggcaacaacgaaatgaagcttaatagaaattataaatgtgataagaggggttga

SEQ ID NO: 87141 - DNA, 1077 bp, Glycine max
  Peptide Sequence Number=SeqID_203919
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgacgagtctagaggatcccgagaatcaatctctgtcgagatttaagggaataaacaattctaatcatggttgttttgcaaagtgtaatccttctactaagtcagaagtatcatgtgattcattttcacatggggtacttgatatccttcaacgtgccattagtcaggctgagaatgatttcttgtacatggttgagcaggaaatggaggaacgtcctgatttagtttctattggatcttgtgttttacttgtgcttcttcacggtaatgatttgtatacacttaatctaggtgacagcagagcagtattggcaacatgcggtacagctgatcggatggataagagtgagagactcaaggctatacagcttacagataatcatactgttgataataaagttgaaagagctagacttctggctgatcatcctgatgatcccaagattgttatagcaggaaaggtgaaaggtaaattgaaggttactcgcgcttttggagttggctacttgaaaaagaaaagtctgaatgatgctttgatgggaatccttcgagttcacgatcttaaaagcccaccatacatatccactaacccatcattgaatgtccatagaatctcaaattccgatcaatttgttatagtagggagtgatggtttatttgacttcttcagcaatgatgaggcagtaaagcttgtggagtcttatatcttgagcaatccttttggtgatccagcaaagtttctcatagagcagcttgtagctagagcagctgattctgccggtcttagcatggaagagttgatgaatattccagctgggaggagaaggaagtaccatgacgacgtgaccgtaattgtaatcatgcttgggatgaatcagcgtacttcaaaggcatcaacttgcatttaa

SEQ ID NO: 87142 - DNA, 273 bp, Glycine max
  Peptide Sequence Number=SeqID_203920
atggaggagtttttgcagaaggttgcttggccaggagtccggccttctcctttgggagggggtgaggcctccgcagcccaggaacctcagccaaatcaggaggatgactcttctgaagccactcccactccacctgagccatttatttttgaggatgatccagtgaccacagagggtactcagcaggcatctccaacaggcattcttgcactggacttgaacaaggaggtcatggatcaggacccaccaccaacacaggaccaggatcactga

SEQ ID NO: 87143 - DNA, 408 bp, Glycine max
  Peptide Sequence Number=SeqID_203921
atgaaggatgagatgaagtctatgcaatacaacgacgtttgggatcttgtcaaatttcttgaaggtgtgaaacccattggtcgtaaatggatatttaaaaccaagaaggattcaaagggtaaaactaagagatataaagctcgtctagttgctaaaggctttactcaaaaagaagtcattgactataaagaaacattctctctggtatcttcaaaggattcttttagaacaataatgacactagtagctcattttgatctagagatgcatcagatgaatgtcatgactgtgtttctgaatggcgacattgaagaaacaatttatatggtgcaaccaaaaaactttctgccaagtgactcaaagtttgtggtgtgcaagctaaacaaatccatctatgatcttaaatag

SEQ ID NO: 87144 - DNA, 267 bp, Glycine max
  Peptide Sequence Number=SeqID_203922
atgttgtttgacactctcttccaagtatatacagattttatgggtccacaaaatcccacatatattgagcccccaactatggttgtaaaagacgtcagaagtgcacttttgacagcgtgtatgaagggagcttttaagatcttaggaagatgtactttgtatcttctccaaggaccaaggcatattaatgacctagagaaacgtcacccacaaggcaacgcaaccagccttgactacttgatgggtggaatatcaattccaaattaa

SEQ ID NO: 87145 - DNA, 339 bp, Glycine max
  Peptide Sequence Number=SeqID_203923
atgaagtatatcatagaccatgctgaagagattgaaaagctaataaaagtgaaggctcaagtttcagaagttaaaagtattatgttagagaacattgataaggccattgatagaggagaaaatctaactattctggcggacaagacagagactttgcactcacaagctgaaggatctccaaattttcaggcccaggaattcaaaaagcaaggaactcatgtccgtcggaagatgtggtatcagaacatgaaaatcaaattggttgttcttggaattttgttgcttttggtcctggttatctggctttctgtttgccatggattcaactgcgcaaactag

SEQ ID NO: 87146 - DNA, 114 bp, Glycine max
  Peptide Sequence Number=SeqID_203924
atggctgagccagaatcagagccaactaccgaaatgctggtgcattggggaagcattatcacatccatggagagagacaatatgtttgtcaccaggagggatgtggaaaggtag

SEQ ID NO: 87147 - DNA, 4398 bp, Glycine max
  Peptide Sequence Number=SeqID_203925
atggctgaccacgggaccaggaagacgaccacggaccgcttagaagatgcgatcgcgcgcctcaccaatagccaagccaacctcaacgaacgctacaccaacatctccgataaggtagactctatactggatcacctacggttacgcgacgagcaccagaaccagacctccgtcagcaacaccaacggccatcgcaacacagtcaaactcgatatccctcgttttgacggccgtgatcccatgggctggatattcaagatgaaccagctcttccagtaccagcacacaccggaggaggaacgtatcaccgtggcttccctgtaccttgacggcgccgccctcagctggtaccagtggatgtttaccaatggtttgatcacttcatggcaaggcttccttcaagctttagagtcacgatttgcaccaactttctatgatgatccaaaaggcgcgctattcaaattggttcaacgcggatctgtgaatgaatacttaacagaatttgaacgtttggctaatcgtgtggtaggtctccccccacccttcctattaagctgctttatttcaggtctagtcccggagctccgacgagaggtactcgctctccaacctatatctctccttcaggccaccgcgctcgcgaagttacaagaggataaactccgcgatagaagacctccaccacagcgttcttctcatccttcaccgtcaccatcctcctctatcccaaacacgaaaccaaaacctccgtacgtgcagcggacaccggaagaaatggcgttccgtcgagagagaggtctatgctacaattgcgatgacaagtggagttccaatcaccgctgcaagggacgcatcctgctcttcgttgccgacgatatcactcaggattccggcgaaccaggctccaccgagcctagcctcgtatcagaagaaaattcagctaatcctattggcgtgctagatccatctcctccccatgtcagcctccacgccatgtctggtttaccttcatcaaaaacttttcgtgtgtatggttccatccggaatacgcgtatcactgtgctcatagatagtgggagcacccataattttctccaaccaagggttgcacacttcctccatcttcctatcgaggacacccagcccctccgcgtccttgttgggaatgggtccacattggactgtaacaagcgctgccccaacactcctctacacattcaaggtcactcgttttcgatcaccttccacctccttgagatcagcggagcggatgcggtgcttggcattgagtggctgaagcaattcggccaagttacgactgattataccttcttcatgatgcgattcaatcacttgggccaggaggtttccttacgggctgatgtcgctacgggcccagaaccggcttccgcaacacaagtcaaacgcatgcttcacacgggatcaacttcagccttgttccatttacgtatcatacccactaaccccatagacgagaccactactcatcttccccattcactcgaatcaataacgaagctcatcctccgttatgatcagttgttccaacctcccaaaagcttaccaccttcacgtgaggtgaaccaccgtatcactctcttgccgtccacagccccggtgaacgttcgtccataccggtaccctcattttcagaaggctgagatcgaaagacaaatcgcagagctgctctccgctggcctcgtacgaccaagtacgagcccgtactcatctccaatccttctagtgaagaagaaggatggaacctggcgcctatgtgttgactataggtccctcaacgcgatcacggttcgcgatagattcccgatacctactatcgacgaactgctggacgaactagggcacgcctcatggttcaccaagctcgatttgaggcaaggatttcaccaaatcctcatgaatgacgctgatgttgagaaaacgacgtttagaactcaccatgggcactacgagtacctcgttatgccttttggattgtgtaacgcaccctctacgttccaagccgcgatgaatcgcctccttgctccgttcttacgtcgtttcgccgctgtattcttcgacgatatactcgtctacagcagctccctttcatcccatgtccaacaccttgacctgatccttcaagccttgctacgcaatgagttctacttgaaacgcaccaagtgtctctttgcccagagggaactcgagtatcttggtcatgttgtttcgggtagcggagtcaccccggaaccctccaagatccaagcaatcgcgcaatggcccacccccaccacacccaaagaacttcgagcattccttggattaactgggttttatcgaaaatttgtgcgccactatgcagctatcgcgtctcctttaacaagcttattatgcaaggacgcatttgagtggtccctcgaatcacaagaagctttcgataccctcaaatccgctatgatcaacaccccagttctggcccttcccaatttccatgaaccatttgtcgtcgagacggatgcttcaggcactgccatgggggctgtgctctctcagcaagggcacccattagcgttcttcagcaagaacttcaaccctcgcctccttaatgcgtcaacctatgtgagggaactccatgctatcacatccgcagtgcgtaaatggaggcaatatctcctcgacagctccttcacgatcctcaccgatcacaagagtcttcgcgagcttatgactcaggtgattcaaacgccagaacaacactattacctttccaaattgcttgggtttgattacacaattcaatacaaaacgggagccaccaacgttgtggctgatgcactctctcgcagaccaccggaaccaggcgagttgctgatcttatcagtgccccaattcgacttcctgcgcgatatccaccaagctcttgtcagtgatcctgaatttcagtcgttattaactcgtgttcaagagaacccttcagcctatcctcaatatcggatccataacgggttcttgttattcaataatcgtatatggctgaataaaaccaacccgtacatcacgaccctcctctcggaatttcacgcaaccccgttaggtggtcattttggggtagccaagactttgcaccgcctcgaagcaagcttcttctggcaaggacagaagcaagacgttcagaagcatatcagggagtgcaaggatatctctatggacttcgtcactcacctcccaccgtcaagcggtttcaccgtcattatggttgttgttgataggtattccaagggggtgcatctcggagcgctgcctacgggattttcggccttcaaggtcgccatgctcttcgtggaaatcgtctgcaagcaccatggtttccccaagagtattgtttccgatagggaccccgtgttcctaagcgctttttggagagaattattccggcttagtggcacccatctgcgcttaagcacggcgtatcatccacagtcggatggccaaaccgaagtggtgaatcgcgtccttgagcagtacctccggtgtttcgttaactcacaaccttcctcgtggttccgctatctagcactcgctgagtggtgttacaacacctcgctgcattcgagctccggtttgaccccgttcgaggttatctatgggaaacccccacccacgatacctcaatatattccgggcttcaccaataatgaagctgtggcgtccctggtccagtctcgacaagatatccataccaaactgcagaagcagctgaagaaagctcaagcttcaatgaagaaatatgcagatgctcatcgggatgatgtgacctttaacgaaggccaatgggtctatgtgaagcttcgacccacccgccaacgctccgccacgggaccacaccaccccaagctatcaaaacggtacttcgggcccttcaaaattctcgcgaaggtgggagaagttgcttatcgactagccctcccggcggaggcacgcatccaccccgtcttccactgctcactgttacgccgtcatcatggaccttccccgtcttccactgaaccctggaacttagagatagttggtcagagacccaagcaacgacccctctgcatcttggataggaggcttgacacttccacttaccccccgacgaaactcgttctcgtccaatgggttggccaacccccggaggacacttcctgggaatcatggcttgagctacaagaagcctaccaccttgaggacaaggtggttttcgaggacgacggtattgttagcaaccaggttcacgaagaagaagataacactcatgaagatgcttctgttgtgcccacgagacccgcacgtgctataactaagcctagatacttacaggattatgttagttag

SEQ ID NO: 87148 - DNA, 567 bp, Glycine max
  Peptide Sequence Number=SeqID_203926
atggggtgggtcgatggtgtgattccattccgttggagtagccatgcctcacgcaagatccgctccatcataaggagcgagtgcgagaacgccacctcctcctcggattcctcgtacgacacgctgtgcgagattgtggattgctccaacggggtctgcgagcacgaccctgttcggttcatgcggccaatgctttcggctagtttctgcttgcagcctcccggggacacgaccacgcgccggtccacgttcgacgcggtactcgcggggtgcataccggttttcttcgaggagctttcggcgaaggctcagtatgggtggcatttgccggaggcggagtttgaggagctgtctgtgtttataccgaaggaggaggtggtgttcagagggatgaggattttggatgtgttgcaacagataccgagaggtagggttaggagaatgagggagagggttttggagttgatgccgagtgtcttttacaggaagcataatagttccccgggtctcaaaactaagaaggatgcggttgatttggccattgatggtacattggataagatttga

SEQ ID NO: 87149 - DNA, 159 bp, Glycine max
  Peptide Sequence Number=SeqID_203927
atgagtgaggacaagggggtggggcccgcgtggcgtttcgcgccaaagcaaccctgggttccggcaacggagttggatgatgtagccgttaacaatgtggggtccgaggaacacgctgttcccaagggtagggcatcgttgtttgttcatgcagcttga

SEQ ID NO: 87150 - DNA, 2247 bp, Glycine max
  Peptide Sequence Number=SeqID_203928
atgctgcgtaagataagccttcgttcaaactccttcaacggcaccattccttcgtcgctatccaaatgcacgctccttcggtcactgttcttgcaggataattcgttttacggcaaccttccggcggagatcgcgaacctcactggccttatgattctcaacgtcgcgcagaaccacatctccggcagcgtccccggcgaactccctctcagcctcaaaaccctcgacctctcgtcgaacgctttctccggcgagattccgagctccattgcgaacctctctcagcttcagttgataaacctttcctacaaccagttctctggcgagattccggcgagcctcggggagcttcagcagctgcagtacctctggctggaccgcaacctcctcggaggaacgcttccttcggcgctcgctaattgctctgcgcttttgcatctgagcgtggagggaaacgcgcttaccggcgtggttccgtcggcgatttcagcgcttccgaggcttcaggtgatgtcgctctctcagaacaacctcactggctccattccgggttccgttttctgcaaccgttccgtccacgcgccgtcgctgcggattgttaacctcggattcaacggtttcacggatttcgtggggcctgagaccagcacgtgtttcagcgttcttcaggttttggatattcagcacaatcgcatacgaggcacgtttccgttgtggttgaccaacgtgaccacgttgaccgtgcttgatgtttcgagaaatgcactttccggcgaggttccgccggaggtaggaaaccttatcaagttggaggagttgaagatggctaataattccttcacaggcaccattccggtggaactcaagaaatgtgggtccctaagtgtcgttgattttgaaggcaacgattttggtggagaagttccttcttttttcggtgatatgattggcctcaatgtgttgtctcttggtggaaaccacttctctggttcggttccggtgagttttggtaacctttcatttcttgaaacattgagtttgagaggtaataggttgaatggaagtatgcctgagatgataatgggattgaataatttgactaccctggaccttagtggaaacaaattcacgggtcaggtttatgcgaatattgggaatttgaacaggttaatggtcctcaatctgagtggcaatggcttctctggaaaaattccttctagtttgggtaatcttttcaggctaactacacttgacttgagcaaaatgaatctttctggagagttaccacttgaactctcggggttgcccagtctgcaaattgttgcacttcaggagaacaagttatctggtgatgtgcctgaagggtttagcagtttgatgagtttgcagtacgtgaatctcagttctaattccttctctgggcatattcctgaaaactatggctttcttcgatcgttgcttgttctttcgttgtctgataatcacattacaggaacaattccttcggagattggaaactgctctggtattgaaattcttgagcttggatcaaattctttggcaggtcacattcctgctgatatctctcgcctcacccttttgaaagttcttgatttgagtgggaacaatttaactggggatgtgcctgaagaaatctccaaatgctcgtcactaaccacgttgtttgtggatcacaaccatctttctggggccatacctgggtcgttgtcagatctatcaaacctaacaatgctagatctctctgctaataacttgagtggggtaattccgagtaatctttccatgatatctggtttggtgtacttaaatgtctcaggaaataacctagatggtgagataccaccaacgttgggatccaggttcagcaacccctctgtgttcgcaaataatcaaggtttatgtgggaagccattggataaaaaatgtgaagatataaacggtaaaaacagaaagaggttgattgtgctggttgttgtcattgcttgtggagcttttgctctagttttattttgctgcttctacgttttcagtctgttgagatggcgtaaaagactgaaacaaggagtatcgggtgaaaagaaaaagagtcccgcaagagccagttctggaacaagtggagctcgtagcagcagcactgagagtgggggaccaaaactagtgatgttcaacaccaaaattacacttgctgagaccattgaagcaacaagacaattcgacgaagagaat

SEQ ID NO: 87151 - DNA, 269 bp, Glycine max
  Peptide Sequence Number=SeqID_203929
cggaagcagtagcggccagggttctaatcgggaccttcgtgagatgggttctccacgatgttcttcgggttgtttccgacgagctcgaacactgtgctcgtccaaaggtctcatccttcctcttcctccttcttctaggttttacaccgcaattagggtttatcgactcaacacaaaacagagttgaaatgaataggggacgaacttcgaaaagagtactaaggcccaagttaaaaaatagaggcctcgtgaacataagcccactataa

SEQ ID NO: 87152 - DNA, 198 bp, Glycine max
  Peptide Sequence Number=SeqID_203930
ttgaagaacgaggcagacgcagctcccgtgactcggtcgctgggtgcatccgactcccgcgcccagtcgcaaggtgccgtcggcgacgacggatcccaacccgtcgagagctctgacgggatcgtggaggttgagcttgaaggacgtcaaggcttggatctcagcgatggttacggcgctgcgatccgcgcacgttaa

SEQ ID NO: 87153 - DNA, 2822 bp, Glycine max
  Peptide Sequence Number=SeqID_203931
atgggttttgttggaggggaagaagccattcaagagcctacagggcatgatgagaggattcttgtttcggttcgtcttcgtcccctcaacgaaaaggagcttgcaagaaatgatgtttcagattgggaatgcatcaatgacactgccatcatatacaggagcaacctttcagcttctgacaggtcactctacccaacagcatattcctttgacagtgtgtttcgaacaaattcttctacaaggcaggtgtatgaaaaagcagctaaggaagttgctctttcagttgtcggtggcatcaactcaagcatttttgcatatggacaaacaagcagtgggaagacatacaccatgagtggcataactgaatacacagtgtcagacatttttaactacatagaaaagcacaaggaaagagaattcatgttgaagttttcggcaattgagatttataatgaatctgtcagggacctccttagtccagactgtactcctctcagacttcttgatgatccagagagagggacagttgttgagagactgactgaggaaactttaagagattggaaccattttacagaacttatttctttctgtgaagctcaaaggcagataggggagacagcactgaatgaagcaagctccagatctcatcaaattttaagactgacaattgaaagttctgcacgtgaattccttggaaatgacaagtctagctctctttctgcttcagtgaattttgttgatcttgctggtagcgagcgagcatcccaaacccattcagctggcacgagattgaaagagggttgccacataaatcgtagcttactaactctaggaactgttatccgcaaactcagcaaggggagaaatggacatattcctttcagagattcaaagctaacccgcatattgcagtcctcattagggggcaatgctagaactgctatcatctgcaccatgagccctgctcggagccacgttgaacaaaccagaaacacactcttatttgcaagctgtgctaaagaagtgtcaactaatgcacaagtcaatgtagtaatgtctgataaagcactagtcaagcaattacaaaaagagttggctagactggaagatgaactgagaaattcagggccagcccaccttacatctgagactgcagcattgttgagagaaaaagaccgtcaaatcgatatgttaaagaaagaggtaagagagctgaccttgcagcgggaccttgcacattctcgaattagtggcatgctccaagtgcatggagaagatgtggctacaaaagaactggaaagtatggatcctcaatatccaaatttacatatgagaaattcatggaactttgaaaatcaaagagaggagccaaatgtattaagtcttgatggtgaagagagtgtcaggtcttttgatgcatctcaatattcagatggacatagttttagttctgatgataacttattccaactccctgaccttgaaaagaatcttctggtcagaagttctcccccagggttgccagtcaaaaggactgatgctgcaccgaatgatttggatcagaaaagcattgaagatcagcatgaagaggacaattgtaaggaagttaggtgcattgagttagaagacgtaattacaaacacgcataaacactcaaactcagcagatttaagatcacatacatacactgattcgaatgcatcatctcctagtgcaaacacagctatcttaggattggttgtagttgataatagagacaaggaaaaagtagtagatttgagttcttctctgtcaaaggaagacaaaagattgaacaatatgcaccaagattttgttcttccctctccaaaagaaatttctgtgtgcatgacaggaaacagtacaagtagttctagaaccttgaagttgagccgaagtagaagttgtatagcaagtatcatgaggaatttatcttcagattggtttgaagatgaagacgtaattcagaacactcctccaatagggaatgaaaaagccttccctggaagaccagagggctttccgaagaacatttatgcactaaattacaatgccaatgcagagaggctttcatgtaatggccatgggaattctgtgcaaaattcttctgttcatgatgttcagaatgtgaaatcctccactaacaaggaaagagagggtaatggtcccttggctccaaaaggaaaggaaacagaaaatcttaacaggttgagtttactggctgaccatgaggttccggggacaggattggatcccatcttgtctgcaaagaatgtcaaagatattggcttggatcccatgcaagctgatggagaaactcactcacactcacattggccttcaaaattccagaggctacaaagagagatcattgaattctgggatgcgtgtaatgtttcattggttcacaggacttactttttccttctattcaaaggggaaccatcagattctatttatatggaggtagagttgagaagactatcataccttacgcaaactttttcccaaggcaatcaaactgtggaagatggacgaaccctcacacctgagttaagcatgagatatcttagaaaagagaggcaaatgctgagcaagcaaatgcataagcgactgtctaaatatgatagacagaacctgtacttgaaatggggccttcgtttgagttcaaagcataggagtttgcagttggcccatcaattgtggagtgacacaaaagacatggaccacgttagagacagtgcatcaattgttgcaaagctggttggtttagtagagccagaacaggcatttaaggagat

SEQ ID NO: 87154 - DNA, 171 bp, Glycine max
  Peptide Sequence Number=SeqID_203932
atgaatgtttggagtcatcacctacctaggaggacacacccatacaggggaaaagcctatggtaactgtgctccttttcctttattctgtcatcatctgacagaacttgatgaggggcagcaagagttcagtggaaccttgtctgacattgaagactggcactgcaactaa

SEQ ID NO: 87155 - DNA, 1995 bp, Glycine max
  Peptide Sequence Number=SeqID_203933
atgcagcaagaaacagagattgagatgtgcaagaagcatagagataaaggccattgtttagttcctggggctgcaagtgacacctggaatcaaattgaagaggccagtttcatccttggcttgtatatattcgggaagaaccttgttcaggcctcagttgggctcaaagctcttgttgagggagtaggagttggtaaggggaaagaagatcttacaggactcgctatagattctatgaaatccacacaagtacttcctgctcgccaagaaatacctgttggcaaagcatgttcattgcttactccttctgaaataataagctttctaacaggtgatttcagattaagtaaagctcgaacaagtgatctcttctgggaagctgtttggcctcgtttacttgccagaggttggcactctgagcagccagatagtcataattatgctgctacttctaagtattctctggtcttccttgtccctggagttaaaaagttttcaaggaaactagtgaaggggaatcactattttgattctgttagtgatgtcctgtgtaaagttgcttctgaccctgagctaattgagcttgagacgatagcagataatgattgcactagcaaagaaggaaatgggtggacaaaagatacaaaactggaccgtgaaaattcccctgatcaaccacgccactgctatctcaaggtaaaaactccaaaccacagtacagatgtcatgaaatttactgttgtggacacaagtctggctagtgaaaaaatgacaaaggtgagagaactgagaagcttgccatttgaaattttaaaagcttgtacttttgaaaatgactctgatgatgagaatacttctgaggagcaaacaaatgaatctgagtctgtcaataccacttgcttggatagggagaagaatgacattactaaagccagtaaatctaatactggtaagtgtgtctcttcacttttgaattgtttagaacacaatccttcaaaagaggagcttccaaggagcagcatgggttctagtagcctatctgctgcctccaagggaccaaagacagaattcttgagtaacacactcaaaagagatggtatgaagtgcccatcactccagagaatggtatctgacaacaaaaatgatctagtccctgttacaaaaagacggaggagattaactgcctgtagtcgtgcaaagaaaaatagcaacactgccaatttctttgtggttcccagagtaaatcaggaggaggccagtttttgcccggatccagacaattcaaaatctagtgcaaatgtaactgccaacgtctttgtggcttccagagtaaaacaagaggaagccattcctcacaagtcaaaatgtagtgagagtgttctttcatgggaaatcccaacccaggagaaaaactcatcagcagattttccaacccagaaaaacaaaacattagcagatcctccatcaaatcccagctcaatcatcaatggagaagctgttcgtgacactagttcttcaggcaataaggatcaatgtgataaaccccagccacggactatgattgaccttaacttacctgttccactggaagttgaagctgatgaaacttttgtgaatgaagtggcggagatgcagcaaaataacacaggcaaggaatcagatgatctcagtgttgtaacaaatgccaaacttagtgaacagcctgacattcacacccggaggcagagcaccagaaaccggccaccaacaacaaaagtgctagaagcttttgcctttggatatctagacagaaaggagaagtgcagaaatagagattatctccaggacagttcaacaaggccttcccgacgtgtttctcgcaaattggcaggctctagaaatggtggtactgatcttgaaaaagaggaaaaaacagatgttgtctgtaatgggaatggtaaccatagcattgacagtaatgtgatatacccaggctccacgtgtaatgaaagataa

SEQ ID NO: 87156 - DNA, 366 bp, Glycine max
  Peptide Sequence Number=SeqID_203934
atggtggataacgttggaggcagttcctctaatgccgaaaatagtggcatcagggaacaggaccggttgttgccaatagccaatgttgggaggatcatgaagcagattctacctccgaacgcaaaaatctccaaggaatcgaaggaaacaatgcaagagtgcgtgtcggagttcataagctttgtaacgagcgaggcgtcagagaagtgcaggaaggaaaggaggaagactgtgaacggggatgacatatgctgggccttgggttcgcttggttttgacgactatgcagagccattgagaaggtatttgcaaagatatagagaactagaagtcgatagaggaaatagcccccccaaaagagaataa

SEQ ID NO: 87157 - DNA, 369 bp, Glycine max
  Peptide Sequence Number=SeqID_203935
atgatgggaggaaagcaaacaggagtaatggtgcattgtggttggaatgaaagtggaaagaaaaggaagagaaaaaggctttggaactactcaaccgggaagtttctgaagacttacaccggtcatgttaattcaaaatactgcatttcatccactttttctataacaaatgggaagtatattgttggtggttcagaagacaattgtatatacttgtgggatttgcagtcaaggaaaatagtgcagaaattagaagggcattctgatgctgttgtttctgtgtcatgtcaccctacagagaacatgattgcttctggtgcacttggcaatgacaacactgtgaagatctggactcagcagaaagactga

SEQ ID NO: 87158 - DNA, 423 bp, Glycine max
  Peptide Sequence Number=SeqID_203936
atggcatttgagctttctgtatcaaagggggcctacttatgttttatctccaacaaacaaaagggacgcgcgcattttggagatgttttttttatcaaccgagaggctattttcatttctcaaattaaatacgtctcccacttgggaatcacgccgctgtaccgaagaaccgtggagctggccgagtacgaccagggctgccacaactggagggtcatggccctcaacggggactccggtcagctcgaggagtaccgtgggaggtttcaaggcctcagtggctttccactgggtttcgttctgggaaggatttcaaagatcagcatgttcttgttgttggatcggggaattctggcatggaaatcgcattggaccttgtcaaccatggtgccaaaacttccattctcgtttatagcccagtaa

SEQ ID NO: 87159 - DNA, 276 bp, Glycine max
  Peptide Sequence Number=SeqID_203937
atggtcgttacccagccaccaaccctcctccacgtctttcagctctttccttctgcttccctctctgcgctaccactgtcgttcctccctctcacggagtcgtctctttcgcgctcctctcactctctcgcggctcgtagtggttcgtctcttttgcagcgaacccatcttctttcgttgtcggcgacgtcgtcctcttgttgcgaagtctcttcgatggcatcaacgccacctcttcataaccagatgcgttgtttgtggcagatccggggttga

SEQ ID NO: 87160 - DNA, 1000 bp, Glycine max
  Peptide Sequence Number=SeqID_203938
gacatacatcctgcacaatggtaattgtggcactggttcacatcttgaggagaaaatgaacaagagtaataaggaaaatgcactttcttggcagaaatctggtaaggttacatcattgcgggttaaggaaaaggacagaatttctggttcggaggttattagggataagatgaaggtttcagcttcagataatgatttttacaaaaatgatgtgagttatgagtcaagagttgatcctaatcatcatgcttctggtactgagacaagaaatgatgttaagaacagttctctgaagtctaatcacaagattgtcgaccctagtaagaaaaattcttcaagacattggtcaaatgaagctggaaaacaaactgtgcaaaaacaaaatgagattgggaatccagttctgaaagtggatgctacacgtagcactaatagaaagattatctcccagcagaacctgattcagaactttgtggaagaaaacatagctaatcaagtatgcactggatcaagagatgggaaagccaaagtgatcgcatcttccgaggataaagtgaaaagggaaacattatatgtgggttctagaactgcacctgagtcacaaaagggagatatgtctaatgggcacccagttcacgcttctggcaatgatgttcccaagtttgcgagaaatccaattgatgtttgttgcaaggttggagttaattgcagttcagaaagtttcatacctgatggacaactcagtgagtcaggtcctgtgacaacaaattctagccaaactgcctctagcattctggaagaagccacaaagctaaaagattctgcagatcattataagaattctgggtttgagtttgaaagtaatgagacttattttaaagctgccttgaagtttctacatggagcatcacttctagaaagttctcacagtgagagtagcaagcatggagagacaagtcaaatgcaaatatatgctactactgctaaactttttgagtaa

SEQ ID NO: 87161 - DNA, 486 bp, Glycine max
  Peptide Sequence Number=SeqID_203939
atggtatcagagcctatcctagatccattaacgggtcacctaccatattatccacgcaccaagcccaaagtgctaggcgtgaaggggtgtattgggaaaaacccaggtgaatctccttcgtcttctgcatctgatattgataatttaaataacctggcggtagtggataaggttactatgacaaggggttctaatactcatgttgctaacaatcaagtcatatctgctcagaatcgcccaaatattgtcaggcttctggactttactcaagacataaatcttgcaatggaggcttctagaaaatgcaagagcacttacagggctgctaatttgaacatggaaggggcacggaataggaatgattgcataacttctattaggaaggttgttgatttcagcttccaagatgtagatgagcttgtacatctggttttgactgcaatgaaagcaattactcgtgctggccttggtggtgttagagattaa

SEQ ID NO: 87162 - DNA, 1812 bp, Glycine max
  Peptide Sequence Number=SeqID_203940
atgaatttggtaacatccctctcttcctctctttcccgccaacacaaactgtcgctgttccatttccacaccaataccaaagctcacttcgttgcaaagctccaaacttgcaaggatttaacctctgcaacctcgacccactccaacgttgtcaaatctggtttgtcaaatgatacttttgccaccaaccatctcattaactgctatctcaggctatttacaatcgaccatgcacaaaaactgttcgacgaaatgcctcatcgtaatgtcgtgtcctggacttcgcttatggctggttatgtcagccagggtcaacccaatatggcactttgtctcttccaccaaatgcaaggaaccttggttctgcccaatgaattcacgtttgccactctaattaatgcttgttctatccttgccaaccttgagattggtagaagaattcatgctcttgttgaggtttcgggtttagggtccaaccttgttgcatgctcttctctcattgatatgtatgggaagtgcaaccatgttgatgaggctcggctgatctttgactccatgtgtacaaggaatgtggtttcttggacttccatgatcaccacatattctcagaatgcacaagggcaccatgctctacaactgtttaaggaattcaatcattctagattggacaaaccgaatcatttcatgttgtgcagtgcagtcagtgcttgtgcaagtctgggaagcctgggttctggaaaaatcactcatggtgtggtcatacgtcttggacatgaagcaagtgatgtgattgctagtgcacttgtggacatgtatgccaaatgtggttgtgttaattactctgccaaaatcttcaggagaatccaaaatccttcagtgatcccttatacttcaatgattgtgggtgctgcgaagtatggactaggcatattgtctcttcaactgtttcaagaaatggttgttagaagaataaagcctaatgatatcacatttgttggggtcttgcatgcttgcagccattcggggcttgtagataaaggacttgagctccttgactccatggatgggaaatatggggtgactcctgatgcaaagcattacacgtgcattgcagatatgctaggccgagtggggcgtattgaagaagcataccagttagcaaagtcagttcaagttgaaggtgatggatatgccatgttgtgggggacccttctttcagctagtaggctttatggtagggtagacattgcccttgaagccagtaataggctaatagagtccaaccaacaggtagcaggtgcatatgttacattgtccaatgcatatgcgttggcaggggactgggaaaatgctcataatctacgatccgaaatgaagcatactggagtttacaaggaacctggcagcagttggattgagataaaagaatcaacttatttgttccatgctggagacatctctaaatatactcaagggagggagatcctgagtttgctaagggaattggaagagagaatgaagggaaggggatatgtgggagggactaaagggttggtgtttgttgatgtggaagaggaggccaaagaggaaattgtgagcatgcatagtgagaaacttgccttggcgtttggattaataaacacacctaaaggagtcacgatcagaataatgaagaacttgagaatgtgcagggattgtcatggggcctttaagctgattagtgatattgtagagagagaattggttgtgagagatgttaacagattccatcacttcaaaaatggattatgcacttgtggagatttttggtaa

SEQ ID NO: 87163 - DNA, 1746 bp, Glycine max
  Peptide Sequence Number=SeqID_203941
atggctttaagcctggggttgaagggggatgtgtttgagaagatgtttggcgagacattgcaagggattaggatgaattactaccctccttgttctagacctgatcttgtcttgggtctgagtccccattcagatgcaagtgccatcactgtgctgcaacaagcaagaggaagcccagtggtgcttaccaatggaagatacaagagtgtggagcatagagctgtggttcatcaggagaaagatcgcatgtcaattgtgacattttatgctcctagctttgaattggagctaagtccaatgccagaattcgtggacgaaaacaacccatgcaggtttagaagctacaatcatggacatctcagaaagcagggtttcacattcacaaccctaaaatggaaccctattgttcaactccaatttctcaaattcgagttctgcactacctcacgctctttcgtggtgccctacctcatcaacaattgtggcttctcccaagaaaacgctctcaaagcttccctcaggctccgtttccgtggcccccaaaagcccgattcagttctctccttcttccgaagccacggcttctccaactctcaaatatgccatatcctccaaaaagcaccccggctacttttatgcaacacccagaagacactgttgccaaagttccaatatttactttcaaaaggtgtttcttcccttgacattgttcgcatggtcacccctgcccctcgtttccttgaaagaagtttggagaatcatataatcccaacatgtgaatttgtaagagggttcctccaatctgacaagcgaatgattcatcttctgattcgcagtcctaagttacttaatgaaagtagtgtgacacctaacatcaaattgttgcttgataatggagttacccactcaagcattgctttgttgctccagagacggaaccagttactctggtctgctaacttgttgaagactgttgaggaattgaagcaaatgggtttcgatccttcaacttcaactttcagtatggcattgcttgccaaaaggactgtagggaaaaccaaatgggccgagaagattgacacttttaagaagtggggatggtcccaagaacaagttcttctagcatttaggaggcagcctcagtgtatgttgtcatcccgtgataaaattaatgcagtgatgagtttttgggtagaacaggtgggtttcaattctgcagagattgtcaaagctccaggaattttcctatttagtctccagaagaggattgctccaagggctttagttgtgcagtttcttatctcaaaaagtctgctacaaaaggaggcaagcttaactacaccatttattctgcctgagaagttgttccttaaaaagccttctatactctgctccgaattgagaaacgtcgtggaggaactgaagccattagggtttgaccctttcaaactgagttttgctatggtgttacaggctaaaagtgctgtttctaattccctatgggatgctaaagttgatacctttaagagatgggattggtctgaggatgaagttttcattgcttttaggaatcagccaaaccatcttctctccaatggtttgataaagaagagttctagcttggttacactgtttagtaagtctgataaggtgtttctgcaaaagtacgtgagatgtttctgggacagggaacttactagcatgtggttgttgtggtttaacttatggatgctgattttggtgtaa

SEQ ID NO: 87164 - DNA, 2482 bp, Glycine max
  Peptide Sequence Number=SeqID_203942
gttatgatttctttcactatccctggaggtgtgctaatatcacctctacatgacagtctcctctacttgataagaaaggaaaaagctcatggaaacatcaaacccatgtattctcttaatggtcatcaagaacattattccatgtctactgatgaatcagattcttttgtgggggatggacatttgttgaagaaaaggaaggtgacagtggtggaccaaagtgacaagcagcatatgaatggtaaccattctgagaatgatatgacattgcatacgaagaaaaaattaagaagtagaactctaaatcgaaaggactttctatctaatgacctgagatgcactccactgtcaagttcaatttgtgatgctggtgaaacagatgaagtcactgttaaggcttttgaagtatccaaggaggttgataaagatggtgtgaaatgtagaatggtttccactgaagcagtgaaggaggatacactagagtcaatatctggtcaggattttgacaagattgagaagcaaaatacagggagtagctttatgcaaaaagttttagagcataaaacggaaatttttcagaataataattcaactgatcctaagattaatagcaagtgtaatgcatttgcaatttcaaaaaggatcaagtgtgatacaatgaaatgtaaggtggatcaagatactcaaaagtgtgaaactaatcaggaaggaaaggtaaaatctgaaagcaagaatgagtcaaaaggtgaaaggagtcctggaaaagttatgactgatgctgaaaaagatagcattggtactagtaataatgcaatggtaaatgatagaaagagtactggcattggtgttacttcttcgaaaagtaaaatgcataaaataaagtcaatgaaggataataaggtcacagattgtgacagagattcattgaaaggaaaaaaatcacaacggaaagttgatcgaataaatccaactgataggcctacccttaataaggctacagtaaattctatccttgatcatgtttataagagtgcatatatagtaaaggaaagaccaagtggcaataaagttgttaatcagttgtcagctgggccatgtgtaaaagatgcaccaggtgcattttctattgctgaaaataaaccaacttctgagattgttccgtcatcagcagcagcaacacctcaagttattgaagaagattgggtatgctgtgacagttgccagaaatggcgacttctacctatgggtttaaagcctgagcagcttccagagaaatggttgtgtagcatgctatattggctgcctggaatgaatcggtgtaacatcagcgaggaagagacaacgaaaacactttatgcttcttatcaaatgccgatttttgtgggtcaaaataacatgcaaaactgtgccactggacctgaaactgaagtgagatctgttgatgctctgcaacttggcctgaatcacaaaaagtccagttctgatgtaatgcttgatcgaggaaagaagaaacatggtattaatgaaaaggcaaggtcagtaatcaataatgacattgggcctgcagactcaaaccgtatgaagaaatctatttctaaacattcgagcaggttgaacaatttgatagaagaaaaaaacacacctaaggtgaaagaaaagcaaatgaatggaggtgacagaaatcattttagattgaaacataagatggaggataatcaacatggatctggaactgctaagaaatctaagactgaagatgtttactatgctgataaacaactgaatcctagcatggaatttaagaaggttggtctaaactcaagaaatggtttaccaacaaaggctagtgggaaaaatatggggaaatatgatgattattgttggtctgatgatctggaggacaagttggtagttccggtgaagaaaggagactgggcacagttttcatcagatgatggttcattggatgctacaaacagcagcaaaattggttcaattaagaaaaggaaaatgactgactggctggatagtgagaaacataacaaaacattgtccttggaaggcgatatgaaatgtggtaaagaaggcaatgtaaataggagggagaagaagtatatagttttgaatatggatgcaaaatcagtaaccgaaagggatgataaattggttagagaaagtggggtgaagcgagttttctcttcagacagcagggatgaaatggctattggaacagaggtgaaaagtgttaataaggtccagcagccaagaaagcacaaaaaaaatgttgcttcttaccaagctttggattgttttgatcaattgggtaaggatttaggctctggagaactttcattgacagcaacttcaagctcttctaaggtttcagggtctcataaagctagaactaaccttgaagatgtcagaggctcacctgtagaatctgttacctcatcacctttgtggacctccaacatggacaagc

SEQ ID NO: 87165 - DNA, 670 bp, Glycine max
  Peptide Sequence Number=SeqID_203943
gactaataacttgcttcctgttttattcaaggatgagaggattcagcatgctctgggtcattttcgaaaggaatttgaagaaggtatctctgctgaccgtttgggtgcaaaatttggtgactatggctcctttttacctacctgtgaacgctctcctcctttgcgatcttgtccaaagactccacaaaaacacagtagttccccaaaatctcctagcaatctccacatggtggctgcatttcagaactcaaaagcacctccaaatataccaccttctatgaggcttggaactgcttcctataaagctcctccatttcgtaatataagagtaccttcagcggataactcagtaaagaacacagatatttcctccaatgaagtaatagagaagttcactttgaaagactgtgcaaataagtcagaaaatttgactgaccaaagaacactgaagttgcgaatcaaagtgaaatcagatatcttagcaaaaaagaaggcagtgatttacagtggtcttggactcgatgactctccatcttcatcaatggagaacagccatgaggaaagtgaagatatgccacatgtatctcaagaaacccctgaagaatctccaactagcattgttcagctgatgcagccagtcgtaattgtggttgctatgcacttgtggtga

SEQ ID NO: 87166 - DNA, 717 bp, Glycine max
  Peptide Sequence Number=SeqID_203944
atgagttttgtttttcgaggaacaagagcagatattgaaaatgggtttccagggtttatacctgagaggcgagcattgctctggctggtgcttggtgttttcttgatggcaacaatgttgaggatgtatgcaacatgtcaacagcttcaggtgcaggcccaagctcatgcagctgcagccagtggcattcttggccacacagaattgaggttgcatatgccaccatcaatagctcttgcaagccgagggcgtctacagggtctcagacttcaacttgcacttcttgatcgggagtttgatgatctagattatgaaactttaagagctctagattcagataatgtttctactgcaccctccatgaccgaggaagagataaatgctcttcctgtccacaaatacaaggtttctggtcctcaaagtggtagttcctcaatgcaacaaacatcatcttccactcctgctgagaagaagcaagataattcaactgctgttgggagcatgaaagcctctgatgatgagctcacttgcagtgtatgcttggagcaagttgatgttggtgacgtactgcgtagcttaccttgcttgcatcagtttcacgctaactgcatcgatccctggctgcgccaacaagggacatgccctgtatgtaaatttcgagctggatctggttggagtgacaatggacataatgatatcatcgctgacatggtttga

SEQ ID NO: 87167 - DNA, 246 bp, Glycine max
  Peptide Sequence Number=SeqID_203945
atggacccaacatctttctccagacgagagagtggttccctccctcacccaccctggacgtcctctctgctaagggtgggtaaacggacccaggtccatggactggcccgcggtgtgcgcagggtctgtgggttgcccgtaagcccgcttaatccatggtttgagaatcccaccaactacaacaccttaagaatctcgcttaatccaaatctttcattgttggcttgtgatattttaagcatctaa

SEQ ID NO: 87168 - DNA, 696 bp, Glycine max
  Peptide Sequence Number=SeqID_203946
atggcggtatggcatggtggatttttgaaaaaatgccaccaaatagcggtggcgttgtgggtttcaactggcggcgccatggcagccgccatagttttggaatcaaaatgggatgagcagcacgcaccagcgcgagcaccacgcgaactcccgaagtcgacgacggcaccatgcaccagcacgagttctctcatggtctcacccgaagttgatgacggcaccacgctccagtgcgagttctctcggtctcacccgaagtcgacgatggcaccacgcgagcaccacgcacgcgagcaatggatggcgacggcaatggctacagacggcagcggcaacaccctgctcggaaatcatgggtccaatctaacagaagaggagcttgaaacacataccatatcagcttggaaaggaggaaagtggacaggatttacacaatgttttatccgtgcagggccatatgataatttgaaagagattgctgtgaagatcctgcaaaatggaatttcaacagttcctattattcattcagaagatggttcatttccacagctactacatcttgcttcactttcaggaatccttaaatgtattttaggaattgttctagttcattacctatacttcaacttccaatttgtgcaatccctgtggggacgtgggtgcccaaaattggggaatcaaatcgccggcctctag

SEQ ID NO: 87169 - DNA, 2664 bp, Glycine max
  Peptide Sequence Number=SeqID_203947
ggaggaagtgacagtggtaaagaaagcaatgatgatgcagaaatatctaaaaagtctcaaaagcgtttgcggggaaagcatctaagtgacagtaaagcattagaagggcacttttcagatcattctcagtcacattctgttgcatcaggtgatggttgcctgtcattgttgaagaagagacattctggaattaggctgcatgctgttcgaaaaaggactccccgagtccctatttcatattctattggtaaagataatggggataggtttttttcatctgccaggcagggctccaaacaaatggttgatactaatgatgttgctcataaggttgcattagcattgacagaggcttcacaaagaggtggctcttcgaaaatttctggatcaccagacaaaaaatttgttccttcaccgggcctgaaaagtgggaagaagcatcctaaatcagaaatagctggagccaagttttgcagttctgacttggatgatggtagttctgagttgagtttaggaagcacagaaggagagaatttaaacaagcatttgaatgacataaaggaagcctccagtggaacagatgatgggttccaggatgaaaagtacaaagctactgttagagaaaggtatttggtaattgctttaataccccttcctcataaagatgaaggttctgcttttgatgctctgaaaactttggctgatttatctttgatgctgccagtaacgaaccctgataccgagtcatctgcacagttcaacaaaggaaaccatgatgttgttgatgaatctaaaatggaaacacataaagtatttcctaggattgaaagcactgcttcaaataaattgggcaaggttttttctgatgatggagctgctgttcctgaagcagagggagcacaccagcttaatgcaggattcaagaaaaggaaacaaaaatcttttaacttgaaaaatgatgaaactcatacaggttcgcatttatgtggttccctgaaaaccaaggctactgatgaggtgaagaaatccattgttaaaggtaagaggtcatctgtttctacagcacattcaagacaactaaaaggggtgaaatccttaggaaatctgtcttcaagcactaatgacaaaagggaaagggatgattcatctttttcgctgatgaaggtttcctcaacttatcaaggcagtccattaaacagaggaaagccaagaagaaagatggaaaaaccaaaaccaatggtacaacaagatttggtggtgtctagaaatatttttagcagtcaacataagaaatccattgcttcactccaagatggctcttctagtcaaaagggaaagcttgtcaattgcctgtcttcatatcaaatgcggcgatggtgcacttttgagtggttttatagtgctatcgattacccatggttttcaaagagagagtttgtggagtacttataccatgttggattaggtcatgttcctagattgactcgtattgagtggggtgtcattagaagaccacgaagattttctgagcaatttttgatagaagaaaaacataaacttaatcaataccgggaatctgttagatcacattatgctgaaattcttgctggtaccaaggaaggacttcctactgatttggcccagcctttaattgttgggcagcatgttattgctattcatccaaagacgagagagattcacgatggaagtgtactaactgttgaccactgtagatatagggttcagtttgaccagcctgaacttggggttgaatttgtcatggatattgactgcatgcctttgtatccatttgaaaatatgcctacatctctgatacaatacaatatctcttctgctccaataaacgaggactttattgagctcaagcctaatggaaaactgaaacagagaaaggttgctgggcacacaatattgtcccctactgagaacacagatgccatagaaaatcttcatatatcttccactatgcatggaagaagtactttatcaaaacaggtttcttcttcaagttccaaatcacaactgaaagttgtgtgcagtgagattgggattggtaatgcccaactagcatcaagctctcgaccttcccttcttgatcatgtccattcaaaagaagctgacatattagctatttcagagttgaattgtgctctagacaaaaaggaacgtgtattgtctgaactgaagcacatgaatgatggggtatcagagagccagaaatatggagacaactcagtaaaggattcagaaccttttaagaggaattatgcttcagtttcttctgccttgttttgcttgaggcaacgcaacacatatcaagcaagctcctctgttttgtcattaaagcccctggctaattttgatgatccaagtggtcaggccagctcttccaattgttcggcttgccacaaccaagaatctatatctcaaagtcatatagctgagattgtcgaaagttctagaagaaaagctagaacaatggttgttgaagccacacaggatcaattgactgccaacatattgaatccgttggcaagttgtcatgtacaagatgctgaacttaatagttcatctgatcaaaatgaaatgaaaattccctcagaactcatatctcattgcctagctacattgttcatgattcag

SEQ ID NO: 87170 - DNA, 150 bp, Glycine max
  Peptide Sequence Number=SeqID_203948
gttgttcttgcaatacgtaatagatctgtggaaatggtagaggccctgtacactatgaacagggcatatttatctcttccagagggtactgcttctgttgttggactgatagcaatgatgacagatcattatagtgttctgaggtgttga

SEQ ID NO: 87171 - DNA, 1027 bp, Glycine max
  Peptide Sequence Number=SeqID_203949
aacctcatcagatacacccttcaaaggatatgatcctagccaaactcaaatgtgtctctctctcctccaacgcaacacttctccttgtggtgagaggaggggcagaaggaagcaagcagaaccagggaggttccttggtgtgaggaggcgcccttggggtcgatatgctgctgaaattagagaccccacaaccaaagagaggcattggcttggcacatttgacactgctcaagaagcagctcttgcttatgacagagctgctctgtccatgaaaggaagccaagctagaaccaactttgtttactctgataacatcaacttccacactctccagctttctcctatgaatgttcaagttcaacctctcttgccagcttcacagttcctcactaccaccaccactcagaccaaccaaaatagccactttcaggttattcacagtactccaaactgtggaaacccctccccattgaacaatgacatgtgtgttgaaaccacatatgggtcagctcaggatgataatttcttcttttccagtgattctaactcgggctatctcgaatgcatagttcctgatgattgcttcagacctgcttcatccagttccaacagttcaaactccagaaagagcaacgtgagtgatcaaaaggctaacacaagctccatggagagtactaatcaccatcatcatcagtactcacatgttgacatgacttcattctctcaagaaggcattgaaatggcaccaagggcatcttataacttttcagatttttgttatcaaagtgaagtgagtcaaggatcatgggatgatcagcagtcatgggattggaatagcagtgaactttcagctatatttaagaacccaatgagggtggaaaatgggtgcatggatgcattatgccccataaatgatagtcctagttcaagctatgggctaatgaatgaggctgcttcttcttctacaacctgttctccgtcacttccaccctttggggacgtagacttgggatacccactcttctga

SEQ ID NO: 87172 - DNA, 306 bp, Glycine max
  Peptide Sequence Number=SeqID_203950
atgccagtttacaccaccacactacacttgaccacaacattctcaacggcgcaagatatggcccaggccctccacgcagacgagtacctccgtcgcgtgatgagcattgatggttgctcccctgatggatacaattctacgtgtccccctacggccagcacccgattgatattccgtgagctcaaacggtgtttcttgaaaaggaggatcatcgacgtgagagaagagtcacgagttcgagaacaagatttagagaactttcaggtggaagagaggatgaatattataaatgaaatacgcgtgtga

SEQ ID NO: 87173 - DNA, 150 bp, Glycine max
  Peptide Sequence Number=SeqID_203951
atgggaaaagatgttggatgtgcaatacagctatataaaacagagttccctattaatggggaaaaagagtttgtccccaagcctattgaatctttagaccaatcttgtctgagctttgttttgaacttcatttacaattttactgactag

SEQ ID NO: 87174 - DNA, 795 bp, Glycine max
  Peptide Sequence Number=SeqID_203952
atgcttcttaaacgccataagaacgtgttcctgggaccaaccccacttcttgaaaaccctaaccgactcaccccagttggttttattcactgtgcttttcgcgaccaatgcagcactgaaattgggggcggagagaacagagggacacatgtgcagcagcctggcaacggcggaacgcgtgaagccgttatcgaggaggaattcggcggtaagcgggaagcgggggtcgtcggagaaaaagacggaggagtcgcggctgagacatcggatgatgagttcgtcggagacgaggaaggttcggaggaattggtaggcggggacgatgtggctgtcgagggagcgggagaggaaggtgggggaagcggtggcgatgcggatgatgtgggaggtggaggcgcctttggagcggaggaactggaatttggggaggatgaggttgttggggtcgcagaggaggatggtgtgttggccttggatgacttggcggatttggaaaggagagaagccgtgggtggcgaagaaggcgagaacggagtcgggcctgtgggggctgtcgaggcggaacttgcgggagatgctgagggcagtctctggggagaagccgaagcgggtgatgaggtaggagactgtgaaggagtccgaaatggtgctgcagaatttgataagaggatgatgttgatgttgagatcttggtgccgaggtcttcagatggagaagggctctgtgactgtgcttgtgccaattcaacatgcttgcgttgctagaggacggatgggggtggcaccacaaaattag

SEQ ID NO: 87175 - DNA, 243 bp, Glycine max
  Peptide Sequence Number=SeqID_203953
atggcggtggcgtcgggggtcgaggtggacggagcggggcgggtgttcgatttcttcgatgaagccgccgtcgcagtcgggacagacgacggtgtggtggggccagacacggacgaagcggctgcagcggtagcaccaaatgtttcttacttctctttctctctgagggtttcagatttcttcttccctgggagagagagaacatgtgtcgcgtggaacaaagataacagcgaaaccgcgtag

SEQ ID NO: 87176 - DNA, 1656 bp, Glycine max
  Peptide Sequence Number=SeqID_203954
atgtttggcatttctcgtcgccgtatgaaacttggcagattgaaggtgcagctttctgaggccaatccgggaaccagaactcccatcagacaccccaaacggaacggaaactccaatggagaaggagagggagatgctggaggttcaagtggccattctgatgaagttgattgccagccttcaactgagataactagtggcagctcagagaactggatggtcttgtctattgctggggataaacctactcctagatcgaatcatgcagcagctgtcattgggaataagatgatagtggtgggcggtgaatctgggactggattgttggatgacgtgcaggttgctcgcagtggtcatagtgttgttagagcgagctctgttttaatattgtttggtggtgaggatgcaaaaaggaggaaattgaatgatctacatatgttcgatctcaagtccttaacatggcttccacttcactacacgggaacagcaccttctccaagattcaaccatgtagctgctctttatgatgataaaattctttatatatttggaggatcatcaaaatccaggaccttaaatgatttatattcacttgactttgaaactgtgagggagctctgtaggtccaaatgtgtcaatggacacggagagactgtgatatttgatattgtaaaaaatgaatggtctgtggcaattacttcgcctccgtcttctatcactacaaacaagggtttcagcatggtacttgtgcagcacaaggaaaaagattttcttgttgcatttgggggatccaaaaaagaaccatcaaatcaggtggaggtgttgataatggaaaagaatgaatcaacattggggagccaatcagctcacattgactcagttgctagacaaaatctagcttctgcaattgaacatggttccggcaggagatctctgtcagaatccctggttattgatcccaatttcccccccaccaacacctcccttcgtaagcaatttgatcacgatgaagaatacaataccgatctcaagatggacaagaactcagatgaacgttcttttcctcgggccgtagatcacagaacgaacaaagattaccatggtaaacagatgaatactagtgaagtcaagaccaatatggaggaacaacaaacattgttatctggaattctaaaccaacaaaacctagtatttgaaaatgacatgccagaaagtgataatttgttattcagtgaaaacattaacattaacattaattcaggatcactgactacttcaaatgtctattattactatgaaagtaaattggcttctctaataaggaagaatggaattttggagggacaattagcagcttccatagcgagcaaagaagcggcagagaaaagcttgacttctgttcttaaaagtaggcaggaaatggataggaaattgacagaatcagagaaggagatggaattgatgagagagaagctggctggtctagagttggcccaggaagagaccaacaacctatcaaacattgtgcattctgacaatgtacggctagagcatgatgttgccttcctcaaggctgttttagatgatacacaaaaggagttgcactcgacaagaggagttattgcaggagaaagagcaagggcattccaacttcag

SEQ ID NO: 87177 - DNA, 1359 bp, Glycine max
  Peptide Sequence Number=SeqID_203955
atggcaaactatgccttcttaatgcttcaccatttgcacattccagatttcttctcgtggggttgtgtgattcgattcttctctcaaaagggtctattcactgaagctgtttttctctatgttcaaatgcacaggatgagcttgtgtcctagttcacatgctgtatcctctgcactcaagtcacgtgctaggattcaggacatgttggttggcgtatcaattcatgggcaagtccgtgtgttaggatttaacacttgtgtgtatgtacaaactgcccttcttgatttgtactcgaaaatcggtgacatggggactgctcgaaagctgttcaatgaaatggctaagaaaagtgtggtttcatggaattctttattgtctggatatgtaaaagccggaaacatggatcaggcgtgtactttgtttcgacgaatgcctgagaggaacctggcctcctggaatgcaatgatcgctggtttcatagattgtggaagcttagtgtcagcaagggaatttttttatgcaatgccgaggagaaactgtgtctcttggataacaatgattgctggctattcaaagggaggggatgttgactctgctcgtatgctctttgaccagatggatcgcaaagatttgctctcatataatgctatgatagcttataagatgactttggctagtgtaatatcagcatgttcacaattgggggatctggaacattggtgctggattgagtcgcatatcaatgactttggaattgtattggatgatcatttggctactgctttaattgacttgtatgcaaagtgtggaagcattgacaaggcatatgagctattattccctagcatgagaaagagggattcggcatctgatgcaatcaagttatttgaacagatgcttgcagaatgtattggtcctaatttagtcacctacactggactcctaactgcttataatcatgctggattggttgaaaaaggttaccagtgctttaactccatgaaggactacgggcttgtgccttcaattgatcattatggcatcatggttgatctcttgggaagggcgggatatctggatgaagcatacaagcttataataaatatgccaatgcaccaaaatgctggtgtttggagagctctgcttcttgcctgcagattacacaataatgtggagcttggggaaatagctgtccagcattgcattaagctggggagtgatacaactgggaattgttctcttctttctggcatatatgctactgttgaaaaatgggatgatgccaagaagttgagaatgggtatggaaggaaaggaaatcactggatgtagttggacaagtaacttagctactccatga

SEQ ID NO: 87178 - DNA, 229 bp, Glycine max
  Peptide Sequence Number=SeqID_203956
ccctggtgcttaccaacatgtgatggcgaagagctaccttcacccggatttcccgtctgttgtatctcttgggcaggatcgtcttgagctaccttctggggtggggaccgaacatggacagcagaaactaatcaaggaacggatgcaagtggggatggggtcacgaccgactgatcattgccccttctctgcgctaagcaagcagaaaacgtcgctgcaaggcagccct

SEQ ID NO: 87179 - DNA, 360 bp, Glycine max
  Peptide Sequence Number=SeqID_203957
gaaaaggctgagaaaaaatggttagatcggagtgctagcacaatggaattagttaaagaaaattatgacagcgaagaggaacaagtgaacaaacataagcaaatgaagaccagctctaaacaattgaagaaattgcaagagggctttaggaaggttgatttggaccgttgggaatttgcgaatgaaggattccaaggagggaagaagcatctgctaaagaacataaggaggaggagaaagtgcaacaaattgcatcagggagcattcaatatgatgaagccagacgtggattctgaagtggagaagctgaagaaagaccataacattttgaaggtggagattctaaagctgaggcagtag

SEQ ID NO: 87180 - DNA, 411 bp, Glycine max
  Peptide Sequence Number=SeqID_203958
atggcagaatcatctaagaagagaaaatgttcaacttcaaccaccaccgctataggccaacgcctccacgacacttccagtgactctcccgcaccacccaatccctccccatgctccttaactttgttttcctccaacgatcaacatcaaagtcaaggcatatcttttgagggcatcttggttgatgattggaaacatatttattctagtcatgatgctcgcaaaatggtttgcaatgaaaatgctaatatgacaggccgtttgcttgctggctcattcactttcgaatgtcgtatcatgcactacatattgtgtcgtgtcttgtttccccgtaccacaaatcttgctcaggcctctgaggaggatttgattatgttgtgggatcttcaaactagtcatcaaattgactga

SEQ ID NO: 87181 - DNA, 114 bp, Glycine max
  Peptide Sequence Number=SeqID_203959
atgtgggagaaggggaaagctgtggtggttggaggaagcgcaacccaatcggtggcctcaaaacggtcgtcattcacggtggctccgggtgtgttttccgggtgtatatgttaa

SEQ ID NO: 87182 - DNA, 429 bp, Glycine max
  Peptide Sequence Number=SeqID_203960
atggtggaaatttcaggaatagacgttacctatcaacccccggggactcagcttagacttctgaattcagttagtttttcacttccagagaagaggtacttaaatgattgtcttatttctgtcaattgcaacagttttggtttaattttcgggcagagtggaagcggaaaaacaactctgttgcagcttcttgcaggaataagcaaaccaacctctggatctatttacattcaagaatatgagagtgatggaaatcccagtcaacctccagagcccttggtgccggaaagggttggtattgtcttccagtttcccgagaggcagccccaagaagccgcaattaagctggctttccaacaccccttcacacccaaggctatgggcgtggagcatggcaatgcgggtggcccaacaatggatattggatag

SEQ ID NO: 87183 - DNA, 927 bp, Glycine max
  Peptide Sequence Number=SeqID_203961
atgactattgtacacattgttcttgctcttgctgcctctcaatcttgtccactacaccaattagatgtcaaaaatgcattcctccatggtgacctcaaggaggaagcacctagagtgtggtttgagaagtttcggtccactcttcttggtttttcattcactcaaagcctgtatgaccattctctttttctacaaagaacttctaaaggcatagtgattcttcttgtttatgtggacgacattgtggtgactggttttgatcaaacagctatctatgcaactcaccagttgttgcattccaccttccacatgaaagaccttggccaactcacttacttcctggccggtctcaccaatgcaagcactgttgatacccccatggaagttaatatcaaatacagtcgtgatgaaggttatcttcttgaagacccgactttatatcacagcatctccacctttcagcagtccatcacatcatctgatatcttcttggcacctccaatcattttcctgctggttcttcactccaacttcgagcctagtgatgctgactgggttggatgtccggacacaagaaaatccactactggttggtgtatgtttctaggtgatgctctaatttcttggaaatccaagaaacaagactttgtctctaagtcgtccactgaatctaagtatcgtgccatgcctgttgcctgctttgagataatttggttgcgtggcattcttacagaacctggttttacgcaagctcaaccaactccattacatgcagacaacaccagttccattaaaattgcatcaaatccagtttatcatgaacacacaaagcacatagaagttgattgtcactcaatccgcgaggcctacaaccgcaaagttatcactctaccttatgtctccacttctatccagcttggcctatga

SEQ ID NO: 87184 - DNA, 942 bp, Glycine max
  Peptide Sequence Number=SeqID_203962
tcaaagccaagcttcagctccacaaatcaacccagtttctcaaagccacaccatcaggaaaatcaaacatcttactctgggttggttgatagcagagaagataagtctcaagaagaaacacctgcaataatctctgagctctttgaaggttttctaacaattggaactcttggtgcagaaacagtcaccaatgaaccaggaacaccaacatttgctatgccttcagaaaacataacatcgagaagtgaagaggtgacaggaaatgaactgaagctcataagttacgagcttgagaaatttcttgagactgaaaaagaagaaagtttgtatgattcatcaggaagaaacagctatgttagcattatcacacttagtgaaaaggaaatagatggacccaaagctgaagattacagaaacaaagctgtatgtccactgcaaggatatttactggggtcctcatttgaactaccagaaacaaaagaagtaaggaaagaaagagcatctcttgctgagctactttataagacaaagtcaacaagtcaagattgtatagacacaggaatacaaggagaaacacaagtcaagagaacacctaagtctgctgccatgcatattatgagaaagatattgaaaagggtccacagttcttcaaaaagctgtaacacttccaggaatgatgctgattctgcttcaaccaataaaaaactccaaaaggcaacaaactctgtttcttctgcttccgcttttccgagttcaatctcacagaaacttgatgatttgaatttctcactatggcgacagaaaattgagcctgtcatcaaatcctacaaacttcaaaggtttgttacgaatccgcaaattccgttacagctcctcactgaggtaggccgcgatgcagggattgagaatcctgcctatgaggcctgggaacagcaggatcag

SEQ ID NO: 87185 - DNA, 570 bp, Glycine max
  Peptide Sequence Number=SeqID_203963
atgaaacttattggttatcaccctacaggtggttacaagctatatgatccaaggaataagcaagtaatagtgagtagagatgtggtgattgatgagacaagaggatgtgattggaaacttgaagctgggagtggatcaaccaggatgatagttgatactagtaatcctattgaatctgaaatgaacacaagtgcccctacagaactcagaagatcaacaaggggtgaattggtgcactatccactgatggcaaaggctaaaataattgagtttgaaaagccagtgcaggaaccaaagtggattaatgctatgaaagatgaaatcggttcaattgagaggaaccaaacctgggaattagtaagcttacctcatgataagaagcctatagccttaaaatgggtatataaagtgaaagtgaatccaaatggtgaagggatcaagcataaagccagattggtagctaaaggattcttgcaaaaagtaggaattgattatggtgagatttatgcacttgttgcaaggatggaaatagtgagattggtggttgcaattgctaacttgagaggatag

SEQ ID NO: 87186 - DNA, 960 bp, Glycine max
  Peptide Sequence Number=SeqID_203964
atggaggaacttaaaagagttcaatctgccaaggagcatgatgcttttgaggaggccatgcttcagtctcttattgaagcatctcttgcaagagctaatgatgatatatctgatgtattggatgaagacatactcaggctcatggaaaaagcttatgtagtgctagagtctatgtctatagaggctataattgtaagtctagaacagaggaagattatacaactcactaaggagccaatcaaattgacagatctcctcaccatacttgacaaacgattgttgaggacaactaaacaacaagaaatagagtggatcttgccttcaagacctccttttcaaactcaaccaagtgtatctatacatcccaacctcaacaccagactatatcatggtttcagaggatacaaagtcttagaatggaaaacttgcaacaaagtttggaaagaaaaaggagtggttggttctcatattctgcattctaaaatgcaagaagtggagttagataagctcagtctgctaaacctatggaaagaagacttccatgggataggtcctttcaattatccctacaactacattagggaagagcaccttgatgaagagccaattttataccaagttaattgctacaaaggcaaagagttgttaattgaagaagatgaagatgctccaccaactagatatatgaaggcttgcccgaaaaggatctttaagcatgagcttgaagctctgatgaataagaccaagcttacgagtctagattggtctactataaaaaggttctacatacttaaagctcattgctctagtctggaacctgataagaagcccattgcagacgcactgcaattgatcctaatgctagctatggctgtagaagtatatgatcctcctccttcaagggaatatgtcagattaatagaggctgaactacttaagacgagggaagaacttccatag

SEQ ID NO: 87187 - DNA, 249 bp, Glycine max
  Peptide Sequence Number=SeqID_203965
atggttgtcggagagattaccacttcttttccattgaaggtactgaagttctcaaggaaggtagtccatccaacacagttaaaaagtcctttgatagggaaaccctcttcttctaggctttggaagttcacccatcatctagggatgaaggaatccactaagaaagcattcttggcctcttcctcgatgttgattcatggaatcacatcaacttcacttctctttggtgccattgttcataaagattga

SEQ ID NO: 87188 - DNA, 225 bp, Glycine max
  Peptide Sequence Number=SeqID_203966
atgacaagtgcgagtagtgcagttcctgattctctaccaactaagaaggtgaagttacagaccttgaggaggcaatacgagttgttgtcaatgaatgatgttgctgtggaaattgaggaatcaaaggatcttgatttaatgagtgttgaagagttgcaaaactatcttgaggcacatgaacaaagaatcaatgagagaaggaacactgaaaaggctcaagaatag

SEQ ID NO: 87189 - DNA, 486 bp, Glycine max
  Peptide Sequence Number=SeqID_203967
atggacattatgctttatggtggtccacgcccagtcacagacaataagaaggagattatcagtttccataaaaccactaacctaacctacatgtgtagactgaatcatagctatttgttcagcatggtgatgccaaaattgtggtcgcaagactatgtcagtgacagggatagattctacacgaacaaggttatggtaggagagaagatgcgggccttcaaggacaagctcaaccccaaggttaagaagaaccatattcattttggaatgttattcactcaaatcctaaggaatgttggagtgaatgtctctaccatggaattgtctgttggagcttcacatcttgaaggagtgacctttgtgaagttgggaattgttgacaatttcccaaaatatgctcaaaagcatattaagaaaaaggtcaagaaggaaccaaaggaagaaccacactctacggtcggacagacaatgggcactcaggattaa

SEQ ID NO: 87190 - DNA, 354 bp, Glycine max
  Peptide Sequence Number=SeqID_203968
atgataaacacggtgttgtctcccctgttctacattgatgttattgagaccaagtgggaacatgatgacatgctccatgtggatcacttctctgggttcctacatagccatccttatgcctttctatcatccttcacaatgcccatgctcaaagtggtcatttcgcccgagatgctttcgttgtctactaacattgcgatgtctttttctgattctaactccttatccaaggcttgggtaccactcggggtggatttggtggatctcgtgtcgaaggatgagggagagaatctgaagaaggacacgtcgtacgaggaggatccatctatggacgatgaggaccccaccacatag

SEQ ID NO: 87191 - DNA, 714 bp, Glycine max
  Peptide Sequence Number=SeqID_203969
atggttaccataagtatagaagccgaaagcacctcatcttggtatctagacacagaatgctccactcatatgtctgtcaggagggattggttgattagctttgatgaatcaacaaagaacaaaataagatttgttgatgatagcacactcaaggaagaagaaattggtaaagtgctgatcaagaggaaggatggtaagaaatccttcatttctgatgtcctatatgtgtctggtatgaagagtaattttttgagtctaggaaagttattagaaaaaggatttgtgatgaatatggagaacaattttttgaaagtgtttgatagtaagagaagacttgtcctcaaggctcacttatctcaaaataggacattcaaggttggaaatgatgtcatgaaacataaatgcctagctaatgtagtatgcaagtctgagcagctttggcatcacagatttggacatttaaatttcagagatctaaatctgttgaacaagcacaatatggtttatggattcccacatatggaagttccaagtgaagtgtgtgaggaatgcttggagtgcaagcaaaccaagagttcattcaacaaacagattccaactagggccagtgataagcttggtgtgatttactctgatgtgtgtggtcctatccaatttgagtctcttggtggaaataggtcatttgtttcctttattgatgacttgactaggaag

SEQ ID NO: 87192 - DNA, 279 bp, Glycine max
  Peptide Sequence Number=SeqID_203970
atggctcaacgtaaaaatatctacaagattccttctggggcctggagagaaaaggacgaatataatgttaggatgacaatgatgcaatgtggcttaactgatcaatggctaagctatcctcccggtattcacatcagacgcaccaccaccatcaagttcatgcctgatcgaatagctccgaggttgccaccattggatcccacaaagaagaaaggcgaggttcctcctcacaacaagcctatgcctcatcaaggcccaaaagacaatgttgccttatga

SEQ ID NO: 87193 - DNA, 318 bp, Glycine max
  Peptide Sequence Number=SeqID_203971
atggtgtataaacggaggaggaaattgtgtcccatcaattgtaggttggaattccgcatccaattttctttgaatgttgtaggcattctcaacaagaaaggcaatgggaaaacggaaactggtaatgtcttcggtagtggggttgaggtctacagcaggtgggcgttgatgttgaaagcgatcaaggtgaatgggagatggaggtgtttcatactgaacttcatcatctatatcgatagtggattcagttctcttcttcttcctaagatggattgtctcaattcttcacaggcttctctcaaactgttgaacaattaa

SEQ ID NO: 87194 - DNA, 456 bp, Glycine max
  Peptide Sequence Number=SeqID_203972
atggagatgcaaaaagaggtcgatgttgttgaacctgcgctgactgaagttacttcacaacctccacaaattgttgaagataccttagcaactatcagcatttccaatacacctcgcgagatcactcctttgaccacctttgctccaactggtctgtctgaagagagaattcgtgtgccttcaacaggacaacctagaagagaccatgaaaaaaagaacactttggagtcttcactcaaatccttcaatgattttgtgctctttaacatgaatttgatggtggaacaaaggttgcctccattcatccaaacacccccgtcaccaccaactactattgtacaacctcatcctgaggttcctacacttgcaataactgttgatcttgtgctcgtgcctccgcatttgccaccaaagtcaccacctcccattcctcaacctctgtccactaaaggttga

SEQ ID NO: 87195 - DNA, 213 bp, Glycine max
  Peptide Sequence Number=SeqID_203973
atgatgatgcttagacttgggcctaaaaactatgttagcggcaaggataggttcaacatatacaaggtgatggttggtgaaaaggccttcaagcatcgattcaaccctgaactcaagaaaaaccttattccctttggtatgttgttcactcagattataaggaatgttggagttaatgtgtttgggatagcaccgtctgctggagccttttag

SEQ ID NO: 87196 - DNA, 663 bp, Glycine max
  Peptide Sequence Number=SeqID_203974
atggagctaaatacaaaagctcattatactctgagatgtgctttgtccaacaatgagtataacaagatctgtagactaaagacaaccaaagagatctgggactcactgaacatcaattatgaagggacaaaagatgttcaattaagaaaaattgtcacactaacaaggcattatgagagcttccccatgaaagaaggagaacatgtggatgatatgtttagaagacttcaagtgcttctaaatgatcttgaagctctaaggcacaccttcaccaaagctcggataaatctgaagatcctagatagctttcccaaggtatgggaaccaaaaacaaccatccaagaagctagaaatatgaaaaatctagcatgggatgaacttcctaagaagactagctccagaagaaaagaaaagatgagcttctctaaagatcttaaagtgcaaatggctagttcaaacaatagttatggagattccatagatgatgaaatgactctcatgtctagaaagttcaaacaaatgatgaaaaagaaaggaaagtttcaacactcctccaaaagaaaggacacaagattcaagaagaaatacaaggaggaaagcaatgagatcatctacttcgaatgtcggaaacctagacatatgaaggctgagtgtcccagctaa

SEQ ID NO: 87197 - DNA, 154 bp, Glycine max
  Peptide Sequence Number=SeqID_203975
gtatccatcatattgcagatcaaacatatggcctagaaacgctttaccagaacttgaagtggctttcaaagcacttgggaaactgatatttgacattggattgatgttggcatatcactgcgatcaatatggtaagacagcaattgatatttaa

SEQ ID NO: 87198 - DNA, 261 bp, Glycine max
  Peptide Sequence Number=SeqID_203976
atgaggattcttgtcatgggtcaaggttcaaagcagcttaaggttgtgtctcaacatgggtgtcgatttcgggttaaacttccatattatttccacgaggcacgcgtaacattgatgatttgggaacaacatgaaaaattagtcatggctacagctaggtgggtactcaagcatccagtttatggcattgatgacgttcctaaaggaaaactctacaaggttctagaatttcaacaaacattatcgacaataacgaagtaa

SEQ ID NO: 87199 - DNA, 363 bp, Glycine max
  Peptide Sequence Number=SeqID_203977
atgacaagcagagaccaagtttggtcattctgcacccatgatacgcggagataccttatggttatccgcacccctttgccattcagacacagtcgtgtccgatggcacgcagagaccaagtttggtcattctgcacccatgatacgcggagataccttacggcagacacagttgtgtccgatggcacgcagagaccaagtttggtcattctgcacccatgatacgcggagataccttacggttatctgcacccctttgctaggcagacacagttgtgtccgatggcacgcagagaccaagtttggtcattctgcacccatgatacgcggagataccttacggttatctgcacccctttgctag

SEQ ID NO: 87200 - DNA, 525 bp, Glycine max
  Peptide Sequence Number=SeqID_203978
atgtcaattttagcagaaaacataaggtatttgagagatcaattgaaattatctcaacaatccgtagcagataacttatcaatcacgcgcggacggtatgcgaagtatgaagatggcgcttcgcaacctccgatagagctattgattaagatgtccaggtattacagggtaagtatcgatctgatggtaacgatagaccttaagaaatatccattaaatgatattattaatcttcccgataacagaattgtgcttcctgtcgtagttgatcaatcgggaaataacagcattgaaattattcctcagaaagcatccatgggatacctgtccggatatactgatccagggtacattgaaagcctccagaatatctccctaccctttcttacaaatggaaaatacagggcttttcctgtagaaggagattcgatgccgccttttaaagatggttcttatattgtcggaaaatacattgaaaaaacagaagacctgaagcctgataaaacatacatcttcgtgacgtaa

SEQ ID NO: 87201 - DNA, 261 bp, Glycine max
  Peptide Sequence Number=SeqID_203979
atggacctggatacattttttgtatcctgtgagcgtcttaataactcagaacttaacggaatccctctgatcataggaggtggggaccgtggggtagtagcctcgtgttcctatgaagcaagaaagtttggagtacgctctgccatgccgataagaatggcacttaagctctgccctgatgctaaagtgatccgtggagatcatgaaatgtattccaacttatcccatctggtaacagaggtcattcaaagaggggttccg

SEQ ID NO: 87202 - DNA, 309 bp, Glycine max
  Peptide Sequence Number=SeqID_203980
atgttctttggagttttccacaggatatggaaccatgagaaggctacactgcttaacagttttgataatcatgattttcccaacaaagaaatttctaagctctgccttgtaaatgagcttgatgatagcttgcttcttgctgcttcatctgatggaaacattcggatttggaaggactatactctgaagggtaaacaaaaacttgccactccattctcttcaattcatggtcataaagctggtgtggttgctctttgtttattcttgggaatgtgggatatctccctcaaccccaatgtcctaaaatag

SEQ ID NO: 87203 - DNA, 720 bp, Glycine max
  Peptide Sequence Number=SeqID_203981
atggtggccttcttcttcttcttgaaagaattcgtcaccatcggtgaaaccttaagttcaccggacaacctcctcctgggagaaaacaaagccctttgcaaacttggcgatgggttagggttagggttagggattggggatttgttgtggttgttttttaagggagagaacgaggcggccttggaggttgagccaccgcttgtaaaccagagagttggagttttgccaagcgaaggagaagtggaagcagttgacgtggacgaattggtcgagttggagatagtgggaaaaaaggacgtaggtggactagaggtcagagctggtgagggcggggacaatgtcgatgtcctagttggggagtgggtgctacaagaacttgaccagctcatgcaacatttgaaagttgaattcaacctccaacatccacaacaacaactaactccaagatcactctacaaattgatcaaattcgatggagcaacttgcaaggaagaattgccaaaaagagaggccgagactactaaccctgattcaaaaacatgcttcttccatactattatgtattgttgcattggggaaggagggtttgctggtggtggagggactgctggtggaaggaccaccgatagtgcatctagagcaactcgggccctaaccttccttggccctgggaagatgatggaagggtctgctggatttcagcagttcttctggatatag

SEQ ID NO: 87204 - DNA, 177 bp, Glycine max
  Peptide Sequence Number=SeqID_203982
atgggaggatatgagcgaaaggttgaaggattaagtctttggggaagaagggatagggttagagaggggctgggctgctgcacaaaaagaaaatggaagtttcgggaaagggggagaaagggacaattaatcaacatgagaggagagaagcctctaaagatacaaaaggtgatctaa

SEQ ID NO: 87205 - DNA, 165 bp, Glycine max
  Peptide Sequence Number=SeqID_203983
atggcggtcacgaaccctagcgacgacgatggtgaggaggagacgacagtgacaagtcttcgcgagcgagagcactctgctcggacaaacatgttagcagctgaaaaggaattgattttgcgttcctactttacgcagtgtcaaagttatatcagatacttctaa

SEQ ID NO: 87206 - DNA, 300 bp, Glycine max
  Peptide Sequence Number=SeqID_203984
atgaaggtctggaatcaatacttcatcgcccccgctgtcataaaggacgcttgctatattattttccttcacaacaaggagtcccagatggcaactcttagtcttcttggtgtggatagcgtactgaccacgctttttgtggcagcttcttcttcaaaatggaagggaatatcattcaacggcggtcaaacagggacccgtcgttatcttattcccatttctacgacgcgccttaaaaccccgatgttgacattaacccaatacaacgacggtcataaataccccccgacgttgacatga

SEQ ID NO: 87207 - DNA, 420 bp, Glycine max
  Peptide Sequence Number=SeqID_203985
atgtctcttgcaactctttttggaaagcttcaggaacatgagatggaacttattagactccatcaacatgaagagaataacaaaaagaataaaggaattgaactcagagcctcatcatcttttattcaagaagaaagtgacaaagaggacttgaatgaaatagaagaagatgatgatttcagattttttgtgaagagattcaataaatttcttagaaacaaaggaaatcaaaggagatcaaacatcaatccaaagaagaaaggagaagattcctccttagccccaaaatgttatgaatgcgatcaacctgggcacttgagatttgattgtcttgtctttaaaagaagaatggaaaaatctgacaagagaaatttcaaagaaaagaaaagaaaagaaagaatacatcacttgggaagataa

SEQ ID NO: 87208 - DNA, 111 bp, Glycine max
  Peptide Sequence Number=SeqID_203986
atgccaaaaacttgttcgcttccggcaagtgcaccagatcgtgcaagtagtataaaacggtgtgtgaaccaactattaaaagggaaaaatcgcgtgagaaatgatgcgtaa

SEQ ID NO: 87209 - DNA, 510 bp, Glycine max
  Peptide Sequence Number=SeqID_203987
atgagcaacactagaggatcacccttgaggattattcaagcaaactcaatgctgcaattctttactagcattgcacgtcctgaagggaatttattccaaggattacctaatgaagaccctgcaagctttggaaagtgttgttttcaccctctcgctaagccaatctgcttgcttagcgagcgtctgctaagcgcaaggaagaatccagaagaagataagttgtacagattagctaagcgcaccgcttcagttcatccgccaagcgagaaaggtgctctaagccaaaaatcactaacgtgcgctaagcggtccatacaagcgcatgagcacaaacaaggtcacctatttaagcctgaaatcagattttgtgaagagagtttggactgggatttagagctttgcatgtctagggtttctagagagagaaagctccaagttccagagagttttgagagattttgctgtgtgaagatctgcaaagaccagagcttgaaacaagagccggtttga

SEQ ID NO: 87210 - DNA, 636 bp, Glycine max
  Peptide Sequence Number=SeqID_203988
atgtctgggaaggcgaagagaagagacgatgacggtgcttctgacaccgactctaactccgaaggccatgtgtcgcccaagaagtccctcaagaaggattacgacgatgatcctgactctattaccatttgcgaagttgttcgttgcccggcaagtgtaccggggcgcgcaagtagtattaaaacggatatttctctacttagcagtgctcctgtattctatgttgaggtcctaactactaaaccccgatatctcccttccattgtgaggaagctcatttttacaagtttaaagaagagaagaagagaaattgaaaaagtaaaaagtggtggggatgtctcctccacctctaaaaacctcacaatctctcaaaaactccttcaaagctcttcaagatgcctcttttggtctgctcagtcgcctctgagtcagcacactcaaaactctcttccaattctgtgttttcagatttcgaacaacaagagggtttccgtgaggaagtggaaaggcaacattatggttgacattcacgagttttacatcaaagatggcaagcaattggctggtaggaaaggaatagtaagggttttaggtcagactttttcaatgctattatattgtctcatccttatgtga

SEQ ID NO: 87211 - DNA, 234 bp, Glycine max
  Peptide Sequence Number=SeqID_203989
atggaaaaaatctccaaagtccaagaacgggagcagcagtcagaaggatatgttcaaagtgttgaatggagcactccccttcctaggagtgtcaaatgtgatgttgatgctgctttttttgagaatgtgatggagatggacattgggatatgtgttggttgcgttgttgcttcatctagcagcaaaggatgcactgcagctcttcacggtcatgctcgtcgatggtggcaatga

SEQ ID NO: 87212 - DNA, 342 bp, Glycine max
  Peptide Sequence Number=SeqID_203990
atgaggcttcactgttatcaagcaagtcggagacccaacatgaccacagatcgacctccactccttatggctctcatagacccgggtatagggactaatatctcaacgtgtgggcaaagtcccagtggagtcaccatcagtcgcaacctaaccttcgacgggagggcaagacgaaaagaaaaagggtcgacaagggggtgcccttgctcctacgtatcctcaggaaaatgggcacttggggcaaaggcagctcgcccaggcgagctgaaacttagtgctgaagcaatgagctcacccaggcgagctggagctcgcccaggcgagttggtttcttcaccatga

SEQ ID NO: 87213 - DNA, 537 bp, Glycine max
  Peptide Sequence Number=SeqID_203991
atgcttcgggcttccggaatacaatgggatctccggaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgtttttatagagaaaaagagccagaatggaatgagtttgagtatcgatttattagtaaaaaaccgtctccgacttttgaattgccaaaacaagaactttatgtaagaattgaagcccccaagggagaattgggaatttttctaataggggatcaaaatggtttttccctggagatggaaaattcgtccgccagagatatatggaattatatgggtatttgcccctattttgattcttatattgggaattacgataagtgtactagcaattgtatggttagaaagggaaatatccgcagggatacaacaacgtattggacctga

SEQ ID NO: 87214 - DNA, 366 bp, Glycine max
  Peptide Sequence Number=SeqID_203992
atggagagagaagcaagagagagagtgatagaatcattgcatggagaagctatgaaatggatggataggttcgttctcactctgaatgggagtcaaaagcttccaaggttgttagccggagccaaggcaatggtggacgtatactcagctcctgaggaggttcatgggcttttcgattatttcgtagtcaaagtaaacaaaataaccaaaaagaatgaacacgctttacgacacccctatcaaacacgtgctaaaaccaaaatcatgtgtgagatagaggaagtgcaagagaagatgaaggccgacatggaggccatgaaggaccaaatgacctccatgatggaggccatgttaagcatgagatga

SEQ ID NO: 87215 - DNA, 848 bp, Glycine max
  Peptide Sequence Number=SeqID_203993
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgcctccgagactatcagagtcttttgtcttgtagagacaatcaaggtcatctgcctttctttgaagacttcaatgtctttcgatcaagactattacaatcttcttttccttccagagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 87216 - DNA, 471 bp, Glycine max
  Peptide Sequence Number=SeqID_203994
atggatgaagatcaatggatgtataatagtataatgtctcaaaaagttgatatgaatgaacaaaatgaagatgaagctggtgtaaatgaagaacatgttgattgttctaatgcattcaatacttctcaagtgtttgctacccgagatgatattctgcattgggctcgatgtgttgcttatgaaattggatttgtgacgatgattatgaggtcagacacaaacactggcacaagaggaaggacttcatttatcttaattggtcgtgaaaggagtggtcaatataggtctaggaagaatgattttgtaagaagagatactgacactaggaaatgtgggtgtccctttaagcttcgtggaaaatcaattgttggaggacaaggatggatgatgaagttaatgtgtgggagtgacaatcatgaaatggcaaagtcattagttggacatctatgtagaagcaaagcttcatggtga

SEQ ID NO: 87217 - DNA, 699 bp, Glycine max
  Peptide Sequence Number=SeqID_203995
atgcaatctcagggacttgcagtgcctcctgagcctctggttggtccctccggtcctcgagtgagcacaaaggggagttgtgttgatccctcaggaaacgatcctgagacgggtgactctgacaggtgcggcttgtacatagaagtagatcatgcctgcctggttgccatggggagagtttatgagggatccactattgttcataacactcctttgttgcctagccaagtaaaggtgagtttggaggaggttacagatgcagatgcttctgttcctgtacccactgatgagatttccttagaagggcagacacttcacacattccttgcttggccgacacatctgctcaagtctttatcacagcaggtagctgcgtctccagcaaaacctcctccgaagcccgatccggagatcgatgatccgctttatctgatgacattgaccatcccagagcttttcttgaggccttatcagatttcccctctctacataaagcacgaagacctctccgaaaatcgcacacggtggtcaaatgtctcagcatatcagtgttacagttgtggattctgcatctcacttaaacatgtatgcgagtggggaattttgatatctatggattcctcgagccacagtccattcagaggttccactacagcggacactggcagatggtcgtcatcctgcccaaggaacacctag

SEQ ID NO: 87218 - DNA, 342 bp, Glycine max
  Peptide Sequence Number=SeqID_203996
atgtgtactgttaggggcttgagcattgaaagatgtattgtctccttagaacttgatagagcaggattaggttacctaagaggaccaaccgcctttagatatctattttcacacttacttgctcattgtcgcaacctacccttcgatgggagggcgacgcgaggctcacaggtgcgtcttccaagaaaggaaaatgcacggagtcgccaccaacgtttatttgaggaaaacgtcggaaaaaccggaaaggagagaaacgttaaggcgttggaccatgaacgatctcttggggtggtcgacaaaagcggggcttttgctcctatgtatcctcaattgcgataa

SEQ ID NO: 87219 - DNA, 914 bp, Glycine max
  Peptide Sequence Number=SeqID_203997
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcattctgggcatttcggtgggacttcaggagagaaggggaagtttgggctcaccaccgcacagattctgagggttgtgaagaagctggcccacgcaggcatgctggattgcttgcaactgctgcattttcatattggttctcagattccctcaaccgcgttgcttgctgatggcgtgggagaggctgcgcagatatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 87220 - DNA, 186 bp, Glycine max
  Peptide Sequence Number=SeqID_203998
atggggggtgaacttagtaaaagggggtgcctcaggaagcttcttgagaaagccacttgctcgtcgtggcgagcagacctcgcctgggcgagctgggcggtgtttcaagtgaaaaaaaattgtttccatcaaaaaattgtttctaagctgaggtacttccataacgcttccgagacgtttccgtga

SEQ ID NO: 87221 - DNA, 207 bp, Glycine max
  Peptide Sequence Number=SeqID_203999
atgaaaacgcaattcatggggctccgaaaaatggttgagaatggagaattgcacaaagcaataactacgcatggctcgaaactcgaagttggagggcacatgaacgataacgcaattcatggggcttcgaaaaaggggtctagaattgagaattgcaccaagcaatcactacgcatggctccaaactcgaaggtggagtacacatga

SEQ ID NO: 87222 - DNA, 390 bp, Glycine max
  Peptide Sequence Number=SeqID_204000
ggttttgccttgcaaaccttcccggtgatgcttttagtctatgggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctggggtttgttggtgatttggaggggagggacgaatcaaagcgacaacgggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 87223 - DNA, 359 bp, Glycine max
  Peptide Sequence Number=SeqID_204001
tacggaatgcagcacagaagcataaaccaaagagggtggagagtgtcaatgctgatgcagaagcctttgttgaagcactagaacatacgaagacaagagatacaggccatcaaagtgtgtcattggagaataagacaggagattcaactgtgctgaagataggagattcggctaaagttgtgataaaacaagacatgaagggaagaaagcataaatatgggtttaacaacaataaacgtgagaagacagagaagaaaagggtggtggatgatgaaactggcgacaaacataagctgtatgaagtcctaaggataccatgtaaaacaaaaaaccgatgcctcactcagagaaaaatgtag

SEQ ID NO: 87224 - DNA, 231 bp, Glycine max
  Peptide Sequence Number=SeqID_204002
atggcagggatgatcaacaaaccacatgatgtcagatttcctgaattattagatccttcaggtctggatgctgaggcattggaagctgagattctggatcttgctgagtctgttagagggacaatattgcagatgacaaatgaatattttgtgtctcaggctatggctgactatcctcaagcccctcgttcgaatctggcagttcaaattgcaaatcaacctgatatttga

SEQ ID NO: 87225 - DNA, 645 bp, Glycine max
  Peptide Sequence Number=SeqID_204003
atggcgctgctattcaccctcgctgccggattcttcggactctggtcggcccatcgatccctaggcgtctttcacggcgatgtccagcgccacatggcggcggaacgccttgccgccgaggtggaaggccacttcaaaacccaggtccaggaatggaagaacgtgctgctgcgcggctcggacaacgcgctgcgcgagcagcactggaagggctttctggccgatgagcgcgccgtgcaggacaagaccgctgccttgctggccctggtggacgatgcctccctgcgcgagatcgcccagggctttgtggcgcagcaccgcaagatggccgaaggctaccgcgtggggctggacaaattcgaggccacgggcttcgacccctcagtaggcgacatggccgtgcgcggcgtggaccgcgagccggccgagatgctctcccagctcaaggccggcattgcggcgcagagcaaggcggtggccgacgatgcctacagcagcggcaagcacgccacggaactgagcctggtgctgatgctggtggcggccgtggccggcgtggccattggctggctcatcacccgtgccgtggtggcaccgctgcgcagcgcggtccagctggccgagaaggggcccagggccatctga

SEQ ID NO: 87226 - DNA, 267 bp, Glycine max
  Peptide Sequence Number=SeqID_204004
atgcaggaaggtctttggatcagacaacatctgaacaaatacagagttgtcaccaatgtttcctctaaatgctcatttagaagcgaaatgctaaacatcccttgttccttaaatgacctttcattcaataaaaacatattttgcaaaaaggataaaaacaacttaaccaaacactttgttcacaaagaactacgtaggtctgatttccttatcgcaattaaggaatacgtaggagcaagggaaacaccctcgtcgactgcaaaatga

SEQ ID NO: 87227 - DNA, 205 bp, Glycine max
  Peptide Sequence Number=SeqID_204005
atgaattacttcacggaagaagcagtcttccgcagttgtaatgtcaactacggaagacagcttcttccgtggagtctcgcggaagacgtctttcgtgagattccacggaagaagcattcttccgtagttgtaatgtcaacttcagaagactgcttgttccgtggagtctcgcggaagatgtctttcgcgagactccacggaacaa

SEQ ID NO: 87228 - DNA, 528 bp, Glycine max
  Peptide Sequence Number=SeqID_204006
atgggcagtgtagagtattatgatagaattattaaaaacattgaaagaggggaggcaagaatatcccggaaagatgagatcatgaaagctattgggaagaagttggaccgctacaagaatccttggcttgaattgaagatacaatatggacaaaacaaagggaagttatacaatgaagaatgtgaccgattcatgatttgtatgattcacaaacttggctatggtaattgggatgagctgaaggcagcttttcgaatgtcgcccttgtttcgatttgattggtttgtcaagtctcgcacaacacaggaaattacaaggaggtgtgacaccctcattcggctggtagagaaggaaaatcaagaatatgatgagagggagaggcaagctcgtaaagagaagaaacttgctgctaagagcatgaccccgtcgaagcgttccatgcctagacagactgagagtccatctctgaagaagcggaagcagttaaccatggatgactatttgagctcggtatatatcttgcaataa

SEQ ID NO: 87229 - DNA, 756 bp, Glycine max
  Peptide Sequence Number=SeqID_204007
atgggttgtgggaaatctaaacacgatgtagcttctggaaacaccgttctccaacgcaagaaatccactgtcaattccaaggacaatgagactcaaaacgtggagaaaaacaatgatgctaatgttgacaatgtacgtttcgaagtggaagagaagaacaaggaaaatgtcaaggagattgaagttgaaggcaagggtgattatgagtccaatgatgttgctgggaatataacaaaggtgcagcaagaagataaggcattggagactagtgcacaagctgaagctgaagagaacaaggcaccggaaattgttgttgctgaaggaccaaatgaagagtctgaacgtggaaaagacgaatcattattgggaaaaaatgaacaggaaaaagtgaaggatgttgctgttgcagaagagaaacaaccaacggaagaaaagaaagaccttgaaaatgaaaaagtggatctgagcgtaaaggaagagaccttgcctttgatgaaggaagaagaaagcaaagacacaaatgaagaggctttggtgaaggaagaagaaaacaaaaacacaaatgaagaggctttggtgaaggaagaaagcaaagacacaaatgaagaggctttggtgaaggaggaagaaagcaaagacacaaaagaagagacattggaaaaggaagaagaaaccaaagaaacaacagagcagggaaagactttggtcaaggaaggagaaaccaaagacgcaaatgtttcaacttcaacctcctaa

SEQ ID NO: 87230 - DNA, 1224 bp, Glycine max
  Peptide Sequence Number=SeqID_204008
atgcaagttttctctaacgctcggcaagcctctcggcttctcctctcgcctcatctccgaagctcggaagctcctcactccaccgcgctctctctcttctcagggctcacgcaacgtgattcccggccagtgaacactgatccaatacaatgcttcttgtcgaaggctttttactcttccggagtgggtaccgttgaagcaactccatcagaggatgtgaaggaattatacgacaaaatgcttgactctgtaaaagttaaacgatcaatgcctccaaatgcttggttgtggtcaatgattgcaaattgcaaacaccagcccgatattagacttctcttcgacattttgcagaacctccgcagatttagattgtcgaatcttcgaattcatgacaattttaattgcaatctctgtcgagaagttgctaaggcatgtgttcatgcaggagctcttgattttggaatgaaggctttgtggaagcataatgtctatggactgactccaaatattgcatctgctcaccatttactgacgaatgctaagaaccacaatgatactaaactgttggtggaagtaatgaagcttctgaagaagaatgatttaccattgcaaccaggcacagcagatatagttttcagcatttgttataatacagatgattgggagttgattaataagtatgcaaaaagatttgtcatggctggcgtaaaactacgacaaacctcattggaaacatggatggaatttgctgccaaaagaggagacattcactcattgtggaaaatagaaaagttgagatccaattcaatgaagcagcacactttgataactgggttttcttgtgtcaagggtcttctgttggaacgtaaacccagtgatgcagttgctgtcattcaagttctaaatcagaccttgtctgatacaaagaagtcaggcatcaagggtgaacttcagaagcttgtatctgagtggcctttggaagttattaagcaccaaaaagaagaggacagaaaggcattagcagcctctttgaaatctgatatccttgtcatggttagtgagctactgagcatgggtcttgaggcaaattggttacggttttggttgcatagtagtggtatatcagtagattatgttggaacaaaaataatctggcatatgtcctctactctgaactgcaagaaattgctttcacaagtgagagatacaatcatggctttttaa

SEQ ID NO: 87231 - DNA, 996 bp, Glycine max
  Peptide Sequence Number=SeqID_204009
atgattgggttgaatccaattgggcgatcctacggcaatattcttttctctcctgctcaagtcactgcgccttatctcatcccaagtggtgcaatcattaccggagaagatgcaggattcgtgctccctgctgcaacgagatctactcatgccgtcactgtcataacgacgctgcgcttgttgaagaatccctttgatcgccacgagctcgttcgccaagatgttaaacaagttgtttgttcagtttgtgacactgagcaacctaggggtggtttggataagctcctgattttatttctcggcttttcacattccctgttgttccttctgaaggttgctcaagtttgcacaaactgtggcgtcaaaatgggagaatacttctgcaacatctgcaaattcttcgatgatgatgttgagaaagaacaatttcactgtgatgattgtgggatctgcagggttggtggtcgagataattttttccactgcaagaagtgtggatcttgttatgcaattggtctgcgtgataatcatttgtgtgtggagaactccatgcggcatcactgtcccatttgttacgagtacctttttgattcattgaaagacaccattgttatgaaatgtggtcacacaatgcaccatgaatgttacgtagagatgataaaaaatgacaaatattgttgtcccatatgctccaagtcagtgattgacatgtctaagacgtggaagagaattgatgaagagattgaagcaactgtcatgcctgaagattatcgaaacaggaagaatcctcttgcgcatatcaattacacatgtatatatcaatataacgaagcatcttcttaccaaaagactccattgcagaagtttacttccacattcttggccaaaaatgtggtcactgcagatcatataatactcgtgcagttgcgcctccagttcttccccaatgaccagattcttgggttcaagaagggaaaactgtcagcagaaaattaa

SEQ ID NO: 87232 - DNA, 2368 bp, Glycine max
  Peptide Sequence Number=SeqID_204010
atggggaggccctccaagacgcaggtttcgaacgacttttcctccgaagaggaagaggaggacgcctccgccgccgccagccaccagatcgtagacgacgaggaggagctcgaagcggtggctcgctccgctagctccgacgacgacgataattcgccggatgaagccgctgaagacgacgacgaggataaacaggacgagagtaatgttgatcctgaagttagcaagcgtgagaaggccagattgagagaaatgcaacaattgaaaaaacagaaagttcaggagatattggatgcacaaaatgcgaccattgatgctgatatgaataataggggaaagggcagattgaactatctcctacagcaaactgagctgtttgctcattttgccaagggtgaccaatcttctcaaaaaaaggcaaagggaaggggtcgccatgcatcaaaagtaactgaagaagaggaagatgaagaataccttaaaggggaagaagatggcttagcaaatacacgactggtgactcaaccatcatgtatccaagggaagatgagggattaccaacttgctgggctaaactggctcatacgattgtatgagaatggcataaatggtattctggcagatgaaatggggcttggcaaaaccttacaaacaatatctttgttaggctacttacatgagttcagaggaatcacgggccctcatatggtggttgctccaaaatctactcttggaaattggatgaatgaaattcggcgcttttgccctgttttacgcgctataaagttccttggcaatcctgacgaaaggaagcacataagagaggagttactcgttgctggtaagtttgatgtgtgtgttactagttttgaaatgaacaatcttcatgaactctgggctcttctcaactttcttttgcctgaaatatttagttctgctgaaacttttgatgaatggtttcaaatctctggtgaaaatgacgaacatgaggttgttcaacaactacacaaggtcctccgtccattcctccttcgaaggttgaagtcagatgttgagaaaggtttgccaccgaaaaaggaaaccattctcaaagtaggcatgtcgcaaatgcagaaacagtattataaggcattactgcagaaggatctggaggttgtgaatgcaggtggagagcggaaacgtctcctaaatatagcaatgcaactacgtaaatgttgtaatcacccatatctcttccagggcgctgaacccggccctccctttacaacaggagaccatctcattacaaatgccggtaaaatggttctactggataagttacttcctaaactaaaagaacgtgattctagggtccttatattttcacagatgactaggctgctagacatacttgaagattatctcatgtttcgtggataccaatattgtcgcattgatggaaatactggtggagacgatcgagatgcttccattgaggctttcaacaaaccaggaagtgaaaaatttgtcttcttgttatctactcgtgctggaggccttggcattaatcttgctactgctgatgttgtcattctttatgacagtgactggaaccctcaagttgacctgcaagctcaggatcgtgctcataggattggtcaaaagaaagaagttcaagttttccgattttgcactgagtatacgattgaggaaaaagtcattgaaagggcttacaagaagcttgcacttgatgctctggtgattcagcaagggcgattagctgaacagaagactgtaaataaagatgagttgcttcaaatggttagatttggtgctgaaatggtttttagttccaaggacagtacaattacagatgaggatattgacagaattattgctaaaggagaagaagcaacagctgagcttgatgctaagatgaaaaaatttactgaagatgctatcaaatttaagatggatgacactgctgagttgtatgattttgatgatgagaaggatgagaacaaatttgatttcaaaaaaattgtgagtgaaaattgggtcgagccaccaagaagagaacggaagcgcaattactcggagtctgaatacttcaagcaaacaatgcgccaaggtggccctactaaaccaaaagagcctcgtattcctaggatgcctcaattgcatgacttccagtttttcaacacacacaggctgagtgagctgtatgaaaaggaagttcgctacctcatgcaagcacatcagaagaatcaggtgaaagactccatagatgttgatgaaccagaagatagaagggttaaaaagggtatttgcttggaagaatactggggagtgaaagtagctaagaacgcttatagtaattggttagttg

SEQ ID NO: 87233 - DNA, 177 bp, Glycine max
  Peptide Sequence Number=SeqID_204011
atgacgacgacaactatgatgagcacgccgacgacaacagaagcaataacaaggagagtcctttcgacacaaagcgacactttgaacacaaggaggtttgggggtgtgcaacaaagagcgcctcaaagtagtcacttgctagctagctatattgtgaccttctcaaatgattgttaa

SEQ ID NO: 87234 - DNA, 144 bp, Glycine max
  Peptide Sequence Number=SeqID_204012
atggagattggcttgccctccaattttagacatgtttcacatgttgcctttgatcgtttcaatggctttcttggtttgcctatggagttcaaagctgaagcccccaaaagggctcttagtgccagttactatagtagtcattga

SEQ ID NO: 87235 - DNA, 243 bp, Glycine max
  Peptide Sequence Number=SeqID_204013
atggtggtcgggttggtggtggttgatctggtggtggtggaggtgcttctgagtaagcatgtggtgacagttcagaatggatgggtggaggcgaattacttggttatggagagttgtaggtggacacattcattgtatgaaacaatacagtctgattccatgaggtgtaggcatcatgacatcatgcctgtgcaactctctcaccaactttttgttgctaaacaagctcctccagtcccttga

SEQ ID NO: 87236 - DNA, 432 bp, Glycine max
  Peptide Sequence Number=SeqID_204014
atggagaagatgagggaagaagaaggaatgagaggtatagggagagaagaaatcataaaagatatggaggtagaccttcacaacaagcttcaaagactaattcaaggaaataagagtgtggacgagtattacaaagggattgagatttccttgattagggctcaaattgaagagtatcaagaggctaccatggcaaggtttttgcatggtctcaataaggaggataaggagacattcaagaagaagggaggatcttcattcaaatctcatgagaaagatgctgcacttagtaaaaataatttaaaccctactctcacttcttccaaaacaagtttattaaatgttttaagtgcttgggaaagcatcatattgcctcccaatgtcctaacaaaaggactatggttgtgtcggggaatgagaatgggaaactag

SEQ ID NO: 87237 - DNA, 319 bp, Glycine max
  Peptide Sequence Number=SeqID_204015
gattttaagcaagggaagatcaacaaaggaaaaagctttcagattcaaggaatctaattccaacaccatgagagcattgttgcctagtacgacagacatttatccatcccagccaaaggacttttatgattcaatttccaattttagttttattctctttaagcggaactatcttcttgggaaagttgaagtcattttaagttcttctaaacctttaaattttctaggttttgggctggcctgtcatattagagttgaggccaatctcccaacaattgtgattggaaagaatgttagtattgatagtatcacttactga

SEQ ID NO: 87238 - DNA, 333 bp, Glycine max
  Peptide Sequence Number=SeqID_204016
atggccaaaatacatcatcaagcatggccaacaaaaacatatcatccaatgaaacataccccccacacttattcccaaaacaattccaaagctccaaaattccttaagggtagggggaacataggctcaaaggggctatcaaaggaattaattcaaggtaggctcatttggctagaggcttataagaacaaaatgcctaaatcatctcccaacatgcatgtgaagcaagaagtatcaacaagagtcaagccaaggctattgtgcaagcaatcaatggggcaaaacacaccaaataaaatagatgatgatggctcaaattctcaccaagggtaa

SEQ ID NO: 87239 - DNA, 498 bp, Glycine max
  Peptide Sequence Number=SeqID_204017
atgacgggtgagatgttctttctaacaacaggaaatgggactgtggaagtactttcttacccatctcttcgacctcttgacactctcatggctcatacagctggttgttattgcatcgcaattgatccagtaggaagatattttgctgttggaagtgctgattcccttgtcagtctgtgggatatctcagagatgctctgcgtgcgtaccttcacaaagctagaatggcctgtccggacaattggcttcaattacactggagattttattgcttctgcaagtgaagacttgttcattgatatttcaaatgttcatactggaagaacagtgcatcaaattccttgtagggctgctatgaacagtgttgagtggaatcctaaatacaatttacttgcatatgctggtgatgacaaaaacaagcatcaggctgatgaagaggcaccgtttttactggtatttgagaatgcaaacaaagagcctgatgaggttgatttgtaa

SEQ ID NO: 87240 - DNA, 789 bp, Glycine max
  Peptide Sequence Number=SeqID_204018
atgggtgaaacaaaagacacccacatagtagaaatccctgtagatcaagaacatcacaataatcaccacaagaatgtgttgtgttccatgacaagcaacatgattgaggccatagaggaccaccctctaacagaaatctccgaaagcccgggtcacctcttgctcctgaagctatggcaaagagaggaagaactctttgccaaacgcattgctcacaaggagactagaatggacaccatcaaagctgaactctttcaactctcctcattcttcttcatcttccatgccttcttcctaaccctccttttcacttcttgggccaaggcccaacaacaggcccaaccccaccatagcgtttgtcacaagtggtggcttccttccatggtgtccctttgcacctcccttgtgtttgtggttcttgtgcaagtgaaggttcataggtattggaaggtgtgggggcacttgcaaagggagaggaatgatgggagggctgtgacaaggtgcattcaggagttgaggatgaaaggggcaagctttgatctttctaaggagcctaatagtagtagtagtgtgaagaggatgaagagctctagtgttgagatcaagtggaggccactcacttggtgttctaagaacttgctcaccttttcccttgtttgctttacagctctccttggagcatggactttgatggctcttgctgagggacttgttgtggtaaattttatccctgaccctactatccccactgtacttggtgaatttgttgaacttaaaatactaggttga

SEQ ID NO: 87241 - DNA, 231 bp, Glycine max
  Peptide Sequence Number=SeqID_204019
atggcctctggtaatcgattaccaagggtttccatgttcagaagctgtgtaactcgagtttgggcactgatcgcgatggcagcgcaattaatccatgatcacgtggagatggagtgcctagagggagtttgggagaccttcgaagtcaatgagaggtgtcgattccgtggctcgctaagtcgaacatctgctgcaaggatttgcgctaagctcctcaaaggctgcgcttag

SEQ ID NO: 87242 - DNA, 265 bp, Glycine max
  Peptide Sequence Number=SeqID_204020
atggaggaagcttctcaattcggaagcattgaggccgtgattgaccttccatctcccatcagatggcacgtgaagtggaagatggcccacacaaagaacactggccaaatgacgtctgagtcagcaaaggaaattgttgagaagattgactcattggaggagcaggcgtcacagggtttctttgtccctcatggacgtcaagatgtcttgactgctgccattgggcgaccagaacaccatggtcgtgtgcgtgctattggagcca

SEQ ID NO: 87243 - DNA, 192 bp, Glycine max
  Peptide Sequence Number=SeqID_204021
atggcagataccacttctccagaacaggcagcatatccttcaatgcctaaagatcaaactacaccagcccagtctccgaacgcctctcttgtatctactcataaggatttgtataactcagaacatgatgaaggccatgaattgtatagacaccagctctttgactttgaccacttagcttaccttgaatga

SEQ ID NO: 87244 - DNA, 815 bp, Glycine max
  Peptide Sequence Number=SeqID_204022
aggactacacaacctcgccctccgagggctacacgtcctcgccttcagaggagtacacatcctccccttgagagggctacacgcccttaccttcaaaagagtacacgtcctcaccttcagaggactatacgtcgtcgccattagagggctacacgtccttgccttcagaaggctacacgtcctcccctttagaggactacacgcccataacttcagaggactacacgtcctcgcctttagagggctacacgtcctccccttcagaggacaacatgacctcccctttagaggaatgcaagccctcgccttaacaggactgcatgttctcacatttagaggactacacaacctcgccttccgagggctagacgccctcgccttcagaggagtacacatcctccccctgagagggctatacgccctcgccttcgtagggttagacacccttaccttcaaaggagtacacgtactcaacatcagaggactatacatcgtcgccatcagagggctacaggtcctcgccttcagagggttacacgtcctccacttcagaggactacatgcccataccttcaaaggataccttcataggactacacgcccttggcttcgtaaggcttcactccctcaccttcagaggactacacatgctcgcctacagaggactacaagcctttgccttcgtagggctacacgccctcaccttcagaggactacacatcctcgttttctgagcgatacacgccctcgccttcagaggactacacgtctaacctttcagggggctgcacgtccttgccttcagggggctacac

SEQ ID NO: 87245 - DNA, 291 bp, Glycine max
  Peptide Sequence Number=SeqID_204023
atgtttcttagtaaactttctccgtcaagtctgacacccccctccttcgacctgttgcatggacacttaataaaaataattattcaactttgggttggtaatgcaagcgggactggtgttgtggcatctagaaaaggtgagatgggaggtgatagtgagagtaactccaaccaggtgtcaatggggtcaatgaagcttagggtttgtaaggaagagggggcatgggacttggcacgttggggtggtagcagaggagtgcaaattaagggtattttggaaagaaaatcataa

SEQ ID NO: 87246 - DNA, 216 bp, Glycine max
  Peptide Sequence Number=SeqID_204024
atgattggcgcagatcttgagcgtcttggattgcctcatgagaagcctaaccttgcccgtagccttatgcttcaggaacttcacggtgcccgcgcctcgctccttccactggttcccatccttgtcgaaccggtaaagcttcgatttgctgcgatccgcgaggaacaagcatcaaccgcaccgatcagtggcaaaacagtaaaatcgagaagctaa

SEQ ID NO: 87247 - DNA, 1650 bp, Glycine max
  Peptide Sequence Number=SeqID_204025
atggctgtgggagtgggagcattgtatttgtatgataaactaaccacattgatgatgacctctgatcatgcttccgtcgtctcaatgaacctttttgttgctcttctctgtgcttgcatcatcatcggtcatttgttggaggagaaccgatggatcaatgaatccatcactgcccttctcatcgcgagtcactttctttatctctattacttgccttttcatcaacaacatgaatttgaagcagctagcattttttctttgtcagggtctctgtactggggtctttatattgtttaccacgggaggaaaaagctctcatatattagttttcagtttcaggtgaagaagaaacaatttttccgcaattttatgactataatgctctttggtgcagttggtactttgatatcattctgcatcatatcactaggtgccatacacttttttcagaaattggacattgattccctcaagattggagattttctagcaattggagcaatattttcagcaacagattctgtttgcacgttgcaggttcttaatcaggatgagactcccttactatatagcctagtctttggggaaggggtagtaaatgatgctacctccatagttctcttcaaagcaattcagaattttgacctctctcacattgacttaaccactgccttacaattattaggaaattttttgtatttattcattgcaagcactgtgctgggaatctttgttggattgctcagtgcattcattattaagaagctctattttggcaagttgataaggcattctacagaccgtgaggttgctctcatggtactcatggcatacctttcgtatatgctgtctgagctattttctttaagtgccattctgactgttttcttctgcggcattgttatgtctcactacacgtggcataatgtgacagagagttcaagagtgacaaccaagcatgtttttgccactttgtcattcattgctgaaatctttatcttcctctatgtggggatggatgcattagatatagaaaagtggcgaattgtaagtcaaagcccaagaaaatcaattggggtcagttcgttgctgttggcacttatcttggtgggaagagctgcatttgttttccctttgtccttcttatccaacttgcttaagaactctcaatctgagaaaattgagttaaaacaacaagtaactatttggtgggctggtctcatgcgtggagctgtttctatcgcacttgcttacaatcagtttaccaggctgggccatactaaactgcgggagaatgccatcatgatcactagtaccatcactgttgtactcttcagcacattggcgtttgggttgatgacaaagccacttgtgaggctattgcttccatcctctaaacacgtaatgagcttgccgtccccaccatcgacaccgaaatcattcactgtgccacttcttggcagtcaaaatgggcctccaccaagcaccttgaggatgctcctaagctgcatccctactcgtggggtacaccactattggcgcaagtttgatgattctgtcatgcgacccgtctttggtggacgaggttttgtaccctacgttccagggtcaccccttgaacaaagtgttcatcagtggcgttgcacttaa

SEQ ID NO: 87248 - DNA, 501 bp, Glycine max
  Peptide Sequence Number=SeqID_204026
atgagtgtgcaagagcacgctgggaacgagaaatcttgcgtttggcacgctagggattttgctgatggtgaactcaaggacgagcttttctgcatccgttttccttctattgaaaggtttgaagtatgcattcacagttttgggagctgggaaattttagctaggggaccttgtctatccaactgtattgtaaacttgtctttgcttgcaagatttcatagaaaaaggatcacagatattgaagttgattttgaggaagattgcaaaagcttcatggaaacattccaagaagttgctgaatcccagaaggcagaggatgagaaggaatcagctgatgcagctggtcttattgagaaattaagtgttgaagaaaaggctgatgcagagaagaaggatgaagagaagtctgaggacaaaactgtggagaaagaatctgcatcagggaaggaaagcaaggcggttgaagataagaaagccgaagagcctgcatcctcagcttga

SEQ ID NO: 87249 - DNA, 1440 bp, Glycine max
  Peptide Sequence Number=SeqID_204027
atgccatttactcttcacccctctaaatttctttgctctcccaactgcacaataataccagttaaggacaccactcttttcaccaacaccatcaacaaaccacacaaaaatcccacaaagtttcgttcttttgccaaggttgttctttccactccccgtgcttccatagtttctaagaaagattcaatcttgggctatacccacttcacacttcgctccaggagtgatggtgatggcttctccactgatgtatctcaagatgatggaacaagccaagaacttgaacagcttgagttgctgaacaagccttcacctgtgcttgttacagaagggtcttcttctgaagttgaagtggaggaagagaaaccctcccaggaggaggctttggcacctttcttgaagtttttcaaaggcaaagattctggggaggatgttgaggaagatggtgaggggttggaagttgctgaagaaaaaagtgatgtggggggtgagaatgaagagggagataagaaggttagtgttgagtactatgagtccaaacctggggattttgtggtgggtgttgttgtttcaggtaatgaaaacaagcttgatgtcaatgtaggggcagacttgctaggtacaatgttgaccaaggaagtgcttcccttgtatggtaaggaaatggagaacttgttgtgtgatgtggaaaaggatgctgaggattttatggttcgggggaagatgggaattgtgaagaatgaggaagcaataagtggagtgccagtgcctggaaggcctgtcgtggagattggaaccattttgtttgctgaggttttaggtaggactcttagtggccggccattgctttccacaagaaggctctttcgccggattgcctggcatcgagtgaggcagataaaacagctcaatgaacctatagaggttagaattactgagtggaatactgggggcctgctaacaaggattgagggtttgcgagctttcctacccaaagctgagcttgtaaaaagagcaaatagctttactgaattgaaagaaaatgtggggcgctgtatgtatgtacaaattactcagatagatgaaactaaaaacaatttgatacttagcgaaaaggaagcttggcaaaaattgtatcttcgtgagggaacacttcttgatggaactgtgaaaaagatcttaccgtatggagctcaaattaagctaggaaaaactaatagaagcccaaacgatgtgattgaaaaaattctcctctctattgtgggtcaatctgccgaagctgtgggatgtaaaaatgaatcggtaggggagtgttctgccttaaagggaagaactcgcgcaagcagtgttggacaaagcggaagcgagaatgttggctttagtaacgcaaacgtctgtgagaatccaatgcctcgaatacccaagggttcctccgcatga

SEQ ID NO: 87250 - DNA, 528 bp, Glycine max
  Peptide Sequence Number=SeqID_204028
atgttgttgatgaaaaggcaagtaatagagataaagaaagtgactcgcgatgagaagggcagtgatggattcattgatccatcggttctcctccaacaaatgaccgatgatgatgcaagcacagagaagagcaacaaaaagtcttcttcctcttgcagtctcacgtcgcctctatctctctcttggtttctccaagttcaacgagtctacgttgctgcttgccaccactacaccatcgaggttgcccacatagcctcaccttctacctctgtctcagcgagtctttcccgtcatcgtgtcacaccaacgtcggatcatccttgcacaacaccgtcgaggtcacccacatggtcttaccttttacctctacctaagttagtcttccctatcattgttgttgtactgtcgtgccacaccaatgtcgagttgtccttgcacgacgtcgttgaggtcgccctcaccctcaccagcactaaacatcaccaatcaccctcaccctctacctctccattctcgaacaaggtatga

SEQ ID NO: 87251 - DNA, 1080 bp, Glycine max
  Peptide Sequence Number=SeqID_204029
atggagcagagttggcgggccaatatgcctcgcgagcttctcagagaggtcctcctccgaattgagtcgtcggaggccacgtggccgtcgcggaggagcgtggtggcttgtggcggagtgtgtcgcacctggaggctcattgtcaaggagattgtcaagccacctcaactctcttccaacataaccttccccatctctctcaaacagcctggcccgagggaacatctacttcagtgcttcattaggcgcaacagtgccacacagacatattatctgtttctcagtttatctagtgcactaatagctgatgatgggaagttccttcttgctgcacgcaagttcagacgccctacctgcatagattatattatctccctagatgcagatgatatgtccagagaaagcaatgcctatgttgggaaattgagatcaaattttttgggaaccaagtttacaatctacgatatcccgctgcctcatgttggggcaaagatgacaaaaagttgcttcactaagctggtgaatccaaaacaagtttcacctagggtccctacaggcaactatccagttgctcacatctcatatgaactgaatgtactaggctccagggggccaaggagaatgcattgtgtcatggataccattcctgcttctgctattgaaccgggaggggtagccgtagccccttcacagactgatttttctgttagtaacatagatacttcattcccattttttcagacaaactcaactagtctggaaaactccatatctggagaccagagaaataaaaaagatgatgtgctagtgttgagaaacaaggctgccaggtggcatgagcagctggagtgttggtgcttaaactttcatgggcgagtgacaattgcttcggttaaaaactttcagctggctgtttcaccagaaaatggacatgctggaccacaagaggatgaggtcatcctccaatttggaaaagttgggaaggacttgtttacaatggattaccggtaccctatctcagcatttcaagcatttgcaatctgcctcagcagtttcgctaccacagttgcttgcgaatga

SEQ ID NO: 87252 - DNA, 4011 bp, Glycine max
  Peptide Sequence Number=SeqID_204030
atgaggttattctgtacgatgatgggtttggggatcaatgaatacttaatgttaggttttgaaggctttaaggaagaagtcattcaacaacaaaacccttttccgacgagttcagatgagatggcctcttcacataatgttgaattggaggctgctaagtttctgcataaacttattcaagattctaaagatgaaccagccaagctggctactaaactctatgtgatactacaacacatgaaatcaagcagtaaggagcattcaatgccatatcaagtgatatcaagggcaatggagactgtcatcaaccaacatggtcttgatattgaagcattgaagtcatcacgtcttcctttgactggtggtcctcaaataggttcttcttcacagtcaatgaatgttacaaaagattccagagtgagtttggctgaaaatgaggtgtccaaaatggacccgtttgcttctggccggccaccggttgccccaagtggtggagcacctgattattatcaaggatctgtggcacagaggagtggtcagtcttttgatcaaggaagtccgtctagtttggattctaggtctgctaactcacagtcacaagacagacgtgatactgctaattgggacaaacaggtgagccaaaaggatggcaagaaagccatgacaaagagaaagaggggagatacatcatcacctgtggaactgcatgttgacagtccttcacagctggatcctcgcaatactggtgttaatgcaaggaaggggaaaatgaccaaggctgaatcatcagatggtcttccagttaaaagtggtgaactaaccaactttaacatggctccaaatagtggtcaattggagaatatttcagctttgtctggtagcatgagaacaatgcttagagcaaaccaagaaggtcatcatttattggcaaaacaaactgatttgacaaaggttggcaatctgatggtgcgagcacctaattcaaagtatgcagaagacacggaagtttcctctgcacatattgcttcagggaagcagcaaggtgcttatgcaaaggttcatggagggatggcggttccagctggtgcatcttcaatggttgaagctttctcaaattcaatgcaatatggtggtgcagtggagcgtgatgggggaagttctactactttagctgatggacataaaattgctcaggttggcaggcaaaatagtggctcagaaataactatgcttagacaaggtgttcctgcaagagacacaggaaaacctgccatgcctttcaaggaacaacagttaaaacagcttcgagctcagtgccttgttttcctagcatttagaaatggtctagcaccgaagaaactacatcttgaaattgcacttggaactgccttttctagagaagatggttctcgcaaagatctaattgaccacaaaggaaaatcacaatcttttaatgaaccaggtaactcatctggggtcatgatgccatttggaggtcccagcaatgtcagacagacagataaaaaccctttggggtcctcttcagctggcaaaattgtggaggctgactctttgtcaaagggaactgagagcccaagaacattggaggacaaaggtaacctacatgtcacaaaaagaggagaggttgaaagacgaattcaagaaagagtggctgctcaagcttcctctgccacttcatgtcagcagcaagattcttcaagtacaaggggtgctgtagttggtaataatcatttggatgatgttgacaccggtaatatgcaggttggaagatctaaccaatcttctgttgttggcccaaataactgggctggttttgctggtgctaatgaggcttcaaagggacctccacaggtctctactattcagcatgagttgcctatagaaagaagagagaatattccttgtcagtttcaaaatgttgttaacaattgtggttcacggaatcacaattctgttaatcagatgtctttttctttaaaagagcaatggaaacctgttccagggacagacagtgatcctcatggagcaaccatgatgaaggatgggaatgtaatgataaaacacgtttctacagatggcttcaaaacagttccacttgataatgcatcaaagcatggcatctcttttgctacagagcaagatgggaatgagaggttggtatcagctgatttgccaccttctccaaaatgtacaatgacagagagatggatcatggatcagcagaaaaagaggcttctagttgagcaaaattgggtgctaaaacagcagaaaacaaagcaaagaatggctacaagtttttacaagttgaaggaaaatgtgagctcctctgaagatatttctgctaaaaccaaaagtgtcatagagttgaaaaaacttcaactattagagctccaacgtcgtctccggagtgattttctgaatgattttttcaaaccaattgcaaccgagatggaacatttaaaatcaattaagaaacataggcatggtaggagggtcaaacaacttgaaaggtttgagctgaaaatgaaggaagagcgtcagaagcggattcgtgagaggcagaaggagtttttcagtgagatagaggttcacaaggaaaaacttgatgatgtattcaaaatcaagagggaacggtggaagggtttcaatagatatgtgaaggagttccataagagaaaagaacgtattcatcgtgagaagattgatagaatccagcgggaaaagattaatttactgaaaataaatgatgtggagggctatcttcgaatggtgcaggatgcaaaatcagatcgtgtaaagcaactacttaaagagaccgagaagtatcttcaaaagcttgggtccaagctacaggaagcaaagactgcagcaggacgttttgggcaggacgttgatgagacaggaaatcattatatggaaagcaatgaaaagtattacaagatggctcacagtataaaggagagcattgcagagcagccatctagtttgctaggcggaaaattgagggaatatcaaatgaatggcctgaggtggctggtttccctatacaacaatcatttgaatggaattcttgctgatgaaatgggactgggtaaaacagtacaggcaaaaaatgatagaggaccatttcttgtggttgtgccctcttcagttctacctggttgggactctgaaataaatttttgggctcctggtgttcataaaattgtctatgccggtccaccagaggagaggcgtcggctattcaaggaaaggattgttcaccagaaattcaatgttcttttgactacatatgagtatttgatgaataagcatgatagaccaaagctgagcaaaatacattggcattatataataattgatgaaggccaccgtataaagaatgcttcttgcaagttgaatgctgacttgaaacactatcagagctctcacagattgctgttaactggaacacctttacagaataatcttgaagagctatgggcactacttaatttcttgttgccaaacatattcaattcatcggaggatttctctcaatggtttaacaagccatttgagagtgctggagatagctcacctgatgaagctttattgtccgaggaggagaatcttttgattataaatcgtctgcaccaagttttgagaccatttgtacttaggaggctgaaacacaaggttgaaaatgagctgcctgagaagattgagagactaataagatgtgaggcttcatcatatcaaaaacttttgatgaagagggtggaagaaaatcttggttctattggcaattcaaaggctcgatcagtgcacaactctgtcatggagcttcgtaatatatgcaatcatccatatctcagccagcttcatgcagaggaggtggataacttcatacctaaacattatctgccaccaattattagactttgtgggaagcttgagatgttggaccgtttattaccaaaactgaaggcgacagatcatcgggtatga

SEQ ID NO: 87253 - DNA, 759 bp, Glycine max
  Peptide Sequence Number=SeqID_204031
atggctaccgagcttcttcaaatcgaacccgccgagctccgattcgtctttactatgcaagctcagcgcatggcaccgcctgatatgctgtgcaaagacaaatttctcattcaaagcacagttgtcccgtttggaaccacagaagatgacatcacctctgatatgttttcaaaagacagcggaaagtatattgaggagaagaaactaagggtagtcctcatcagtccgccatcttctccggtgttgcttccagtaaatggtgatatgaagcatgatccatccaacgaaatttatgtgcaaaaagatagggtgcccagtggagttgaaaacatacctcccccttgtaaactatccagtagccaccacccaaatgtttctgatgaggttaaaggtttggaaccagcccaggatatgaaggaggatagagaagatgaggatattgtcccaagacaagctgagaatgttggtgacatgaagccagcaaaagatgatatgcaattgaatttaactaacgaatctgaggaattgaagtcaaaacttagtgtaatggattccaagctaagagtggctgaggtaaccatcacgaagctgaatgaggagaggcacaggaacactcaagaaaaagatttgcttaagaaagagttggaggtgttgaagaggcaaatcaatacgaaaggaagtcaggctggttttccatttctgtttgtttgcatggttgctcttatcagcgtggcagttggatattatattcacccataa

SEQ ID NO: 87254 - DNA, 5483 bp, Glycine max
  Peptide Sequence Number=SeqID_204032
tgaaacagagttggatatatttgaggctgttgacaaaaaaaggaaggaagatgagctggctacatggaagaaattagtgcttggacaggccgctgatggctctgactctgatattcctccacttcctgctcgtctggtcactgatgaagacctgaaacagttctatgaagcaatgaagatatccgatgtgcctaaggctgaggtagaatctagtggagtaaagagaaagggtggatatattgggggccttgatactcaacattacggcaggggaaaacgtgcaagagaggtacgttcctatgaagagcaatggacagaggaggagtttgagaagatgtgtcaggttgaaaatccagattcacccaacaaagtaaaagaagtggcagagaagagttgtccaacaaatacttccagctctgttgtatctacttctaactcacaacctgtggctgtgcctccagtggtcccaacattgccagctgtggagagtttgccggtagtggtacagcaagttaaagagataaccccacccgccaaacgtggtcgtggaagacctaaaagaataacttcagataagtcaccagctgtggtgatctctccagtaacttctggaactgttgaagtagacacgcagttacagaaaggaattgggtctggacatttagcatcatcaactcctgattctgttgctcattctgctgaagttgtaggtgtgaatgcacccgtgcaacagtctgatccgggagtttctcctaactcacagcctgtcattcctatgccttctattccaccaaattctcaggtagctgctgttcctgtttctgtacctattcaagcaagaggacaagggaggaaaagtcatggtggtgaaggaattagacgtagagggaagaagcaggtcatgacttcatctccaatccctgctggttctgttgttcctgatctaaaggttaatgagaaattggaagatacattggtcagtccttcttcaggtcaagctatctcccagagtgaaactgttcccagctctgctgcagttccccatccaccttctgcttctttgagcagtggaaaggatcctgtgggtgttgggattgttttgaattctcaggcaccccctcctttgccctctaatacaaccttgattcaaactgcacccacttatccgtccgtgcagatgcaaagtaaaggacaaaatcagaagtcacagactggagtttcccgccgtaggggaaagaaacaggcaacaatattagcatcggttccagatcttttacatcaggatttacatcaaactgctaatttacctatttcatcagacagtatgtctggtgaaaaagccactgagttaaagagcttgcaagcgaacaatgttcaagaatcaaaatgtgttgtccaggatcaagcatcacagagcgtaggtgatcaggatttaaaatcactgggaggatcagatgattcatccaaacagacagtgatcatgtcttcatgtgaagatagtatgatcaaatctccagggcaagatcttgacgaggttaagaatcctgatgctcatgattcttctgtgaaggttgttaaatcttctgaaattacctcatcgaaaattgatgaagtttgcaataactcagggaatgaaactttacttgtgacaacagtgcctgttaccgaggcgataaaggatcaacatttaggtggtaaaactcataatcaaactgttgaaacttcaaaaaccttcccttcagttgttgatacttcaattaattccttgactggcaatgaaactacagaaaacatcagcaagtctttagatcctgtgactccaaagattgttcccagtacattaagtactgtttattcttccacgccaggctctgaatctactcatccaggatcgattgaatccatgcccaccaaaaggcaaggtcgtaaaactcaaaatagagcagagccaccacggcgtagggggaaaaaatcaactgcagtgttacctgttgttcctgatgctgttactggtcaggatcctaagttaagtcatcatgcacagaattcatcaggagattcattgctgggtaaagccactgcgaatgtcactcaaacccaagcattggagatccttttaccctgtggagtagttagtcatgattcgaatagaaaagagagggcaaccaattctacccacaataagcaacagaaagttgcatcaacaaggattgatggtgcacctatctccacagataagatttctgtgcatgatgttgcacgggtaatgaaggaagttttctctggaacttgcataccaaagcctaaagctcatgattctgctgggagcgaagataggaatgcacctgttgtaccagtactgactaaagctgcagtggatgtcacttccaataaccagagtttgaaggataaagtgtattctgatatagcagctactggtgcagcatgccttacttcaaatgttgctgtgaatgttaacgaaaaacaaccagaaatggcatccaatatgcagaatttggagggtaaatcatgtttagatatgccaattactggggaacataacctgacatcagatgttaaagaaaaggctgaacagatgctacattgtgttgaaagctcaaccacggggtgtaaaatagctcttgatacaaccctcaatgctgtccaaaagaccgatgattcttctgagagacttcctaccagctgtgctctcaatgatttaaatatagatagttctagccatcagatgtgttcatcttcaggtgctgaacctcttgcagtaattgatcacaagattaaaagccaatccgactctttagagaagtgttcaagatcttctccacttgatattggtagcatgggatgcccaccaactccattggaaccagacacttttagcaataatcctgtaactagtcaggctgatacctgcactcagagccattcatccacaaacaaacctcctgtttccacagaactcatttctaatgaaaaattggaatctttggaaccatctttgaaatcttcatctcttgcttgtgttgacggctctgggtttttggttcagactgaaaatttgggtgatcaaccacaagtgatcccatcaagtcctgcaacagatcttcctccaatgacaatgatagtttctagtatttcggaacatgccgaagttaaaagtgaaacagagtctacattaaaagcttctgctgaactctcttctgatgaggggattgttgggtataaagttccttcttctcagttgctggagactgagaatcggaatccatttggacataattctcaaaaggtattagaaccctccgtgaaacagtgttcagaatcagcttctgaaatgaaagttcctgtgagtcctaaagctgttcaagttcagaaacatccagatgcactagaacctgctgatttgcatggtactccattgatcgagagttgcccaaaatctctctgtgaggaaaaaaaggatgatgggaattccatatgtgaaccgcttcagtcttgtgttgttgaacctataaatattgaccctgtttcccaagaaaatatagtattacccattcctattgagaatctaaagactgattcttctgaggcttgccatatggaaatggacacatcagacaggttagtgttgccacaaccttctggtttggaagctgtagggaatgatttggttggtatttctggtgttggcagtcttgtagagggaaataaatctgaagctgcagttctgcccccgtcaaccttgaaagaagagcaaaataggggattagctgtaacatgtacagttaggagttcagaacctttggaggagtcaatggagaagggtgtggctaacgactctagagtccaggaggaagcaaaagttgataaagtagaaaccgatattcaaatggattcatccattagtcagactttgcaagcaaaacatgagatttttcaagaaaatatgaattttccctcccatctaatgacgaaggaagaaaacatagaagtctcatcctcaaggcccctatctatcagttcatctccatcacatgaattgaaggattctgaacttgaactaggtgataaatatatatctcaggttggtgattctcagactggatctgaagataatatgttgaagaggttggatttagtttcatctccttcagttacgaaggaagaagtgctcagttctacatctgatattgatggttctggaggcctttcaacatctctgaatgttcatcaattagtaactgtcccggatgctgtcaagtcttcatcatcccaagtctctgagaataattcagaaagggttacttccaaatgcatggatgtaccttcttgcttccaaatggtggagggagataatgttgatatgttgtctgacaagggccctctttgcaattcccttgctcctagtgaaccaagagaccctttgattgagaatagtagtgatggcatcgaggattctattccaaatccattaccacaacagaaatcagaatgttctgaatctgagaaggttgatgaggtgaagacatctgatgttgtcagggttgatccaggactgatgtccaaaaacacagatttgccttcttccttggtgatggagcaagataaagctgatgcatcatatgatagcccactggccgctgcagaaccaaaatattgtttgactggagagaattgtgaagatgctaatgaggaaccgaatccttcagaagctgagattggtaatgaaatggatgcatctgatgtagctgggattaatacacaactttcatctagtaacaatattgtgccatcatctttcttgatgaccaaagatgataagattgtggtgtcatctgacaatggcccacaatgcagcgtgcaagtactcaagggatcggaagattgtcagactgaagggagctgtaaagatgccactgaggttcggctatctgtggaagatgtcacagcatcagggggaaaaagagaggtggagacattgtctgatgagggtccacaaggaatcttggaagcccaggatggatcaagaggactagctgactttgaggaaggggcagatagtaaaagctgtgctgctgagatgggaaatgtatctgaagtcccaaaaccctcagtatcagctgagaaggtggaaagaatcttggaagcccaggatggatcaagaggactatccgacgttgaggaagggacagatagtaaaagctgtgctgctgagatgggaaatttatctgaagtcccaaaactctcagtatctgctgagaaggtggaaggaatcttggaatcccgggatggatcaagaggactatctgacattgaggaagggacagatactaaaggctgtgctgctgagatgggaaatttatctgaagtcccaaaaccctcagtatcagctgagaaggtggaaggaatcttggaatcccgggatggatcaagaggactggctgacattgaggatgggacagata

SEQ ID NO: 87255 - DNA, 245 bp, Glycine max
  Peptide Sequence Number=SeqID_204033
gtggaaaatgctctcaacaggcagaacttagtggagagaatatcaacatcacttacaaacctgatgggactcatgtagctgttggtaacagggatgatgaattaacaatattggatgttcggaagttcaaaccaattcataggcgcaagttcaattatgaggtattatctagtttatacttcattcttgctgtctggtctgtttctgtcagtttgttaaagcctgttttggaggataagaaatga

SEQ ID NO: 87256 - DNA, 2910 bp, Glycine max
  Peptide Sequence Number=SeqID_204034
atggactgcaataaagaagaggccttaagggccaaggacattgctgaaaagaagatggaaaacagggattttgtgggggctcgcaaaattgctctaaaggctcagcagctgtaccctgatctggaaaatatagctcaaatgcttgttgtttgtgatgtgcactgctcttctgagcagaaattatttggtaatgagatggattggtatgaaattcttcaggtcgaacagacagctggtgatgcaataattaagaagcaatataggaagttcgctctccaacttcatcctgacaaaaacaactttgctggtgcagaatctgcattcaagttgattggggaagctcaaagagtgcttttggacagagaaaaacgttctctttttgacatgaagcgtagagttccaacgaacaaacctgctatgtcacgttttaattctacagtgaagaacaatgttagacccaactcgtcatgctcaaattctcagcagcagcagcaatctaggcagccagcacagcagcagcaaaatggtgaccgccctactttttggacggtctgcccgttttgttctgttaggtatcaatattacaaagaaattttaaataaatctcttcgctgtcaaaattgcaaaaggccctttgttgcatatgaagtgaatgtacaaggtacatcatcaccagcaactaattcaactcagcaagcttctgaccagcagaaagatggtttgaatcatggtgctttcaagatgggtgcaggatctcaaggcaattcgcaggctgagaagtccaatatggggccttatgataaaaaaagacctagtaatgtctctggaaaaccaaatggaaagaggaagaggaagcaggtggcagaatccagtgaaggttctgatactatgagcagcaatgattctgaagaagatatagttgctggcaaggatggtaattctagtgtagaaaaccattcatctccaagagaagggcatccacgcagatctacacgtcaaaagcatcaagtttcctacaaggagaatgtgaaaaacaatgataatggcttcttgaaaccacgtggtgatggtgaaagtcatggcaagacaactaaaatgaatgatcagaaaggtttagctgctgaacataaagaaggaaaacagaagcaacacttgtattctgaaagaaatgaggaaactaagacggataggggaaaagatgcagtgggagggtcaacacagatggatggaaattcagagcattctccagattcaacctccaaagcagaaaatcatcctaatgtttatgtctatcctgatgcagagttcaatgattttttcaagggcaagaataaagaatgttttgctgctgggcagatatggggtatttatgatacagcagaaggcatgcctagattctacgctttaatcagaaaagttttgtctcctggattcaagctgcagataatatggtttgaatcacatccggattgcaaggatgaaatcaactgggtaaatgaggaattgcctgttgcttgtggtaaatataaacttggtgacactgacatcactgaagatcatctaatgttctctcatctggttttgtgtgaaaaaattagccgtaatacttttaaagtgtatcctagaaagggcgaaacttgggccctttttaaaaattgggatattaaatggtacatggatgtgaaatctcatcagctctatgaatatgagtttgttgaaatcttgacagattatgttgaaggtaagggtgtatatgttgcatacatggctaagttgaaaggttttgtaagtctcttccttcgaaatattaatgaagaaaacaaatcatttcaaattccaccacaggaattatttagattctctcacagggttccgtccttcaaattgactggtcaggaaggagtgggtgtaccagcaggatcttatgaacttgatcctggagctttgccagtgaatcttgaagagattgctgttcctgaaaattcggatgtgaaggttggtcgtagttcatctggtggtgagaatacaaggccttcaaatagatcagaaccccttatgacatctgagggagatgcatctattcccaaggttaatttggaaagaagcaatttggcaacagagaacaaggattctgttgatgacagtgataattgttgtgctcctccagaatcgagcccagaagctatcaatgttccagatactcaattctttgattttgatggtgggagagcccttgaaaagtttcagattggtcagatttgggcattttacagtgatgaagatggattgccaaaatattacggtcagattaaaaagattgagacaagcccagatcttgaattgcatgtttactggcttacttgctgctggctaccagagaataccattaaatgggaagacaaagatattcttatttcctgtggcagatttaaagttaatgaaacacatgattttctcagtgtttatagtaccacctcttgtgtttcacatcaagtacatgccgatgctgttggtaagaataagaattatgccatctttccgaggaaaggtgacgtttgggcgttatatagaaaatggacaaataaaatgaaatgttttgagatggaaaattgcgagtatgacatagttgaagttgttgaagaaactgatctgttcataaatgttttagttctggagtttgttagtgggtatacttcagttttccggggcaaatcaaatgaaggatcatctgtcaatctaagaatacccagaaaagagttgcttaggttctcccaccaaatcccagctttcaaactgacagaagagcatggcaatcttaagggcttctgggaacttgatccagatggagctagtgctggtagtaacattttggtattgtgttggctacccctaggaagtgtgaattgttag

SEQ ID NO: 87257 - DNA, 1899 bp, Glycine max
  Peptide Sequence Number=SeqID_204035
atgaatggcatgcgctcttatttgttccgtactacgcctaagattgtagcgctagcacgttcaggtcaaatctccgatgctcgcaaactgttcgatgaaataccccacaaagactctgttgcttggaacgccatgctaaccgcctattcccacgtgggactttaccaacagagtcttagtctctttggttgcatgagaatctcccattccaaacccgacaacttctcattctctgcagtcttaaatgcatgcgcttgcgctggtgcatcctatgttcgttttggagcaaccctacacgctttggttgttgtttcaggctacctgtcttctcttcctgtggctaactcgctcattgatatgtatggcaagtgtttgcttcctgatgatgcaagaaaagtgtttgatgagacgagtgatagcaatgaagtgacatggtgttcacttatgtttgcttatgcaaactcttgccggttaggcgtggcccttgaactgtttcgtagcatgcccgaaagggttgtgattgcttggaatataatgattgtgggccatgctcgtcgcggcgaagttgaagcgtgcttgcatttatttaaagagatgtgtgggagtttgtgtcagccagaccagtggactttcagtgctctcattaacgcttgtgctgtgtcaatggagatgttatacggatgcatggtgcatggttttgtgataaaatctggttggagctctgctatggaagtaaagaactcgatgttaagcttttatgctaaattagaatgtcaagatgatgccatgaaggtgtttaactcctttggatgttttaatcaagtgtcttggaatgccatcattgatgctcatatgaaattgggggatacccagaaagcttttcttgctttccagaaagctcctgagagaaatattgtttcttggacttctatgattgcagggtatacgagaaatggaaatggagagctagctctgagtatgttcttagacttgacaagaaactctgtccagcttgatgatttagtagccggagcagtccttcatgcttgtgctagcttagcgatactggttcatggaagaatggtccatggttgcattattcgtcatggtttagacaaatatttgtatgttggcaatagtttggttaatatgtatgcaaaatgtggggatataaaaggttcacggcttgcatttcatgacattcttgataaggacctgatttcttggaattcaatgttgtttgcatttggactgcacgggcgggctaatgaggctatatgcttatacagagaaatggtggcatctggtgtgaaacctgatgaagtaaccttcacagggctgttaatgacttgcagccacttggggcttataagtgagggctttgcgttctttcaatcaatgtgtttggaatttggactatcccatggaatggaccatgtggcatgcatggtggatatgcttggtcgcggtggatacgtggcagaagcaagaagtttagctgagaagtattcaaagacaagcataactaggaccaattcatgcgaggttctactaggagcatgttatgcacatggagatttaggaaccgggagcagtgtgggagaatatctaaagaacttggagcctgaaaaggaggttggttatgtattgttgtcaaatttgtattgtgcaagtgggaagtggagggaagcagagatggtccggaaggcaatgctggatcaaggggtgaaaaaagtacctggtagtagttggattgagataagaaacgaggttacctcttttgtatcaggaaacaatgcatatccctacatggctgacatatccaagatactatactttcttgaattggaaatgagacatacatcgcctattaattttgatattgaaggacctttatag

SEQ ID NO: 87258 - DNA, 333 bp, Glycine max
  Peptide Sequence Number=SeqID_204036
atgactctaccttgtggggagcaagtgatgcctttccatgaacaaggtgttgagcttgaagggttccatgaggagagaacagaaggtgatgatcttgcagcaggtagaagagaaagaagggcttgtccatcaggggagagacaagtgactcctatctttgttgtcagggtgaggcagaagaataacaaggaaaataacaaagtggtaacactatggggaacaatgttttccatttggactgtgaaaatggcttggttttggagattaagaacttggtctaacggtgtgttgctattgaagatggtggtgattggtgaagaaagtccactctag

SEQ ID NO: 87259 - DNA, 249 bp, Glycine max
  Peptide Sequence Number=SeqID_204037
atggaggaacaaatcccatttaagaatctccataacagagagtattcgggtcacaagaagaaggtgcactccgtggcttggaattgcattggcacaaaacttgcttctggttctgtggatcaaactgcgcgaatatggcatattgagccacatgggcataggatgcaaagggcttttatatttcccttaagtataggccagtcttttgggttgttgtacctgaatatggcttcagggctaatggaataa

SEQ ID NO: 87260 - DNA, 237 bp, Glycine max
  Peptide Sequence Number=SeqID_204038
atgggggaagcgggtggtggtgcgccagggggacatggtgtagtagttgccgatgaaggggtcggagtgggtgagagggcctcgacgtcgtaccaggacttgaacaccagtggggcggcgttgcggtcggggtgggaggtgaggaagtggagcacgctttccaggatgttctccaggacttggtctggtcgtcattcccgttctccaggagatgtgagtaacgaatcacaatcataa

SEQ ID NO: 87261 - DNA, 4119 bp, Glycine max
  Peptide Sequence Number=SeqID_204039
atggtgatttcttactctgattttgctaccaatccctctaatccatactacatgcatccaaatgagaatccttctcttgttctcgttcaacctgtgcttgataacaaaaactaccagatctggtgcagattgatgaaggtggctcttatctccaagaacaagcttcgttgtaataacctcgttctctcatggcttcaacgttcaatctttgaagaaatcgcgaaatctctcctctggtgtgatcgcgcttctcttgtatggaaaagtttggcgaatcggttctctcagggtgatatttttcgcgttgctgatattcaagaggaagtagctcgtcttcaacaaggaactcttgaaatctcttcgtatttcaccaaattgatgacgctttgggaagaaattgagaattttcgtccaattcgtgattgtacttgtgctataccgtgttcttgtggtgctgctacagatttacgcaaattcaagaagcaagataaggtaatcaagttcttgaaaggtcttggtgatcaatattctcatgttcgctcgcagattatgctgatatctccacttccaaccctagacaatgcattcaatttgattcttcaacaagaacgccagttcaatcttccttcaaccactgattcttcaattgagaatcaatcgtcggtgaatcacttctctcaaacgccttctcgtccttctaataattccggtcgcggttgtggtcgtggatattcctcaggtggctgtggcaaccggctatgcactcactgtaatcgcaccaatcacactgttgagacttgcttcatcaagcacgggtatcctcttggttttcaacatcgtaagtccaattcctctggaaatgcctctgtggtgaactctgttcaagatgctggttctgctcacatttcctcatcatcatctgcttccacatcaacaaatggatcaagtgcttctttgtccacgattcaagagcaatatactcagattttacagctactccaacaatccaacttgcaatctacttcaccttcttcagttaattctgtttttgctacaaattttgtctcttatacctctccctctccttcatctggtaagaatctctcaaataataccagtcactggtggattgttgacaccggtgccactgatcatattacttatatctttgacagtttttcttccacatatcacattgcacccaaaactatgaccatgcctaatggtgacactgtcactaccacaatagctggttcagttttgttatatgactcccttgttcttcataatgtttactactttccttcgtttcatgtcaatattatctctgttactactctatttgattccaccttatatgatgtgaaactctaccctaattattgtaaaattgtgcagctactttatcccaagatgactggatttatagctaggaggattggcaaattgtatgtgcttgacaccacctcacctctggttttctctcccacacctggttctgtcaacacctccatctcttatgatcctaccaccatttggcattttagactaggacatttaagttctcatatacacaaatgtatttcatcttactttccctttgtcactttcaatgacaatcataaaccttgtaatacttgccatttggctaaacaaagaaatttaccttttgcttatagtactactaaatctgttgccatttttgatttaattcatgctgatatatggggacctctttccaccccttccatatctggccataagtattttctaacacttgtagatgattacagcagtgataatgggcctgagtttctcatgactagtttttacctttctaaaggtatcatccatcataggtcatgtgttgaaacacctcaacaaaatggcatcgtggaaagaaagcatcaacacattttgaatgtagcacatgctctttcttttcactctcatctccctcataacctttggcacctctccatacaacaagctatccacattatcaacagacttcctacccctcttttgaacaacctcaccccttatcaaatgcttcattctactcctcccagccttcatcatttaagagtttttggatgtcttgcatactcctcgaccttacataaccatagaaccaaatttgcaccaagggcaagaaaatccatatttcttggatatagggaaggcaccaaaggctaccttctttatgatcctatcacccatgagttctatgtttcaaggaatgtaatcttccatgaaactgtctttccttttgcctcacctccacctgccaataatcctgtcagtgtcaaccccgatattactaccttagacacatctgacattctcctagatcttccactatccttaccttcaccaaatgaacctacctcccctcctgcaccaaccagaaaatcacatagactaacaaaacctcctacttatctctctgaataccactgcaatttgctatcctcaatgctgctagcatctaatccagaacccaaaacttataaacaagcttgtaagtttgattgctggaatcttgctatgaaatttgagttagatgctcttgcatccacaaacacttggtctgttgttgatctgcctaaagttgctaagcttaccacaattcgcacctttctatctgtggctggtattaaggactggcacttagaacaacttgacgtcaacaatgctttccttcatggtgatctgtatgaggaagtatatatggatttgcctcctgggttcttgccacctggttcttcttccaataaagtctacaaattacataagtccttatatggactgaaacaagctagcagacagtggttctccaagttatccactgctcttatctcccttggatactcaccttcatttgctgaccattctttgttcacaaaactacataattctcatttcactgctcttctagtctatgttgacgatattgtcttgacatgtaatgatttgcaggaaatacaatatgtcaaacaattccttgactccacattcaaaatcaaggaccttggcaagcttaaatactttcttggattggaaattgcaagatctactcaaggcatctttctcaatcaaaggaagtatgcattggaattgcttgaggacagtggtttattggctactaagcctagtacaactccctttgattgctccttgaagcttcatgacagtgactcacccccttatgaagatgaaacaacctataggagacttgttggcagacttttatatttaactacaaccaggcctgacattgctttcattgttcagcaacttagtcaattcatctctcagccattacaagttcatcactcagcagcaattagagtcctcaaatatctcaaaagtgctcttgccaagggattgttctattcttcctcctccacactcaaactctctggttttgcagactcagattgggcaagttgccctgctactcgcagatcagtgactggttattgtgtctttcttggcacatctatgctgtcttggaaatccaaaaagcagtccacagtatccatgtcaagttcagaagcagaatatagagctttggctagcttaacttgtgaattacaatggctgcagtatttgttcaaggatcttcacatctctcttgatcaacctatctcagtctactgtgataataagagtgctatctatcttgctcacaaccccatcttccatgagaggacaaaacatattgaaattgactgtcatgtcattcgtgagaaaatacaaactggcctcattcatctcctgccagtttcttctgctgcacaattggcagatgtacttaccaagccattgcctgctccctccttcaattcattgatttccaagcttggccaattagacattcatagtccagcttgtggggggctattacatgatcccttcagtccctcccaccaccctagccaatatatagtgccaaatgataaggatagcaaattgggtctgcaggaagcaaggggtgtgcaagaagaaggcaaggcccaaaagaaaggtgatgaaggattacgtacctcatggatagtgtgtcatgcagcatgcaggaagtgcacagtagaggctagggttcgtagcttctag

SEQ ID NO: 87262 - DNA, 1584 bp, Glycine max
  Peptide Sequence Number=SeqID_204040
atggtggaggtagttgagattgaaagtttgtttaactatgccatgaaggggcaatggaaagaagtgctagaggtctgcaagaacaaccctcgagcgttggaaactaaagtcacaaaagcagaagacagtgttttacacatcgctgtctatgtgggccaaaccatttttttgaccacccttcttgagaacattaatgaagatgtctctcttgcaatcctaaatataccaaactcaaagggaaacactcctttgcatctagccgcagagcttgggaaagtggacatttgcaacactatagccaaaagagaccccaaactcattttgtgtcgcaattttaaagatgagacccctctttacctggcagcaattcatggtaccaaagatgcattttattgtctccatggtcacctacaaaacaaagatgattactcgccatgtattaagagcaacggggacactattcttcactctaccatctctaatgaatactttggtttggcacttcaaataattcggatgtacccaaatcttgcggatgctgtcaatcaggatgggttatcacctcttcatattcttgctatgaagccaaattgttttaaaagcagcacgcggatggagtttttggatcgtatgatctataattgtttgcttgtgaatgagttgaaggaagagacagaggacctaagtagtaatggagaagatacacattttaactatgcaatgaactacagaacatgcttcagcttcttaaatttgttgaagaatgcagttaaagctataacaataggtacaaaggatagtaatgctggaactgatgatgaagagaatctcccaaaatcatcccccattaactttgtgcaagagcgagcaaagaaagaaaataaactctaccgattccctccgaattgggaagtgctgatccgatttctgaccattatgatgaaggctttgctaatactttttggagtgggagcatcttggataggaaaaatccaacgaaggaaggagaaacacatttgggctaagctagtgatggatgaattgattgagagagcttctctgtacaagtatgactatactggaaaaagctcttttgttcttcagcatgacaatgatatggaaaacaaagatagtcacgtgaacaaaaaaactattgagaaaaagagaagtgtgtcaccaattttaattgcagcaaagatgggagtaaatgaaatggtggagaaggtcctagataccttcccagtggccatccatgatgtagattctgacaacaagaatgttgttcttttggctatagagaacaggcagcctcgtgtgtacaagctgctggcaaagaggaatttggtaaaggaaagtgcattttgtcacatagacaatcaaggtaacagtgcattgcaccttgctgccatgtatagggaacatagaccttggcgtgtccctggtgatgccatgcaaatgcagtgggaatataagtggtacaagcaaaatcattttagacatgtttacaacaatgtctcggacaagattacctctaacgaggataaatgtgaggaaaaaattggaaatctttacaaattagcatag

SEQ ID NO: 87263 - DNA, 468 bp, Glycine max
  Peptide Sequence Number=SeqID_204041
atgctggaaactaccgtcaagagccccaaacctctgtcttccaccgacgatgagtccttcttaccgaatgaactgatcttggagatctttcttagggttctgattgacgtcattccaaagattgtcaatctggttatactcgtgatgcgtattttacttaccatggtttttgctacgatcacgtgcatgacaagtactaagttgctattagttgtgacagatttgtttgaaactgtggccaaagtatatacctttggtgaagaagaatattcagggaaaaggcttcagaatttcccatgtcgacccactgtgagactggggaaatttgttagtggcacacttaattggatagctgagggggctgtaagtgatgatcgatgcgtgattctttcccctgatcttaagcaaggtatttgggctgtgtggatgatgaaggagtatgtgttcaagattcttggactaaattga

SEQ ID NO: 87264 - DNA, 213 bp, Glycine max
  Peptide Sequence Number=SeqID_204042
atggggtttttggatcctcctgacattcaaaaatatattcttcctccccatttgattttggtatcgatggggctcttaagtgttgatcagcttcagatcccttcaacgttgatgtctggtgtgagcactattgctcactatcaacgatggcatatacaacatcctggattcaagggcttgcttttgaattccaataacgcatatcagcactaa

SEQ ID NO: 87265 - DNA, 2628 bp, Glycine max
  Peptide Sequence Number=SeqID_204043
cagttacggatcgggggcaatccatatctcaccggacaaatcccctcacagttaggcctactcaccaacctcaccacttttggtgcagctgccactggactttctggtgtcattccctctacatttggtaacttgatcaatctacaaactctagcactttatgatactgaaatttctggttcaataccaccagaacttgggtcgtgttcggagctgagaaatctgtacctacacatgaacaagctcactggctctatccctcctcaattgagcaagttgcaaaagcttactagcttgctactttggggaaattccttaactggtccaatcccagcagagctttccaactgttcatcgcttgttatatttgatgtctcttctaatgatctctctggtgaaatacctggggactttgggaagctggtggttctggaacagcttcatctatcagacaattcactcacaggtaaaataccatggcagttgggcaactgcaccagcctttccactgttcagcttgacaagaatcagttatcaggtactattccatgggagttaggcaaattgaaggttctgcagagttttttcttgtggggtaatttagtgtctggaaccataccatcctcttttggaaactgcacagaactatatgcacttgacctttcaaggaacaagctgacaggttctataccagaacagattttcagcttgaagaagctgagtaagcttctgcttctgggaaattcattaacaggaaggttgccatcaagtgtttcaaattgccagtctttagtgaggctgagggttggagaaaaccaactttcgggacagattccgaaagagataggccaattgcagaatctggtgttccttgacttgtacatgaatcatttctctggaagcataccagtggagattgccaacatcacagttcttgagctgttagatattcacaacaactacctcactggggaaatttcatctgtgattggggagcttgaaaatttggagcagcttgatctcagtagaaacagtttgataggtgaaattccttggagctttggaaacttcagctatttgaacaagctcatcctcaataacaacttgctgacagggtcaatcccaaaatccattagaaatttgcagaagttaactcttctggatttgagttacaacagcctctctggtggcataccccctgagattggtcatgttacaagcttaaccatcagtttggacttgagctcaaacgaatttaccggagaaatcccagattcagtgtctgctttgacacagttacaatcacttgatctttctcataatatgctttatggaggaatcaaggttctggggtctctaactagcctcacttctctcaatatctcctacaacaacttctcaggtcctatcccagtaactccattcttcagaactctatcttgtatttcatatcttcagaacccccagctttgtcagtcaatggatgggacatcatgttcttcaagcctgattcaaaaaaatggtttgaaatccgcaaaaacgatagcttgggtcacagtcattctagcctcagttactataattctcatttcatcctggattctagtaactcgcaatcacggatacaaggttgaaaaaacactgggagcatcaacttccacatcaggagctgaggatttctcttatccttggactttcatcccatttcagaaagtaaacttcagcattgacgatatcttggattgcttgaaggatgaaaatgtgattggaaagggttgctcaggtgttgtgtacaaggctgagatgccgaatggggagttgatagcagtgaagaagctgtggaaagcaagcaaagcagacgaagccgtggattcttttgctgcagagattcagattcttggatacattcggcataggaacattgtgaggctcataggttattgttctaacgggagtgttaatcttcttctctataactacatcccaaatggtaatctgcgacagcttttacaagggaacaggagcctagactgggaaacaagatacaagattgcagttggatcagctcaaggtctagcttaccttcaccatgattgtgtccctgcaattctccatagagatgtgaaatgcaataacatacttctagactccaaatttgaggcatatctggcagattttggtcttgcaaagctaatgcattcaccaacttatcatcatgcaatgtccagagttgctggttcctatgaatatggctactccatgaacataacagagaagagtgatgtctatagttatggggtggttttgctagagatactaagcgggcgcagtgctgttgaatctcatgttggagatggccaacacatagtggagtgggtgaagaggaagatgggaagctttgaaccagctgtatcaatactagacacaaagctccaaggtctgccagatcaaatggtgcaagagatgcttcaaacacttggcattgctatgttttgcgtgaactcttccccaacggagcgccccacgatgaaggaagtggttgcactacttatggaggtgaagagccagcctgaggagatgggcaagacctctcaacctctaataaaacagtcctcaaatcaaagctga

SEQ ID NO: 87266 - DNA, 2010 bp, Glycine max
  Peptide Sequence Number=SeqID_204044
atggcggcggcgatttcttcaccgatggctcagtctgtggcggcggcggcgactccagtaatagctccgggagtcgcattgggcggaggtccctttgcgaatgcgtctctgtacgtgggcgatctcgaggggaatgtaaatgaggagcaactttatgatctgttcagccaggtggctcagattgcttcaattagggtttgcagggatcagaccaagcgatcctctcttggttatgcctatgtcaactttgccaacgctcaggacggttttgacctccctgaactgaaatctctatgctgtcattgcgcagaaaaaacatccaatgccatggaacttctgaacttcactcctctgaatggaaaaccgattcgaattatgttttcccaacgtgatccaagcattcggaaaagcggacatggcaatgtgttcattaagaacctggatacatcaattgataacaaggcattgcatgacacttttgctgcctttggcactgtactttcttgtaaggtggctcttgacagcagtggccagtcaaaagggtatggttttgttcagtttgacaatgaagaggctgcccagaatgcaatcaaacgattgaacggcatgttgataaatgataaacaagtctacgttggactctttattcggcgccaggaaagggagcagacaaatggatcacccaagttcactaatgtatatgtgaaaaatttgtctgaaacatatactgatgaggacctgaagaagctatttggcccctatggtacaataaccagtgcaacagttatgaaagatgtgaatgggaagtctagatgttttggttttgtgaatttccagaatccggattcagcagctgctgcagttgagaggttaaatggaactactattaacaatgacagggttttatatgtggggagagctcagaggaaagcagaaagagaggccgagttgaaagcaaaaattgagcaggaaagaatcagtagatatgaaaaattacaaggtgctaatttgtacctgaaaaatcttgatgacagtttcagtgatgagaagttgaaggatctattttctgagtttggaactataacatcttgcaaggtgatgattgattcaaatggacggagtaaggggtctggttttgtttccttttctactcctgaggaagcaagtaaagctttgaatgaaatgaatggcaagttgattggacgaaagcctctatatgttgctgtggcccagcgcaaagaagagaggaaggctcatctacaggctcaatttgctcaaattcgagcacctggtggaatggcacctctgcctgctggtattcctttatatcatccaggggcaccgagacttgccccccaacagttgtattatggtcaaggcacacctggctttatgccaccacagcctgctggattttctttccagcagcaaatcttgcctggaatgcggcctggtgtcgcccccaatttcattatgccttaccaccttcagagacagggtcagcttgggcagaggacgggtgttcgtagaaatggaaacttccaacaggtgcaacagaaccagatgctacatcgtaactccaaccaaggatttagatacatgcccaatggtcgaaatggcatggatccatctttagttcctcacggtcttatgggtcccatgatgcctatgccctttgatggttctggagtcactgcagcccctaatgataatcagcgtcctggagcattgtctaccacacttgcctcagctcttgcctctgctaccccagaaaatcagcgcatgatgttgggtgaacatctatatccccttgtggaacgactcgcaccaaaccaatatacagcaaaggtgacagggatgttgctggaaatggaccagtcagaagtaatcaatctcattgaatctcctgaggacctgaagacaaaggtgtcggaggcaatgcaggtcctgcatgaggttgcatctggttctgaagttgatcagcttggctcgatgtcgttgaatgaatga

SEQ ID NO: 87267 - DNA, 351 bp, Glycine max
  Peptide Sequence Number=SeqID_204045
atgtactgcaattcatgtgaaagaaccgttgccaaagtcatctccaagtgcaaagataatagttgtgtaactactacgcttttgttaggagtggaaaagttcattaccgacatgaacgaacaccgggtggtggtgacgggtcgtattgatcccatgaaagtatttaaaaaactaaagaagaaaacgggaaagaaagtggagattgtgtctaacatggatgaagagccaaacgatgagtcggataaacttgttatgatgcatcagttcgcaccggaaaatgatagttgcataaagaccgaaaccatcatgatgttcagtgatgagaacccaaatgcatgtgtagtaatgtag

SEQ ID NO: 87268 - DNA, 739 bp, Glycine max
  Peptide Sequence Number=SeqID_204046
aagagaatgggaaggtatcgtagccggagcagaagctatagcccccggcggcgaagcagaagcccaccggcaccgcgcggacggaagcgctatgtcgacgatcgctacggtgacagcaggtcttacagagaccgccgctcacctcttccttccggcttgcttgcctgaggatcttaggatcccatttgagcgctatggtcctgtgaaggatgtttatctacctaaaaattactacactggtgagcctcgaggctttggatttgtgaaatatcggtatggtgaagatgcagctgaggcaaagcaacatctcaatcatactatcattggtggacgtgaaataaggattgtttttgctgaggaaaataggaaaacttctcaagaaatgcgtgttaatactcgaggaagtggtcgacatggaggtggtagaaggaggaatcgtactagatccccacgaccccgatcctattctcggtctccatcaccagctagggatgattcaagaatcctcactgacatgatgacatatagggatggcaggggtagggatgattattattctcctgagcgatcaagatcttattctaggtctctctctcccagtggtgggaaggactacaagaagtcccctcgtctcagggagaatggtcggagtcctaatgacaagaaggatcagacaccccgcagatccgagagtcctagggacaatgattgcagtccttcaaggtctcattcacggtga

SEQ ID NO: 87269 - DNA, 267 bp, Glycine max
  Peptide Sequence Number=SeqID_204047
atgactgaattagctcctaaatgtaagcctcaaattgactctcaccattatacacagaaagtatggttggaagacaaaacttatggtactctgataggaatcagaaaggaaactcagaacagaacaataaagaatttcagagatgaaattctagtaaacttgatgcctcaagaaggaagaggaaaaccagatgcagatagtagagaaaaaccttcacaaggcaaagaaaggcttggagttgtgagggaagagccgaggagagattga

SEQ ID NO: 87270 - DNA, 912 bp, Glycine max
  Peptide Sequence Number=SeqID_204048
atgaaggggacacgtggccaacgttgctgtaagcactggaacgatgtgggccccacacagaggccacgcgttccgtggattcgtgctgctcaagtgcgtgtcacgtgggccacattttcctttgttgggttcctctcgagggccccgataacctcaccctccactccaaaacccgctgtctccggtcaccctcaccctctcccgccaccgggatctgaagacatgcagtccaagtctgaaactgcaaatcgactgagatcagatcctcattcctttcaacctggcagtgtttattctgagccttggtggcgtggtattgggtacaatcctgtggcccagacaatggctggggcaaatgcatccaattcatcgtctcttgaatgccctaatggtgattctgaatccaatgaagaaggtcagtctttgtccaatagcgggatgaatgaggaagatgatgatgccactaaggattcacagcctgctgctcctaatggaacaggaaattatgggcaagaacagcaagggatgcagcatactgcatcatctgcaccctccatgcgtgaagaatgccttactcagacaccacagctggaacttgtcggtcattcaattgcatgtgctacaaatccttatcaggatccgtattatgggggcatgatggcagcttatggtcaccaacagttgggatatgctccttttataggaatgcctcatgccagaatgcctttgccccttgagatggctcaagaacctgtgtatgtgaatgccaaacagtaccaaggaattctgaggcgaagacaggctcgtgctaaagcagagcttgaaaggaagctcataaaatctagaaagaaaaagtattgggacatgaataaatgtaacatgtctgggaaggttatctatcaaggatacaat

SEQ ID NO: 87271 - DNA, 661 bp, Glycine max
  Peptide Sequence Number=SeqID_204049
aaagtgggcaattgaggagcacaaggatgttgatagtggagaagccaataggattcagggtttgcaagagcccttcattcaacatgagaaggatgctgctgcctgtaaagatgttgaatctaatacaacagtggaaaatggatctatcggaatggtgttgttgctgtttgtggtgggctattcagctcccactcaagcggctatcagggaagatcttaatctatctcttgctgagttttctatgttcggttctttagtaaccattggtgcaacgcttggggctataacgagtggccggattacagatttcattggccggaaaggggatccttactcacttgacctgggaagatttttcacaggatatggaattggagttatctcattcgtggtgcctgtatatatagctgaaatagcacccaaaaatcttcgtggtggacttgcaacaacaaatcagcttatgattgttattggatcatcaatctcattcttattaggaagtttcttaagttggagacagctagcactagcagggcttgtgccttgcatttcattgctgattggtttgcactttatcccagagtctcctagatggctggcaaaggttggcctcaagaaagaatttcaagtagctttaagaaaactcgggaaaagatgttga

SEQ ID NO: 87272 - DNA, 570 bp, Glycine max
  Peptide Sequence Number=SeqID_204050
tgctggatctatgagtacttttcgagtgtgcatcagtgcgtcaccgatgatgcgtatgaggagacgtccccacgtgcctcccggtggctgacgacgaaggcacatatgaagggaattataggagcgtcataccgggcacgttgtgatgctttgacggtcatagacgtgtgctggttgccttatactgagatgggtcctatggtggtcacagttcaaccggagagggtgctatgccagtttcggtacattcagagcatccctccgccgcctgttagcgcttcgttgtcatatgatgatatggatgacaggtggatgcatttctcagaccacgtagcagctgtgggtgacatttgtgtaatgcctaggcaggatgattacgaaggctatgaagcgatcgcagaaagtttggagcgtgtgctcaaccttaggatggtcactgcaggcacagagttacagatatcatgcaagattgcctcaggatcgccagggggggtgctagcgcagatggaagtgttagggcttgacaaagacggcgcacagagcattgatgatgttttttatgttttgtag

SEQ ID NO: 87273 - DNA, 204 bp, Glycine max
  Peptide Sequence Number=SeqID_204051
atggctttgcggcagcacttgaagaggaagaagctgcagatattgcagaaaatacactttcaacatcggttatttagaacattctacatcggttctaaaaccgatgttgaaagttccgatgttgaatggatggatgttaacatcggttttgtaaaactgatgttaacatatgacaatatcggtgctctgaatacccgatgttaa

SEQ ID NO: 87274 - DNA, 216 bp, Glycine max
  Peptide Sequence Number=SeqID_204052
atgcccaacattgtgaatttaatgtgtttcaacttcaatttcagcgaggcttgtgcgcttagcgagagtcatgcgctaagcgaggcactcagcccacttaacgagttgggagaatatggaggagaatatgagaatcatctgtgcgctcagcgcatcatcagcttgctcagcgagacgtttgtctcttcctgcgctaagcgcacccagctcgcttag

SEQ ID NO: 87275 - DNA, 448 bp, Glycine max
  Peptide Sequence Number=SeqID_204053
acgctgcacggcagcggcacgccgggccaggtgattgagatcgaatatggcgtgcagggtgaaggcttgcgccacgccggcagcgtgctggtcgatgccgacggcaagtggagcttcacctcgccgtatctgcatcagcctggcgtgtgggaatatcaggcgcgcgcctcgaccggcgagatgaagagcaactggagcagcaaattcgtgctcgacgtcagcccggacgccgcgttcgatcagcaggcgcaggatgaagcccagccggacgggctgacgctgcaccaactgctgagtgaaggtggcacagggctgttcattgaggatgacagcacccagctgctggtgaacggcaagccgggcgacagcgtgcagctgcaggatattctgccggaaggcgaagcggtcgatggctggacgcagcagaccggcaccctgaccatcgccg

SEQ ID NO: 87276 - DNA, 628 bp, Glycine max
  Peptide Sequence Number=SeqID_204054
atggctacttctggtcctgttttttcattttctggaatcccaaccattgcaactgccaagctcaactggaaaaattatttgtcgtggtctgcttcagttgagttgtggtttcttggtcaagggtaccatgaccacctagagaaaaacgtcaatgttgttccaaatgacaagaaacttgaatgggagaaggtagattatcaactatgtgctgttctgtggcaatcagtcgagtcagatgttttggaaattctcagatcttttaaaacatgtcatcttttttggaagaaggcccaagagatcttcgccaacgatattcaaagcctatttgatgcgactgtgaaagttacagctctcaagcaatctaaccatgacatgattgcacatatgggtaaagctcgggcaacagtagaagagctgagaaggtttcttgtggctgattcgttggaagaggtgaataggaaactggacaagttctacatggtcctagctggagatcaagtcccattgatggattctctcattactaggcttctccgtgtacctcatgcgttgaaggatgaaaatctcactgatgctgtggaaacatcagccatggtggcacctcgtgggagagggggaggccgtaaca

SEQ ID NO: 87277 - DNA, 562 bp, Glycine max
  Peptide Sequence Number=SeqID_204055
cgtgactcaaaagtcagtatgacagatcttgtgagcacggaagatgacgtcgcagaagacgacgttagtctctgcgtgctatcaagcttttcgtcttacagacagcaaaaagtttatacggataaccactcgggtatttccgcccgtcagcgtgactcaaaagtcagtatgacagatcttgtgagcgcggaagatgacatatatctccgcatgtcaacgggcttgtcggccgcgattgacgaagggcgcagaagacgaccaaaagtttatacggataaccactcgggtatttccgcccgtcagcgtgactcaaaagtcagtatgacagatcttgtgagcgcggaagatgacggcgcagaagacgacgttagtctctgcgtgctatcaggcttttcgtcttacagacaacaaaaagtttatacggataaccactcgggtatttccgcccgtcagcgtgactcaaaagtcagtatgacagatcttgtgagcgcggaagatgacataaatcacagcatgtcaacaggcttgtcggccgcgattgacgaagggcgcagaagacgac

SEQ ID NO: 87278 - DNA, 540 bp, Glycine max
  Peptide Sequence Number=SeqID_204056
atggagatgctggaacacgtgccggatccgcgttccgtggtgctggcctgcgcgcagctgatgaaaccgggcggcgaagtgtttttctccaccatcaaccgtaaccctaaagcctggctactggcggtgtttggtgctgaatacgtgctgcgcatggtgccgcgcggtacccatgacgtgaaaaaatttattcgtcctgccgagctgctgaactgggtggatgagaccgccctgcgtgaacgcaatatgactggcctgcactacaatccgctgaccaaccagttccgccttggccgcggggtggacgtcaattatatggtgcatacccaccgtcaggccgctgttgtagcggcgcgatgtattacgcgagaaatcgcgccgctatggaatctacgaccggcaatttacttaactgaacggcataacgccctactaactgccagtcctcctctcacttccgaccgcccccggtttatcacgcgctggccctatccagatcaatttccttttagacgctgcgatgcgctttttgtaaggtga

SEQ ID NO: 87279 - DNA, 189 bp, Glycine max
  Peptide Sequence Number=SeqID_204057
atgttgttgttggggataaggtgttgggttttagtttcttcaattgcagtggtagtgttgattattataggaggttgtgcagagggtagtaggcctcatcggattcttgtggatacagatgttgacactgatgatttctttgctcttctctatctcttgaagttcaacgcttcacagtttcagttggag

SEQ ID NO: 87280 - DNA, 768 bp, Glycine max
  Peptide Sequence Number=SeqID_204058
atgaggatgttccggtggatgtgtggtaagattcgacaggataaaattagaaacgaagctataagagagagggttggattagcgcctattgtagaaaagatggtggaaaatagacttaggtggtttgggcatgtagagagaagaccggtagactctgtagtgaggagagtagaccagatggagagaagacaaactattcgaggcagaggaagacccaaaaagactataagagaggttataaaaaaggatctcaaacttaatgatttggatagaagactttcttcaggaaaaattggtagcatagcatacgcttgtatgcaggttccattcactgtattgggagccatgttgatggataagtctggaagaagaccacttataatggatcagagcttattgcttgattgtgtaccaatattggcagttgccagcgtgctgatctacgtaggggcgttttcaattggaatgggaccggttccttgggtaataatgtctgagatctttctcatacacgttaagggaactgcagggagcttggtggttttggtgaattggctaggagcttggcaaagttactcccagaaaccaaaggaaaaacactggaagaagttcaggcatgcatcaattcatagaaggaaaaaaagagaaacaaagcttggatggataaattcagcaattgcctccaaatgttgttcccaaatctcagtccgtgccaaaaatttccagcaggaggatcatgtgcaattactactagtcaaattcttttag

SEQ ID NO: 87281 - DNA, 2322 bp, Glycine max
  Peptide Sequence Number=SeqID_204059
atggcgggcgaatcgggtggtagtgctacgaacttgaactttgatcttcccgaggaggtggtgcaagtgctaccgtccgatcccttccagcagctcgatgtggctcgcaagatcacttccattgctctatcgacacgtgtcaacaccctcgaatcagacctatcctcacttcgcgcccagatcgccgacaaagacaacctcatcgccgaccttcaatctcagctcgactccctcgacgcttccctctcccaaatcgccgccacactcttccaaaccgaacaggataaggagagcttgctccaggagaatgcttcgctttccgacaccgtcaaaaagctcaatcgagatgtctccaagttggaggttttcagaaagacgcttatgcaatcacttcaggaggatgatgataattctgtaagttctgtgctgggaggaactccagacactgttgctaaaatacagagtcaagcaagtttgacttccacgtcgcagattggaggtactttcaacttgtatgctatctacctctacaacattgcacttctgttgattcttggtgcactatataacgaagcttcattgccaccggctatatcttcttcaacaggaaattcatttgctgatgatcaggaatctgatgccataagacctagagtatcgcagaatctcctcttagcatctcaaggttccacccctcggataactcctcctggttcccctcctattctgtcggcatcagtatcacctacgagaacatccaaacctgtatctccacggcgacattcaatttccttttcaaccacaagaggcatgcatgatgacaggtcttcagtgttttcctcaatgtccttaacccatggttcaatatcaagctctgatgcaggaacaggatcacaaactggacgaacacgggtggatgggaaagagttttttcgccaagttaggaaccgtttgtcttatgagcaatttggtgcattcttggcaaatgttaaagaattgaattcccataaacaaacaaaagaggtacttcctcctgtcttctcagttctctcctccctcacctcttacgcgggttccgctagctccgtcatcaacccttccaaggtcaaacagatttcctggaagccaagagctttcgtttatgaaggtttcctcacggatttggaatgcgaccacttgatctctctagcgaaatcggagcttaagagatctgccgtagcggataatctctctggagagagccagctaagtgatgttcgaacaagctctggaatgttcatttccaagaacaaggatcctattgttgctggtattgaggacaagatttcgtcatggacctttcttccaaaagaaaatggggaagatatacaagtattgagatatgagcatggccagaaatatgacccgcattatgattacttcactgataaagttaacattgctcggggtggacatcgcatcgcgactgttctcatgtatctcactgatgtagccaaaggcggtgaaactgtcttcccttctgcagaggaacctccacgtcgcagaggtgctgaaacaagcagtgatctttctgaatgtgccaagaaaggaatagcagtgaaaccacgtagaggggacgcacttcttttcttcagtcttcacacaaatgctaccccagacactagcagtctccatgctggatgccctgttatcgaaggtgagaaatggtccgcaacaaagtggattcatgtagactcgtttgataagactgtgggagctggaggtgattgttctgataatcatgtaagctgtgagagatgggcttcacttggagaatgcactaaaaatcctgagtatatgattggatcttcagacattcccggctattgtaggaaaagctgcaaggcgtgggactcttctgatcatcatgtaagctgtgagagacgggcttcccttagagaatgcactaagaatcctgagtatatgattggatcttcagactttcctggctactataggaagttctgcaaggcatccgaaggcacagagagacttgtgttctttgagccttcagctcctgaaatccgatccatagacttcaatgcatctctttacgatgattctgcttctgttgcattaaagctcaactttttgccacccaaaccttatgatgttcgaatccgaggtttccacggacaactagcttacccacctataattgctcccagtaagaatgtcatgtttttgacatttctctatggtttttggtatgacccatcaacagatgactacttggtggttaaagtgttctgccacgcttgctcagctgttagtgctaactga

SEQ ID NO: 87282 - DNA, 2265 bp, Glycine max
  Peptide Sequence Number=SeqID_204060
ggcatcagcatcagtgcaaatgcttggacgagtgctggtcatgctgttaatcacatttacgatctactttacatgatggggcgagatgacgttgccgttggagttggaggcgagggtggaatactacaaaatggtaccatactccctaacgtcggtggatatcttccaattgtagaacagggaatgacaacagtaggaggttgcagatacagaggggcaattcctgtaggtcttggagggcgattagacatcgatgccaattatggtatcaggaaggctttcctaccgcagcaaccaactgcacagcaagtgttgattgaaaaaatatctgcaggtccaataactctgcttgtgattggagcgcatacaaacattgcaattttcctaatgaataacccacacctaaagaaaaatgtggaacatatttatataatgggtggcggtgtaaggtcaagcaacccaacaggttgttgccccaaaaatgcttcatctacctgcgtgcctatgcagtgtggtgaccgtggcaatatgttcacagattataataccaacccttatgcagagttcaatatatttggagacccttttgcagcataccagagttattttatgtgggactctttcacagctggtgtagccgtctcaatcatgagtaaacccaataaccataaaggagaaaatgaatttgctgaaatggagtatatgaacataactgtaatcacttcaaacaaaccatatggggtatctgatggctccaaccctttctttgatggccgaagagttcctaaattcaatttagaaaaaggtggggtgcatagtggccatgttcaacaaggacttagagatccactctgctttgtgaataatgggaaagggaaatgtcaggatggttacacagcagaggtaagtggtccagactcagtgagggtacttgttgccacaaaagcaaaacctaacaaggatgtcgggagctcacttgacagagaatatttcataagcttcttgaatgttctaaagcatccacaaaatgctgggaggttcaacttcatcacacagtttccttactacaaagaagtaacttacaagccagattttcaaaataaaacactggggaaacctgttgtgtttgatatggacatgagtgcaggcgattttctggctctattttacctcctaaaagtgcctgttcaagtaattgaccttaaggcactcattgtgagccctactggatggactaattcggcaacaatagatgtcatctatgacttactgcacatgatgggtcgtgacgatatcccagttggtctaggagatgtttttgcaatgaatcagtcagatccaatattcccacctgttggagaatgcaagtatgtaaaagccattccccatggaagtggggggttactagactctgacactctttatggtcttgctcgtgacctaccacgcagcccaagaaggtatacagcagagaactctgaagtttggggggctcctcgggatacggatcaccctgaactcagacaaccactagccatggaagtttgggactctgtattgcaaagaactaaaccaaggtctaagattacagtattgactaatggacccttgactaacctggcaaaggttgtatcggtgaaaaacataagctcaagaattcaggaggtatatgtagtggggggacacttaagcagcaatgtcaatgacaaaggaaatatcttttcagttccttccaaccaatacgcagaattcaatatgttcttggatcctttagcagccaagacagtttttgaatcagaagttaacatcacactcattccactgaacacacagcgccaagtaagttcattttcaaccattataggcgagttgcgtaggacaccaagaacacctgaggctgtgttttccgagcgtcttctgtcaaggctataccgtttaaagcaaactcataacagatatcagcatatggacacattcttgggggaaattgtaggtgcagctgtcttgactgatagcaattccggtcttaatccaaattttgaggtgaaggcagttaatgttttggctgatggcaatgaatcaagtgatggaaaaattgtggtggatgagaaaggtggaaaactagtgagaattttaagcagtgtggatgcaaaggtttattatagtttgtatgcaaacaagcttggcgatgaggaccaatcagcaaagataggcagctttgagaaacagcggagaaaatggaatcatcctcacagtaaaaaatag

SEQ ID NO: 87283 - DNA, 225 bp, Glycine max
  Peptide Sequence Number=SeqID_204061
atgtctatttcttgctacactggatgtatgctgattgtggaaactaaaattagaaaagtggtaatgatatataacaagaccaagaaaaaccattttttacagataagtagagattgtcaggagctggagccctctattggagagcagctggcatccttgctttatcttgagccagatagtgaacttatggtatattctcctttgagtcatcatcttgctttgtga

SEQ ID NO: 87284 - DNA, 2466 bp, Glycine max
  Peptide Sequence Number=SeqID_204062
atggccgattccggcaaagctttaggaacctcggatcggcttgagaatgctctggttcgtctcaccaaccaacaactctgcttgggcgaatccatgcattccatgaccttgaaaatcgatgaactcctccatcatgtctcccctctgctctcgcctcctcctgtgccacttcccttacatcatccacatcctttattcaaactcactcaaaggggaaatgtgggacaatacctatcgaagttcgaggacttggccaactggattgtcggtcttccagtccctttccttctgagctgcttcgtctccggtttgacaccggaaattcacagggagtcacgggctccccaacctatctcactgagtcctcctcacgcaacaccattaccaccacttctcccttcacctccgcggccgccaccacccccgaccttgaagtgcttgacgccagaagagatagcctcatgccgcgagcgtgggctctgcttcaattgtgatgagaagtgtcatagaggtcatcgttatgcctcttgggtttttctcttaatcgcggaagacgaagacccaacgatatctcatataggccccaatgactcgattcctgacccgcccgatgggcctgactcgtgcccggcccaaataagcctcaattcattagcaggccacttagcgtcaaaaacgctccgtttagtgggaacgatcaccggttactcggtgatccttctggtggatagtgggagtacccacaacttcatccaacaacaactcgtcactcaactgggattgccttgttggaaaacaacacctctaagggtcatggttggcaatggacaacaactggagtgcaattgcttctgcgaggctgtcaccatcgacattcaaactactccattcacagtggacctctatgtcctaccgatagcaggtgccaatgggcgcttagtagaattacagggagataatgatgctaatttgggcttcttcctcgctaccagagattctcatccggaactccaagctttactcactaagtttggctccctgttccagaatcctcaaatcctactgccgacaagggacactgaccaccacattcatctcctaccgctgtcaacaccggtcaactacgagtccattctcctcgccggtactactagtgaagaagactaccgagccttgaatgcactcacagtcaaggataggttccccattcccacaattgatgaactcttggatgaattgggaggcgctaggtgcttttcaaagttggacttgttgcaagggtaccatcaaattcgaatgcatgtttccgatattcccaaaacggccttcaagacacaccatggacattatgaattcaaagtaatgccatttgggttgtgtaatgcgccgtcatcattccaggcgaccacgaagatgatctttcggccttatctcctccacttcatcatcgtcttcttcgacgatatcctcatatatagcgattcctttgaggattatttgtgccacttggagacaacatttcaggtgggtggaaccagtagcttcgaaagtagcaactatccatcagtggccaattcctcggtctatcagagccctgagaagcttcctggatcttgcagggttttatcaccggttcatctgaggttatgctaccattgcggctcccttggtgaagttacccttcaccgtggagacgaatgcgtcgggagtaggaatgggcatagtcctatctcaatagggacatcccattgccttcttcagcaaacccttcagctcgaagcttcttcgtgcatccatgtgtgtccgggaattgttcgtgattacgacggcggtaattcaaaccccgaaacaacacatgtatttggcgcgtctaatggggcggctgatgccctgtcaagattgccagaacaagacccatcaatgttcatgattctgtcagtaccgtgcttaactttcatggaagaacttcgccgtcaacttgacagccaccctgagtatcaacaccaacatcaaaatgttcgcgattgccccgccaaacaccctgaattttccattacacatgaccttgttctgaacagaggtcgtatttggttgccatggggacttccgataatttccaccttactcacggagtaccatgccatgcccactggaggacacataggggttgccaagaccttagctcacataacggaaaatttctattggcctggtctcagggatgatgttaaccaatttgtggccaactgcgtggaatgtcaggttacgaagtacgaaacaaagaagatagttgggttattatgtcttctccctgttccataccggccttgggaggacctctcgttggatttcatcgtcggactttcatcgtatcatggctatacggtgatactcgtggtggctgtgtacacagagtctctactttcactcccttatgacagcaagaaagccgaaaaagataactga

SEQ ID NO: 87285 - DNA, 144 bp, Glycine max
  Peptide Sequence Number=SeqID_204063
atgcctttccccacactagaaacccaaggtgtaaaggaaggaaaggaaaggtggcggcacgatgttgatgaagagggtgtaagggttgacatggtggaggacgaggtagttgttgtcacaggaagcctgactgaacttatatag

SEQ ID NO: 87286 - DNA, 1029 bp, Glycine max
  Peptide Sequence Number=SeqID_204064
atggaggattccgagggagtcctcagcttcgatttcgagggcggcctcgacgccgctccctcctccgccgccgccgccgttccctccggccccctcgtccagcacgactcctccgcggcagcttccgccgtgtccaacggaggccacgccgcccccgccccgtccacggcggaccccgccggcggcaacgtcccggggcggcggagcttccggcagacggtttgccggcactggctgcgcagcctgtgcatgaagggcgacgcgtgcgggttcctgcaccagtacgacaaggcgaggatgccggtgtgccgcttcttcaggctctacggagagtgccgagaacaggattgcgtctataaacacaccaatgaagacatcaaggagtgtaacatgtttgatggagtattgaaaagtagtgattgtgcaaagagattaaactttgaacagacatttttaattctagtttctactttcattatgcattgcattctagctgctggactgtttgtttgggatgatgacttaagcttgttttctgagcgcattactaattacttcttggcatcgttgttatgttcgagtaatgaagttttacatggaaggatttattggtacaagttgggattttgtcctaatggacctgattgtcgatataggcatgcaaaatctcctggacctccacctcctgttgaagaggttcttcaaaagatccaacatttattttcctacaattataactcatccaacaaatttttccaacaaagaggtgctagttataatcaacaagctgaaaaaccccagcttcctcaaggaactaattctacaaaccaaggggtgactggaaaaccattaccagcagagtcgggaaatgcccagccacagcaacaagttcagcagtcccagcagcaggttaaccagagccaaatgcaaaatgttgctaatggccagcctaatcaagcaaatagaactgcaacccctttacctcaaggaatatctaggtgtgttcagggtcctgtgtttttcaattga

SEQ ID NO: 87287 - DNA, 285 bp, Glycine max
  Peptide Sequence Number=SeqID_204065
atgagcttagttactgtatgtctttttggcaggggtaattcccttagggatccagcttccaaagcttacgaacaggtgtttgcacctcaccatggctgggcgatcaggaaggctgtttctgcgggaatgtatgcccttcctacaaaggaacagcttctgaagaaactcaatgaggatgaggcatcggcaaaagaccacatgcaaagttatgtcactgcttccgcacctctaatccaatacattgacaaactctttgtttctagagacttgggaatagattggtga

SEQ ID NO: 87288 - DNA, 201 bp, Glycine max
  Peptide Sequence Number=SeqID_204066
atgacgccaccaggaaggaatggcgtggtggatttttttgccaaccgccataggctatttgtgaagggaggcctgccatggcgatgccataaggctcaatggcaagttgatatggcgaaatttcggcttttcaccattgataacactgggtctagattggctagacaagagagaagctcgctttgccagactcaaagctga

SEQ ID NO: 87289 - DNA, 534 bp, Glycine max
  Peptide Sequence Number=SeqID_204067
atgatcatcactttggatgatgtgtctcgtttgttacacttgcctatgacatacagaatcattgattatgtctcctcgacctttaacagagacacggtgacggtcttgttgatgactcatctcagcattctaacagagataaaggctaaggcagcaacaaacgcaagtgtcaagtacgatatttaccaagagcttgactcacgttcatgtcatctacctctagtacctcaacaacctgattgcttgccacgagtacgcatgggagtagttgcattggcgtacctccatgatcatttctcctatgtgagcttgtatgatagcaagcaatgtggagattatatggcgttactcatggcgtgggtgaagtggcaacaacatatcattcccccagacgatgtagtgccacctggggatccttgggcttgcacctctaactatctgccttggttttataagtattcacacccttatgtcattccaccagtggaggaacgagcaccacgcagtcttctatgtttatcccgcatcccatga

SEQ ID NO: 87290 - DNA, 246 bp, Glycine max
  Peptide Sequence Number=SeqID_204068
atgtatttcagaagaccaatacctattttaagatgtggtgtcagcaacgacgacagtaaaaacactaatgatgattacattaacaatgacgataaagataatgatagtgatggtatcgatagtgttggtggtggtgatgatagagataatattggtggtagttatagtaataatatcagtgacatcgaccatggtgatgatagtgataatagtgacaataacaagatcggtattaacaatcaataa

SEQ ID NO: 87291 - DNA, 312 bp, Glycine max
  Peptide Sequence Number=SeqID_204069
atggacgggtactggtactccaccatccacgtgactccggaggacggtttcagctacgcgagcttcgagtgcgtgggatccgtcaacggcaacataggacacgtgttgaggaaggtggttcagattttccgtcctgggactatgtcaatatcgaccacgtgcaatggcttcagcaacgacatcatgtggacgcagatggcgggcgcggtggagcctctcggcttgaaatgtaggagttgcgcaatggacaagttccccaacgcgggtacagtcgtgtttcaaacgttcactcctcgccggaaaaatgtttaa

SEQ ID NO: 87292 - DNA, 4251 bp, Glycine max
  Peptide Sequence Number=SeqID_204070
atgggttgtgtccatggcaagtcttgctgtggcgacagttcttcatcagatgatggttctagggattaccgagaacttggcttcattcatggccacaggaagaacgtgctcgctcagagatcattgaagcatgttcctgttccttcccacaacttcattttggagtacactttcctcagtcagcgggggtactaccctgattcacctgataaagaaaaccaagatagtttctgcatcactacacaactccaaggtaaccccaatgtccatttctttggtgtctatgatgggcatggccaatttggtagccagtgttcgaattttgttaagcataggctggttgagaagttgtcaaatgaccctgcattgttggaggaccctgttcaggcttacaattctgcattcttggcaacaaatcaagaattgcgtagtactagtgagattgatgattctatgagtggcaccaccgcgattacggtgcttgttattggtgacactctttatgttgctaatgttggtgattcaagagcggtgctggctgttagggatgggaatcacattgttgccgaggacttgtcctctgatcagacgccatttcggagggatgaatatgagagagtgaaactttgtggggcaagggtgttgagtgttgatcaagtggaagggctaaaggatccagatatccagcattggggtgatgaagagagtcggggtggcgatcctccaagattgtgggttcctaatgggatgtatcctggaactgcatttacaaggagtataggggatagtttggcagagacaattggtgtcattgctattccggaggtgaaaacggttcagcttacacctaatcatcttttctttgttgtggcaagtgatggcatatttgaattcctgacaagccaaactgttgttgatatggcagcaagctatatggatcctcgtgatgcatgttcagctattgcagagaagtcgtataaactatggttggaacttgagaacagaacagatgatataacaatcatcattgttcagatcaaaggtctctctaattcaggtacatctggagttggatccgatgagatcaatggtgggggtactgtaatgaattccaggacaggaactcatgagatatctgctacccctggatctaatgtttatcgttctgtcagaaacagtttatccgatttgcactcctgtcagcatgtggcttcagtgacgagcgcagcgatagagagaggctttactgaagcttcatcaagtctctttgcagtttctcccaagtggtacatttccacgttccaacttcctgagcattgtgcattactgttgtacatttactggtcactacattttaggctgccaacttgccagcttaagaaaccaaacccctcagaggagaacacttgtgctcaccttcctgtgacgcaattgcacctccactctacagatttgatctttggaaggggaatcaataacgagcttgaaataaaaggaaggtggtatacaaggagctgtgactgtgactatcatttgcaatggatcgttgaagaaactcataggatggtcgatgctaaaatgatttcattggttgccagttgtagcagtcaaatgtctccttcagtttcttgtcaagaaaaaggaagtaggaacaaaagaaaattcagagttgatccacctctaggggagccaaataagttcattcctgcacctcaactcaagtgcttcagttatgaattctctgctgagaggtttgaaataaccccaggtcatggacaagctgctgcttgtgacctgtgtggtgttagccaagattattctgatggattgaaacttggccttggattgtataatcctggaacatctgaggtcgggcctagtcaatctaaggacgaacctgagacagatgaaattaatgatgcagattggagcgatctcacagaagcccagctggaagaacttgtcctgactaatttggacaccattctcaagagtgcaattaaaaaaattgtagcatgcggctacactgaagacgttgctactaaggccattttaagacctggcatctgttatggatgtaaagatactttgtctaatattgttgataattctttagcatttcttagaaatggtcaagagattgatacatcacgagagcactattttgaagatctagtgcagcttgagaagtataacttggctgaattggtttgtgttcttcgagaggttaggccattcttcagtgttggggatgcaatgtggtgtttgttaatttgtgacatgaatgtgtcacatgcttgtgcaatggattgtaaccctttaagtagtttaggtaatgataattctactggtggtccatctaaccaagctgaatcactatcaaaagcagaaaccaaatgtcctgaaccgagtcttataagtcctagtaaatcaattcctacatgttctcataattctcaatcaaagaaaccctttgtgacaagaattcctggtgtgaacaacttgaatcctcaaattattggtggagcctcagagaaggagggtgccagttgtggatctgagtgcattaataaagcattcagcgctgcaggaacatctcaatctggcctgatgaaagaaaagcgtggaacagttagaaaggtccattctggtagcaccaagagagactacattcttcaacacaagtcatttcacaaagaaaaaagttatcgtacttatggattaaaagggtcttcaagacgaggaaaagtgaatggcttgagtggtttggtcttggataaaaaacttaaatctgtgtcagaatcttctaccataaacttaaagagtgcatccttacagataagtaaggcagtgggcattgatactacgcaagacagtattagtgttaacttttcatgtaatgctgggacttctacatccactgcatttagcctggtgaattcttctgattctgtttgtagatcaaccaatacttcatttgcaataaatgcagcaaatactatacccgtattcagttgtccagcttcattatcagctaccaatacagatctttctctctcattgtcttcaaaaatcaagccttctacggaatctgtctgcagcaataatgaggcacctaatagtagttatatgggaatactgtataataataataataataataagtccccaaggcagtggataccccacgatggaaaggatgagatgattttaaaactgcttccaagggttcgggagctgcaaaaccagcttcaagaatggacagagtgggctaatcagaaggtcatgcaagctgctcgtcgtctgagtaaggaaaaggctgagcttcagacactaaggcaagagaaagaggaagttgaacgtctaaaaaaagagaagcaatctctagaggaaaataccttgaagaagctttctgagatggaaaatgccctgtgtaaagttagtgggcaggtagagcgagctaatgccactgtccggaagctcgaggtggagaaggctgcactgaggaaagaggtggaggctgctaagatacgtgccacagaaactgctgcaagctgtcaagaggtctcaaggagagaaaagaagacacaaatgaagtttcagtcatgggaaaagcagaaatccttgtttcaggaagagctaacgattgaaaaacggaaattggcacagctgctgcaggaattagaacaagctagaatgcagcaggagcaagttgagggtagatggcagcaggaagcaaaggcaaaggaagagtttatcctgcaggccagttctataaaaaaggaaagagaacaaattgaggaatcaggaaaatccaaggaggatgcgatcaaattaaaagcagagaggaatcggcaaatgtacagagatgacatccataaacttgaaaaggaaatttcccaactaagactgaagactgactcttcaaaaattgctgcactgaggatgggcattgatggatgctatgccagcaaatgcttggacatgaaaaatggcactgctcagaaggaaccccgggcttctttcatctcagagctagtcattgaccactcagcgacaggtggtgtgaaacgggaacaagaatgtgtgatgtgcctttcagaggagatgtctgttctgttcatgccatgtgctcatcaggttgtttgcaaaacatgtaatgagctccatgagaagcagggtatgcaagattgcccttcttgcaggagccctatccaacagcgtattgctgtgcgctttccacgtatttga

SEQ ID NO: 87293 - DNA, 663 bp, Glycine max
  Peptide Sequence Number=SeqID_204071
atgaatgcaaacagttcatctatgtctacaaacacccaaacccaaccgttactaggtacaggcgtgagcgtgacaaacacaaacacttcgccattctcagcagttgggagcttcataaagctgctccctacagggactctcttcgtgttccaattcctgaaccctgttttgaccaacagcggtgaatgcaacgccagcaacaagtggctcagcggcattctcctggttgcatgtgggttcagttgcgccttttcttccttcacagatagctacacaggcagcgacaaccagaggcactatggcatcgtaactaccaagggattgtggccttctccagcatccgagtctgttgacttgtcaacctacagactcaagtttggagatttcgtgcatgccgttttatccttgttagtgtttgcggtgttagggctattggataccaacactgtgcactgcttataccccggctttgagtcaactcagaggcttctgcttcaggtgctgcccacagttattggggtattagcgggtggacacttcgtcatttcccccagtaatcgccatggaataggataccctttaacttctgattctaacaccacctccccagaactcaatcacactaccgctcctccacaacatcccaaccacacttctgtttag

SEQ ID NO: 87294 - DNA, 435 bp, Glycine max
  Peptide Sequence Number=SeqID_204072
atgacagaggggaacggtgacaaaactctgcgaaagatcgcagacgcattcaatgaccttgcaaacgttttcaccgattctcagagcgcagaagcagaggtcaaggttgctcccttctctcatgcctgctctctcgtctcccctctcttcggttgcttgggcgtcgccttcaagttcgccgaaatggattacgtcgccaaggttcatgatctggcagaggcgtccaagtctattcagaatctgcagtctctgattgagctggatgtgcaagctaacactgttaggaaaggaggtagccatacgcggaatctgctcagagtgaagcgcggacttgacatggtcagagtgctctttgagcagattctagttacagagtatgtgcatcacttactgatttacattttgctttgtgctaagtatattctttttatctaa

SEQ ID NO: 87295 - DNA, 1338 bp, Glycine max
  Peptide Sequence Number=SeqID_204073
atgctaccgaactacgaagagggcgatcttgattttctccgtttatcagatgctggtttatctgctctcggccaagacttccccaagcttcacaaattgggcttaatccggtgttccagcgtctctagcgatggcttgacacccctagctcggaaatgcacctctctcagagccttggacttacaagtttgttatgttggggatcaaggtctggctgctgttggacagtgttgcaagcagcttgaagacttgaatctgcgattctgccatcgattgactgatactggtctggttgaattagccttaggtgtggggaagtcattgaaatctcttggtgtggcggcttgtaccaagataactgatatctcaatggaagctgtaggatcacattgcagatccctcgagaacttgtcgttggaatctgagaccattcataataaagggctgcttgctgtgtcccaaggatgtccggctttgaaggttctaaaactgcactgttttgatgttacagatgatgctctgaaagctgtaggcactaactgtctgttactggagttattggcattatatagttttcagagatttactgataaggggttgcgtgccattgggaatggatgtaagaagttaaagaatttgactttaattgattgctatttcataagcgataagggtctggaagcaattgctactggctgcaaggaacttacacatcttgaagttaatggatgtcacaacattcgaaatttggggctagaatacattgggagatcttgccaggagggatttgcactaggatttgtcatacgcaagagcaattcaactctgggatcggattcttgggtggatgatcccattactcgccacatcatcagtctttacattagcaaagaagaggagcctaggcatttaaatgcatatgcaaggttgtgtaaaagacctgattgtggagctgctcttggtatgaatgatggcctgtcttccctcttactggatcttccatcagtaacaggggcatttatggtagcacatgccattggtgacataattactggtgacacagtagaacttgaagtgattgtaactgcagctccctctgttggaggcctgtttgattcactcactggtgagcatctatccagctgtaaaagcacctatgaagttttcaactcagaagaagaagaagatgaagaagaagatgaagaagaagatgaagaagaagatgaggcgcccttgtcctcttcacttgaaatcaaattcaagaccgccttgccttccttctcagtacattccatttcgaatggaagcagggctttgctattttcatttttaaaatag

SEQ ID NO: 87296 - DNA, 174 bp, Glycine max
  Peptide Sequence Number=SeqID_204074
atgaccttcgtgagtctttcgttaaccataactgcccatggttggatggtgttgtgggatttccggaagcagtggaaattattcgatttagagcctggtcctggatctcttccaagtgggaaaacgcagctagcccccatttctcaccaaaagaaagaaaaagaaatgaagtaa

SEQ ID NO: 87297 - DNA, 551 bp, Glycine max
  Peptide Sequence Number=SeqID_204075
atgacaacgttcgaagcctctccacccacaaagtctcgcatctgcaactgcaagcaaggccttgtggtttgtcatggtgttctgccattggtactggcggaacatacatgcactgattccaccattagaaaaagcggttaccaaccaaaagattccgctgctggcactggcgggatacacatgtatagggttagggttgcagaacatacatgcactaattccgtcattggaaaaagtgattaccaaccaaaagattcttctgttggcactggcgggatacacatgcgatccatccagccaattagccatgcagcatgcacccaggtactgattccgccattgggaaaagctatcaccaacctaaagattccggctggtggcactggcgggatacacatgccatccatccaaccaatgacccatgtagcatgcatccaggtactgattccgccattgggaaaagtgattaccaacctaaagattctactgctggcactagcgggatacacatgccatccatccagccaaggagccatgcagcatgcatccag

SEQ ID NO: 87298 - DNA, 291 bp, Glycine max
  Peptide Sequence Number=SeqID_204076
atgatatcagcgtttatacaaggtagaaatatcacggataacgcacagatcccgaatgagattctgcaccatatgaagtgcaaaacgcgaggtaagcattgtgaaattgccttgaagatgaacataagtaaagcttacgacaagcaaccaaactatagagttcagtttgtgatgaggagacaagctaatgctcttgttcatcctttggctagagtgacaacttcccatgcatgttcaaaggtttttcaatacatgcattctatcatgtatcttccaacacagtatgaatga

SEQ ID NO: 87299 - DNA, 166 bp, Glycine max
  Peptide Sequence Number=SeqID_204077
aagaagcgatgatgaaaaagcggagaggggacagaagagcgtggataaacagctttacgagactgcatgcgggatcgggtcacgatttcatatcgctatcggcgcgttggtgacgcactgcggggtggaactctacggtggaggctgtgagcgctggggtgcatga

SEQ ID NO: 87300 - DNA, 1416 bp, Glycine max
  Peptide Sequence Number=SeqID_204078
atggacgtgaaagaacgaccactgaaactttacttcattccataccttgccgcgggtcacatgatccctctatgcgacatagcccagttcttcgcctcacgtggccaccatgtgaccatcatcaccaccccttccaacgccgaaatccttcaccagtccaaaaacttccgcgtccacaccttcgacttcccttccgaagaagtaggcctccctgacggcgtcgaaaacttatccgccgtcaccgacctcgaaaaatcctacagaatctacatcgccgccaccacactgctccgcgaacccatcgagagtttcgtggagcgggacccaccggactgcatagttgccgatttcctatactgctgggtggaagacttggcaaaaaagctccgcataccgtggcttgttttcaacggattctccctcttctccatttgcgccatggagtccgtcaaaaagcaccgcatcggcgatggtcccttcgtcattccagatttccccgaccacgtcaccatcaaatcaaccccacccaaggacatgcgagaattcttggaaccccttctcacggcagcgctcaagagcaacggcttcatcatcaacaacttcgccgagctagacggtgaggagtacctccgccactacgagaaaaccacgggccacaaggcctggcaccttggcccagcgtccctcgttcggagaaccgagatggagaaagcagagagggggcaaaagagcgtggtgagtacgcacgagtgcctgagttggctcgactcgaagcgagtcaactcggtggtgtacgtaagttttgggagcctctgctatttcccggataagcagctttacgagatagcatgcgggatggaagcgtcgggttatgaattcatatgggtggttccggagaagaaagggaaggaagaagagagcgaggaagagaaggagaagtggctgccaaaggggtttgaagagaggaagaaggggatgattatcaaggggtgggccccacaggtggtgattctggagcaccctgcggttggtgcgtttttgacgcattgtgggtggaactccacggtggaggcggtgagtgctggggttcccatgattacgtggccggtgcacagcgatcagttctacaacgaaaagttaataactcaggtgcggggtattggggtggaggtgggtgcagaggagtggaacctcagtgcttacttccagacccagaagctgctgcccagagatcgcatagagatggctgtgaggaccctcatggacgtttctgatcaagccctgcaaatcagacgccaagcgcaaaactttagcagaatcgcaagacaagctgttcaagtggcaggctcatcatacaataatttaacagccttgattcattatgtaaaacgattcagagactctgctgagggataa

SEQ ID NO: 87301 - DNA, 108 bp, Glycine max
  Peptide Sequence Number=SeqID_204079
atggatgcatctgtcatagctgaatatgaccccaaaagtgatttattggatcaggagttcatgctgaaagggaaatggtatcaacggaaggatgtagagagccattaa

SEQ ID NO: 87302 - DNA, 1431 bp, Glycine max
  Peptide Sequence Number=SeqID_204080
atggagccactcaaactctacttcattcattacccaacagcaggtcacatgatccctctctgcgacatagccacgctcttcgcctctcgcggccaccacgccactatcatcaccacccccgtcaacgcccaaatcattcgcaaatccatcccctccctccgcctccacaccgttcccttcccctcccaagaactgggcctccccgacggcatcgaaagcctctcctccctcattgacgacatccgccacttccccaaggtctaccatgccatctccatgctccaaccccccatcgagcaattcgtggagcagcacccacctgattgcatcgtcgccgacttcctcttcccctgggtccatgacttggccaacaagcttaacattcccagcgttgccttcaacggcttctccctcttcgcaatctgcgccatacgcgccgtcaaccttgaatcttccgattcttttcacattcccagtatccctcaccccatctccctcaacgcaacaccgcccaaggagttaacccaatacctgaaactgatgctggagtcacagctcaagagccacgctatcatcatcaacaacttcgccgagcttgacggacaagactacatccgccactacgagaaaaccactggccacaagacttggcatcttggcccggcctctcttataagctgcaggaccgctcaagagaaagcagagaggggcatgaagagcgcggtgagtatgcaggactgtgtgagttggcttgactcgaagcgagtcaactcggtgctgtacatatgctttggaagcctttgccatttcccggacgaacagctatacgagatagcatgcgggatggaagcatcgggtcatgaattcatatgggtggttccggagaagaaagggaaggagcacgagagcgaggaagagaaggagaagtggcttccaagggggtttgaagagaggaacgcagagaaggggatgattatcagggggtgggccccgcaggtgattattcttggccaccccgcggtgggcgcgttcatcacgcactgcgggtggaactccacggtggaggcggtgagcgagggggttccgatgctgacgtggccggtgcatggagaacagttctacaatgagaagctgataactgaggtaagggggatcggggtggaggttggcgcagcggagtggaccaccactggcttcggagagagataccagatgctgaccagagatagcatccagaaggctgtgaggcgcttgatggacggtgctgatcaagctctagaaatcagacgccgtgcaaaacactttcaggaaaaggccaaacaagctgttcgagtaggaggttcatctcacaataatttaacggccctgattcatgatcttatccgactaagggatgccaagcttccatctccagataccccaaaaggctaa

SEQ ID NO: 87303 - DNA, 1236 bp, Glycine max
  Peptide Sequence Number=SeqID_204081
atggcttcaggatccaaatcagtagcttctatcctcttggtactgaatctagtgttgtacttcattgtgcttgttattgcttcttgggcagtgaaccatgggattcaaaggtctggcgaaacagcatctgttttgtccattccagctcgaatatttccaatatatttcccaatgggaaacatgacaactggttttttcgtaattttctctctcgttgctggtgttgtgggattcaccacctcactcactggattgcaaaacattctccagtggaatgctcccaacttacatgcagcagctatgtcttcattgactacatgggcactcactctactggctatgggatttgcatgcaaagagattgaacttggctggacagactccaacctgcgcaccttagaaacgatcactataattgtaagcgcaacacaactgttatgcacgggagttatccatgttggagtttcagaagttgttgcgcagagaatgggaggaagacacaagtctcgtagagtgttatacaaaggttacatttctaagctgttcgtaccataccaagacccaacagatgatttttactacaagactttctttgattctggagagtttgggtttggtctctccactgtctcgttgaacgctatctgtgtctttgaacaatatggcagcatcatgtggcgtcacacagaaacaggcattcccaatgaatcgttcgccgaaactagaatggaagtgaacttagtgctaagaacagttgttactgtgggcaactacgacaattgggagtttaaaacaagtgcctcaatcaagccctcgggagtggacattaagcacaagagtgagatcaagagcgatcgacatggaaccttggtgtcagcaaacagcattggtagaaactgcaaagataatacttgcaggttgagccccggtgagctttcagtggtgaagcctaacaagaaaacctccgttggatcacaaatacgtggcgcttttaccaacttcaatgtttgggtcactccatacaataggactgaggagaatagagacattaacaacaaggacattgtgctgtggcacgttgtgggaattcatcatgttccagcacaagaaaacttccccataatgccattattgagcactgcattcgagctcaggccaaccaatttcttcgagaggaatccggttcttaaaaccctttctcccaaggatgtgcaatggcccggttgccccaagtga

SEQ ID NO: 87304 - DNA, 697 bp, Glycine max
  Peptide Sequence Number=SeqID_204082
ggcgccataggtcacatactaaacatcactcccgaagaagagaaaaggatagaaagcctcaagagggaaggaatgattcatggggatcctctagtagagtattggaatgattttaagagtgcctttaggaagaggcacattccctcctactatgaaagggagcttatggacaagctccaaaggctcagacaagggagtatgagtgtcgaagaatatagacaacaaatggaactactccttttaagagttggacttagggatgaggaaagaacaagcatagctaggttccttagtgggcttaatatggaagagagggacaagattgaactccttccatataaggacctagatgagctagtccaactttgtataaagagaattttgggggctgcaccttcaaaacccaaggaagataagggtaagatcatcgagaaatccacccctaagactagttcccaagaaaggactagcaacattaaatgcttcaaatgtcttggaagaggtcacattgcctctaaatgccccacaaagaaaaccgtgattatgaggggtcaagacatttatagtagtcaagaggatactatttcttccccttcctctagtggaagtgaagatgaagtaaagggtgaagagtctagtgatgaagtctacccccatcaagaaggtgacctcctaatggttagaaggctccttggag

SEQ ID NO: 87305 - DNA, 339 bp, Glycine max
  Peptide Sequence Number=SeqID_204083
atgggtgaagtagaggaggtacaagagaagatgaaggccgacatggaggccatgaaagagaaaatggccacgatgatggaggccatgatgatcatgaagaagataatggaagccagtgcggttgcagttgccgctaccagcactgatgctaaggtgaacccgatgcccccatctggcctcaaccaaatgaatcatccaacctcagctatggtaggaaaaaatttgggaagtacgggcggcccccatgatgtgcaaattcaaaacgagcaagccttcccaccatatggcttgcctctcaactatacaccacctaatgtggcgtacactcccaataagaat

SEQ ID NO: 87306 - DNA, 245 bp, Glycine max
  Peptide Sequence Number=SeqID_204084
tctaagggttgaatctcaacactttgctactgtacatgatgacaatcctcgtgtagcttccatgccttactttggagttattgaagaaatctgggagaacaagctaaacaagtattttatgttcaagatccttgtgatgaaagatgatgatgattcaacccttgatacttgtctcactcctttctctatgcaaatgtcgagtaacgccaacggagaagaagaaattgacgacgtcctcgcaaatc

SEQ ID NO: 87307 - DNA, 519 bp, Glycine max
  Peptide Sequence Number=SeqID_204085
atgtcatgttgctattcagttcttgtcctttatacatttgttctcccttacacttgtgtacgttcatctttggatctgaaatttattaatagatgcttccattgcgtggattttaagtttgcttctttccgttgtggttcagttgcttcaggtgttgctgcgcggcccggaaaagttgtaggttcaatattgcattacaacaactgtggggcagcagttacagctgatgctgagcagcggaggatgggtagaaatccatctgtttcagcccagtatgctgctccaagcagttcatatccaagacgaaacccaagctgtaaaagtgagagggcagaagaagtgatcgaaggtgctaatggacttcagactaagcctcaacacataacacaaaaagttgctgctgctgctctagggggacctggtgcatatcaggtttcttggcctacacggaacgcagatcaatcatctgaattgaataaagatatgagaggccatagcatcgacaatatcgaaggatga

SEQ ID NO: 87308 - DNA, 2475 bp, Glycine max
  Peptide Sequence Number=SeqID_204086
atggaaggagagggaagcattcatgtacaagttgatgaactccaaagggtgaggctcagcgaaaccatcagcataggcaccaccatgtttgagcctcgtggactcagcagcatagacaagttggacagtaataatagcactgccaattctgtgtcttcaacaacctcagcaccagaaaagaagctaacccttttcgctcttcagcttgcagtgcttgagaaagcagcaaccgggttaggaactctcggtttcatttgggcaaccgttgtcctgctcggcggtttcgccatcaccttggagaaaaccgatttctggttcatcaccatcatacttgtagttgaaggaaccaggattttcagcaggagtcatgaacttgaatggcagcaccaagccacatggtctatcactgagaaccatcagcaccaatatgtttctacagatactaccccaacaaggacaccaactaggatgtggattagctcagatgttccactcctgccatatgctaaatggtttttcctttcaaggcatgttagtaggcttctctattggcttcaacttctttctgcaacagcttgtgtggttctctcgttaataaagctcgtcaagcatgattatggagaggtggcaaaaggggacactgacaagaggaatcgcaaatctgctctctccatcttctatgccttggctcttgcagaagctttattgttcctgatggaaaaggcctattgggagtggcaagtcagctattgtaaactgttggaagaggtcgacaaggagtgtgagttggggtcatcaggaatggtgtccactagaaggttcttctatgatgcctattcaagatgtgtcaatggaagcatatttgatggcttgaaaatggatatggtaggtttttccatggacttgttggcttctaactcccctgatgagcagctcattggagcaagaattctgaggcagttttcaatcagtgaaagattttctgatgacacccttcaaaagattggaattgacatatcaatggtggagagactagttgagatgttgaattggacagaccccaaggaggaagagattaggctctcagctgctgagattttgtcaaaactagctggcaagaagcagaactctctccgcatagccggaataccaggagctatggaatcaatatcatcgcttctacaaactaataggagtgtgattcctgcagctgatgagattggtgaaaataaacttttatttgatcaccaaaattacgggttctggacatttaaccacttgggactcctcatactgaaaaaacttgcacgtgaccttgacaactgtggaaagattggaaacactaggggcctccttccaaagatcatagacttcacacgtgccgaagagtggttgctcaagagtgaaaatgttactccatctcaagttctgacactgaagagatctctgcaactggtgaagatgctggctagtacagatggcaccactgggaaacatcttcgaagagagatttcggagatagttttcaccatcagctatattagagatattttaagatatggagagaagcatccccttctgcagaaactgagcatagaaattttaaccagtctggcattggaagaggatgcaacggaaagaatagggggtacaggtggagtacttaaagaattgttcaacatatttttcaaacacaacataccagaaaatcagaaacatgtaaaaattgttgctggtgaggcccttgcaatgctggctttagaaagcaagagtaactgccatcgaattttgaagttgaaagtactagagaggctcgtagaagcattgaaagatccattgcttcgtgtcaatgcagctagaattctacgaaatttatgcacctatagtggatcagaatggttcatccagctaaagggagtaacagctgcagcacccgtaatacttcaggcgatcatatcagaagaaaacaagatacaagaggtgattgttggactagcaggaaatgttttcagatacatgacctctcatgaatcaagcattgtatttgaagaagctggaatcacggaggctgaacttgcaaacaaattagttcagattctcaagaaacaccagtatcccccaactaaggttccaaggataaggaggtttgtcatagagctggctatttggatgatgaaagacaaagctgaaaacatagatacctacaagggtctgggaatggatgaggtgttggagggtgtcttagagaccacatcagaacttgaaagctttaatgttttctctggcactgttggactgaaccggcacactctaacaactcagtcactggttgagatggcattgaaattgatggaagatagttatccacgttggcctagagagactaatgttgcaacttgcaagtgtgcggatacactaaaccgtaaattctccaaaaagacagacatgtttgctgcggctgaaaagatggcctaa

SEQ ID NO: 87309 - DNA, 201 bp, Glycine max
  Peptide Sequence Number=SeqID_204087
atggccttgccacagctgcagcatgcgcaaaacttgctttgcagtgcaccatcttcatggcttcccaaagacaaggatagacaatcttcaaaggtgcggttgatcaagttgttaggagctcagtcattcctatcagagcatgaggatgaacataaaaagcttttaggcaagtttttgggatactattcaaatatgtactag

SEQ ID NO: 87310 - DNA, 318 bp, Glycine max
  Peptide Sequence Number=SeqID_204088
atgcggctaccgcaagagcccttgaacaagaaaccaagagggctcgcaaggaagaacatggccgagacaaattccgtggagctttgtggggcagcaacagaggagttagctgcttgctcaaggtccaagagaagcttgtctcagcgtttatgcgagacagagaccaacatgttagccatcgtcagcaagtacaaagaagaattaaatctagccacggcccacgagcataaagtggcagacgagtatgcccgagtgtatgcggaaaaggagactagaggaagggtgatcgactctttacatcaagaggcaacaatgtag

SEQ ID NO: 87311 - DNA, 1026 bp, Glycine max
  Peptide Sequence Number=SeqID_204089
atgccatctactgaagtcccgtcatctcaaaaagcatccactccaaatacttctcataatgttaaacagaaaaatgatccagcttggggacattgtaaacaaattgatgaaggttatacaaaagtgacaatgatgtgtatttatattgtgaaaaataggttaagggaggtggtattaataggttcaaggctcacttggttggacaaaaaggccaagttgaggctttgcaagaaggttcttgttaatgtccaacatcaaatgaaacaactacttgaacaaaatgacaaaaacaagaaaagaaaaatgcaagaacaatttgaggaaagtaatacctttaatgaagaccttgtaagaatagttgaggatttaagaagaactccaaaatcatccgtttctgccaagtctcaaaaggggaagaacactcctcgtgtagatgactatttcatgcctataacaactcctagagctcaaccaagcttgaagagtgtcttgcaaagtaaggaagttgtagaaaagtgtgacaaagccattgcaaaatggatgatagatgcttcaatgtcatttaatgtagttaactcaacattttatcaacctatgattgatgctattagtagcatgggtctaggggactattttcataagcatattgggccagaaggatgcattgagagctacaatggcattagggactgggcaggctcaacttatgccaaggacttcaaggctgaaaaatttgtggaacaaatcttggactctgggttttggaaacaattcaatgttgaagaatttgataagcataagaacacccaacctagcattttggaacccattaataggtatacacatgaagatcctgaggtgcaagataaattaaatgaaggcatgaggatatacaaaaatactaaaggagattttgcaagacgagcgactgtacgtgaacagaacacgattatgccagtgcttcgggttgtgaaagaaattgaagtgtatttgaacatattcattctcataaaaggaataggttag

SEQ ID NO: 87312 - DNA, 141 bp, Glycine max
  Peptide Sequence Number=SeqID_204090
atgtggactgagaattggactggctggtttaagaattggggaggaccaattccacatagaattgctcgggatgttgcatttgcagttacacgatttttccaatatgttggcgtattccaaaactattatatggtaacataa

SEQ ID NO: 87313 - DNA, 420 bp, Glycine max
  Peptide Sequence Number=SeqID_204091
atgtaccccctaggttaccaatatagtcaaaatagacaatattcattcacctatgaggcaaagatcaagttgaagaaaggcacgaatgagataagtctacttagtggcactattggtttacctaactatggtgcccacttctccaatgtgtcagttggtgtttatggtccagttcaattagtagcactaaagaataacactgaggtagtcaaggatatcaccaataatacattgaattataaggtgggattacatggtgagattgtgaaactatacaatccagaaaacaataaaggatggaacacaaatggtcttccaacttatagagtatttgtttggtataaggccttattcaagagtcctaagggaattgatcttgtcgtggtgaatttgaaagggttaaaaaagggccaagcctag

SEQ ID NO: 87314 - DNA, 1203 bp, Glycine max
  Peptide Sequence Number=SeqID_204092
atgggaactgaacttagaaccgattccactgactatagaaccgagcttctttcaccaacaatagcagtagagaatgtgtctatggctaggcaaccttcatggaggatcaacatggaagaacatcggttaccagaaaggcgaatggagtctcattttggctttggattcttcataaatacactaaagaggcaaaggaaacttgctgagtactacaagaggcaagaaaggcttcttaaaggctaccaagaagtggattcatacactgacttgggcatgataccaggaaatttaacagaggatgagatgaaggaacttgaaaggagtgagagggtggcaatttatgcatccaacatagggaacatggtgctatttgtggcaaaagtgtatgcttccattgagagtagatccctggctgttattgcatcaactctggactcactcttggatctcttgtcaggattcatactttggttcactgctcatgctatgagcaaaccaaatcaacacaaataccccattggcaagaaccggatgcaacctgtgggtatagttgtgttcgcatcagtcatggcaactctcggattacaaatattatttgaatcaggaagggaaatcatcacaaagactcaacctgatagggatccagtgaaggaaaagtggatgatagggattatggtcacagccacattggtaaaagttatgctcatgacttactgtcgcaggttcaagaatgaaatagtgagggcctatgctcaggaccatttcttcgatgtcattacaaactctattggtctagcaactgcagttctagccatcaaattctactggtggcttgaccctgttggggccatcctgatagctttatatacaatcagcaactgggcaaaaacggtgatggagaatgtgtggtcattgattggcaaaacagccccagcagaatacctagcaaagctaacatatctttgttggaaccatcacaaggagatcaagcacatcgacacagtgagagcctacacctttgggtccaattactttgtggaagtagacattgtggtgtctgaagaaatgtcacttagtcaagcacatgatattggagagacacttcaagataagcttgaaaagctacccgaaattgagagggccttcgttcacatggatttgaacacaactcataagctggagcataagacaaaggtgggataa

SEQ ID NO: 87315 - DNA, 627 bp, Glycine max
  Peptide Sequence Number=SeqID_204093
atgggctgcttcattctgctgaattgctgtctttgcctattgtctttttctctttttatgatactaaatgcaaagaacattgcagacaaggttgcagctactgggtattatgtcgtggttcctgacttcttcaatggggaaccctatgatcctgagaatgtgaaaaggccgaaagatgtttggttaaaagatcataatccggaaaaaggtattgaagttgcaaaacctgttattgaagccttaaaaagtaaaggtgtctctgctattggagctgctggtttttgttggggtgctaagaccgttaccaacctcgggaaatccaaacatatccaagtttctgtgctattacatccatcatatatcatagtggatgacatccgtggtgttgagattccaattgctatacttggagctgagaatgacagagttgcttttcctccaaagcttgcagaacaatttagacaagccctaaaggctaaacctcagattgatagttatgtaaaaatatttcctaacgtctcacacggttggacagtgaggtacgaccctaaagatccaaaagctgtagaggctgcagataaggctcatcaaatcatgataggttggtttcataaacatttaaagtga

SEQ ID NO: 87316 - DNA, 308 bp, Glycine max
  Peptide Sequence Number=SeqID_204094
atgcaaagggagtcccaatctgaatcggttgatgtacaaataggagatcgcttagaggaaatgatttgtgatcttggaaaagaatcttttcagcaagcacatgcctctatgtatgatacattgcaaagtgattcgaagaagcgtttgtatttgaggcgcaagaagtctttgacgttgttgtcaatggtgttaagtctggttatgtcaaggccagatataggtggagtgacaaaggcctcacttcacttcttcaggtggtgcaggatatgcttccagaggaaaacacgttgtcaaaaaattactatcag

SEQ ID NO: 87317 - DNA, 212 bp, Glycine max
  Peptide Sequence Number=SeqID_204095
gggtggtgagacttcaagttcaactgagagcaatggtggcagtcaaaatgtccgttcgtcaataccaattttaccaaattccagttcttcattagtttcaatgacatactctccttctttcaactctagtcaacttgttgctcagaggaaactgtttgcagaatcccaaataggaaggaccagttttcagaggcttttggagccaaactcag

SEQ ID NO: 87318 - DNA, 225 bp, Glycine max
  Peptide Sequence Number=SeqID_204096
atggaaagaagtctttcaaaatacaagttaaagtactattactacaaactattttgtatcatcactactacaaaagcagcttactacgtcagcaattcaacgacggtttcaaagaaacgtcgtagaagctcaaccggtggcatatccgtaattaagggcttcagaacgacgacgtttgccgctacccgtcgtagacatccagctgttgtggcgattcgtatttag

SEQ ID NO: 87319 - DNA, 629 bp, Glycine max
  Peptide Sequence Number=SeqID_204097
atgacagatcttgtgagcgcggaagataacgtaaatcaccacgtgtcaatgggcttgtcggccgcgattgacgaaggcttttcgtcttacagacagcaaaaagtttatacggataaccactcgggtatttccgcccgtcagcgtgactcaaaagtcagtatgacagatcttgtgagcgcggaagattacggcgcagaagacgacgttagtctctgcgtgctatcaagcttttcgtcttacagacagcaaaaagtttatacggataaccactcgggtatttccgccagtcagcgtgactcaaaagtcagtatgacagatcttgtgagcgcggaagatgacggcgcagaagacgacgttagtctctgcgtgctatcaagcttttcgtcttacagacagcaaaaagtttatacggataaccactcgggtatttccgcccgtcagcgtgactcaaaagtcaatatgacagatcttgtgagcgcggaagatgacggcgccgaagacgacgttagtctctgcgtgctatcaggcttttcatcttacagacagcaaaatgtttatacggataaccactcgggtatttccgcccgtcagcgtgactcaaaagtcagtatgacagatcttgtgagcgc

SEQ ID NO: 87320 - DNA, 1578 bp, Glycine max
  Peptide Sequence Number=SeqID_204098
ggttttaatggtggagctcttgttgctagtgaaattaagactccattagagatgagggttgaagaattaggtttattgtgttattctgggaaaatagctaaaacggggtcgctttgttgtgtggcttcaaggccacatgaatcaaatgctggtagtagggactggtccatgggtccaaatgagccctactggcgaacgaattcaagctattcgccacctccgacgaggtgggatttcagatttcagtccgaagggctgccatatgatgtgaatgatggtgttcaactctatgggtcatctacatcatcaattgataaagaaagtagaggctgggtcagaggcaaccacctgtatgatcttcactattctgcttcagatgatactgggattttccttagcagtccatctgacctttctcagggtcctcagtggacgccacctgcaatacaagaaatcagtattgacaattatgaaacttcgactaggaaagattctcatccttctgttgaccgggtatcttttactcccaataaggagggaacatccgtgaatcccaacagtgggggttcaacgtcttctcagtcggaaagtagtgaatctgagtctactgcaaaatcacgtttatcctctcagaggaatttctctaatcttcgttcattcatgtctaagcccattcatcctatgtcctttaatgacctaacaactactagggatgcctttgatcctgcagttacagattttacagagtttgatacttccactccactcagagatggccaccgttggagtagtgccagcagtagtcaggagtttgctgacattactgagtcatttgaattagaaactcctggtcgctcacattttctgtcagatggatttagatgtggtttgtgtgaaagatttctcacacagagatcaccttggagctcccgtcgtattgtgagaagtggagacatgcctacaattggggttcttccgtgttgtcatgcttttcatgctgagtgcttggagcaaacaacgccaaagacacagaaaagcgatcctccttgccctgtttgtgtcaaattggaggaggaaaattcccctgatcaaaggggccacttgagattgaggactggttttccaaggcttaaatcatctcgtgacgatggaccctcaagaccttggggctgtgtacaggtaggtgattgtgttgaaggggctctgcatgcaccgccacgcaacacgatgctcctgcttaatcgaaatcgcattaagaagaacctttctttgaaaggtaacatcggcaaggaatttccaggtaagatgaggaaaaatgggacattttcttcacatctgtttagtggaagctcagctgatggggaagcagtgggttcctctaaggcaactgcaggcccaagtgtgtggaggttcttcttctacttgcactatggacgtcttagtggcagccacctcccctcttccggcaccggcaccggcaccgacattgcttcgccctcctccgggatcaatgcaaaggctggtcaatttgggaccgaagcagctcaaatacttgatttctttactcttattatataa

SEQ ID NO: 87321 - DNA, 213 bp, Glycine max
  Peptide Sequence Number=SeqID_204099
atggataccagtaatcgtaatggaacttttctcaaatttatgcagagagttcttgatcctctgcaacagacacttgcagatgggtgccacctttctagggaaaccggaaacgatatatccagggccggattttcaagtgttgagctcaacacggcattcttgtctagtgctacatttataaatccccatgcatatggaatagcttacaagtag

SEQ ID NO: 87322 - DNA, 789 bp, Glycine max
  Peptide Sequence Number=SeqID_204100
atgaagccacacacaagtctcgcacgcttcagaagcgagtcaactcggacgcgccaatcaaactcagcaccgagtttctctcccatgactcgctggaacccaccaccaaaccatgcttctgtggaagaagacacttcattgaagctgcaacactgggaactaccctatttccaatacaaccctccagagccaccaacccaccacgctttgcttaaaaagtttcatccaccaagacctgattggtacgaggagttctatgcttcggttatgaattcagctactaaggattatgaagctgagtttggggtgtttccttgtaaggttgcaatgtacaagtctcaaatcttcggtaacttgaaggggaagggtctaagaatattggagattggcatcggaaccggtcccaacctcagttattatgccagtggctctggtgttgaggtcgttggtattgatccaaacccgaagatggaaaaatatgctcggtcctcggctgcgtcggctggattgcctacttcaaattttgagtttatacaagctatgctttcaatgatcgtggtgattggagcctatcaggttggcgaggctataccattaagtgatgcttctgttgatgcagttgttggaacacttgtcttgtgttctgttaaagatgttgatatgacactgaaagaagcagaaaaaaggggaaagaagctttggatgtttttgaatgaaaaaggagaccagaatcataataagcattgcatcacatttgaagacacatatttatcatcctctacactataa

SEQ ID NO: 87323 - DNA, 582 bp, Glycine max
  Peptide Sequence Number=SeqID_204101
ttccaaagaagggaaggtttcatgatcacgagcttctatgatactaactatgttggagacaaagtcgaaaggaaaaacacaattggaagttacaacttcatcgatggaaacttgccaagctatcctcctaggattcatatcagacccaccataatcatcgagttcatgctagattgtatcacttcaaggttgcctccattggaccttaggaagaagaaaggaaagtttcctccatgcaacaagcctatgcctcatcctagtccaaaggacaacattgccttgcatccaatcccttacaattggagagtaaaaaagcttcaagaatcaagtctcaaagaatcaagattcaagaacaatcaagatcaagattcaagactcaagattcaagattcaagagaagaaatcgagaaacaacagtcaagacttcacaagggaagtatttttcaaaattccaaatatagcactgtagaagcaaagcttcatggtgaatcaaagatgatgacaaaggagatgacaaaaagctcaaagattaatcaaagaacaactcaagtgaatcaagaacagctcaagagttcaagataa

SEQ ID NO: 87324 - DNA, 561 bp, Glycine max
  Peptide Sequence Number=SeqID_204102
atgaagggaggttcaattgaagttggagaagtatccaaggatgcatccccaagaaaaggggtggcaagagggttgtctataatggactttattttgagaattattgccgctgttgcaacactgggtagtgcattggccatgggcacaaccaatgaaacccttccatttgccactcaatttataaaattcagggctgaatttgatgaccttccctcgcttgtgttttttgtgatggccaacgctgttgtttgtggctatcttgtgctttcacttatgatatctgtcttccacatactcagaagcaccgcagtaaaaagtagaattctccttgttgctcttgacacggtaatgctgagtctggtcacagcttcagcctctgcagcaacatcgatagtgtacatagcacacaatggaaacacaggtgccaattggtttgcaatctgccaacaatacaacaacttctgtgaacgtatttcgggttccctcattggctcttacattgctgttgctctcttcataatactaatcatgctatcattagtagcaatctctcgaaactga

SEQ ID NO: 87325 - DNA, 198 bp, Glycine max
  Peptide Sequence Number=SeqID_204103
atgtcaaatgaagaattgaagttgcaggatccacgaatccacgatgtcggatacaatattttttcagaagaagatagatctcctccagcacaagccgttgcagcccagaaacgcaaattgctatataatcatggaggctgcacgagttctgcaccaagtccgggatcgaagagttattttgtgagttttgggacttga

SEQ ID NO: 87326 - DNA, 219 bp, Glycine max
  Peptide Sequence Number=SeqID_204104
atgaagaagatcctaggcctacaagctccacatggagcttcatcacagatgctcaaaagcgaagctactaaactccaatttcgcaatgctctgttatgtgccctatcagaaaaggactataccatgtggaacataacatatgaaaggaagagaagatgcaagagaaataggataattttacaaggtaggctcgctaaagcgaggtataagccgctataa

SEQ ID NO: 87327 - DNA, 309 bp, Glycine max
  Peptide Sequence Number=SeqID_204105
atgaccgcagaagaccgctccgccgaagaaaacgtccgcaatggcgtcgccgcgaaggatctcggcggcaaggagaaggacatcgcggaagtgacttcggccgctgaaggtttggttgccggaagcgtgaagggaccttggtcaccggaggaggacgcgctgttgagccgattggtggcgcagttcggggcaaggaactggggcatgatcgcgcggggagtgccaggacgctccagcaagtcgtgccggctccggtggtgtaatcagcttgacccttgcttgaaacgcaagcccttcactggtaattaa

SEQ ID NO: 87328 - DNA, 417 bp, Glycine max
  Peptide Sequence Number=SeqID_204106
atgtggtcagaaaaacggtgcgctctagcaagtttgtggctttgtcttatcattggttaccatttgttgtcatctctgattccaccgtccacgtcatcaccgccaccgccaccgccaccgccatctactgattcgttttttgctccttcctcaggaacactgaggaagtgccctcagcagaaaatgggattgtggaccttacttgaggggttcctgcttcttgcaaacgcactagcaatactaaatgaggaccgctttctcacacctagaggatggggcttatcagatttttcagctggccagacaaaatcttttaaaggccagcttataggtctcatttatgcaactcagtacctaagatttcctcttatacttctcaactctgtcttcattatcgtgaagttagtttctggatga

SEQ ID NO: 87329 - DNA, 1530 bp, Glycine max
  Peptide Sequence Number=SeqID_204107
atggagtgtctcctattattagcagcctccaaaagcaaagagcaaaaaccatttttatatttgataaattgccttcacaaacctagaggcaaaaaaagaaaaaccaacagcaacaccagcagatcagcacacagcggacagaaagtcacgctggcggtgaagaacgtttctgcggcggcagaggaggaggaggaggcggaggcggaggaggaacacatgacgctgatttccgatgttgagaaccttgcggatgccgaaatccccgacaccgcacatcaaattagcaccgattcatggtttcaagtggggttcgtgctgacgacgggaatcaacagcgcctatgtgcttggatattctgggaccatcatggttcccctgggttgggcagggggtgtggttggtttgattctcgccactgcaatatcgctctacgcgaatgctcttattgctaggctccatgaatatggaggaacaaggcatattcgatacagagatcttgctggatttatctatggtagaaaagcttattccctcacatgggctctgcagtatgtcaatcttttcatgataaatgccggctacatcattttggctggttcggctttaaaggctgcttatgttctatttagggaagacgatgggatgaagcttccgtattgtattgccatagctggatttgtgtgtgcaatgtttgccatatgtattccacatctatcggctcttggaatttggctgggattttcaacagtcttcagcctagtacctccacatacttggtattcatgctcgagctggaaacatctacagcatggtataaaatcaccacctggtgattatagtattccggggacatcaacaagtaaaatattcacaacaattggggcgtctgctaatcttgtgtttgcatataatacaggaatgcttcctgagatacaggcaacaatcaggcaaccagtagtcaagaacatgatgaaagccctgtattttcagtttactgttggagttctgccattatatctggtaacctttgcaggatactgggcttatggatcttcaacagcaacctatttgatgagtgatgtgaatggtccagtttgggctaaggccatggccaatattgcagcctttcttcaatcagtcattgcactgcatatatttgcaagtccaatgtatgagtatttggataccaaatatgggatcaaagggagtgccctggctttcaagaacttgtcatttcgagtcttggtaagaggtggctacctgactgtaaacacatttgtatcagctctgttgccatttcttggagatttcatgagcctcactggagctatcagcacatttcccctcacatttatccttgcaaaccatatgtacctagtgacaaatgagaacaaactaacatccacccaaaagctctggcattggatcaatatttgtttctttgccctcatgtctgctgcggcagctattgcagccctgcgacttattgatttagactccaaaacgtaccatgtttttgcggatttatga

SEQ ID NO: 87330 - DNA, 1230 bp, Glycine max
  Peptide Sequence Number=SeqID_204108
atgagtgacaaacggaaagagaacttcacaaatggttaccttatggtccatgccaatggaggattaaatcaaatgaaaactggaataagtgacatggttgctattgcaaaaattatgaaagccactttggttttacctacattagaccataattccttttggacagattctaggtatggattgtcatctactgattttaagcaaatttttaactggaagaacttcattgaagttttaaaagatgatattcaaataatggaatccctaccaccagaatttgcagcaattaagccagttttgaaggctccagccggttattacgaaggggagatgctgcaattattgaagaaaaacaaagtgatcaaatttacccatactgattctcgcttagtcaataatggtctagctactccaatccaaagggtacgatgtcgtgcaatgtatgaaggacttagattcacagttccaattgaagagctaggaatgaagttagtaaatagacttagagacaacaacaccccttacattgctctccatttaagatatgaaaaggacatgcttgcttttacaggttgcagccacaacctgacccaagatgaagccgtggagcttaagaaaatgagatataaagtgaaacattggaaggtgaaagagattgatggcaaatcaaggcgcttacggggtagttgccctatgactccaagagaggttgctgtgttccttgaagcactaggatatcctcatgacacaaaaatttatgtagctgcaggcatgatttatggtaaagatgcaatgaaacccctccaaagcaagtatcgtcatttgctcacacactccactttagccacaaaagaagagcttctaccctttatgggtcaccaaaatcaacttgctgctttggattacttcatagcagtagaaagtgatgtttttatctacagctatgacgggcacatggccaaagcagcccgaggtcatcgcgcatttgaagggtttcggaaaactatcaccccagacaagcaaaagtttgtgaggctgattgatcagttggacaatggtttgatttcttgggacgagttttcatcgaaagttaagagcatacatgcaaataaaaatggaggtcctcataatagaaaagtcaatcgacaccccaaattggaagagagcttttatgcaaacccttatcctggttgcatttgtgagcgtcgagagacaacaacgacgatgtaa

SEQ ID NO: 87331 - DNA, 546 bp, Glycine max
  Peptide Sequence Number=SeqID_204109
atgagcgccacaagaaagaaaattgcaaataagcaagattgggaagaataccccgctggcaatgacgacgccggtgacgacggggacgagggtgagataggtgagccaggcctcgcgcttgaaggtcatgacgtaagcgaaaacggcggtgaagaagggagtggtggcgccgacggcctggttaaaagagacggggaggtagcggagagagacgttgccgaagacgacggagaagcagaagatgaggctgagggcggcgatcttgaggaactggaggcgggagcggatggtctgcatggggaccatcttgagccaggcgatggcgacgtagctgaagagggagcaagcggtcatgtgacacatggtgaggaagatagggtacttgaagccatagttgctaaggaggtacttgttcaggagcagcaccccaatgttcgacgagtaccacgccgacacaagcccgatcctcaacagacgcctcgacgacttcattttccttcaccccctcagtctggatctgagaacaacaacatcgcccaccactga

SEQ ID NO: 87332 - DNA, 483 bp, Glycine max
  Peptide Sequence Number=SeqID_204110
atggaatgggccttgcagaaaaaccctagccggcccgctccgtttgactctgtctataagaatcccgaaactgatattactactccttccgccgagcttagtagaagagaaaaggaggagcaggaggcatcaccgttaccaaacatggtgaaagggcgacaaggagagcgtgttagactttacgtcaggggttcaatacttggatacaagaggtccaagtcaaatcaatacccaaacacctcattaatccagattgagaatgtaaacactaaggaagaagttgcgtggtactgtgggaagcgtatggcttacatttacaaagccaaggtaaagaaggacggaagccactatcgctgcatttggggtaaggtcaccaggcctcatggtaacagtggtatagttcgtgctaagttcaagtccaatctgccgcccagatcaatgggagcaagggttagagtcttcatgtatccaagcaatatatga

SEQ ID NO: 87333 - DNA, 873 bp, Glycine max
  Peptide Sequence Number=SeqID_204111
atggtcacctccatcgcccaaaaccgctccgtggcacagtcctggctctacactcacgtggtccccttctatccacgcgtcaagatcacaacaatctccgtcggcaacgccttccccgatgtgtaccctaattccgtgaacgacctcctccccgcgatctccaacgtccacgtgtccctccgcgacctcggcatccgcaacatcaaggtctccacctccttctcattcgtcaccgcactcacctcccctttccctccctcaaacgcacagtttcaagaacccaacggcgcaaccctattcggtccactcctccaattccttcacgacaccaactcctccttcttgatcaacctctacccttacaatctttatcgcctcaaccccgagattcctctcggaatcgcgctttttcaagaacatccttttaacttccgcgacgacttcaccaccggtgttcggtaccggaacctcttcgacgtcatggtcgacgccgtagtctccgcactcgccgtcgccggctacgagaccgtgccgattattgtgaccgaaactggctggccgagctccagcgccgccgctaacgagttcgacgcgaatttagggtatgccgagatatacctcaaggggctcgtgaagcatcttaaatctggaatgggaacgccgttgctgaaagacggtgtgacagaggttttcgtttacgagatgttcgataaggaggaaggaacaacagggaggagctggggggttctctaccctaacggaactgcaaagtaccatcgcgtcgatttctcgtgctcctcggttgcttctgggagtcttcatatcgcggtgatgatcatcatcttcttcttatcgcttttggttattgtgtga

SEQ ID NO: 87334 - DNA, 558 bp, Glycine max
  Peptide Sequence Number=SeqID_204112
atggcaaagctttttcatttgctcatccagttcaataatatattaatcgattttgatagagatgtatggggctatatatctttgggttactttaagcagaccaccaaggctggagagattgggtcatcaactatgcctcacaaagtgaatcctattgattttgagaacagcgaaggtaatctaggtgtagctaatggaggtataggtcattctcttcttgcctacaaaagcacacttcaaggaatagggaagcttcaggttaatgaagcttgcttgagtgaagacttgaaccactgctgggaggtgcttgctgaaccaattcagactgttatgcgaagatatggtgttcctgagccttatgagaagttaaaagaactaaccagaggaagagcagttaccaaagagagcataagagatttcattaaaggcctagatattccagaagaagcaaagagtaatatgttgaagttaacacctgatacttatgttggagcagctgttgaattggccagaacagtggaaaatgtggtgaatactgtgattggaataaagatctag

SEQ ID NO: 87335 - DNA, 933 bp, Glycine max
  Peptide Sequence Number=SeqID_204113
atggagttcactgcactctctaacgctacccaacttgggagcttcaaccctcttagaaccaaccttcaaagttcaacacaacactttcttcctttttcgtatgcttctttcccttcttcctctcgcagaggttgctcctgcaaagccgtccttagcacccacacacccacctctacccacaacaacatgtttggaccccgttccatcgattttgagctctctgctttgacggctctgtccccattggatggtcgttattggagcaaagttaaggaacttgctccttttttgagtgaatatggcttaatctactttcgggttcttgttgagctgtctgtgattcctgaaatcgttgaggttcccagtttcagtgatggtgctaaatctttcttagaaggcctgattgataactttagtgttgaggatgccttggaggttaaaaacattgagagggtcacgaatcatgacgtgaaagcggtggagtacttcttgaaacataagtgtcaatccaatgctgaagtggctaaggtggttgagttttttcactttgcttgcacatctgaggatataaataatcttgcccatgccttgatgctgagggaaacaatgaattctatcatgtttcctgtcatggataaaataatcaaagctttgtgtgatatggctaaagataatgcacatgttcctatgctttcccgcactcatggacagccagcttcaccaactactttgggaaaggaaatggcgatctttgctgcaagattaagcagagaaaggaaggatctgtctcaggttgagatagtggggaaatttgctggtgcggttggaaattacaatgcacatattgttgcatatcctgatgttaactggcctcacattgcagaacagtttgtacactctcttggattaagttttaatccttatgttgctcag

SEQ ID NO: 87336 - DNA, 198 bp, Glycine max
  Peptide Sequence Number=SeqID_204114
atgacattgtggattgttggatttggtgatcctatcgaaggaggtaaacttgttaccgtgtgtgactcgaaggacactgcacatggcaacgatgaaggtgaaggggaaaatcacgttcgttcaaaaggattccaattaggaaaggttaaagagcaaaatgatgagaaaaaatttgatgctagaaggagaggaagttga

SEQ ID NO: 87337 - DNA, 171 bp, Glycine max
  Peptide Sequence Number=SeqID_204115
atgatgggtgttaagtacctcggggcggtcaagcgaaggttgcattccaccaaacaatggtccccgggcgaaattaggggtgttccaacagaaggcggtgccttctggtggaagcagcccagctcgcctggccgagctgggtggcaaccacctccctcttttctcctataa

SEQ ID NO: 87338 - DNA, 721 bp, Glycine max
  Peptide Sequence Number=SeqID_204116
ggcgccagccgtcccggtcatttccgcggcgtggcgaccatcgtcagtaagctgtttaatctggtgcagccggatatcgcctgttttggcgagaaggattttcagcagctggcgatcatccgcaagatggtagcggacatgggctttgacattgacatcgttggcgtgccgacggtgcgcgccaaagacggtctcgcgctcagctcacgtaacggctatcttacttccgatgaacgcaagctggcgccggtgctcagccaggtgatgaacagcatggcgcagcgcctcagcaacggcgagcggcacgtggatgagattattgagcacgccgaacagacgctgcgcgatcagggcctgcgccccgacggcctggccatctgcgatgccgatacgctgcagccgctgacggtcgacagccagcgcgcagtgattctgatggccgcctggctcggtaatgcgcgtttgattgataatcagcaagtggatctgacggcggatttgcattatgaaggctcctgcgccatcgatcaggattttcttgatgcctccggcattctgcaatacgaagccatcgacatctataacgtcaccaacggccagcgcttctctacctatgccatcgccgccgagcgtggctcgaaaatcatttcggtggaagatgaagtggcgcgcagctggcagcccaaagtggcctacttcgacggcgataacgagatgaaac

SEQ ID NO: 87339 - DNA, 775 bp, Glycine max
  Peptide Sequence Number=SeqID_204117
gcgctgggggagtgacggcagcatcgtgctggccgacagccactacagcaccatcggtacggtgaccacgacgacggaatggaagggcgaccgcgtgatcaccgtggatggctcgctggatctatggggcgatgagtcgtgggtcggaaaacccgtagcggatctcgctcgggagcttggcatgaccgagagcgatgtctgtgattccggaccctactgcggtccggccccgcgcctggtcgacaaggaaggctcgctggcatggtggggcgatgaatcgtgggtcggccgcccggctacggagctcggggccgagatgggcatgtcggaggaagaaatctgcgcggcgatgggctactgctatggcggcggcacgttgactgaagtcacgacctatggcaagcgcctgggtgcaccggcctggagcgtcctgcgcaccggcaagggtgacctggcgctgctggccgcgcaggatgtgcgcatgaagtccggtttcggtgtgtacaccgcaggtgcgccgacggcgctgggtgatggccgtgacacgcagttcaccccggggcgggccccagtgcccaggaacaccgcgctgctgggcccggtccaggcgtccggccgctacgatgccgccatcgccacttaccaggcgtggtatcccgaccagggtggcaatctgcacgtgcaagcgggccgcgatatcaccggtgatacctggagcgcgcgcgcagaggcgggcacgccgcagcgcgaccaggccgggcattccagcgccgcg

SEQ ID NO: 87340 - DNA, 778 bp, Glycine max
  Peptide Sequence Number=SeqID_204118
ccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggcatcgacaatgatccttccgcaggttcacctacggaaaccttgttacgacttctccttcctctaaatgataaggttcagtggacttctcacaacgtcgcgggcagcgaaccgctcacgtcgccgcaatccgaacacttcaccggaccattcaatcggtag

SEQ ID NO: 87341 - DNA, 252 bp, Glycine max
  Peptide Sequence Number=SeqID_204119
atggcggcggctttgtctctggcgagagacccatacaaggtggcccttttgcctccggtgcagttgtgcttcagggtttacaccgatgtaaaaatcgcgctaagtcgcgagtttaacatcggttatttgaacactgatgttaaacttgcgatggccaaaggattattcgaccatgtagttgagggtttggttatgtattttatgagagctgaagaggaattaggccacatagttgaggtctcgactacatag

SEQ ID NO: 87342 - DNA, 890 bp, Glycine max
  Peptide Sequence Number=SeqID_204120
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtgtggaacgggccaacagaacccttcaggaccgtctgatcaaggagatgcgcctgaaaggcatctgttcgattgagcaagctaatgtctggctaccctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 87343 - DNA, 579 bp, Glycine max
  Peptide Sequence Number=SeqID_204121
atgccaaagactcaagtcaagaatcaagagtcaagcaagtttcaagaatcaaagagtcgttcaatcaatgcaagtttcaagaatcaaagagtcgttcaatcaatgcaagtttcaagaatcaaagagtcattcaaccaaagcaagtttcaagaatcaaaaagttgttcaatcaagattcaagattcaaggtacatcctttgtggtacaagtagagggtacatctacttgggttgtaatactgaaaacaagagagggtacatctcttgtggatcagttcaagtggagggtacatccacttggttgttcaaagagaacaagggagggtacatcccttgtggatctttgcttgtaaaggattttacaaggtttgtggtagcattcagagaggaattttataagttgtacttgccgaatttgggtgacatcaaggaaaggaattattgtttacttagcttcggaatcttaagaccaagtacaaagctagatagaactacctatttctccattctggcaatgactatacttgatgaaattgaaggcaaagttatcaatattgattcaatagagtcaggtctgtaa

SEQ ID NO: 87344 - DNA, 306 bp, Glycine max
  Peptide Sequence Number=SeqID_204122
atggagcccatgcaaatcgcaggagggaatggcgctttccctgtgaatgcgacagctggccatggtgtcgccattaacgatggcgttttgctggaggttggactcgccagtcaaactggcgagttgatgttagggcactgtttgcccagcctacgcgtgcagcaggaagttgcagagagggacaggcttttgcagatgaaagcgccagtgccactggcgatttgggctgcagttgggagtagccagtggcactggcgatttgaggttgatgtagccattcccaatggcgatttcagccctttataa

SEQ ID NO: 87345 - DNA, 1014 bp, Glycine max
  Peptide Sequence Number=SeqID_204123
aagcaagtccctactgctcagaaggatttgatatgggaggatattcaggctaaatttgatatccctgaagcatctgataggacaaaaaagaaaatacttcagactgtaggggagcagtggagacagtttaaatctgatttgacttcaaaatgggtacttgcagccgacaaggacagtgtggatgacactgtttgtgaaaaatatgacattagcaaggagaaatgggccccagttttgttagacccacagagacccctcttgggaggatgtgcggaaaaaggcacaggccatctagaagcaaagcaccgccccccacgtgttgtctcgtggggcactgaggttgtgattcaccctctatctcccatcaaacgacacatgaagtggaagatgacccgcaccaagaaaactgggcagatgacgtctgaggcaacaaaggaaattgttgagaagattctaagtcattttcaattaagaattgatctcctgactactgccattgggcgaccagaacaccttggtcatatgtgtgttgctggagccgcagctaactcaacaaatcagggaccagctggaggagtcgatcacagaaaaagtgacttggcagatgatgttatccttcagctagatccagtctcagtttcagtcacagattcaatcatagggacttgcactgtcagcacaaagaggagttgtgttgatccctcaatgactgatccagacacgggaagagtttatgagggatccataaccattcacaacatccctttgttgcatgatcaagtgaaggtcggtgttgaggaggttaaagatgcagatgctcacattcatgtacccactgacgaggttaacttagtgggacaagcacttaacaccttccttgcttggccgacacatctcgtgaagcatttatcagaacaagggactgtaggacccacaaaacctgtagataggctggatcatgaggttatgtgggatgctaccgtgttcggggtgtttaatcaagacttccccctt

SEQ ID NO: 87346 - DNA, 528 bp, Glycine max
  Peptide Sequence Number=SeqID_204124
atgaaggttagtgttgcggaagcgaagccctttggcggtgttgatagtggcgtagaaggtgaggaggaaagggtggtcgagctccttgtccctgaccttggcaatgaacggaaggatgtggtggctggggaactccgcatggatccgatggatggcaacccaacgacgaccgggggaggacgcctggggcttgctgttatcggagaggtggacggcaacaatggtaagcgaagccagcaagggtgcggggtgtgcttcatgagtgcaggttggggaggtggaatcggcataggcggcggagttggcatgggtgtgtgtgtggggagtgcctttgcaaaggaagaagatggaaggtgttggctagttaatagggtatccattttcaggagaaggagatctagtttggcagccatggaggcttgggtgacaacgagatcggcaatggcggcctcgaggcggtccaagcactctgaggaaagttcgtcgtttgccattggagttctcaatgaaagcaccaaattgttatga

SEQ ID NO: 87347 - DNA, 831 bp, Glycine max
  Peptide Sequence Number=SeqID_204125
atgcttgatccacgaagagaccaacccacaatttcttttccattgtccaatgaaataggacacataactcatggttatgacacatggggtgccacaaatactgattttatggcatcaaagaaacggccaaaaaattataaaatttgccacagctacaataacgacatggaagtgcaattgggaacaggatcaaaggtggatgatgatgaatctggtatttgttcacctcctctttggactacaagcccaccaaagagtcctcatcagtgcaaaaaccactataggtgcctttctcctgcgtccaagactcaagctattgcaagaggccaaagggaactcatggaaatggttaagagcatgcctgagtcaagctacgagctttctctcaaagatcttgtggaacaccctagagttgaagttgcacaagagaaaggagcagaggagaggaaaaacttgggtgacaaaaatgtggatagtagaaaaaaggttgatatgaatattaagaagggtcaagtgaagagaagtgggaacattgatagtggagggttttatctcaaaatggtctttccaatttctttgggatctaagaagaagactaaaaatgagtccttagtgaatagtggttctaacaaggtgtctcctagaacttcggtttctgatcatggatctaagagccttgataaggagtggtggaagaagaagagcctttctggttctggtggagagagtgatagtggtgtgtcgagcattaatagtggaagcatgaaaagttctggtagcaacaacagtagtagcagtagcagaagtaatagcagaatggaaaacaactaa

SEQ ID NO: 87348 - DNA, 336 bp, Glycine max
  Peptide Sequence Number=SeqID_204126
atggtttttcacttaaggcttgtaatgagcttcaaaacaaagaaaggggacataggctcaaaggggctatcaaaggaattaattcaaggtaggctcatttggctagagacttataagaacaaaatgcctaaatcatctcccaacatgcatgtgaagcaagaagtatcaacaagagtcaagccaaggctattgtgcaagcaatcaatggggcaaaacacaccgaataaaatagatgatgatggctcaaaatctcaccaaggagaaaaacaaggatttcaattcacaaaatgccaagaacttctatttcaaaaaacattacccattaccggtacataa

SEQ ID NO: 87349 - DNA, 234 bp, Glycine max
  Peptide Sequence Number=SeqID_204127
atgagggagtgcgggttctatgtaatgtattggatctcaagaataatcctaggaggtttcaaggataactgggaaacgattttgatgatgtcaagaagaattaagaatttgcttgagaaagggggagaatccttgattcaagatttcttcaagatcaagccttgcctcacaatgaaaggtttcaagtcattcaaggcacatgtaatcgattaccaatggcttgaaagtgtgtaa

SEQ ID NO: 87350 - DNA, 298 bp, Glycine max
  Peptide Sequence Number=SeqID_204128
gtgtttgctacccgtgatgatgttttgaattgggctcaagctgttgcttatgaaattggttttgtggcagtcattatgaggaagacagattttgtaagaagagatactggtagtcacaatcatgaaatggcaaagtcattagttgggcattcatatgctggtagtgatactgaaatgcaacaactaatgaagcttcttgaacaggatcagtatattcattggcatagattaaaggatgaagaagttgtacgtaatatcttctggtgtcatcctgatgcagtgaagttatccaatgcat

SEQ ID NO: 87351 - DNA, 1078 bp, Glycine max
  Peptide Sequence Number=SeqID_204129
atgttttctttgttacagacagctgaagcagaaaaggcatcattggagcagcaaagaaaaattgatgagcttgaagctcaattgaatgaagctgaggatatcgtaacagatctaagggcagagttgaagcttgtatatctggagttagagacggcaaggaataaccaggtccagcctttgaatggacagaatgaaaagcaagttgtaacttttcaggagagtgcaaaacctgagatttcaatatcctctcctcataaagaacttgaatgtgtaacgagctgtgatgtggcaaacaaatcactgactatgaacgttttagataataagtgttgtaattcaaaacaacaaactgagcaattgtgcatctataatttggaggattcttgtggtcataactctgactttgcttccatcatcacgagaagcaaggaacctgaacttcgccgaaatggatttactcagagagtccgtgcacttgaaggaaatttgctggatgaaaagctgctcaagcaagatgtacacaatcaacattatggtaaaaaactcgggatcattgctaaagatagtaatgggcaagttgcaaaatatagtgcattgactgagaaaatggaaattaagaagcacgttaagcaccataaaataccaaaacggaagatatattcctattactggtctcgctttctttcttcttgtaaaattcatttaaacgacaactgtaaatccagcaaaggtgtgtgctttctaccttctatcaagcttggtgccattagcaaatggaaaagcaagaggagaagacatagacatttgggaatgaaatcttttgctttcaggagttgtaaaccatcattttttcttaagcagtgctcatctgtctgtaataatgaaaaatgttgtgaagatgaatctggtgcaaagatgaagtcattgccacctttgactgatgtagaacctgtgcataggaccattggtgttacagaaagtatccaggctgtaaataaatttgagcttgtggagaaggcaattgagaaggatagcgagttattaaatttagaagaaaatgctgcgcagaatctaacag

SEQ ID NO: 87352 - DNA, 504 bp, Glycine max
  Peptide Sequence Number=SeqID_204130
atgctagatttttccaacaacttaattggtggtgctcttccaatatcatttggaaaactttcatcattaagatatctcaatctgtctattaataaattcagtggaaatccatttgaaagtattggatcactctctaaattgtcatctctgcgtattgatggcaataattttcaaggagttgtcaaggaagatgatcttgcaaatcttacaagcttgaaggagtttcatgcatcagggaacaatttcactttaaaagttggttccaattggcttcctagttttcagcttacctatttggatgtgggatcatggcagttaggtcccagctttccatcgtggattcagtcacaaaaaaaacttaaatatttaggcatgtctaacacagggattattgattctattcctacacagatgtgggaagcacaatctcaggacaagccaatgcaattagaaattctcaatcttgcatcaaataatctgtcaggagaaatacctgattgttga

SEQ ID NO: 87353 - DNA, 432 bp, Glycine max
  Peptide Sequence Number=SeqID_204131
atgggatcattggcggctatcctaagggctgtgagagaggaagaggccaaagctccggaagagagtaaggaggtacaagccataaaggtggagcttgagaaaacccaagcagtcaaggagaagttcaaggcctggaaggaagaacacgaccgaaacaagttccgaggagctttatggggcagcaatagcgagcttaaactccgaagagacgaaagggatcagtcgcgagtcgaaggcctgattttgaaggacgagttaaaggcttgtattaggtccaaaagaagtttgtcccagcagttaagcgagacagaagggaacatgttggccatcattgataaatacagagaagaattgaacctagcgacagctcatgagcataggctagtggatgagtacgccaaggtatcagtggaaaaggaagcaagggggagg

SEQ ID NO: 87354 - DNA, 378 bp, Glycine max
  Peptide Sequence Number=SeqID_204132
cccaagcctcttggagtcttttatccaatacccttggggggtaggattgcatcatggactctcaacttgctaacattttcgtcaaccaaaggaatcaaagctgcaaagcaagaccttaagaaggcatcggaagagaaggagaagaagaagttcaaggaaaggtttaggattagtagactaaagatcacttcaaggttgaagtacatgatgagattacaacatgttgactattttgagctcttgatgattgagaagatggaagaacttgtgagaattcataaggaagagtataaagtgcttatgggctgccttgaaaccatctctaagaggcttgatgccacgggatcacctcatctcgattatattccctccccatag

SEQ ID NO: 87355 - DNA, 363 bp, Glycine max
  Peptide Sequence Number=SeqID_204133
atggtgtctaccacgctacttatggaatcttcttttcttgatctgaacttcaacaaacttcctataaaacacaaacaaacaacccaaagatcaagcgcaaaagtaaccaactatgacattatgattttcttgggataccccaccttcgggtgtctggcaagacacccaaagattaatgttagaccctacctatcaatttgttatcatattcctaggattgggaaaacatctatctttctttttagggcaagggggtcgcgatgctttggcacagtgatgtgggtagtggctatggtggtgccgaggttatggttgtgtggtgatggagttggtatgcgtgagggtggccatggtgatttgtga

SEQ ID NO: 87356 - DNA, 376 bp, Glycine max
  Peptide Sequence Number=SeqID_204134
atggtgactatgctgagcggggcgaagccagaggaaactctggtggagggccgcagcgatactgacgtgcaatcgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtg

SEQ ID NO: 87357 - DNA, 162 bp, Glycine max
  Peptide Sequence Number=SeqID_204135
atgggagagttcatttgcgccatcgcccgatcgccacctagtaccacatatgacggtggtacctggagatatgtcgcggaggtcaggagaccttggggacgtcaggtggggtgctattgcccaaaaccaagcttggctaatcccgacccaacccaggcatag

SEQ ID NO: 87358 - DNA, 147 bp, Glycine max
  Peptide Sequence Number=SeqID_204136
atggttgtagatgatgatgttatcttttctgtctttaagaaatattgtaagtatagtcctgattctgaaaactggacaagctggtctgaagggttgaactggaaaagtggatcaatggccagacagtcatgcttccagattaactaa

SEQ ID NO: 87359 - DNA, 324 bp, Glycine max
  Peptide Sequence Number=SeqID_204137
atgaacattcaacaaagaattagtgctaagcacctcaagaaccaaagcctaaacctgtccacgaaactccttggagaaaccattgtaagaattaatgtctcatccatcacgaacggagagaggcagaaaagaaaggccaaaggaagtgaaatcttatttctctcctctttcaaggaaatcaaagtgcactggagagaagtccctatggagaaaggtacaagtcttcctatggagaaaggtttcaagatcctgttgtttcctatcattgatagtctaggaaaccccttaagaattttacatgtggtatcagagcatgtattatga

SEQ ID NO: 87360 - DNA, 207 bp, Glycine max
  Peptide Sequence Number=SeqID_204138
atgtggcttaatcacccatatgtgtgtactgttatgggctttagcattgaaagatgtactgtctccttagaacttgatagagcaggattaggttaccgtatgtctggacacagagtgagttgttcaattgagctaagttcaacaagaaacatctgcgaacgaagtttaattagaattaggctaaactcacgagacatcagtgtttag

SEQ ID NO: 87361 - DNA, 342 bp, Glycine max
  Peptide Sequence Number=SeqID_204139
atggatgagattcaaggattgcaaaacatgttcaagtatcttctagaagcagaaagccaagtgggaacggataaaaatgatgaaaatgttgctggttactctgttggagctgggcataatattcaaggattgcaaaacatgttcaagtatcttctagaagctgaaagccaaatgggaacagataaaaatgatgaaaatgttgttggttactctgttggagttgggcatagtgtacctgttgctgctggtgttggggataatcgcttcctgcatcctaatccaaaatgtaatttacatctcaaattagtgattttgaaatataaaaaatttcattttggataa

SEQ ID NO: 87362 - DNA, 468 bp, Glycine max
  Peptide Sequence Number=SeqID_204140
atgggatcaaggctttatacttgtaccacaattggccttcttggtaccagtttgtcacagctacattttgtcatgctaattggaaagcttgttgaagaagaggaagggaactttgctttgtggctttcttacattcttactggtgtaggagccaaccttgtttcatggttggttttaccaagaaatacggtttctgttggagcttctggtgctgttttcgggttattttctatcagtgtccttgtaaagatgtcctgggattggaggaagatccttgaagtgcttatattgggtcagtttgttatagagaaggtcatggaagcagcccaagcttcaacatcattgtcaggccgaggaggctacgcattgcaaagtgtaaatcacattgcacatctttctggtgctcttgttggtgtgcttttggtttggctccttagcaaagttccttcagatccttctgaccaataa

SEQ ID NO: 87363 - DNA, 366 bp, Glycine max
  Peptide Sequence Number=SeqID_204141
ttcgccggattgagatccaacctcgccgacgttggaggaactgaagaaaggttgaatcaatggaatgagatcaaattgaagaaagaggaagaggataaggtggagcttgtttgtccggcaacaagtctcaccaaggcaacaagcctctacaagcttagacgcagtctcaccaaggcagcaagcctctacaagtcttccttaaagaagacgcctgcatgcgtcagtatcttcaagacctttgatcacttggagctagaagagtatggagttctaagtgaatcggttcaatcatggaaagatttttgtggcttgcatatgccactggtttgtccagatggcgctgtgatcgcttatgcgtggaagtga

SEQ ID NO: 87364 - DNA, 426 bp, Glycine max
  Peptide Sequence Number=SeqID_204142
atggctccaaaaaagctttccacgaagagatctaggagggacatcgcggctgaagggaccagtgccactctcgagtttgatagccaccgtttcaggagcgccgaacatcagcagcgtttcgaggccatcaaaggatggtcattccacagtgagagacgcgtccatctcagggacgatgagtacacagattttcaggaagagatacctcgccgacattggacgtcgctagtcactcccatggctaagtctgacccagatatagtcctggagttttatgccaatgcttggcccacagaagagggagtgtgggacatgcgatcatgggtgaggggtcagtggaaggtcaggagtgcgagtttagtcagagaaggaacagggccgatgggtttgacgaggaggccattgcccaactattatgtataccgg

SEQ ID NO: 87365 - DNA, 150 bp, Glycine max
  Peptide Sequence Number=SeqID_204143
atggataagcctatccacttagttgcatctctttgtaaagataacatactacgtgtgctgattgagttgcaagtgaatagttgtaaatcccactctaatctccaagaagctttacgggaatctaagaaggcacctattattgttgcttga

SEQ ID NO: 87366 - DNA, 687 bp, Glycine max
  Peptide Sequence Number=SeqID_204144
atggcttctctggcaagcttagttgttgttcaaccatctactgtcaagggccttgctggatcttcccttgctggaactaagctctctttcaagccctctcgccagagtttcagacccaagaattttaggtatgaccatagttatgtggttgaacagcgtgttgaatggcttgaatcagtgtgtctgggtaattggttagcggttttctacaaaactttccttttttgtctccaggtggagctgctaaaagctacggtgaatcaatgccaacttccacggagcttttcaagcattctagttacctttcttttacttgatttaattgatattagacagtttgcagctggaggccaggatgtatatgttcaaattgatgcttcagaattagaacatgccaatgagggccacaagaagggtggagtcctagtggtagtaacagtttctttggtcgtggttgcagttgctggaatactaataatacttggttcgtgttttagaaagaaatcatgttgcaatgtcaaagacttcagtatcaaatcaaatcaaaacaatggagtgcaagtggatgatatggacctactagtttttgacttgtcaacaatagctaaggccactagcaacttcacagtcaagaacaaaattggagaaggtggttttggacttgtatacagagtaatttgcttatag

SEQ ID NO: 87367 - DNA, 717 bp, Glycine max
  Peptide Sequence Number=SeqID_204145
atgtatttatacattcacaatttacaacttgcctcattggttgtgcatgaagaaaaaatacatgatgttatcaatccattgattgaaaacttgacaaagttgtgggacgagggggttgttgtgtttgatgggtatcgaaatgagacattcaagttgtgtgcaatgctattttgtaccattaatgactttccaacatacgggaatttgagtggatacaatgttaaaggacatcgttcatgccctatctgtgaagaagacataagctacgtacaactgaaacatggaagaaaaatagtatacactcggcatcgaccttttaatggaagtcaagagcatgatagtgcgacgactatcgacaatgttcctttggaaaatgatcaagtgaaggtagttgcgggattggcgaaacctgtgccgtgggatgctagtgtgtttggggtgtatgctgataacttcccattgtacataaagcatgaaaatctttctgaaatagctcacgatggtcaatgtctgagcatctctattatacaattgtggattctggctttgaagggattcaacgacagtcaatgcagtaaatccaaggatgctgctagatggatcatagctaaatattttacatatcaaagaccattggaaccagagagaatgaaggcaattcgcattcaatgggcaacatattatttaaaagttaaaaatcaaacactaggagtttaa

SEQ ID NO: 87368 - DNA, 243 bp, Glycine max
  Peptide Sequence Number=SeqID_204146
atgcagcaagatggaggtatgatggagagacgcagcaagaacgaaggtgagatggagagaacagacctaagatggaaggacgcaactgagaacgtagaccgagaacggagaggaaaacaacatagcttagatggagacaaaaagaaagggcaacatgaaagaataagcattgcagtgggagcggggatcgacaacgaaagtggcagcagagagagcgaaaaggagatgacggagaatgcctga

SEQ ID NO: 87369 - DNA, 138 bp, Glycine max
  Peptide Sequence Number=SeqID_204147
atggaagtatggatattgatggatgaatgcgaagaaggagagatggggactgcggcggaacttgtggaggcgcacaatgagggtgtccttgtcgttgagctcagtggggcgatgcggcatcacacaatgagagcaaat

SEQ ID NO: 87370 - DNA, 432 bp, Glycine max
  Peptide Sequence Number=SeqID_204148
atggggattttcaaatggggaaaagccactgatccaaatcaatcaatttgtttggtgaggctgaggaagcatgtgttcaccatatggactttgacacactatgagacaagtgagtggagaagggttttgaagataagagtgaaagcaatggtgaaggatcatcctattataagagtaaagggctatgcagttttgaatggtgatcttttggtctttgccactgagaagaaggtctatggctgtggtttgaatgatatgaggattcaggaaatctgtgatcatgaatttgacttcaatgttcttcgcttcacttcatacaaggacactttgcgcacatttggtactggtgctggaactttgcctctttctctgcacacgtgtggtactagagctggaactttgcctcttccttcacacaagcagtgttggtag

SEQ ID NO: 87371 - DNA, 1101 bp, Glycine max
  Peptide Sequence Number=SeqID_204149
atggtcttcgttcatcatcatcatcagcagcagcagcagcagcagcatgaactgaagctgcagttcgggtctttacccacggttgcgtatgccgccgccgaagtttcctccaatggtgactccttgctcaatttgaagttcaacagaggtgggaatgtggttcaccccacttcgaattcgagtgggaatgtggttcttcagggtaaccatgatgctgtggagagagaaagaagaggacttgggggttatatggctggtgggtcgttaccccccgagacaagtagggttgcaccagggtttgggaacaggattagagggaagggtttggagggtaggaatgagaatttgtatggtaggagggaaggtgggagaatggtgtctggtgagaggagcaatgtgggacttgttgatcagcttgatcgtcctgggccaccggcccggagtcacctccattcgggttcggggaatgagaccagtggcattggtgaagttggtggtagggatagtaagcacaagggaggtgggagattgaggatggagggttttcctgagtctggtggaagggttgctgatgttgatgtccttggggagcagttagctgattccttgttggtagaggatgagtctgatgacaggactaacttgaggcaacgccgccgagagaaggatgttagatttttggattcaagaggacagcagataatgagccagcggggaagaatgtacagaaggcagatgatgtgtcgaagggacattgatgattttaatgttcctttccttgcaatatatgggtctctaatacctcctgaagaagaaaagctgaaacaaaagcaattagtagcgatattggagaaattagtcagcaaagaatggccaacatctaatctatatctctatggatcatgtgctaattcgtttggtgtttctaaaagtgacattgatgtttgccttgctattgaggaagcagacatggaaaaatctaagattataatgaaattggcggatattttgcaatcagataatctgcagaatgtgcagaaagtgcccatctatagactagcacagaagctattggcctcactgatcattgctagtgtctag

SEQ ID NO: 87372 - DNA, 174 bp, Glycine max
  Peptide Sequence Number=SeqID_204150
atgacgctatttggtgacccaggcgagccagaggctagcctgggcgagccagaggctagcctaggcgagctagggtccaggaaaaccaaggaaaagacccttttgccccctttttttgctagcattcaacaccataagtcaactagtaaggatcaaaagatcaatgaacgataa

SEQ ID NO: 87373 - DNA, 263 bp, Glycine max
  Peptide Sequence Number=SeqID_204151
aaacacttgtgtctgtggtggaggaaggttctccatcttcagatcttggtgtggaggaagtgacgacgacaaccatggcacccatcatgacaacgacgacgattagcacccacgtgtgcgacgattatagccatgtcgcggccaacatggtcgtcgctctgctcattgacgtaatgaggaaaatcttggcggcggatcgatatttgaggactcagcagagtcgcgacaatacgccttgggattttttcacattcggctccaag

SEQ ID NO: 87374 - DNA, 234 bp, Glycine max
  Peptide Sequence Number=SeqID_204152
atggatgcggagcgggaatcctgcaagcgagagaaggactggacaagaaggataggtaatgatcgccatttgatatgtatagaggatccttttgaaatatctcatgatctaggtcgagtggtagataaacatagcatcaaagttctcagggaagagtttgaacgtgctgctgaagttatgcagaatgatccaaatccatgtattaaactttttgagccctatgttcccagttaa

SEQ ID NO: 87375 - DNA, 606 bp, Glycine max
  Peptide Sequence Number=SeqID_204153
atggctaaccccactattttacaatgggttctggtctttgcactaagctacaaattaatgttgcatttattcatgagagtattgtcaaaggtgaaagcaagtgaacctggacgcaatattatattggtccatagaaagttgaaggatcgattgagaatactaccctcactcactcccctttcaccctctcacctaccctcttctcgtccccgcaccagcctcatcgtggaggccctcatcgcctcactcatgcaccttaacctcgacgacgtgtggctgggttcaaggtctggcacagttgctacttgcggtgctgttagggttcatgaagaaccttttcctgctcgtgcaagcctcggtgctagaagggctggtcgatttctgcgagcgcagcagagagtcgagagacatcatgttcttgttggtaaaaccctcatttctcataccctgatgagatttttagttgagaaatgggtgttaaaacttacaagcttaacacatggaggattttcaattttgtggaagcatgctactgagtgcttgcctgcattggacatgactcaagcaacctctactcaggacagcaaaggatcttcatggatttga

SEQ ID NO: 87376 - DNA, 300 bp, Glycine max
  Peptide Sequence Number=SeqID_204154
atgttggtattaggaaaacaaggctttattgtcaatgtaggaagaggaggtcttattgatgaaaaggaattggtcaagtgtttgatggaaggagaaattggaggtgctggtttggatgtctttgaaaacgagcctcgtgttcctgaagagctccttgaaatgaataatgtggttttatctccacatgctgctgctttaactgtggaatctatgatgaatttgtgtgaacttatgggagggaatttagaagccttcttctcaaacaagccacgaataactccagtaatgttggctgaataa

SEQ ID NO: 87377 - DNA, 432 bp, Glycine max
  Peptide Sequence Number=SeqID_204155
atgtaccattcaagaaacgagaagccatttatcttgtaccctttttattctaatgttgttgagcttgctggtaatagtgatgtccttgtgttttgttgcccacttaatgagcaaacaaggcacataatcaacagggaagtgatgctggggaaagatggagttattgtcaatgttggacgtggatctctaattgatgaaaaggaattggtgtggtgtttgatggaagaagagataagggatgctggcttggatttgtttgagaatgagcctaacgttcccaacgagctctttccattggataatgtcgtcctctccccacatgcagcttcattgacttcagatggtttcaccgaagtatgtgaacttgccgcagaggctctagaagtgttcttttcaagtaaactaccgagtactcaagtgttggatgactaa

SEQ ID NO: 87378 - DNA, 477 bp, Glycine max
  Peptide Sequence Number=SeqID_204156
atggggggtaaggttatgacaaacagattgccgacgttgacatttccatgtttgaggcatctggaagttatcaaagtgtccacacaacgacaggacctgtggtgggttgcgagaattctgaaggcatgccctatgcttcaacgactagagttgcatctgaagacctatctttgtattgatgatgatgtaagggaaagaggttggcctcccaaatttgagcataatcatctcaaggaagttgtaataaccggcattaaaggatacttatgtgaaattgaaattgcaatttatcttctaaggaacgcaatttcacttgagaagatgacaatagatccacgtgcaaaagtttacactgaaaacggaaaatggggtcaagcagaagcttttgggaattggagcagggtagggaagccgaaggtccatagacatctaaagcaagaagctaattcttcagcagtggaattgttgataaagtaa

SEQ ID NO: 87379 - DNA, 231 bp, Glycine max
  Peptide Sequence Number=SeqID_204157
atgacaatccccgtccaaaaatttaccttgagaagaattggagcatcgagggatacaagaatattggtatgtgcaaaacctcaccaaacaatagacatgcatatagataacggaatcagacaaggaagaatagaacaactaaataatggagaagtggacatggagataaaatttgtgcctagtactgaacctggtcaggatgtctgccaagatcctaattgctctgaatga

SEQ ID NO: 87380 - DNA, 561 bp, Glycine max
  Peptide Sequence Number=SeqID_204158
atgagtcaagctgataattctacaacaatttcctccgatgatgcttttccaaaagtgttggggaaagatcactgtggacgtgtacgttgcttgggcttaggaggtttatatagtattgcatttaagttcaacacaaaattcagtggtgtaggatgtagttcctctagttttgaatctagtgaaagttctcaattaaaggaggaggttgttagtttgaaggcaaagttagcggcttcggaggaaaatgtcaagacattacaaaatgtaatggttgcatatatacacataaaggaaggacgtattcctccagagttaggtgctatgtttggaaatacgactaatccaagggatgaagagagtggacaagatgtacctacaaccacatggaggatcttcactagctacggaagacaaaggagaagaggtgagaggaggcgtcattcactagggaataagccatggaaaaaggagcttcaccaccaagatgagccttggataagaagcttggaaggatgcttcaatggaggaaaagaaagagagaaggggggagcacgaaattga

SEQ ID NO: 87381 - DNA, 936 bp, Glycine max
  Peptide Sequence Number=SeqID_204159
atgaagaatcaaaatcggaagaaacaaggggaatcggcagctaagtgtaaaaaagaagattatatcagcaaacttcccaatagcatcatatgctacatcttatcttacctcaaagtcaaggatgctgtgacgaccagtgttctttcatccaaatggaggaacatttcttgcaatccaagcaaccttattctggatgaagacaacatgctaattaagcgagaacactctctaacctatgttttgctccaccaaagcgtggtgcaaaggttggaattcaaaagggacagaaccttagccttcgttagtaatgtcaacatgtacttgtcacatgttgaagaagtccaaaagattgacaagttaaaggtttgcttcacatttcgccataatgagtatggctccactgatcttgatcggtggattcgtttcgccgtcgagaaaaatgtggaagagattgatctttgcttgttggaagagaatcatcatcaccagatcaatgctagtccaaatgatggatactatgttttcccctgtgaagttgttggcaattatgagggtgaaagtggctccaagtcatttctgaagagtcttcgattggcacattgtgtacttgcaccccacatgttacataacttgggttttagcacacttaccactatggaactcttcaaagtagatctgaaatctgaattgcatattcagattttgttgtctagctgcagtaaccttgagttttttgggctgtctgaatgttacaacatgaagaatctgaagatagagcacccctattgccagaagttaaagtacctgaaggtgaagctttgccaggagttgaagaaacttgtgctctacagcaccagcttggaggccttggaattcaagggaagcaaaattgaatttgtgttcgatgctccaagacttaaaactttctacagtcct

SEQ ID NO: 87382 - DNA, 216 bp, Glycine max
  Peptide Sequence Number=SeqID_204160
atgggctcagaaatctaccctgaggttcatgagaaccctagggccttcttcagcagctctagcccaatcctcttgcagcctcttgctcatggctctagtgactggtcccttcctagggaggattgcatcaataaccctcacctttcaccttttgatgccatgattcaaacaaatggtgaaacgcattccttgaacatgagatcccttcaaacttag

SEQ ID NO: 87383 - DNA, 318 bp, Glycine max
  Peptide Sequence Number=SeqID_204161
atgctagacgacattgggccaggaaagttaacagatggaggccctaaagaaaagtcacctggtcggctagggtttttcgtgcgcgctgtaccgagactgtgtttcggccgacactggcatgttctcatttactcggccaggaaaagattagcccacctcggaaaaaaaaaatgtgattcaccggcactgatcgaaaacaatgcaaaccgacgtcggccaggaaagatgaccgatcgaggtttggaaaagaagcctcaccggatggcgccgatcgcacatttcctaatggacatcatccaaatattattcagggattga

SEQ ID NO: 87384 - DNA, 567 bp, Glycine max
  Peptide Sequence Number=SeqID_204162
atgggtaaagtagacgaggggcaagagcggataaaggccgacatagaggccttgaaagagcaaatggccacaatgatggaggccatgatgagcatgaagaagataatggtggtcaatgtggctgcagttgccgctaccagtgctgttgctgaggtgaacccgactcccccatttggcctcaaccaaataaatcatccaacctcgaatatgaacaagcatgccttcctgccatatggcttgcctcccaactatacaccacctgatgtggtgcatactcacgatgagaatgttaataactccactcccatactcgttgagagccaacaacctaaatctgatcatgcacatgtctctcaacccatgagggaggcacatgaaataccccaccacaatctagccaacttcgagcctcgcctcggatacgccattgaggggcaagcagttggtggtgtacccctgccagacaatttggaggaccctcaatttcgcccacaaccacaacccttgcattttgcgacggggagagtccctcctgctatggcgaaaaagggaaattggatcaaatag

SEQ ID NO: 87385 - DNA, 276 bp, Glycine max
  Peptide Sequence Number=SeqID_204163
atggttacctcgaaggaaaacgaaagggttacaatagagaacaacgtcggtttgtggtggctaacggtggctgtgggtgatggagaaagtgcttgggacgttagaaatgactttgaaagaaagaaagaagaagaaatggtgtttttcctaagctacacggaagcaaaggctaaaaatgctcaagtgagaaatggtcttggacacagaaacgtcgcgcaaactcctaacatcttctcgaagatcccaacggtcagatcgtgggaaaatgtcttgtga

SEQ ID NO: 87386 - DNA, 156 bp, Glycine max
  Peptide Sequence Number=SeqID_204164
atgccacgtgggaatttgaaagtcagatgcgagaagctcacccatccttgtttgagtaagagggtgtgggtagataaggatcttgcttctcaaagaagcctcttgagaaagcttctcaaagaaaccacgaggaagtttcttgaggaagcctcttaa

SEQ ID NO: 87387 - DNA, 108 bp, Glycine max
  Peptide Sequence Number=SeqID_204165
gtattccggaagttacgaaggccaattccggaagaagtgcttccggaaacttcttccggaaaaccgtcttccggaaatgggcttccggaagaccttcatccggaagtg

SEQ ID NO: 87388 - DNA, 234 bp, Glycine max
  Peptide Sequence Number=SeqID_204166
atgtactctactgttgttcatctgctcccacgaacaaaggttcgcgatcatcacaggtaccaactacacggtacaaaaatttcaatgggacaaccatacatccccatagttaggttccctgaccccaactacggtatcaaagtggtaaaccaaaataaactcccctcacctattgtgagctcttgttcgaacccggcaagtgcaccagatcatgcaagtagtataaaatggtaa

SEQ ID NO: 87389 - DNA, 387 bp, Glycine max
  Peptide Sequence Number=SeqID_204167
atggcgttccgctgggttttcgggtatcaaggtgaacaagcaactcgcttctatcgaggcttttcaggaaacgaccggatcgggccggatccagaccttgcgcgtcactgcccgggcgcagggcaagagcacgcgtgtcgatgcggtcttcaccattcaggcgggacaggcgaccagcaagtccgtcgtgcgcgaaggactttgccgcatcattacttctgctgcaaattgagtttgtcgtcccaaggtccgaacgatgtgttccaagcgcaaaacccaccgttaaccggtgacgccgccaaactcggattatcgctggagaaagagaatggtagcggaggagggattcgaacccccgacacaaggattatgattcctctgctctaa

SEQ ID NO: 87390 - DNA, 861 bp, Glycine max
  Peptide Sequence Number=SeqID_204168
atggaagcgcgccatgcaactcttggtcgacgaacgttggaggaaattcggcaaaagagggccgcggagagattgagtaaaacctcttcgggaccagatctcacgcaggttcccagcacctccgagattgcgggaatgagcaagtccgagagcgcaaataagctctctgagacagatcttagtgctctattgtctcaattgaaaggactgcaaaagaagaacacggagttggaggaagaaaacacaaaaattagtttaaagcttcaaacgatggaaattgataatgagacaatgcacaagcaattaaatgatgtggaacaaaatacagtgccatctctaaggaaagctctgagggatgtcgcaatggagaaagatgctgcagttgttgcacgggaggacctttcagcacagcttcgtaccctgaagaaacgtcttaaggaagcagaagatgagcaatatcgtgccgaggaagatgcagcagcgttgagagcagaattgaactcaattcagcaacaagcaatgactaatacagttagcacaatttcatcatttggtaatccacccgatcattttcaaattcaaagattacaaaaggagctagatgatttaaaactggaactgcagcgagaatcacttttgaggcaccaggagcaggaacaattagcaaaagagcaagcctgcattgcctcactgatatctgaaaagcaggagttggaagagaaactcatgtccatatctagagagcctgcagaagcctcagataaagctgctcacaaagcattttctttggtgagaaaaacttcttccatatggatttttcactatttagtgaattttcagttttctgtatctgttagctaa

SEQ ID NO: 87391 - DNA, 512 bp, Glycine max
  Peptide Sequence Number=SeqID_204169
atggtgattgagaaaggttgtttgtattgtaccgttcgtcgaccaagagttgcatggcgcgcttccattgttacagatgcgatgggagcggaatgttcgtctgcgaattcacctctccgccgagacgccgagagattgggtcactgctcagttgttgaagatgaagattttgttgatgagagcagctttgatatgctagatgatatgattgttttgctaagtatggtttatccattccagcaacgagaaggagaggaggggtttgcgtgtgtgagagagaatcagaatcagaagatgaagaaagaagacacagtgaagctgatcagttccgaaggtttcgaatttgtggtcgacaaagaagctgcaatagtttcacagaccatacataacatgcttacttctccagggagtttcgctgagaggcagcacggcgaagttacctttcctgagatcagcaccaccattctcgagaagatttgccagtacttttattggcatctccaattcgccag

SEQ ID NO: 87392 - DNA, 1059 bp, Glycine max
  Peptide Sequence Number=SeqID_204170
atgacagaactagagcacttgccagcaaaaataaacaatgctgaaaactgccaatgccataattcatcataccaagaaatattacaaaagcaaaaccaaccaataaacctcctttcatatcctttttcatggaatcaccttatgctttcctcagagccaccttcaaagttccttaagattgtactttttgtcaagaaatggccacaaaagtctcatgcacgtgggctcgaacgccatgctctcacactccaccctgcccttgccaaaagaggccatgatcttcacaaattcaccacttccacaaattcctctttctccaactattcaattaacaacctacgctttcacttctccaaaccaacacctgctggttaccttgaccaagctttggtttgggagcaatttcaagcacaaaactcaactagcacacacgatctctatatgttactaatttggctgtcacttggcacggaattgcgtacgagacctttcattctgacatcattcaagaactccttagaaccccccaaaaaaccacagacaaaggctttgactgaaagagctgtgaaggttgttgaagaggtcaagttcttctcatattatgctcatcacgttgccactagtgatcatgcaggtgatatcctaaagagggtctacatgattccaaaggaaagggtccacattattctcaatggtgtggcccaacacgttttcaggccagatgtttcgaaggggaaggacttcaaaaagaggcatggcattccggattcgaagtcattggtgataggactagctgggaggttggtcaaggacaagggacaccctttgatgtttgaagcattgaagcagataattgaagaaaatagcactttccaagattgtagcatggttgtggttgcaggagatggtccttggggtgcacgatacagagatcttggggaaaatatattggttttggggccgttggagcaagctgaattggcctctttttataatgctattgacatttttgtaaaccccactttaagagcacaaggtttggatcacactttgctatag

SEQ ID NO: 87393 - DNA, 1419 bp, Glycine max
  Peptide Sequence Number=SeqID_204171
atgaacagaaaaattaatgacaggttgaaactggagaaagcttctttgtcatatgctgattttcgtcatgaaattaccaaaaatgacaaagacaactctttaaaaccttacggaaataagcaaaagcaagcaacttatcaatgggcaagtgaggaagatgaactggttaagtatatgtcgaatttaccaggttacttggagaagggagaaaaaattcctgataaagctttgaatgttggggtgcttgattgggccactctacaacaatggcagtacagtcataaacatgtacccttaagtagccggagctcgacatctactattaatacatcatcttctgtttcaacagagggattatctggtaattctagcaaaggttttgtttgttctccttctcgtcaaagaatatttcgtccgtcactgcaatctcacttcatggcatctccaatgcaagactactctgtatctgtcaaatcatctggagggaattttggaaattgtcagaatcttagaggtgggtgcagtaatattgacacacacagcaacgatgctcgagttggtgatcacctttcccaaaaccatcctactagtataccaaaaggatgtgtcaggagacagctgaatccacatattaataaggaaagtgatatcttgccaaatggcggaatatatgaggcagcatcacatactaagattgaaatgagccctcaagatggtggaccagaaaagaaagtggagaatttcagagaaccaaacattgatgctgatgagcaagttatgcttgggaaaagcaaacctattgttcttattttgcctagagacattccccagaataatcattgtgaagttcctgatatgcaaacatccttgggtcaaaagctaggaagtcccactggaacaagattatcagaaaaacctaaggaacctccctgtagatatccaaattccaatatttccaaaacatgtcctctgccagatgaaattagaggaatccgttatcagccggaaaggtcaggatctagttccacagatccagaaggtattaaaattcctgcttctactttatcagcacctgtaccagtcagaacagggataataagtccatgcagatctagaaaggctgaggaaaagaaacacaacattggtgcatcttcatctgcaaatgggtctctcaagggattagatcagaaagtaacaactgagaaaccaagaagttcttcaccttttcggcgatttagcttcagcattggctttacaggtaaaggttctggctgtaaagaggttgcacatgtgccacatcagagctccatagcagcacttaaatctagttcagaaaatgtgagaggttatgctagctcaaaaatttcaggcaatgataacctggtaatgctgtcaaaagcaggtctagtagccctttaa

SEQ ID NO: 87394 - DNA, 1842 bp, Glycine max
  misc_feature (91)..(91): n is a, c, g, or t
  Peptide Sequence Number=SeqID_204172
atgcttgggaaaagcaaacctattgttcttattttgcctagagacattccccagaataatcattgtgaagttcctgatatgcaaacatccnttgggtcaaagctaggaagtcccactggaacaagattatcagaaaaacctaaggaacctccctgcagatatccaaattccaatatttccaaagcatgtcctctgccagatgaaattagaggaagccgttgtcagccgaaaaggtcaggatctagttccatagatccagaagatgttgaaattcctgcttctactttctcagcacccgtaccagtcagaacaggaataagtccatgcagatctagaaaagctgaggaaaagaaacacaacattggtgcatcttcatctgcaaatgggtctctcaaggtattagatcagaaagtaacaactgagaaaccaagaagttcttcaccttttcggcgatttagcttcagcattggctttgcaggtaaaggttctggctgtaaagaggttgcacatgtgccacatcagagctccttagcagcacttaaatctagttcagaaaatgtgagaggttatgctggctcaaaattttcaggcaatgataaacctggtaatgctgccaaaagcaggtctagtagccctttaaggagattactggatcccctgctgaaaccgaagacatcaaacagccatcgcacggtggagtcatatcaaaaagattcagtggtaataaagaagaattgtaggtcaggtaatggggaattttctatggagaaagaactggacagggaccagagggttggttgtacaacaattaatacagttgatttatcaaagaacaagaagtatgtgccatcgacatttcaagctcttctaagaattgctgtgaagaatggtcagccccttttcacatttgctgttgacaataatagcaacattcttgtggccacagtgaagaacttggctgtctcaaaggaagacaagtgcaaccgtatctatacatttttcacctttagggagggcaaaaagaagaacggaagttggatgaatcaagcaagcaaaaccaaaggtccggattatattcatcatgctgttgcccaaatgaaggtttctgattcgcaccattatgattcaactagtcagaattgtgtgaactcctctacaacaaaagagtttgttttgttttctgtaaagctaaaacagggagatgctcaggtcactgactatgaacccaatgatgagcttgctgctattgttgtcaaatcagccaaggctgtcaattttatcaattatgcacatcagagcagttgccagaatgacagtcaagatctacatgtaacagttgtgctcccaactggggttcacagtcttccaagtaatggtggaccttcatcactgattgagcgctggagaacaggtggatcatgtgactgtggtggttgggatatggcttgtaaacttaagattctcgcagatgaaagtcaagcatgtagaaaatcaagaatatcaaaagcttgtttcccacatccatttgagcttttcctccaggtgaatgaccaagaccaagagaaccagcctgctttcagtttttctccctttaagcctggggtctattcggtagcttttgattcttcattctcacttttgcaagcattctccatctgcatagcgttagttgatggcttgatctcatatgaactttctggatcaagaaaccacatcgaaggaaaaaattcgagagaaactctgttggtgcaaacagatgaactaaaggcttttggcaaattagaggacattcctgcaagttatgttgcttatcctcccctctctccagttggtagggtctaa

SEQ ID NO: 87395 - DNA, 1325 bp, Glycine max
  Peptide Sequence Number=SeqID_204173
gtccagtagagcttgctgctgtaggagtttccatagctctcttcaatcaagtatcaaggatcgcaatattcccgcttgtcagtgtcacaacctcttttgtggctgaggaagatacccttagtggagaaaaccctcatatagaggagggtagatgcttggaaacaggtccacctaaggatgctgaaaccaaagagttattaccacacaaaggtggaaataatcacaattcagattttgttggtgaatgctttaatatagctaaggaggaacataagagaaggcatatcccttcagcttcatcagcaatatttatcggtggcatccttggactcatccaggcaatatttcttatatctgcagcaaaacctttattgaacttcatgggagtaacttctgactctcctatgctacaccctgcaaagcagtatctgaaattgaggacccttggtgctcctgctgttcttctctcattagcaatgcagggagtcttccgaggatttaaagacactaaaactcctttatatgccactggagatgtaaccaacatagcactagatcctttattcatgtttgtattccgcttgggtgtcagtggtgcagccatcgcccatgttatatctcagtacctaatttcagcgattctcctgtggaggttgatggaacaagttgaccttgtacctccaagcataaagcatctgcaattagaccgatttcttaaaaatggttttctattattaatgagagtcatcgctgtaacattctgtgtgacactggctgcatcactagctgcacggcagggaccaacatctatggctgcatttcaagcgattcttgcgggcgcatttgctaataaggacttcgacagggccacagcaactgcatcacgagttctgcagatgggtttggttttaggattggcacttgcattcattcttggaataggattgcactttggtgctaaaatatttacacaagatgctaatgtcctccacctcattcaaattgggatcccgtttgttgcagtcactcaacccctgaattctatagcatttgtttttgatggtgtcaactttggggcatctgattttgcatattcagccttctccatggttgtggttgcaattcttagcatcatttgtctgcttattttgtcatccgctggtggtttcattggaatttgggttgctttgaccatctatatgggtcttagggcatttgctggcttcttaaggaccttgggagttcctaaggagctcatgactgcacatggcagacaccgtagttatagcttcatattaggcctaggtttcagtggtgtttgctga

SEQ ID NO: 87396 - DNA, 264 bp, Glycine max
  Peptide Sequence Number=SeqID_204174
atggctgagaaagagagtatgtattcattaggtgattggaggagaataccaatttgcactttctttaaggatgccagactagtttttaaagcagacagtcttggtcgggaaattttgtcaattgcattgcctgcagcaatggctttgacagctgatcctattgcttcactggttgacacagcatttattggccaaataggtatgttctgttattcttttattaacattgagcttacttcacacatttctcatcggaaaccatag

SEQ ID NO: 87397 - DNA, 324 bp, Glycine max
  Peptide Sequence Number=SeqID_204175
atgaggaagccagaggcgagtaataataatactaaaaacaacaacaacaatagcaagaagcttagaaaggggttgtggtcacctgaagaagatgacaagctcatgaactacatgctaaaccatggacaagggtgttggagcgatgtggcaagaaatgctggcctccaaaggtgtggcaaaagttgtcgccttcgatggatcaattacttgaggcctgatcttaagagaggtgcattctcaccccaagaagaggaactcatcatccacttccattcccttcttggaaacaggtatgccattcctgtaagagtgatagaattctaa

SEQ ID NO: 87398 - DNA, 1073 bp, Glycine max
  Peptide Sequence Number=SeqID_204176
atgcgaaactggcaggctccaacccgacgcaccgcgttgttcctggcgctgctggccgtgaccggcccggcgctgcatgctgaggatgcaatgaattccacgtcatctcatttcgcctatatcggcacctacaatcccaacggcgaaggcgtttaccgggtgcaggtcgatccggccagcggcgcgctgagccaggttacgctggtcagcaaagtgccgaatccggcgcagctgacgctgggcgctgatggcaagacgctgtatgtcgccagcgaagtggccgatttcaacggcggcaagcacggcggcatcaccgcttaccgggtcaatccggctgacggcggcctgacgcagctcaaccaggtggattcgcagggagcggggccggtgtatctctcatcgacgccggacgggcgccatctgctggtggcgaactacgtcagcggcagcgtggcggctttcccgatcgaagcggacggcagcctgggcgccgccagctcggtgcagcaacagcagggccccgcgggcgcggccaaaccggcggcggcggtgaacggcagcttcgccatcagcgatcacaacggcccgcatgcccatatgatcgccagcgatccgagcggcaagttcgtgttctccaccgatctggggttggatcgcatctaccaatggcgctttgacgccgcgagcggccggctgacgccgaacgatccgccgtggatcgccgcctcttccgccggcgcgggtccgcgtcactttgtgttccatccggacggcgaaaccgtgctgctggtgaacgaagaggcctcgacgttgaccagctaccgttttgatcgccaaaaaggtactctgaaacaactgcatgcggtttccgcgctgcccgccgactatcagggcaccagcttcgcttcggggctggcgctcagcaagaacggcgacacgctgtacgtcgccaaccggctgcataacagcattgcccagttcagcgtgggcgccggcggtgagttgaaaccggtggcggaaacctggacgcgcggcgattacccgcgttcgctggcgctgagcccggatggccg

SEQ ID NO: 87399 - DNA, 351 bp, Glycine max
  Peptide Sequence Number=SeqID_204177
atggcctctagcggcatagcttctctgctattgcctggaggtagaactgcacattcaaaatttaaaattccagttctagtttttgaagactcaacttgcaatatccatcaaggaactcaattagccgagctattaaatcagacaagtctaatcatttgggatgaagcacccatggctcacaaattctgttttgaggcacttgatcacagtcttagagatatcatcaaacacaactcaaaggacaatacaatctttggaggtaaagtcatggtctttggtggagatttccggcagatcctgccagtcattccaagaggcagccgcaataattccaaactgttatcttactaa

SEQ ID NO: 87400 - DNA, 1084 bp, Glycine max
  Peptide Sequence Number=SeqID_204178
aggactacacgtcctcaccttcagaggactacacgtcctcgccatcagagggctgcacagcctcaactttagaggactacacgtccttaccttcagagggttgcatgcgctcgccttcatagggctacatgccatcacgttcagagggctacacgccctcgccttcagaggactgcacgtcctctcctttagaggactacatgtcctcgccttcagaggattacacgtcctcgccttcagagggcaacacgccttcatcttcagagggctagacgtcctcaccttcagaggactacacgtcttcgccatcagaggactacacatcctcgccttcagagggctgcacgtccctacctttagaggactgcacgtcctcaccttcggaggactgcacatcctcaccttccgaggatcgcacgtcctcaccgtcagaggtctactcgccctcgcctttagaggactacacgtgcttaccttcagaggactacacgtcctcaccttcagagggctacacgcccttgacatcagagggctacgcgttctcgaatttgtagggctaaacgccttcaccttcagagggtttcacgccctcgcctttgtagggctacacgtcctcaccttcagaggactgcacgtcctcaccttcagaggagggttacacgcccttgccatcagaggactacacgtcctcgccttcatagggctacacgccctcaccttcagaggactacatgtcctcgccatcagaggactgcacgtcctcgccttcgtagggctacacgccgtcaccaccaaaggactacacgtcctcgccattagagggctggatgccttcactatcagtggactacgcgtgctcgccttcagaggactgcatgtcctcaccttcagtggattgcacgtcctcaccttcagagggatacacgtcctcgccttcattggactgcacgtcctcaccttcagaggactacacgtcctcgtcttcataggactgcacatcctcgccttcataggactacacgtcctcaccttcttagggctgcacaccctcgccttcagaggattgcatgttctcatcttttaa

SEQ ID NO: 87401 - DNA, 675 bp, Glycine max
  Peptide Sequence Number=SeqID_204179
atggcgcaaaccgccgcgcgcggcaccgacgcgggcgcggcaggactgggactgctgctgctatggctggccgacgacgtcgaacagcgcgccaacgccgcgctggcgccgttcggcatatcggaaagcaagctcgacgtgttgatgatcttcggcctggccgaacgcggactgatcgacagccgcgcggtgacgccgtcgtacatcgccgactatttcggcgtcacgcgctcgacggtcacgggcctgctggactggctggaaaagcgcgaactgctcacgcgcgcgctcaaccacgaagaccggcgcagcatctcgctggcgttgaccgacgccggacgcgaactgctcacgcaggcgctgccggcgttctggaccatgtgcgcgtcgctggtggattgcctggacgagaacgaccgcaaggccttgcagggcatcctggcgaaaagcagcgccggcagcaggagcacggcgcgcggcttcatcttgccgccggccgctcgccgatcctggccgagaatcgcagcagatacccgtccggatcctgcaccaggaattggcgcacccccacttcgacggcgtcgctgcggtaccagcgctcttccggttcccggtacaacggccagcgtgcccgcgccaagcgttccagcaaaggctcgatggcggacaccttga

SEQ ID NO: 87402 - DNA, 2253 bp, Glycine max
  Peptide Sequence Number=SeqID_204180
atggctgcaactccttccaaattccttcaaactccctccaaacccaaactccgatcccaatccaatcccaaatcctcgccggttgtaacccccgacactccacaaaccctatatcctcgcagatccacgcgcgccaagtccctcctcttcgatgctcccaagcctccccacacaccgctcgaaatctcgctcacaactccgaagcggaggatacgacgatccatcgattgtgtcgatcaggattccggcgaagataaagccacaaccagcaaaatttcagataaaaataaagctccggtcgtcgatgcgtcaaagaagaagaagaatgggaagaactcaattgaagtttcctttgctccggtaacaccggcttcatcggaaaaggcatccacgaggaagagggagggtgaggggggtgttgttaccagagctaaaagaaggaaatcggagaatcgtgaaaagagtgcaaaactgcctcagaggcgcgtgtattacacaaaggtggtttatgatggaggtgagtttgaattgggggatgatgtttatgtgaagaggagagaagatgctagctccgatgacgaagatcccgaaatggaggagtgtaggatgtgtttttcctcaaacgatgaggtcatgattgagtgtgacgattgtttgggtgggtttcatttgaaatgcttgaggcctccattgaaggatgttcctgaaggggattggatctgtgggttctgcgaggctcgtaagatgggtatggaagttcagttaccaaagcctccaaagggtaagaaactagttaggactatgagggagaagctcctttccagtgatttgtggtctggtcgtattaaaagcatatggagagaggtggatgacaactattggtgtcgggtgcgctggtatacaatcccagaagagacttctgttgggcggcaacctcataacctgaggagggagctatatcgaactaatgattttgctgacattgagatggaatctgtccttagacattgccatgtcatgacccccaaagaatatgctaaagctagcgatgagggagatgatgttttcttatgtgaatatgagtatgacatccattggcacagtttcaaacgtcttgctgatattgacaatgaaacagagaatggtgaagagcatgacagtgacgaagactggaatgttgacaaggaatcagactctgacacagatgaagatgttgaatacgaaaaagaaaatattaaaaatacacaatctaagccatcaacaagccatcacttagctgcaaatctgcagaagggacagttctttggacttcaaaagataggcacaaaaacaattccacagcatgtaagatcgcacaaacagactgatcttgagagagcaaaggctacactgttgttagcgtcactgccaaaatctttaccttgtagaaataaagaaatggaggagataactgcattcatcaatggtgctctttctgacaatcaatgtctgggacgttgcctctacattcatggtgttccgggaactggcaagacaatgagtgtactatcagtaatgagaagcttgaagtcagaagttgatgcaggaaacatcaaaccgtacacttttgtggagattaatggtctgaaattggcatcacccgagaatatttacaaggttatttatgaggcactaaatggccacagggtcagctggaaaaaggctctccacttgctaaatgagagatttgtagaaggaaagaaaaccagagatgaggctgaccggccatgtattttgcttattgatgaacttgatcttctagtaaccagaaaccagtcggttctgtacaatattcttgactggcctactaagccacattccaagctaattgtcatagggatagcaaatactatggatcttccagagaagttacttcctcgtatatcaagccgaatgggcatacagaggctttgctttggcccatataattatcagcagcttcaagaaatcatttcaagtcgcctcaagggaattgatgtatttgaaaagcaagctgtagaatttgcttcaagaaaggttgcagcaatctctggagatgcacgtcgtgctttggagatatgcagacgtgcagctgaaatagcagattatcgtatgaagaagctaatttctaatcctgattgtgttactgcaggaaagggacttgttggaatggtagatgttgaagcagccattcaagaaatgttccaagcacctcatattcaaatgatgccatag

SEQ ID NO: 87403 - DNA, 597 bp, Glycine max
  Peptide Sequence Number=SeqID_204181
atgaaggtggcgaatgaggctatcttatatgttaacggagttcgcagggtgttacctgatggattcgctcatttcactcttctcgagtatctcagagatataggtctgaccgggacaaaactaggatgtggggaaggtggttgtggagcttgcacagttatggtttctcaatttgatagaagattgaagaaatgctcacactatgctatcaatgcttgcttagcacctctatattctgtagaagggatgcacgtgattacagtggagggattgggaagctgcaagcgtggactacaccctgttcaggaatccctggctcgggctcatggttcacaatgtggattttgtactcctggttttgttatgtccatgtatgcattattacggtcaagtcaaacaccgcctagtgaagaacaaattgaagaatgccttgcaggaaatttatgtaggtgcactggttacagaccaatatttgatgcattccgggtcttcgcaaaaactagcaatgacttgtatactggtgtttcttcattgagccttgaagaaggcaagtctgtggtgataagagatatgagtctacttcctatgatgaaatag

SEQ ID NO: 87404 - DNA, 762 bp, Glycine max
  Peptide Sequence Number=SeqID_204182
gctcctcagaagcaccagaaatatgtttctcatgttcttggccttcccatgtcaaaggtagtttgcaaaacaaaacgagttggtggtggatttggggggaaggagacaagatcagcctttattgctgctgctgcttcagttccatcttatctgttaaatcgaccagtgaaaatcacactggaccgagatgtggacatgatgataactgggcagcggcatagttttctagggaagtacaaggttggatttacaaatgaagggagggtgcttgcgctggatcttgaaatttataacaatgctggaaactcactggatctatcgcttgctatccttgaacgtgctatgtttcattcagacaatgtgtatgaaataccaaatatgagggtaatggggagagcttgctttactaatttccctagccacactgctttccgtggatttggtggtcctcaaggcttgctcattgctgaaaactggattcaaaggattgctgtggaactcaagatgagtccagaaaagataagggcaagagaaggatccgttctgcattatggccagatagttcagtacagcacactagccccactgtggaatgaacttaagttatcctgtgactttgcgaaggcacgtgaagaagttgaccaattcaatagtcacaaccgctggaggaagcgtggcattgctatgattcctaataagtttggtatatcctttacaacaaagcttatgaaccagaaaaaagtgatttcaactgatgtttaa

SEQ ID NO: 87405 - DNA, 645 bp, Glycine max
  Peptide Sequence Number=SeqID_204183
atggggcaaggtttgcataccaaagttgcccaaattgctgcttcagctttcaacatccctcttagttctgtcttcatatcagatactagtaccgacaagctatataccataccaacttaccaagttcctaatgcttcagcaacagcagcttctgcaagttctgatatgtatggagcagcggttttggatgcatgtgagcaaataatggcacgcatggaacctattgcttcacagcataacttcaactcatttgctgagctagttggtgcatgctatgcagaacgaatagacctttctgcccatggattttatattactcctgatattggttttgattggacgacgggtaaaggaaaacctttcagatatttcacttatggggctgcatttgctgaggttgaaattgacaccctgactggagattttcacaccagagtggcaaacgtatttttggatctaggttattctctgaatccagcaatagatgttggacagaatatacaaggaagtttatcaaggatggagaaacactacacagaggatacaaattcctctaaacggaagtcagaaaatttgatagaaaagaaattaaatcgagggagctttaatgcaaggttcgggttgggtagctttagaagaacttaa

SEQ ID NO: 87406 - DNA, 267 bp, Glycine max
  Peptide Sequence Number=SeqID_204184
atggagaattggcgaacaacgctattcaataacttcctggggctccattctggaaggtggaggatgcatgaacagcacttggcaataacattcatggggctccgaaaaaagtggagaatggagaattggcgaacagcgctacgcaataacttcgcggggctccagactcgaagtggagaatggagaattggtgaacaacactacgcaataacttcgcggggctccagactcgaaggtggaggacacatgaacagcgctaggcaataa

SEQ ID NO: 87407 - DNA, 803 bp, Glycine max
  Peptide Sequence Number=SeqID_204185
atgtgcaggcagcaacatgttcatgagcccgaaatgctagcagacccaaccccctccccgctggcccaccattggcggcagcgcgacctgcaggtgctgtggcatccctgcacgcagatgcgcgagcatccggacaccctgccgctggtgccgatcgcccgtggcgaaggtgcctggctgatcgaccacgacggcaaccgccatctggatgcggtcagcagctggtggaccaatctgttcggccacgccgaaccacgcatcggtggcgccatcgccgcccaggccgggcagctggaacaggtgatgctggccggcttcggccacgagcctgcgatcaccctggccgaacgcctgctggcactggccccccgccagcccggccgcgcgccgctggccaaggtgttctatgccgacaatggttcagccggcgtggaagtggcgctgaagatggccttccagtatttccagaaccgcggagagccgcgccgcacgcgcttcatcgcgctcgagaatggctaccacggcgagaccctgggcgcgctggcgctgggcgacattccgctgtatcgccgcgtctatgcaccgctgctggccgaaggcctgttcgcaccctcacccgatgcctacctggccgaacccggccagagcgcggccgatcgcgcgcggcaggcagccgatggcctggccacgctgttcgaccagcacccgggcgagatctgcgcggtgatcctggaaccgcgcctgcagtgtgccggcggcatgcgcatgcatgacccggtctacctgcagcgcgtgcgcgaact

SEQ ID NO: 87408 - DNA, 405 bp, Glycine max
  Peptide Sequence Number=SeqID_204186
atgaccgtgccggccgtcgcttgccgatcatccatcggatcaccgatgaggagaacggtcccttccagcgccagcacctggacctggagttctccaacggcgaacgccgccgcttcgagcgcctggcatgcaccgctacgaactgggcctggtcaagggccggatcgatgccggcgagactcccgagcaggctgcggaccgcgaactgaaggaagaggccggttacggtgcgcgccgggtcgacgtgctgcgcgcaatgacccttgccccgacctatatgagccaccagtcgtggctggtggtggcgcgcgacctgtacccggaaaagctggccggcgacgagccggaagaactggaagttgtcccgtggaagctggccgagctggaccagctgatgctgcgtga

SEQ ID NO: 87409 - DNA, 796 bp, Glycine max
  Peptide Sequence Number=SeqID_204187
atggcaggtcattggacagttgcggctcgcgcttatcttcttcatcttctgggttgcactctgtttgctaacaagagtgcaaccaatgttcatgttgtgtatttggaggcccttcatgacctcagtcagactgggaggtactcctggggagtagctgcattgtgctggatatacgagcactttccctcagtcacggagtccactgctgatcaggactacgacgaggattcattgcgtgcctgtaggtggattgccacgaagaagaccgtgaagagcatacatacaccggcgtacagggagtgcctggaccgactccggattctggatgtctgttgcatcccatatggggagcaccgaccggtccaggacttccatatgatttcatgttattccggtctcctacgctgggggcctgttgttgtgtattatcgaccagagaaggtcatgcggcagtttggatacacccagaccattcctactccgcctgccgactcatgggtgtcgtatgatgatatacacgacaggtggatacactattcggatcatatggttctagtaggtgaggtgtgcgatgtgccaagtcagtgtgccaacgactacatagactggttcttccgcatttcccattttttcatggcaccaggccaggcatcagatcctctgctagatggtcatgctccgcaaccccgagtcgtccctcaggccccagagacagatatccctcacgtgccggagccaggagcaccatcgacatctgcgaggcccgttgtggaggagcctagacatgcagtgataa

SEQ ID NO: 87410 - DNA, 537 bp, Glycine max
  Peptide Sequence Number=SeqID_204188
atggccggcgcgcagctgggcaataatccagccaatgcccaaaccggccagcgccagcgcgccgctgatgataagttgctgatccataatccccccgcggatcgtctcgctgaggagaaggcaccgtccgggcaactacagggcgcgcacggtcaggtcgccggctttccaggcgtcgatcaggaaaaacggcatcggcagcacccattcgctgtcgcttttcaccttcgccggatagcaccagctgttgccgccgtaggtcagctccacctgctgctggccattttcggcgttggccactttgccggccatgctggcgaaaccggcgttgctgccgacgtggaagctgtcggtctgccagcgaatcggcgcatgcgccggccacggctgcgcgtggtggaagtgaaagatatcgtcgtgattgaggatgctgtcgcgcaccgtcggccacagcgctaccttgaggaagtactggtcggtaaagcgctcgctgccgtcatactgcgcgataaagtcgcgcatctgctgctccacatt

SEQ ID NO: 87411 - DNA, 246 bp, Glycine max
  Peptide Sequence Number=SeqID_204189
atggccatcaaagggaattatttgagtgcttcattgttcaatctatctctttcaagagagatttcttcttctcttcttcttacttctaaaaagggattaagagaccgatggtctcttgttgtaaagcaatttgaatacaaaggatgggttgtccttgtctggttcagaacttgtaaagggtttttgcaagttagtggaactctcaagcaggttgcttggggactggacgtaggcataagggtatga

SEQ ID NO: 87412 - DNA, 1480 bp, Glycine max
  Peptide Sequence Number=SeqID_204190
atgttgtctgaattggggacaagaccgatgcttggtggtaacgaaggttcctttggggatgaactggagaaggagatagggatgttgcttcgtgagcaacgaagacaggaggttgatgatcgtgaacgtgaactcaatctgtataggagtggatcggcgcctccaactgtggaaggttccctcagtgcagttggagggttgtttggaggcggtggcggtggcgctggcaccgccgctggtgcggtgttttcggagttttctggggccaaaagtgggaatggtttttcttctgaggaagagcttaggtctgatccggcttatctttcatactattactccaatgtgaatttgaatccccggcttccgcctcctttgctctcaaaggaggattggaggtttacacagagactaaaaggtggagcttctgttcttggtggaattggagataggaggaaagtgaacagggctgatgacaatggtggcagatcactgtttgcgactcctcccggttttaacatgaggaaacaagagagtgaggtggagagtgaaaatccaagaggttcggctgagtggggtggtgatggactcattggtttgcctggcttagtaattgtgcaggatgatttgggacttaacgcttctgtcactggctttccatctcgtcctgccagccgtaatgcatttgatgaaaatggcgatatcatatcatctgttgaatcagaactggctcatttacgtcgtgattccttggccactgataccttaagatctgtatcaaatgtccctgtgtcatctgctgcccaaaatactggcccacaagcttcctattcttatgctgctgcactaggttcttccttgtcgcgtagcactactcctgatccacaacttgttgctagggctcccagtccctgccccacacctattgggggtgggagagttgtagctgctgagaagagaggtattaacagtcctgatgcttttaatggtgtttcatctggagtcaatgagcctgcagatattgtggctgcattgtctggcatgaatctgtcagctgatgatgtgttagatggtgatagccatttcccgtcacaggttgagtcagatgttgataatcatcagagatacctatttggcatgcaaggtggtcaggatcctggcaaacaacatgcatacttaaagaagtctgaatcaggacacttgcataaatctgcttactctgattcaggtaagaatggtgggagtatgtcagacatcaacaatccatctttggataggcatgctgagctacaaaagtgtgctgttcctcccaataactcatacttcaagggatcacctacctcagcttttagtggtggaggtggcgtgcctgctcagtactcgcccttagatggtactaattcagcatttacttactatggcctgagtgggtacgctggaaatccagcattggcatccttggtggctagccaacttggaacta

SEQ ID NO: 87413 - DNA, 975 bp, Glycine max
  Peptide Sequence Number=SeqID_204191
atggtttatcaagaaatcatgcctcaagctcttgctttgatgactgatgtctttggtaattatgtggttcagaagttttttgagcatggacttgcatcccagagaagagagttagccaacaagctttttgaacatgttctgacgcttagccttcaaatgtatggttgtcgggtcattcagaaggccatagaagttgttgatctggaccagaagataaagatggttcaagaacttgatggaaatatcatgcgttgtgtgcgagatcagaatggcaatcatgtaattcagaaatgtattgaatgtgtccctgaagatgcaatcaactttattgtctcaactttttttgatcaagttgtgacactatcaacccatccatatggttgccgggtgatacagagagtactggagcattgcaaagaccctaacacccagcaaaaagttatggatgagattttaggagcagttagcatgttagcccaggatcagtatggcaattatgttgtccagcatgtacttgagcatgggaaacctcatgagcgatccgccattatcaaggaattagcaggaaagatagttcaaatgagtcagcagaagtttgcctcaaatgttgtggagaagtgtttgacctttggaggtccttctgaacgccaattacttgtgaatgagatgcttggttccacagatgaaaatgagcctcttcagcttgctcagtcaaggcttgaaatgccaatctttgtccaaataggccatgatgatcacatggcaatgatgaaagatcaattcgccaactatgttgtacaaaaggtgctggagacttgtgatgaccaacagcgagagctaattctttcacgaattaaagttcatttgaatgcattgaaaaagtacacctatgggaagcatattgttgctcgtgtagagaaacttgttgctgctggagagaggagaattgctgctcagtctcctcatcctgcttag

SEQ ID NO: 87414 - DNA, 2025 bp, Glycine max
  Peptide Sequence Number=SeqID_204192
atggcatccttcgctgcccccaacaacctcggtagcgccgtgctaccctctcgtccccctcccgtcaaatgcacccttttcccttcttgcaacaacaacaacaaccattcactttcaaacccttctccctctcaccctccgccgctcttcaaagccatcgccatctcctccgccgcctccatccttatgcactgtacccctctctcccccttcctccctaaccccctcgccaaactcggcggaggcggcggaaacaccggcggcggcggcggaggcggagacggatggttcggcggtggcggtggcggaaatggagggttctggtccagaatgttcgccgcggtggccgacgaatcccagtctcaggagtgggattcgcacggtctacccgcgaacatcgtggttcagttgaacaaaatgagtgggttcaagaagtacaaggtttccgacatctcctttttcgatcggaacaggaagatgaaagtgggaacggaggattcgttcttcgagatggtttctcttcggccgggcggggtttacaccaaagggcagctccagaaggagttggagacgctggcaacttcgggaatgttcgagaaggttgatttggaagggaaaacaaaccctgacggctcaattggggttaccatttccttcagcgagagcacgtggcagtcggcagatggatttcgctgcatcaatgtagggttgatgcagcaaacaaagcctgttgaaatggacgctgatatgaccgataaggagagactggagtactatttgagtcaggagagggagtacaagaggagaatcgagagggccaggccctgcctcttgcctcgctacgtccacaatgagatcctggacatgctcaagagacatggcatggtcagtgcccgcctgttgcagaggattcgggaccgggtgcaaaaatggtaccatgatgaaggctatgcctgtgcccaggtcgttaatttcggcaaccttaacaccaaggaggttgtttgtgaggttgttgaaggcgatatcacacaattggatattcagtttcaagataagcttggtaatgttgttgaagggaacactcaagtccctgtcattcaaagagagcttccccggcagctgcgcccaggttacaccttcaatattgaagcagggaagcaagctttaagaaatgtgaactcccttgctttgttttcaaatattgaggtgaatccgcgccctgatgagactaatgaaggaggtatagttgttgaaattaagctaaaggagttagaacaaaagtcagctgaagtcagtaccgagtggagtattgtccctggacgtggagggcatcccactctggcttcccttcagccaggtggcactgttagttttgaacatcggaatctgcaagggctgaatagatctattaacggttctataacaacaagcaacttcttgaatcctcaggatgatcttgcatttaagctagagtatgtgcatccatatctggatggtgtatactattcacgcaaccgtactctccgtgtaagctgcttcaatagccgtaagctgagtccagtattcactggggggccaggcgtggatgaagtgccaccaatatgggttgatcgtactggtgttaaagctaatattacagagaatttcacacgtcagagtaaattcacatatggacttgtaatggaagagataacaacacgtgatgaaagtagtcatatctgtgcaaatggtcaaagagtattacctagtggaggaattagtgccgatggacctccaaccactctcagtggtactggcattgatcacatggcatttttacaggcaaatatcacacgtgataacacacgttttgtgaatggaactgttgttggagacagaaatatgttccagcattttgttttgctaacaattcaaatcttgacttgggtggggaaagacaaagcaagaagtttgaagaaaagacaaaagggtgcatcaagcaggggcagagcatataatttctatgcagatgccatgtctccctaa

SEQ ID NO: 87415 - DNA, 615 bp, Glycine max
  Peptide Sequence Number=SeqID_204193
atggtggtgagagcaaggcgtagcgagtcaccgtatgatgttttgggagtgtctccatcagcatccgtcgacgaaatcaaaaaggcctatcggaaacttgctcttaagtatcatcccgatgttaataaagaggataaggcacaggagaagtttatgaggataaaacatgcatacaatacattgctaaattctagttcccgcaaaaaatatgattctggaagtcgaggttatgatttttctcaaggaagccgaagtaggaatgtacaaactgaagaagaattttatggactagaggacttctttaaggatcttcaagaagaattcaagaactgggaagcaaacgctgcttcacaaggaaagccaaagagtctatgggaggaattggcggaaataggagaagaatttgtggagttccttgagaaagaacttaatattactgatcaaaatgatgattataaaacgtctcagggagaaaatacatccaacttttctgggacggagacaccaagcaatagcagtcaaggtgaagctagcaagggaaacagaagcgttgacgataacattgaggaaatagaagctactctggctcagttgaaaaaggaattaggtttatag

SEQ ID NO: 87416 - DNA, 450 bp, Glycine max
  Peptide Sequence Number=SeqID_204194
atggccaccacatttgcatcctcatctccacaaattgcagcttcttcttttactcttccacccttccaatccaaaaagttcatcctttttcacaacccagtacttcaaaaaaacaacatactccgacccattcttcttcctcctcctcctgctgctgctgctgcccaagatgcggtggatgctgcggaacaattgtacaaaaccaccgatcaaggggtggccacagtcgtatccgctcttttctttattgctttcgttggcctatccgctatcactattggggttatctatctagcagtgacggatttcctgcagaagagagagaaagagaagtttgagaaagaagaagctgctaagggcaagaataagaagaggaagaaggtgggcagagccagggcaggacctagaggatttggccaaaaatatgttgaagacgaggttgatgaatga

SEQ ID NO: 87417 - DNA, 1185 bp, Glycine max
  Peptide Sequence Number=SeqID_204195
atgcctctgccagaacgctcgtacggacatgttaatacttcaagaagtcctaccgccgtcgcaagcgtggaacaattccttcgagctacatcaggaggggagtcttgtagaaagtcaccaacctactctcccacctcgtcttccccttcctctccttactttgagaggttgaagaaccataactcagaagaagacaatggtctctgtcagaagaaatcagtcctcaccaaagtgaaggagagggccatgaaattccgctacagcctcagcaagagaagaatggaggacgagaatgtcacaccctcttggggtgttagcttagaagatgatgaggaagaagaagaagaccctgaataccttggagccccaatgtatgaatcagagctggcacctgagggatacaaagaaaatgcaaggcaacatccaagagcaaatccagtaatctctgagaagcatgttttgcaccacactgtcaaattaggagtggagcaagattcaaaaaaatcacgtggtcctgtcaatgccaggttcacgacaacaactcaacctgttactacaacttcaaacatgacatctgaaaacatagctgagaaactggcacctgtctatgctggagggtcaaatgcagctaatgctatatcctccaaaattctagcttctggttccacgactgctcctgcaaccaacatgtcctcacaaacctcattagttccatcatcttctatgcaaaattcatctgcttctctttgtgagaagaatacatgccaaaagagtgcttctctaagagatcatttcatgaaccagtctgaaaaaggtgatggagccagaaatgtgtctacaatgcaaaaatcatcatccttatctgcttcaatgagtgggaataagaatataacaagcctaaagagtgcttcagttaaagattattcaatgaacaagtctgagccaagggaagatgccaaaactgatgtgtctcagcctcagatgatatctaaagcaacgagtcctacgagaacttctagtaatgcaggtgtgatggacaaggtaagaggagctgtgaattcattgttcggaaatgaggaaccatcacaacaatatggagtcaaaacttctactacacgcacttcgtcgcaaactcaacaggttgatcaggaagagaaccgtgggagaattctacaggcaaattga

SEQ ID NO: 87418 - DNA, 336 bp, Glycine max
  Peptide Sequence Number=SeqID_204196
caaccttcttctccttggatgaaccaaaggcctccacttgatgtcaatgttgcttatgtggaagggagggatgaggcagacaaaggaacttctaatcaacctctgacacaggacttcttcacgaggacgtcagggaagcgaaaacgcaatgatttgacttctcaatataatgttggtggatatatacctcagcaagatggagctggggatgctgcacatggagtttttgaaattgaggataataacttccctttcttgtccttttttgggattgtggttgacacaagttgggacatgtgggatggtgaaaacaactcttgccatcccatcgcttga

SEQ ID NO: 87419 - DNA, 252 bp, Glycine max
  Peptide Sequence Number=SeqID_204197
atgagtgaagataaagaatcacataacatttccgtcatcaagaggttgggcaggaacgtactgataatagtgatagtggtgattgtgaacctgaaaatggtgtttttcatgagcatggggaattgctatgcttcttgggctttgctatttggagctccttactgctattcgtatcattcccgtgggcttcaaacaccaccttgtcctcaaggtgacgaaggaaaggaccgcagtaccgtttgcctaacttga

SEQ ID NO: 87420 - DNA, 396 bp, Glycine max
  Peptide Sequence Number=SeqID_204198
atggctttgaatgctaattatccattgaagtgtgtcaatactggtgacatttattctaccttaccagttgccaaaaataaaatcaaggaacatgatgataagaatgagacgaatgttgcaggacctagtggtgtcaaaattggtgaagggaaggaagatgatgttggtgagcattatggcagtgatgacgagaatgttgcagttgcaggaccaagtggtgtgaatgctgcctatgatgatgagactgaggttaattttgatgaggatgagaacaatggacttactgctgcagaagttgttctgagagctcaaatagaagcagaaaggcagaagagtggtgaaaacaagaatgacccaacacccaaaagacagactcgattaactcattctgtttag

SEQ ID NO: 87421 - DNA, 555 bp, Glycine max
  Peptide Sequence Number=SeqID_204199
atgtggaaaataaggaggggagtgatgaagttagattggaaggaagacaagcagaaacttgataggcagttgtatgatatggctatagccattgagaggttggaaagcagtaggcagaaacttctaatggagattgactcacaatctacagaaatagagaggctttttgaggaaaattctagtctctcaaattcataccaagaggcaattggagcagcagcgagatgggaaaaccaggtgatggattgtcttaagcaaaatgaagagcttcgtgggattctagataatttgagaatggaacaggctaggggtttgccagactcttctaaaaatggggcacatgagattgcttccttggcatctatgaagggccaacttgtgacagaacagagcagagcagaggcgctatctgcagaagtcatgcagctttctgctcaacttgaacaagtcaaacaagcatatgatggtcttgcacgcttctataggccagtgctgcgcaacattgaaagcaatctcataaaaatgaagcaagacaactcgttggctgtacgatga

SEQ ID NO: 87422 - DNA, 567 bp, Glycine max
  Peptide Sequence Number=SeqID_204200
gctgacaacatttgcacctattgctcaagatgttgagcatgtggatcatgcagctgataaggttcatgagcagcctcgagagccagttgctgatgatgtagttgttaatgcccagggttttccaggcaagtcccatgatacacaacttttgacggaatgtgttcatcatgtggcagtcacagtttggaatggagaaaagttgtcctcccatggaaagaagatagagaaatttggagggtttgatcaagagattgaaggcatagtggctgtcacaaaattaagtcttctgattgcatgttccttggacactagtgataagggacttatatttgcttttgtagagaagtggcataagaaaactaatagtttttatcttcccgtgggagagatgggtcaatctattgtcatacaccgaccaaagaggattgtgcaacagtttgattatgtgaagaccattcctctaacctctgttgttccatttttatctgtaaagaagattgacgataaatggatgcacttctctgaatatcttgcaatggtgggtcagatttgtgttgctcctggacg

SEQ ID NO: 87423 - DNA, 327 bp, Glycine max
  Peptide Sequence Number=SeqID_204201
atggcttcatgtaaccttcaatatagtcatcagaagaatcacttaccattagatcaagacctgagagaaggttacatattagacaggcctaaaggtgtaaactacaacacagcagatattcctataggttggggaaaaatagagggaggaaatgaacagcataaaaacaccctacaaaagaactcagagcatccccctcgaaccaaatatgccaaaattatccccttggatttaacgagtattcagcagaaaagtagccatggctggttcagcgagcatcgtattcaatggaaaatccaaccagaaaccaaacaacaaaggttataa

SEQ ID NO: 87424 - DNA, 1416 bp, Glycine max
  Peptide Sequence Number=SeqID_204202
atggaagaacaagaagaagaagctccaactctgcgactcgagatcctgcaaggccctggcgagggcaaaaccctagaattcaaacccggcaccgccgtccgaatcggccgcgtcatcaaaggaaacaatctccccatcaaggactccggcatctcctccaaacacctcaccatctcaaccgaatccaacaaatggaccctccgcgatttggattcctcaaacggcaccgttttggacggatcccaaatccctccccacacccccttcacgcttcatcacgactccgttattaagatcggagaactcacctccatccatgtcatcttcgttcctcgcgaacaacaacaacaacaacgcgcggttcagccgcggcgaaaccctactcgccgcggccgaaccgaaccggtcccggctccgactgaaccggttcagacacgcggacgcggtaaacctaggggtttgaagggtaaggttcagattcaggttcagagtgttgaggaaaatgacgcgagtgtggtggacgcggaatctgagcgcgtggatccacctgctagggttacgaggaagaccaacagaggaaggagtgtggctaaggaggattcgagtgttgttgttgagaatttcgatgctccagagggtaagactcagattcagattcagactcagagcgttgaggtgaagaacgcgagtgtggtggaggcggatggtgagcgcgtggttccacctgctagggtaacgaggaaggtgaacagagagcggagtgtcgttagggtttgcaatgacgacgacgatattccggtggagaaggcggaggagccgaagagtactaggaatttgagtttggttgagatttctgattccagcgttgggaattcggatgccacggtggcagaggagccgaagaagacgcgcgtgacgcgaaatccgaagaacacgcgtgcggtgaagggtaatgttgagaataagacgaagaggggtgttgctggaaagagagaattggagaaagagagtgaagatttgaatggtttgaaagaggtttgtgatgggacagaagaggagaatttgaatggagacgttggaaaattgcctgatttgaaaggaagaaagaggggtgctactgaaaaaagggaattggagaaagaggatgaagatttgaatggtgtgaaagaggcttgtattggaagagaagatgcgaatttgaatggagatgataggaattggcctgatttgaaagggagagagagggaattggagaaggaaggtgaagatgggaatgatgtttacttgcccaaacagatcatagatgagactgaagagatgatcgatttgatgacgcaaaaagctgagagactccgcgagtacattgtagagaagcaacaacagaatggcaaggccaaaatgccaatggaggaatag

SEQ ID NO: 87425 - DNA, 228 bp, Glycine max
  Peptide Sequence Number=SeqID_204203
atgtttgagggactggttcatcagttgcttctcggttacctcggtcggtatttcaaagatatccagaaggagcagctcaagattaggctcgaggacataaccgataacacttgtatatttgaaaggccagaatggatgtttacttgtgttaacatactattagtttgtgagctagtgtactgttggtggcaatgcacgttgccggtcttacaatggttgaggatgtaa

SEQ ID NO: 87426 - DNA, 174 bp, Glycine max
  Peptide Sequence Number=SeqID_204204
atgacaagcaattcatggggctccggacttgatggtagaggacgcacgaacaacgctaggcaatcaattcgtggggctccggactcgatgataagatttgttggtggaggatgcacgaacaacgctaggcaatcaattcgtggggctccagactcgatggtggaggatgcatga

SEQ ID NO: 87427 - DNA, 282 bp, Glycine max
  Peptide Sequence Number=SeqID_204205
gggtgtaatcgattaccaggcttgaaaaacgaagtcaggaaactaagggagcccctgagggatgggtcactggtaatcgattaccagatcgtgatggcggcgcagctaatccatgatcgagtagagatggagtgcctagagggagcctgggagaccctcgaaggcaacacgaggtgccgatttcggggcaccattcgattcacggctacttctttggtgcatccagatgaacctgcacggacgcatcagcggacggtggagtggacagctttttcggattag

SEQ ID NO: 87428 - DNA, 309 bp, Glycine max
  Peptide Sequence Number=SeqID_204206
atgcctggaagaaccctcattctatacatgactgtgttggatgagtcgatgggatgtatgctgaggcatcatgacgcgtctggaaaaaggagcggcccaccgtctaaggaaatacatgctgagctacaccacttgactgagttcgacattgtttacgtcactcaaaaggtgatagagggaagcaccttggtagattacctagctcaggcgacgcttgacttgtgggtgcatcttccaagaaaggaaggtgcgcggagtcgccaccaacgtttacttgaggaagacgtcggaaaaacaggaaaagacgtg

SEQ ID NO: 87429 - DNA, 909 bp, Glycine max
  Peptide Sequence Number=SeqID_204207
atgggaagaaggctggagaagatgaagaactggaggagagattcagatgtccttcctgtaagtgatggacagagaactaggaagaaaattcttgatccacagggtttcgttgccccttcctctcgtgtttttggaaggggtgagctcactgatgatcctgtggctataatgaaaagatacttaacttcacacttcatcattgatattctatcaattattccactttcgcagtatatgccaaggctttggcggatctatccactataccaagaagtaacgaaaacttctggcatattgactgagaaagcatgggctggagctacctttaatctttttctctttatgatagcaagtcatgtgattggagctatctggtgcatgctttcgatagagtcagaggtgtggtcgaatcaacaacggttctttatcagaagttcttctactgcttttggtgggacagtcctttatgctgagaatagctttattgttcgtgaaggagatccagttgaggagatgcttttcattatgagtagaaaagtttcttctgtgacaacaaatggtggaagaactggtttcttcaactccttgtttctcatggctggtgacttctgtggagaggagattctgatttgggcctcggatcccagctcctcctcaaaattacccatttcaaccaggactgtacaaactatatcagaagttgaagcctttgctctcatgtctgaagacttgaagcttcttgcttctgaatttcgaaatcatggcggcaaacagctccaccacgctctcaggcaaggttctattccgggcagtagagggcatgggctgcctgtttcatacaagcagcttggagccgatactggaaaaagaagattgagaggtcattgcatgaagccgaagacaagctaa

SEQ ID NO: 87430 - DNA, 4074 bp, Glycine max
  Peptide Sequence Number=SeqID_204208
atggcttacactgcagttgccatgcctacctctccagcagctacctcggcaactgtagacattgcaaaagagcataacggtcttcgccgctcgcaatccagcaaagaactacacacacgtgccgttatgcggaggtcttattctgacaaccacctatgttgctccatcaatcgcgtacaagccacatcagtgccaccaaaacttaagagcaatcaaccaatggggatttcaccatttcaattttcaggctccattcttccaaattcactgcgctccttcttgtttgacccagaaacaagcaatgatctagttgtggaggagaaggtggtaagcattgaggaaaacatggtagaaagcagcaaggaagagatagtgaatagagccaactgggtagagaggcttatggaaatcaagaaacattggagaaacagactgcccaaagaaagcatgaatacagatgcgatatgcaacgacaatacgtatgatgaatgtgaatgtgatggggatggagatgacaatgtttgtgtggtgggtgaagatgaagatgagcaggaagtgacatatgatcgtgactcattctcaagctttctggttcaagtgccatggtctgataccaaactatactctcaacttgctttcctctgcaacatggcctatgtaataccccaaatcaaggctaaggacttgcgaagatactacagccttcaatttataacatcttctttagagaagaaagctgaagtggccaagttaaaagtgcaacttaatcaggactccacttgcgttcctgtagatgactcggtagcctctcaagatgtatcaaagaaagacaaagataatacaaagaagcctcaaatcaaactagcttatgatattgctgcctcagcagcctcttatgtccaattacgagctaaggatcttttgcaccgtgctgctaagtcacaagacacacaacagactgaaaatgaagattctaatgaaagagaagacttgccggggcgagaagagctagaaggcacttcgcgaggttacaaatcagaggttgcagcttatgttgcagcgtccacaatgacagcagtggttgcagcaggggagaaggaaaaacaagaaacagcaaatgacctccagtcacttcattcctcaccttgtgaatggtttgtttgtgatgatcccggcaattacactcgatgctttgtaattcagggctcagactccctggcatcttggcaagcaaacctcttctttgagcccactaaattcgagggcacagacgtacttgttcacagaggaatttatgaggccgcaaaaggaatatacaagcaattcatgccagaaataatggagcatttgaagagacatggggatcgtgcaaagcttcagttcactgggcactcccttgggggtagtctctctcttctggttcatttgatgctattgactaacaaggttgtgagtccctccactcttggaccaatagtgacttttggctcaccgtttgtattctgtggagggcaacaaataatcgatgagctaggcctggatgagagccaaatccactgtgtgatgatgcatagagatattgttcccagggccttctcctgcaattacccaaaccatgtagctctagtccttaagcgcttacacacctcatttcggtcacatccatgtctgctcaaaaataagctgttgtactcaccactgggtaaaatattcattctccaacccgatgagaagacatctcctccgcatcctttactccctcgaggaagtgccttctatgccctggacaatactaaatgtccaagtgttcttcgaaccttcctgaatcaaccacaccctattgatacactaagtgatccaacggcatatggttcagaaggcacaatcctaagagaccacgactccagcaactacctcaaagccatcaatggagtgttgaggaaacattcaaagattatcgtcggcagagtgaggaagcaaaggattaatcagttgtggcctctgttgacatcaccatctccacactctaggagccatgaacagaactcggagagatgcagcttgaggacaaaggagatagttacaggggactggaaatcagagtcatcttttagtccagagcaagaaaattctattaacaatgggaatcacaaaagaagacctagtgtgggtgcggttttgaagagtataggaagaaggctggagagtgtgtcagagaagatgaagaacttgacaagagcttcagctgtccatcctgtaagtgatggaaagaaaaagcttcctcctaggaagaaaattcttgatccacagggtccaatccttcagaaatggaacaaaatctttgtaataacgtgtgtgatggcagtctctgtggatcctctcttcttttacattccggtgataaataatgctagaaaacgtgttgatttggatggagtattgcagatcactgccagtgttcttcgcaccttctttgatctattctacattcttcgcataatcttccagtttaagacaggattcattgccccttcttctcgtgtttttggaaggggtgagctcattgatgatcctatggctataatgaaaagatacttaacttcacacttcatcattgatgttctatcaattattccacttccacaggtgattcttttagccataaatcgaaacctgaaaacatcagatccatttgtagcaaaggatttgttgaagtattcagtattaatccagtatgtgccaaggcttttgcggatctatccactattcaaagaagtaactagaacttctggcatattgaccgagacagcatgggctggagctgcttctaatctttttctctatatgctggcaagtcatgtggttggagctaactggtatatgctttcggtagagtcagagacactattgaatcaaacagttcttaatcaaacttgttctttggttgaccctgatacaatcaaagacccaaaaaccttcaattttggaatattttctgatgctctagattcacatgtggtagaatcaacaacagattttcctcagaagttcttctactgcttttggtggggtttgcgcaatttaagttctcttggacaaaatctcaagactagtactgatgtctcagaaatagcctttgcaatcttcattgccatctttggattggtcttattctcgttacttattggaaacatgcagaaatatctgcaatctacaactgttagagtggaggagatgagagtgaagagacaggacgcggaacagtggatgtcccaccgtatgctacctgagaacttgaaggaaagaattagaaagtacgaacagtaccaatggcaagaaaataagggtgttgaggaggaggcattaattcgtaaccttcctaaagatctccgaagggacataaagcgtcacctttgcttagctttagttaaaaaagtgccaatgtttgagaaaatggatgagcagttgttggatgcaatgtgcgatagactgaagccagtcctttacactgagaagagctacattgttcgtgaagaagatccagttgatgagatgcttttcattatgcgtggaaaggtttctactatgacaacaaatggtggaagaactggtttcttcaactccatgttcctcatggctggtgacttttgtggagaggaacttctgacatgggccttggatcccaactcctcctcaaatctacccatttcaactaggacagtagaaactatatcagaagttgaagcctttgctctcatggccgatgacttgaagttctattcctcacagtggaagacatgggctgctactttcatacaagcagcttggcgtcgatactggaaaaagaagattgagaggtcattgtgcaaagcagaagcagacctacaagatgctttggcaaatgaggaagggtctagtctaagccttggtgcaaccatatatgcatcaaggtttgctgtcaatgcactgcgaaacttgagagaaaatagcagacacaatacaatgcagcagagactactatctctgttacctccaaagccagctgagccagatttcactgctcagaaacactaa

SEQ ID NO: 87431 - DNA, 720 bp, Glycine max
  Peptide Sequence Number=SeqID_204209
atggggaagaggaaattgaatgaaagtgatagtgatgattctgatgaagaggtggagatcgagaaatcagatttgttgaatggtccgaatgagtcgggctctaataaggctgagggcagtttgggttcggtaaatgggggcggaggctcttctggtgctggctcgtgtgaaagtgggtctgaagaagagaaggaagctgctgtagaaggaaatgtgggatctgttgcgatgctgggtggtgaaagtattcaggctgcagctgaacctgtgataaatgatgaggctactgaaatgccaaaggagtcggtggttgctggaattaatgctgaagataatggatatcaggattgctatgtaggcgtgcctgacaagttcgatggtgctgtgaatcaggcctcaactgttatgggctctgaaactgtcgccagtgctggtgaatctaattatatggaaattgatggatctcttgagcataaagcagcagtcaatgaagaaagctcaccaagcactagtgttcctgtgttggaggagcccctgaattttgatgcctttaattcagctgctgaacttgaggttcttggcttggaaaggttgaagtctgaactgcagtcacgtgggttaaaatgtggaggtactttgaaggagcgtgctgccaggctttttcttttaaaatcaactcccctggatgaacttccaaagaagctgcttgcgaagaagtaa

SEQ ID NO: 87432 - DNA, 909 bp, Glycine max
  Peptide Sequence Number=SeqID_204210
atggtgattcacgatttgataaccaagcttggctataatcatgctgtgcttccattaggctattttattgatgaggaagtactattggagaatgtggagctgatacttgacgcatttgattatctccaacttccatttgcactaaagcaaggtcgagttgggaagttaagcataaaaattccgtggaagaagccttgggaccccattataatcattttagaggatgtctttatttctgcatcacagcgaggcgatcaagagtggagtgctgacgctgttgaacaaagagaatttgctggaaaaaaggccaagctagcagcagcggagttgggaaaattatccagaagggtgtgcggtagtcaagctgggcaatcgtttatttctcatgtcactactaagcaagaaccaaacacttggccacatggtcaaagagactctaataccatgtcaatgactatctctcttatagcttttaggttgctatgtattgacgtaggaatgatccttgacagcatccaagtagacatacggaattttcacgtattatactgtgacatgcagaatgatctggggcatattatgtttggtttgaagtttactagcttgaccatgaagcaaaatcttattggatcttcaaatggaagggtgagagttggccaagaacataaaattgtagaggttaaggggctggaattttattccagaatgtttcatggttcaatggacttggtaaatatgaacaatatgggtaactcttattcagcaaacagtattagatcggaaggaaaacattactattctatactggcaccgtgtgatgtaaccttaattctttcgagagagacagtgtgtatgatcttctcatggtctctttcgaggtgtttctttgttaggcatgcaaagcaatag

SEQ ID NO: 87433 - DNA, 345 bp, Glycine max
  Peptide Sequence Number=SeqID_204211
atgtatatcggggtaaagagtatcaaagacatgataggcaaatggaaacaactagaaaggggaactaaagtcaccttgttcctcaaggataaccagttggagtacttggaagagacgaggatcaaggatcttgttaacaaactctttgaattcattagccatcccatttacatgtggactgagaacaaaattggtgatgttgatgaggataaggacaaaggttctaagatcaaggaggtggagatttctcatagaagaaatttgtgggtgccactagtggaaagcataataagaaccacatacttgatgatcttgcattctccattctgtcaaatctgcctttaa

SEQ ID NO: 87434 - DNA, 369 bp, Glycine max
  Peptide Sequence Number=SeqID_204212
atggagaaagaatcagatctagatgatatattaaattatcgatctgctgcagaatatgaaatgcaggaatttctttcaaggtgttctatgcctaacaatggcaagattaacaatgatattcctacagagaagtcttgcaatgatgaacatacagtaaaatctcggggatggttgaattggctttctcgtggtatgcttggtgctgggggaactgatgattcgagtcaattttctggagttgtgtcatatgatgttaagatgactgcaaaactgctagagggatggcaggtggtggatgaccattattatgatgttttgagattcacattaagtaatttatattacacatctataaatgctgaaaaataa

SEQ ID NO: 87435 - DNA, 493 bp, Glycine max
  Peptide Sequence Number=SeqID_204213
atggatgtcaagtctgcctttttgaataggtacttggaggaagaaatctttgttgagcaaccagaaggtttttttgtccaaggacaggaggagaaggttgataatgacatacttgtggtatctctttatgttgatgatctgtttgttataggaagtcataatgagcttattgataagttcaaagaaagaatgaaagatgcctttgaaatgatagaccttggaaatatgaaatttttccttgagtgcaaaccaactgcaactccaatgaatcaaaaggaaaagttttgcaaagaagatgaagctaaaagggttgatgaaaggtacatgcattgtgctagtgaaattcactttcaagcagcaaaaagaatccttagatatgttaaaggcacaattgattatggaataaggttcagtcaagttaaaagtttcaatcttcttggttattctgatagtgattgggcaggatgtgttgatgataagaggagcacttctg

SEQ ID NO: 87436 - DNA, 4941 bp, Glycine max
  Peptide Sequence Number=SeqID_204214
atgaaggaagaaaaagacagccaggttgtgcttttatcgggaaatttatcttctcctggtgctgcagttggagaagactgtgtttctggaccaaatattgaagttgatcaatattctgatgtggctatgctggctgatgcatgtttcgctatgcattatgaatcttccagaactgatgtgctttgtcataagatttttatgtacttaaataatgctgatatccactgctacccacatattgctggactgctcattggattctttcataggttgtctgcctatagtagcagttttgagaaatcctctgccagtaatactgttgacatttcaaaaattttctcaagttttgggttacagaagtttggcttctcaaattattttgaatttggtttcactgattctgcttgcattccattggattgctttccatttgtaacgattcacaattctggttctcttggtaatctagagagcgcactcgtacatgccattcctgactggagaaaatattttatcctgagggacagaaaaatcaaaagttccaatataaatatgaggagagggtccaaatttttccaggtctctccctcaaaatccaaatctgattttgtatattctcatgaaactgggattgcgagcacctgtgatattttttctactgaattgcacctatttggaataagagcacattttcatgactcatcatgcattattgggacaatcatggtgcctacttctaagtcttctctattattttgtgaagacagtatggatatattgtcttcttctgaaggattggctcttacatcatcttgggggccgcaaaattttcaagataatctatggggtccctcttcaccaaatttgtctcctattttaaatgtacgagtcaggaaaggacaaaatatatcttcaactattgatttggaaataagcattggcattcagcatgtctactgcatgttaccttccgaatatctctccattatcattggttacttctcattatctgattggggtggtgcttctggtgaccagtgtttctctgacgagcaaagtgatacagatgtaaaaaatgaaatgaaaattacatataaatttgaaatcttggactccaatcttatttttccagtggtaagtaatgaccgtcagtttataaagattgaaatgccacagctttattgtagtttcatcgagaattctggtgttgatgaagtactaaagaacatccctcctgaatgtttggttcctattcataagcttgcaaaaagaaatgattgtttaaatgtatttgggcgagacttgtttgtatcattccttctttacaagaatgatttgcttggcttagcaacagttgaacggaatacggaatttttaacaagtgctttaattgcacccataaatgcagatgtttgggtcagaattccagttggtggcaaatctaattgcaaaagtacttcatcaatatgtttcatgacaagcatcagcagttgtcatattgttgcagaagatttgggtttctcttccgtagtgttttactctccacgtgattctattttagcaaaatgcaccccaacttccttttccatgtcagtacttagtatctctttttctcaatctattggtggaaaaaataaacttgacctttgtctttcatccattgatatttggcttcatttggctgagtggactgaggttgttaaattccttaatcatttccgtttacatttggaaagaactcctgtgaatgcaataacaaatagtttgtccgtggatgcttctaattctgtaaaaaaatcaacagttcaacatagttcaagtttccttgattctgaaagcacctcagcaccttttacttcacaagagattgagaatgatgtctttataattaagtcagaaaatttttgtattacatttcacatccctgtttgggttggtgaggaacctcatgtggaatttcagcattctcaaggtctcaatgtgacacctttaagtgtatcttctgatatagttgaagaaaaagatgcaaaatttcttactgtttctttcaacatgaatggttttgaattagttataagaagcagagatatccaactgacgtccaaaatggaaaaacttagcagtgtaataatgatagttgagaatggaagacatacatcttgcccactgcttgatgtaattgaggttcaagtggatgctgtactctgtaagaatcatacgaacaccattgagctcaatgtggaaattgcatgtgataattcaaatgtatggatttcgcatcctacatttcatttatggaatgctgtaaaatttgatgttccggaatcaggaccttctcaatattcaactagtggcattactttcaaattccagatgaggaaggtttctattctactaacagatggaaggtggagctacaatgggcctgagctggagattctggtcagaaacatcttgtttcatacaattgcaagtggaaagcacatggaatgttctgtcaatggtgatcttcaagtaaactacaataacatcgaaaaggtgtcatgggagccttttattgagccttggaagtttgtgttgacattagtcagggaacaagaaatgagtgttatgccgaataggtccgtttcaacagatatcattctcaaatctacaacccagctgaacattaatattacagaatccttagtagagtgtctttcacgtgctacagagatgttttctgatgccctgggtcttatggtattggatgatcatgaaggcaacaaacttgtgcattcaccatgtgcagaatatatgtgtactagaaaatgtggtgctccttatgttttgcaaaacttgacttctgtgcctcttttatatcaagtatttcatgggcttgtcaatcctgatgatcttcatgattctgatgagaatcatgcaaaatatgtgcaaccaggttcttcaattccgatatacatggatgaaaatgctgaacagcaactttcgcgtttcaggccttctcattcttctgatagtttaaatgagccaaggtcaaatggatttgctcatcattatattactgtgcagcttgaaggaacttctaggtcatctggtcccatttcaatggatttggtgggactaacatgctttgaggttaatttctccaagacatataatgacactgctgaggataatagtctgaatacatcccctacttttgttgttccggttgtatttgatgtttcagtgctgcgccatagcaagttaatacgaatatactccactgttgtacttctaaatgcaacctctacccctgttgagctgcggtttgatattccatttagtgtgtcaccaacgttattaggtccaatacaacctgggcagcagtttccacttccactacatttggctgaagctggctgtgtaaggtggcgaccaatggggaactcttacttgtggagtgaagctcataacctcaccaatcttctttcagtaaacagcaaagttggaaattttaaatctttcatgtgctatccatctcatccaagtagtcgtccgtttcggtgctgtctatcagttaagaatattagcttgacttcatctggctggctgaaaaataatgtccctgcaaatgatgtaaagaagcactatattcatcacttgatcttaagtgctccactaataattaacaactaccttcctaaagaaattttgttgatcagtgagagtggtggggtaggccatactgtgagagtttcagaggtgggaacttctgtatatcatattgatccctcacatgacctaggactggagatctgcattgatggatttaaatgttctaattttaaatttcctcgtttagaaactttctgcacaatggcaaagttcactgaacccaagttttcattttctgaaaccctgatatttgaaccaaatagttctaatggcccagtatatgttactgtagagaaagtgatggatgcttattctggtagtagggaactcatcttttttgttccctttattttatataactgtatgggttttcccctgtgcgtaacggaagccactggtgaaaccaatgaaagggaatttgtcattccttcttattttgacggaggtgaaaatgaaacattatcatataaaaaggatggtctttctttgcttacatccaaccgtgaattacccgtggaagttcctcataacccaaggagttatatgaagaatcataccatttcttacagagaggatggtagtgcaaactctattggtaattaccataagaatttgggaaggcaacacagcaaaattgattctatatttcgaaattcttcttcaggaaaattgaagagtatgctgagctcgaagatccagtccacttggaaggattcaggttctggtaatcatgagcgtgagaaggttcagccatgcatttattctccaagccctgattcctctgtaaatgatgcttttgttaaagtatgtagatgtttttctgaagatgccaaggaacagttgccatattctctgtggtcaaatccattttctctgctaccaccaagtggttcaagcactatccttgttcctcagttgacttcaaattctgcattcattctagctatgacatgtaactcagttactgaacaatatgctgggaggataaatgcaatcacttttcagcctagatatgtaatcagcaatgcatgcagcaaggaaatatcttataagcagaaaggcactgatgccgtgttttatttaggaataggaaaacatgatcatcttcactggacagatacaaccagggagctgcttgtttcaatttgttataatgaatctggatggcagtggtctggaagctttttaccagaccatctgggcgatacacaactgaaaatgaggaactatgtttttggaacttcaaacatgatacgagttgaattgcattacttcagtagttag

SEQ ID NO: 87437 - DNA, 864 bp, Glycine max
  Peptide Sequence Number=SeqID_204215
atggcacaaggtggtcataggagtaaggggcctgttgcaggttcttcagaaaacagttctcatgagacaaatcttagagaggtattgaagtcaagatctttatgctgtaaatccacaaatagtcttgagtctttttcttcaaaagttgaggagcaaccgtactctctgaagaactttttaaattcaatatccacatctgggatttgtttaggcatccaacttcaagatctatatgattattttgatgttacactaaatgattttaagatcatcatggtaaattctgaccagtcacaaaaggtttatattcttgagaaatttagtgtttcgttcttcctggcactttgcatgatcccagatgagtccattttgaagcagttagaggtttatgtacttattgaatcacttaaagtacacttctctccttcaatatacggtgcattcatagaattgacgaatcatctgggtacattgcatgtaacgggtgaatctggagtcttaaattcccctcatcctcccaatattgtttcagttttgccaacatattctacttttggcatatccattgtttcaataattgattccattgatcttgatgttgaccttgaagatagtggagataacagctcaaagctcatggtttccttacaaaaaatggtcttacgataccatcagcacctacagtaccctgaaggaacactttattggtcccctgtgatttcacaagacataaatgaagaaccagtatcagaaatgcttagacatggcaatggggcgggtcgggtacgggtattgtcttcccaatcccttaccccgactcctcaacatatccccatacccgtacccgatacccgacgggtttga

SEQ ID NO: 87438 - DNA, 732 bp, Glycine max
  Peptide Sequence Number=SeqID_204216
atgggaagtacaggatcaaacactccttgtttggcttcaatcaacgctcttgaaattcgttctttcacgcgtgttaggctcgaatcactcctatcaggctatgtcaatgagcttgctggtgttggagttccggtacgccatggggagcatatcaatgctattcttcaaggtctaccttcgggttatgcgccagtagtttctgtgattgaaagcaagaaatgtacaccatccattgcagagatcgagacactcagaggaggttatggtagaagtaacggtggtcgtaacactttgtttgatcgcggtgttggtcacagtggttctggcaggtcctcaaacactagggttaatcctagctccaaatctgttgcacagctaactaatcaacctagtgttatgcttacaacctcagcatctcatggcaatgttcaagctagtggattccagattttggagctagtttccatacatggcaagaaaactcgtacccgtgggtacccgcccgaatccgtcccgactttgacgggtaatacccgagttgaccgggtatggttcgggttcgggttttccccgataaccaaaagtcgggtacagtacggggatgggacaataaactcaaacccgtcgggtatcgggtacgggtatggggatatgttgaggagtcggggtaagggattgggaagacaatacccgtacccgacccgccccattgccatgtctaagcatttctga

SEQ ID NO: 87439 - DNA, 312 bp, Glycine max
  Peptide Sequence Number=SeqID_204217
atggaaggttcaaatgaaggtccacataggtatagtaacctcaatttagaagagaagaaaacacagaccatcaaacagagaataaaaaataaatatctggcaatcgagaaagtcaattgttattgcttctttgttcacttgagggaaaaagaaccatccacaatttttcaccctcatggttgctactatgctcttggatgccattgtgtgagcttattgaaggacggtaaaggtttcaacaaagaacacaagactcggctattgcggtttgtgacatgcacatccaaggtctattgctatccaggactttga

SEQ ID NO: 87440 - DNA, 1425 bp, Glycine max
  Peptide Sequence Number=SeqID_204218
atgaagcctgcgaggactttctatttatcagtgcatgcagagggagcaacaaaggttcttagtgttcttgattcaaattaccatatctttaatgatgtgaagaaatcaagtgttccacttcctacagagaaaaggttatgtgatcacagtctagttagggcttcagaatacaaggagaaaatatcaatttgtgttccatatattgggatttctttgattgattcatacccacaggaattgctttttgcctgtattaaggatgtagaaatgaatctactgcaaagtttggatcgtcaatgtctttccttgctgatattattcatacaaattgataaccagttgcgctctactccatatcctgttatgttgtccttcgatagtggatacagatctggtcatgttgatcatatgaaatctagggatgatgtcaatgcttatcatattatgcttaattcttgcaggatggaagatttccgtcttgagattgaacaagaagtcatattaagcttatttgagtttttcacgaatgtcagttcagggatgcaatatggaatcatgccatcttcagatccctatgatggagtgtcactagagaattcatcctcatttgttcaaactagtgagaatttcagattaagtgctcaccaatgttctccaagaatttcccccatgttcgatgaaaaatctaaaaggattgcatctttaccttccgttgttccaattggagccccatggcaggaaatttttctgttggccagaacccagaagaaaatttatatagaaatgcttgaattgtcaccaatcaagttgactttaagtttttccagtgccccatggatgcttcggaataggatcctcacatccaaggaatttcttatacatagaggccttatggctcttgctgatgttgagggagcacatatttatctaaaggatttaatcattgcacatcatatggctagttgggaatccattcaggagattctaattaggcattacaaccgccaactacttcatgagacttacaagttgtttggttcggctggtgtcattggaaatcccttgggtttcgcgcggagcatggggcttggcattagagatttcttgtctgtgcctgcaaagagcattgtgcggagccctactggacttattatgggcatggctcaaggcaccactagtcttttaagcaacacagtgtatgctattagtgatgcagcttctcaattcagtaaagctgcacgcaagggtattgttgcatttacatatgatgaccaagcggtttcaaggatggaaaaacaccaggcaattgtagcttctgacagtaaaggtgtaattaatgaagttttagagtgtgggatgcccaaaaggaacattgacagaaaagcattttctctttacaatgggtttagagatgacacatgctag

SEQ ID NO: 87441 - DNA, 801 bp, Glycine max
  Peptide Sequence Number=SeqID_204219
atgtatcaaccaccagcagtacctctgggactcacaggtcttctccagtttcctgtaacaggagccgagaggcatggtcttcctggtgtcctctctggtgttgcattggggattacaggacttgtggctaaacctgctgctagtatacttgaagttacgggaaaaactgcactcagtattagaaaccgtagtaaacccagtcaattaagactgcaacactttagggttcggcttcaaaggccactgtgccgtgaatttccattaaaaccttattcgtgggaagaagcagttggaacgtcagtacttgtggaagctgatgatggtttaaagttcaaagatgagaagttagtggcttgcaaagcccttaaagaagctggtaaatttgttgtcataacagaaagatttgtactcgttgttttcagtgcaagtttgataaacttagggaagcctgaattccgcggcatccctgttgatttggagtggataattgaatgggagattggattagagaatataatacatgccgactgtagtgaaggggttgtacacatagttggtagtcggccagactccttattgaggcaaaatcagcattctcctaagggtggtagtggtggcagaaccagatctgtgcgttggaaccaatttgccactcatcttccatttcctcagacaaacttggaactagcaagtgaggaagatgcagccaatttgttacagattttattatctgctattgaaaaagaaaaaggtaaagcatgggacggtgggcggattctgcatcgatctagaatgaaatag

SEQ ID NO: 87442 - DNA, 171 bp, Glycine max
  Peptide Sequence Number=SeqID_204220
atggagtgtatgaaggattgcaaacaaacagatggcagtggtggtgcttatgtaaggaggatatatttcagtgtgcaggctggaaaaggggaaatggtgccagaaggagggcatgtcaatggcattaactggaaacaggagacagtttctgaaagaaaaaattggcactga

SEQ ID NO: 87443 - DNA, 1002 bp, Glycine max
  Peptide Sequence Number=SeqID_204221
atgaaccatggcacgtacattgcttatgatgtggtcatggttactctatctatatccttctttgttcttgctgttgttctctatcttgtgtgcaagaagaaaccggttgaatccgaagaaacacttgctgtgaagcattgtgctcgtgcatactcattgatggacattcatgctgccactgatggcttcaaccatagcagaattctgggaaagggtcgcgtaggaaccgtgtatgccggcgtacaagagaatggagaacttgtggctgtgaaaaggattcattccgttcttgtgttgagcaatgcaggatttggattctcatcagtgttgaaatggctctcttcagctcaacaccccaacattgtttctatcctaggattctccgaagcaccgggcgagaggatcatagtgatggagtttgggagaatggtgagtttggatttctatttgcatcaaaatgttaatggtgcatcactcttggattggaacaagaggatcagaattgcgtctggagcagctagagggattcagtaccttcatgaagtggcgacaccaaacattgtacatgggtgtgtcaagtcctcaaatgttttaattgatgtcaatttttgtcctaggatttgtgattatggtctcaattttttggcaccccgagaaaagagagggctagtagggtatgtggatgatgagtattggaatgaagaagggggtggtgctggcaaggaaagtgatgtttatgggttaggggtgatcatgcttgagctattaagtggtagagggtgtgaggaaggattgatagctaaatgggcattgcctttgatcaaggaaacgagttttggtgaacttttggatgctaggttggtgattccttctgacatgaagcctctagttagattagccaaagttgcttcagcttgtgttggtaattcaaggaagtgtaggccttccattgctcaagtgacaactattttgaacaatatagagatggaagtgtgcatatga

SEQ ID NO: 87444 - DNA, 1806 bp, Glycine max
  Peptide Sequence Number=SeqID_204222
atgtcatcagctggtgtctctacacttactgtggttcccactgagccattgttgtcaccaaaggcattcccttttccaattccatcacacttgtctttggaagataaatccattttcatatacctctccttttcgggctcattgactcccatccgtgttatggagtgggataccattgaatctgtcaaattcaaaatccaaaggtgtgaaagccttccatttttaacaaacaagcagaagttggtttatgctggccgagagcttgcgcgaagtgatacgccgctcaaggactatggagtaacggatggaaatgttttgcatttggtaatcaaactgtcagatcttcaggtcatcaatgtgaaaacttcttgtgggaaggagttcacgtttcaggtcgaacgaggcagggatgtcgggtacataaagcagcggatcgccagaagggagaaacagtttgatgatcctgaggagcaggagcttgtgtgcaatggggaaaggcttgaggaccagaggcttattgatgatatctgttgcaaacataatgatgcagcagtccatctgtttgtgagaaaaaagcatgttaaagttcagaggagaccccttgagttgtccattgtagcaaaagatttgattgataagaaaaaaaatgatgtcaatggaaatactaatcggagaagttatgatgttggtaaagaagatactattaggaagtctgatgtcattcaaagagctgtgccgagaaagcctcctggtagagattttattttggagccagttattattaaccataaaattgaattagctccagctattcggaatatggtgaactctacatatgagggacttggcagtggaaaatgtccaatcagatctgcagagggtacaggaggagcttactttatgcttgattcagcagagcaaaagtatgtgtctgtttttaagcctattgatgaagaaccaatggctgtgaataaccctcgaggtcttcctttgtcattagatggtgaaggcttaaaaaagggtacaagagttggtcaaggagcattcagggaagtagcagcctatgttctagaccatccattgagtgggtgccagcgccactcattatttggtgatgggaagggctttgctggtgttcccccaacattgatggttaagtgcttgcataaagcattcaactatccccgagaattgactcctaagattggctccttgcaaatgttcacagaaaatagtggaagttgtgaagatatgggcccgggggctttcccagtaaaggaggtacataaaattactgttttggacataagactggcaaatgcagataggcatgctgggaatattttgatcagcaaagaggaggacaacaaccagtctgttctgattccaattgatcatggatactgcttgcccacaagttttgaagattgcacctttgaatggctttactggcctcaagctcgccagccatactcctcagaaactattgactacataaagtcactggatgctgaagaagacattgcccttttgaagtttcatggatgggatctgccagttgaatgtgcccgcactcttaggatctcaaccatgcttttgaagaaaggggtagagagaggattgaccccttttgccattggaagcctgatgtgcagggaatccttgaacaaggaatctgtgatagaagaagtagtacaagcagcactggattctgttcttcctggcacaagtgaagctacattgctggattctgtttcccaaatcctggacttgcacctcgatgagattgtcagatctcatttataa

SEQ ID NO: 87445 - DNA, 606 bp, Glycine max
  Peptide Sequence Number=SeqID_204223
atggcagcgaaatggaaaaggaagagagagaggagacgccactgggagcttatggacaagttccaaaggcttaaacaagggagtatgagtgttgaagaatatagacaacaaatggaactactttttttaagagctggacttagggaggagaaaagaacaagtatagctaggttccttagtgagcttaatatgaaagtgagcgataaggttaaactccttccatatagggacctagatgagctagtccaactttgtataagagtgaaacaacaacttaaaagaaagtcttctttaaaatcttatggctttcactcttatccaaggaaggaccaagcccaaagaattttgggggctgcaccttcaaaaccaaaggaagataagggtaagaccatagagaaatccatcaaccctaaggccttctattgcatctttagtccaatcttcttggagtcttctatccaatgcccttggggggtaggattgcatcagaaaagacataaatcaccattggtcaccgtaaacttcaatgctgaatgtggcgtcggaagtgtgagcgtttttttagcttctcttcgatctcaattgtttttcttaaatataccgtaa

SEQ ID NO: 87446 - DNA, 924 bp, Glycine max
  Peptide Sequence Number=SeqID_204224
atggtcgcaccgaggtttgacctcatgcattctactccaagccgcaccactaggccgaccctagtggataaatgtccaatcttgcatgctccaaatgttcagttttggatgaaaagttccaagagagggggggctcgagctcctgctcctccccctctagatctgtccctgcattgccacaacggtcacacactttgctcaacttgcaagacaagggtacacaatcgatgcccaacttgccggcaggaactcggtgatataaggtgtttggcattagagaagatagcagaatcacttgaactgccttgcagatacatttctcttgggtgtccagagatatttccctattacagcaaacttaaacatgaggctatttgtaacttcagaccatacaactgcccttatgccgggtcagactgctcggtggttggggatattccatgccttgtcgctcatttaagggacgaccacagggttgatatgcattctggatgcacttttaaccatcgctatgtcaagtccaatcccatggaagtagaaaatgctacatggatgctaacggttttccactgttttggtcagtatttttgcctccattttgaggccttccagctgggcatggctccagtttacatggcattcctccgattcatgggtgatgaaagagaggcgcggaactacagctacagcttggaggtgggaggaaatggacgtaaactaacttttgaggggagtccaagaagcattagagatagccataagaaggtaagagacagccatgatggtctcatcatttaccgcaacatggcgcttttcttctcgggtggagacaggaaagagttgaagctacgagtaacaggaaggatatggaaagaacagcaaaaccctgaaggtggagtgtgcatacccaacctgtgtagctag

SEQ ID NO: 87447 - DNA, 264 bp, Glycine max
  Peptide Sequence Number=SeqID_204225
atgtcaaagattatagaaattatcacttgtacacttttgagccagcacactccaatggctttttattgctatggttccttaggttatcaggaggtctaccttaaatgtaatttgattgtggctgacctgtttcaaggacatccaattagtgaaaggaagctgaaggaacttctaggtcacactccttctcaagtctttgctggtgctctgctgggctttttagtagcttgtttcagttgtcaagcttacatggtgggagcttag

SEQ ID NO: 87448 - DNA, 960 bp, Glycine max
  Peptide Sequence Number=SeqID_204226
atgattgatgcagtggaggatcctgtggattctcacaaactaaagattgacactagtaactctgactgttttgaatccccaaatcatactaacgccatcatgcaagaaggtgaagagttaagggtcagtttatctccatcaagtcaaggtgattcccagggcatcccgtataagaagttatctgcatctgcagctccattcaatccgtcgccaggcattgcacgtgctgcaccatttgccatgaatacaacacttccttcggctgctggtgctgtttcaccaattggcccatggccagtaaatatgaatgttcaccatggacctgctaccatgttacctgcagttatcccaatgtgttcctctcctcaccatacatacccatcacctccaccaacaccaaacatgatgatacaaccgttgccatatatgtatcctccttacactcagcctcaatcaataccaaccaacaattttccagttactagcagtggatttcatgtcaatcagttctcatggcaatcttttgttctgccagaggacattaataatgtcagtgaaaacaagaaagatgtgcaagctttagaatcagagactagtgatgatgaagtgggtagagttaatgcagaaagtgtaaaggaaaatggaaatcctaattttcatgggtttgaaaatgctgcgaacaaaccaaatcgtaacattggcttgaataacattagcagaaatgaaaagaacattgatggtgagaaaaccttcagcattttgattaggggaagaagaaatcggaagcagacgctaagaatgccaataagtttgctaactagacccaatagctcacagtcatttaaggttttatatataaccgtgtggtcagaggaagtgatgtacccaagtccatcagcttgtcttctagaagggattgtacagctactgcttaacccacattttttttgttgttactaa

SEQ ID NO: 87449 - DNA, 405 bp, Glycine max
  Peptide Sequence Number=SeqID_204227
atgaggtgtacccatgggcccgaaatctaccctaaggctcataagaatcctagggccttctcttgcatctctggcccaatctacttggagttttctatccaatgcccttgcggggtaggattgcatcagctttccaaatggaaaaagttctccaacaacagtgccaaaatacttgtttcgccctttgggatactacttgtttgtgtagatgtgaaatctaccagcaagtgcactgggtcatcaacaataaacgtgaacaagtgtgaaaacaaatatctaaaggcgttgggtcctcttactaagaaaattgatgcaattaaggatgtttctctaattaaagatgtttttgtgttctatgctgaaggctcaagtgctaaacaccaatgtctcttgagtttagcctaa

SEQ ID NO: 87450 - DNA, 990 bp, Glycine max
  Peptide Sequence Number=SeqID_204228
atggacgagattgatgagtgtttggagattttgcatgcaaaacaggagtctgtgtcggatgatatcttagatgatgaagaacttggtgacttccgttctttggaactgcagcaacttcgtcttgaagcattgaaagaaggggagaaagtttatgaggacaatgataacaagtctgatgactctggtacagacagcctgcttcatcgaggacgtgaagttgagtcaaacactccaaggagtaaacttaaagccgaagctcctgtggtacgatggagttcttacttggataactggggttcaaacacggtttttatggctaatcagcggggtttggagcttgaaagtcactggggtagggtggacaacgatgcagttattccagcagataaaattgccgaattgaatgttcatgcaatgccttatgaagaaaaggaaattgagatccaaccatgcttggctcctttgaggaaaggaggattatgtcagagaagagatctgaaagtttgtccatttcatggatctatcattcctcgagatgatgaagggaggccactcaatgagaattcttcagatggcatgaatattgatttaaggactgatttagtagagcagttagcaaaacaagcggtgaaaaatgttcgtgaaagagatcaagaggtggcaaggaagagggaaattgatgaacagtcactgaaacgtgcaaaactagctaaagttcgggaacacaatgaagctgttttacgggatgctgctttggcttctacatcaagatcagccatgcttggagaagatggggaggcaactaatgaagataaactgtctgccagagacaagaagcaaagtctcgcttccatgctgcgaaagaaagtaacatcaaaagatagaatagctcagaaacttttaagttcacgggcaagggttactgcagataggcagcatgtgtcatgtgaagatgccaaatatagagaagccttcccaaatcaatggtga

SEQ ID NO: 87451 - DNA, 195 bp, Glycine max
  Peptide Sequence Number=SeqID_204229
atgggtacggaagaaggagcgcatggaaaggtaacaaaggtggtatctttgatcgagaaggccaccaactccaccgcgccggaggtcgatccccgcctcctcaaggctatcaagacggtggttcgctattccgattcggagctccgcctcgccacccaaacccttatggatctcatgaagcgtttttactctcag

SEQ ID NO: 87452 - DNA, 291 bp, Glycine max
  Peptide Sequence Number=SeqID_204230
atgtcattgcctagcgctgttcatgtgttctcccttatcaagtgcgaagcttctggtgactgggaagcacgttattctgttgttttccagatcggttccttcgccaagacggacgaaattagtcctatctttgctttcctcttatctccgatgagaggaagcaggcttgcgtgttccgtgaaattcggtaatgtggcggaagtcgaaaagaggaagcaacctggctcgcctgggcgagctgagctcgcctgggcgagctgggcggcaaacatctcccctattttgctataa

SEQ ID NO: 87453 - DNA, 153 bp, Glycine max
  Peptide Sequence Number=SeqID_204231
atgaactattttatacatcacgcactgcaaatatttggcaaacttgaagcaataggcactgatgaagatagcgtgaagacttccctggatggatggtcgacagctcttcttcctcgtcttgcttctggcaaagctcatcagtccttacgctag

SEQ ID NO: 87454 - DNA, 642 bp, Glycine max
  Peptide Sequence Number=SeqID_204232
atgcatatcaacactggcatagttcgtagcagtgactcaactgagcttgcaccaatgagtaaaatatctggaatgatgatacgaatattggaacttggaagtgaaaatttcaaaaaaatacttaacggaacatattcaggacttttactgaaagttgatggtttaagtgaaacaaagtttaaagtgacagtccccagcaagttgcatcattcaaatggagaagctaactatccatggtttctcctgattgaaattaagaatcagacatatcaacagacccagacacaagttaagaggttacccaattcagcttcctcaccgcctcttcagtttcaatatagtttggaggtacatcagattctcccgaaagtagaggaaacttcacttctacatctttcctacagccagagtgttgtcttgggtggcggggatggttacgttcgggtcacgtggcaaacctctgtgttctcgcaagtggccacaagaggaagtgcaaccgacgttgagaatggtgtgcattgcgaaaacaaggagagaggaatgtggtatggtatggtggatggagttggctttgagaaaaggaaatgtccaccaaaggactttttgtggtgtttacactctttaattttaatgacaatttag

SEQ ID NO: 87455 - DNA, 1629 bp, Glycine max
  Peptide Sequence Number=SeqID_204233
atgaaggttgacgcggggttagggcgcgtggtgtgggacgatgaggacaaggccatgcttggggctgttctgggtggtcgagctttggagttcctaatgacgaactccgtgccgaatgagagtgttttaatggcggttgggagcgacgagggacttcagaagaagctgtcggatctggtggagcgtccccacgtgtccaatttcagttggaactacgccattttctggcagctctcgcagtccaaatccggtgactgggttctgggttggggagacgggtgctgcagggaacccaacgaggaagaagaagagggtgctgtgactgtgagaagacgaacactgcgcgtggacgaggaggagatgcagcagaggatgcggaagctggtgctgcagaagctgcacaccacgttcgggggcgaggatgatgacaattacgcttttggcctcgaccacgtcaccgacaccgagatgttctttctggcttccatgtacttctcattccctcgcggccatggtgccccaggtaagtgcttcgcctccgggaaccatttctggctcaaatctgtctctgtgtctgatcactgcgtgcgttcttccttggctaactctgcgggaattcagactattgttttggtacctactgatttgggagtcgtggagttgggttctgtcagaatgttacccgagagttttgaactcttgcaggctgttaaatctgtgttctccacgccgattcccaaggttttggtgaacacaattcgcaatcagacacattttagagagaaacttgctgttagaaaaatggaggataataggccttggaacaacaacaacgttagttttccgaatgtgcggagcaatggccttcatgtttcaagttgttggccagtgaattcgggtttgaggcagcctgctcctagggtggtggcggagctggctaatggtgtgagacaggatttgaggctgagcaatagctatgaacctcaaagacaggtgcaaatgcaaattgactttagcggaggcactagcaggccttctgatgtggaggcctcttgcaaggaggagcaaccaagtgttgccgatgaaaggaagcccaggaagcggggaaggaagcccgccaatggaagggaagagcccctcaatcatgtggaggccgagaggcaaaggcgcgagaagctcaaccagcgcttctatgcgttgagatctgtggtgcccaacatctccaagatggacaaggcctcattgttgggagacaccattgcttatatcaatgagctccaggctaaagtcaagatcatggaagccgaaagagagagatttgaaagcatttcaaatcaggagaaagaagctcctgctgatgtggatattcaagctgttcaggatgatgaggtcattgtaagggtgagctgccctcttgacaatcatcctctttcaaaagtaatccaaacattcaaccaaacacagatcagtgttgtagagtctaaacttgcttctgcaaatgatgctatttttcacacatttgtaattaagtcccaaggatctgaacagctcacaaaggacaagttgattgctgttttttctccaacggaatccaactcattgcagccattgtcatcagttggatggtaa

SEQ ID NO: 87456 - DNA, 1776 bp, Glycine max
  Peptide Sequence Number=SeqID_204234
atggaagcggaaactcgacggaaagtggaggagatggtgttggatattctgaagaaatccaatattaaagaagccactgagttcaccatccgagtcgctgcctccgagcgtctcggcatcgacctctccgacaccgccagtaagcacttcgtgagatccgtcgtcgagtcttttcttctctccgtcgcggccaatgaaaagtccaaagacgcagagaagaagaaggagaacgaagatattgccgccaaaaacgacgacgtagcgaagaaggaagatgtcgttgtggccaacgaagaagagtcccgagagacagagctgtccaacaggaggaacgtggcggtgaaagatttcaaagggacaaccctggtctcaattagggagttctatatgaaagatggaaaaccacttcctggttcgaaagttctctccctattttctgtgagccactgctctgtttcaggcaatccgtggttttggcattatgacctgcttgtttctgtgattgaaatttgtagatggcaaacccaaccccttctgctactccctcatttggtgttcatgtcttgtgggataagtttatcttcggaacaatggtcgaccttcaagaagagtgttcctgccatagaggaagctatcaaaaagatggaagaaaggataggatcggagcctaatggtaagcaaaatggagatgtgtcaaattcagttgttgatgttgcttatcttgagcctaatagtaagcaaaagggagatgcatcaaattcagttgttgatgttgctactcttgagcctcatggtaagcaaaatggagatgcatcaaattcagttgttgatgttgctcctcttgagcctcatggtaagcaaaatggagatgcatcaaactcagttgttgatgttgctcctcttgagcctgtcgtccctattgaggtcatccgttttgatgggaagaatttccaattctgggctccgcagatggaattactcttgaaacaattaaagattgactatgtgcttgatgaaccatgcccgaaccctacactaggcaaaagtgccaaggctgaagacattgctgcaaccaaggctgcagaaaggagatggctgaacgatgatttgacatgtcaacgcaatatcttgagccatttatctgatcctctgtacaacctctatgcaaacagaaaaatgagtgctaaggatttatgggaagagttaaaactggtttatctgtatgaggaattcggaaccaaaagatctcaagtgaaaaagtatcttgaatttcagatggttgaggagaaagcagttattgagcaaatccgagaattaaatggcattgcagattctattgctgctgctggaatttttattgatgacaactttcatgttagtgccatcatttcaaagcttccgccatcctggaaggacttctgcatcaagttaatgcgtgaggagtatctaccttaccggaagttaatggaacgtatacagatagaggaagaatatcgctatggagtaaaacgagtggtcgaatattcttacagtatgggaggatatcaccaggcctataaaggtggacataggagagctgactataagccggcactcggaatgtgtaggaataggccagaaattattgcgaggagcgtaccctgtactgtatgtggcaagagggggcatctttctaaacattgctggagaagaaatgacagacaaactaatgagaggaaatcagaagaggatgtgcgtatacctacagaagttgatactcagggtgctacccagtag

SEQ ID NO: 87457 - DNA, 561 bp, Glycine max
  Peptide Sequence Number=SeqID_204235
atggttttaggaatggaacatattgatgaagaggtagatgcaaatgatgaaaatggaataaatgaaaggggtttcagtttaatgatgccttggttagtaacgtattttcatacatttgtgtgttctagacaaggtgttcataaggataggaggttgactgcaaaaactaggaagcatgagccaagaaatgatataagatgcaagtgtttggctaaatttgttcatgtcaagaagaatcatggtaggcggggagttaaggagttcactaatgaccacaaacatgagttgttagaaaaagattattgttctcttgtaccatcccacaagaagatgacaccaggtgatgtattgaaaattaagaatctaagaaaaactgacataatgactcctcaaatatttggttctttagccaacatttctggtggatatgacacgcaatttatcgatacaatgaaagggaaggcactagtgttcataataactgatggggatttggctatgaaaaatgcaattgaggtagttttcctagtgcaaatcataagctatgcacatggctcctaa

SEQ ID NO: 87458 - DNA, 126 bp, Glycine max
  Peptide Sequence Number=SeqID_204236
atggaatcaactgcttctttcattcttcctcactatgaggtcgtgaaaacaagacaacacttggtacctctaagccctacactggggcaacgaaaggcaccatgcaaaaacctcaagcgaacctag

SEQ ID NO: 87459 - DNA, 496 bp, Glycine max
  Peptide Sequence Number=SeqID_204237
ggagattccaaaatggttccactatgttaacaagggacggtttccggatttcaaggctcgtgggaagttccctgcggttgctatagcgtttgtatttggggaagtgaatgccattgacaaagctaatagaagtataaatgttggcattcacttgttgattgaggatgaaaggagaaagtttcgtaatgtccctgtccctgagaatcatgtgttcttgtgtgacctacgaggtttgttcagtttggaagaatgggaggatgtaggtgttggagttggtaatgattggaagaccatacaggtttactgtgacacaaagttgcctctatgttcatggggagtttatgtgtacaagagtgaaactgactatgctgctacttcttaccaaattggcgctttgattaaggaaaggggctttcctgtgtacttaaatccaaacaatgaagttaccttagggttcaacattgaagatgaggaggaggatgatgagattgattaa

SEQ ID NO: 87460 - DNA, 2655 bp, Glycine max
  Peptide Sequence Number=SeqID_204238
atggaaaatcatggtgcagtgtctgaaaccaagtgtacgtttgatgttttccttagttttaggggtgaagatacccgtcacacatttacttgtaaactctatgatgctttgtggctgaagggaattgacacctttatggataataaagagctgaagaatggagacaaaattggccctactcttcataaagccattgaagaagcaaggatttcagttgttgtcttgtctgaaaattatgcagattcttcatggtgcctcgatgaacttgtcaagatccacgagtgtatggagtcaaaaaaccagctcgtttggcccatcttctacaaagtgaatccctcggatgtgaggcatcagaaaggaagttatggtgtggccatgactaagcatgaaacaagtcctggaatagacttggagaaggtgcacaaatggaggtcaaccttgaatgaaatagccaacttgaaaggaaaatatttggaagaagggagggacgaatccaagtttattgatgatcttgctactgacattttcaaaatagtatcttctaaagatttatctagagaaatgtttatagtcggacgagagtatcgagttaaagaattgaaattacttctagatcttgagtctcgtgatatcacttgcctgttagggattcatggaactggtggaattggcaaaactacacttgcaaaagctttgtatgactccatttacaagcagtttgacggtacaagttttctcaacgttggagaaacctcaaatcctaagacagacttaaaacatctgcaagaaaagcttttatcagagatacttgaggacgacaaaatccactggagaaatattgaagaaggaaccgcaaaaatagaaaggagacttggttttaaaagagttctaatagttcttgacaatgttgatgacattaaacagttgaataatttggcagggaaatgtgcttggtttggtcctgggagcaggatcatcataacaacgagagataaacatttgctagatcttggtgaggttgaaaagagatatgaagtgaaaatgctagatgagaaagagtctctagagctcttttgtcattatgcctttcgaaaaagttgtcctgaatcaaactataaagatctgtccaatcgagcaatgagttgttgcaaaggccttccattggccttagaagtactaggctctcatttgtttaaaaaaaatgtggatgtatggaaggacgcattggatagatatgaaaaaagtccacatggaaatgttcaaaaagttcttagaataagctatgatagcctgttccgccatgaaaagtctatttttcttgatgttgcatgttttttcaaagggcaacgattggattatgtaaaaactgtactagatgcatctgatttcagctcaggagatggtattacaacattagttaataaatcacttttaactgttgactatgattgcctgtggatgcatgatctaatacaagacatgggtagagagatagttaaggagaaagcatacaataaaattggcgaacgcagcagattatggcaccatgaagatgttcttcaagtattagaagatgataatggaagtagcgaaattgaaggaataatgctcgacccccctcatagaaaagaaattaattgtattgatactgtatttgagaagatgaagaatcttcgaattcttatcgttcgtaacacaagcttttcacatgagcctcgttatctcccaaaaaacttaaggctacttgattggaagaactacccttcaaagtctttgccatcagaatttaatcccactaaaatcagtgccttcaatggaagtcctcaactcttactggaaaagccatttcagtttgaccatttgacttacatgaatatctccggttgtgataaggtttctgaatttcctgatgtgtctagagccatgaatttaagaaaattgatacttgatggatgcgagaacctggttagcattcataaatcagttggacatctcgctaaccttgtttctcttagtgcttcaaattgcacacaactccatagttttgtgccaacaatctatttgccatctcttgaatccctttcctttgttctttgcacaacactcgcacactttccagatatcgaaggaaagatggataagccattagagattgttatgtcatatacagctattcagaagcttccagattccatcaaggaacttaatggccttacctatcttgagatgacaggttgtgaggaactccgatatttaccaagtagcttatttaagttgccaaatttggtcacattaaaacttgcagaatgtgctttccttccaaggtcattgagaatgtttataggaagtccttcaacgtgcgcaaaactagagacattacatttcgacaatactgggctgacagactatgatcttaagactattgttgccatttttcctaacttgaaagacttgaatgtatcgcggaacagattttctgatctcacattgagcattgggaaatttactaacttgacaagtcttgacgtgagttattgtacggaccttaaaggaatgccttcaatactgccatcaagtgttcagaaagtagatgcaagagaatgtcgatccttaaatcaattttcatcaaacgccttatggattcaggtttactag

SEQ ID NO: 87461 - DNA, 1494 bp, Glycine max
  Peptide Sequence Number=SeqID_204239
atggctgggagattgcctaagagcaatggcattccatggagagggaactcagggttaaatgatggaaacgacactactgatgtgaaaggaggcttggttggaggttactatgatgctggggacaacacaaagtttcactttcccatggcttttgccatgacaatgttaagctggagtgtgcttgagtataagcaaaagtatatggctattaatgagtatgcacatactcgagaactcatcaagtggggtactgattacttgctcttgaccttcaacaattctgccaccaaaattgacaaaatttatggccaggttggcgggagtctaaatggttccaccacaccagatgatcactactgttggcaaaggccagaagacatggagtatcaacgtcgcaccatatccatacatcaaggtgctgatcttgcaggggaaatggctgcagcattagcatcagcctctatagttttccaagatgatgttgcctactccaaaaaactcatcaagggtgctcaaaccgtgttcgacttcgcgagagatagcggtaagaggaagccgtatagtcgcggggagccttacattgaacccttctataactcctctggctactatgatgagtacatgtggggtgctgcttggttgtactatgccactggaaatagtacttacatttccttggccaccaatccatccatattcaagaattccaaggcatatttcttgactcctgattttagtgttttgagctgggataacaagttaccggctgcgatgttgttgctgacacggttcagaatgtttttgaatccgggatacccgtacgaggacatgctgaagatgtaccacaatgtcactagtcttaccatgtgctcttatcttcatcattacaaagtctttaacaggaccagagggggattaatccaattgaaccatggacaacctcagtctctacaatatgcagctaatgctgctttcatggcatcactttttgctgattatatgctagagattgatgtccctggatggcaatgcggttctacttatttcccaatatcagctctgaaggcattcgcaacctctcagattgagtacatcttgggtaaaaatcccatgaaaatgagctacatagtggggtttggaaacaaatttcctaagcatgttcatcatcgaggagcatccataccaaatgatcacaaacatcgctcatgcaccgggggttggaagtggcgtgacactcctaacccgaatcctaacacgatcacaggagcaatggttggaggaccagaccgttttgaccaattccgtgactcgagaaagaattacaacttcactgagccaaccctagccggaaatgcaggactagttgctgcattaatttccttaacaagtaccacaggcagtggcattgacaggaacaccattttctcagccattccaccacttgggccacaaaatcctcctccaccaccaccttggaaaccaatcaaaacataa

SEQ ID NO: 87462 - DNA, 963 bp, Glycine max
  Peptide Sequence Number=SeqID_204240
atgaggcgaagtttcagagttagcatgacacgagctgcattgggaggccgtgttgcagccacgggaagatcatctttagtggagagagtatcagaggagctattgccttttcctagcaaaagttctcaaagcactgtgacattcatctaccaagccaatgttgcggggtattcgagacatgtgtcagtgttgtggtgcaaaaatctcatgaaccacacattaaacctcaaggttgatagcacaagaggagacttcagttacacttgcaagatacaggttaagccatggtatttttggaacaaaaaagggtacaaatcattcgaggttgatggccaccaggtggaagtctattgggacctccggtccgctagatttgtcggcagcagccccgagccgggtagcgattactacttggcaatggtgtcagacgaagaggttgtgttgttgctgggggatcagaagaagaaggcctataagagaatgaagatgaggccaagcattgttgaggcactgctattggtgaagagagaaagcgtgtttgccaagaaaagttttgcaacaaaggccaggtttgatgagaagagaaaagagaatgacattgtggtggagagctcaacatttgggaacaaggagcctgagatgtggatcagcattgatgggattgtgttgattcatgtgaagaacttgcagtggaattttagggggaatcaaacagttatggtcaacaagcaacctgtgcaagtgttttgggatgtgcatgactggttgtttagtgtgcctggctcagggcctggtctgttcattttcaaggcagggcctgtggaggttgagagtgaaaaggaagagagagttaatgagggttgtgacagtgataatggtagttgtgccagtggctattattcaaccctgagttatgctccctctgagtcttgccttgtgctctatgcctacaaacttgagtaa

SEQ ID NO: 87463 - DNA, 403 bp, Glycine max
  Peptide Sequence Number=SeqID_204241
atgcattcaagaaataattggggagggtcctttgagatgagctcaagtggtgaagaggtttcagggtacgaggctaataacaaccacaacaaagagtgggatagggcagcactacttgagaggtaccatccacaaagccaagatttggatgaaactctacaaagctgggttttggggaggggtgagaagagtaagaagaccaagtatgtggactttgggtgcataatgatcagccacaaggcattgaagtggctttttggttccattttcttggctttcattgtcattggtctccccatcatcatcgtcaagtccttgcccaagcaccattctccacctacaccaccggataattacacccttgccctccacaaagcactcctcttcttcaatgctcaaaaat

SEQ ID NO: 87464 - DNA, 126 bp, Glycine max
  Peptide Sequence Number=SeqID_204242
atgaagaagaactcagagcttgtggctaatgttgaaaagcatgtccatggaaactggtgttcagttccagccaaaaagcagatgatcaatcacaacatctcacagcttgtccaatacaacaaataa

SEQ ID NO: 87465 - DNA, 703 bp, Glycine max
  Peptide Sequence Number=SeqID_204243
atggattacgaacctccatttctagagttctacaagcccctccttctacaaggctcgcaccgcgttgatgttgccatcagtggcggtgccataagaaatgacaagtccgagtggtgtgaacttcctctgattgatcttggccgattaagtctcggcggcggcggcgagaaggaggagtgcatgagagaaatcagtgaagccgccagaacgtggggttttttccaggttgtgaatcatggtgtttcacaagagcttctgcaaagtttacggcatcagcaagttgaagtgttccgaaccccttttgcaagaaagtcccaagagagtttcttcaacttacctgccagaagttacagggtgtttggcctcttatctcacactgactctagtttcctcactatagtgaaccaagaccagattgggggtttgcaaataatgaaagatggaaattgggttggtgtcaaacctaacccccaagctctggttgttaatattggtgatttattccaggcactaagcaatgacatttacataagtgctaagcaccgggtggtggcagctgagaaggtagagaggttctctgtggcatatttctataacccttccaaagatgcattgatagagagccacatcatgccaccaatgtacaggaagtttacttttggagagtacagagggcagatagagaaagatgttaaggaaacag

SEQ ID NO: 87466 - DNA, 237 bp, Glycine max
  Peptide Sequence Number=SeqID_204244
atgaagaagaactccaagcttgtggcttatgctaaaaagcatggccatggaaactggcgcacagttcctgccaaagctcttcttcgaaacaaatggtcaatcatagcatctcacttgtccaagcaaacaaacaaggagaccatgaattattggaacaccaacatcaagaaattaaaggtttatcagaatggaagacatacattcaattacacacaaacgaaaagccaacacctttga

SEQ ID NO: 87467 - DNA, 2970 bp, Glycine max
  Peptide Sequence Number=SeqID_204245
tctacattctcttcttctcactagcaacgacgttggtgtcgtgtctgaaccaagaaggcttatacctctaccagctaaaactctccttagacgacccagactcgaaactctcctcatggaactcacgagacgccactccctgcaactggtacggcgtaacctgcgacgccgcaacaaacaccaccgtaacggagttggacttgtccgacaccaacatcggaggcccattcctctctaacatcttgtgtcgtctcccaaacctcgtttctgtgaacctgttcaacaactccatcaacgaaaccctaccttcagaaatctccctctgtaaaaacctcatccacctcgacctctcccagaatcttctcacgggcccactcccaaacacgctcccgcaacttcttaatctccgctacctcgacctcaccggcaacaacttctccggccccatccctgactcattcggaacattccagaacctggaagttctctccctcgtttcgaatcttctagaaggcacaatcccttcctccttaggtaatgtgagtactctgaagatgctgaacttaagctacaacccttttttccccggtcggatcccgccggagatcggaaacctaacgaacctccaagttctctggctaacgcaatgcaacctcgtcggcgtcattccaacctccctcgggaggttgggaaagctacaggatttggacctcgcgctcaacgacctctacggttccattccgagttcgctcaccgagttaaccagcctgagacagatcgagttgtataacaactcgctctccggggagcttccgaagggaatggggaacctcactaacttgaggctcatcgatgcttccatgaatcacttgaccggaaggattccggaggagctctgttctctgccgctggagagtcttaacctttacgagaatcgcttcgagggcgagttgccggcgagcattgctgattcgccgaatttgtatgaattgaggctcttcggtaaccggcttaccggaaagttaccggagaatctcgggagaaactcgccgctccggtggcttgatgtttcgagcaaccagttctgggggccaattccggcgacgctgtgtgacaagggggcgctagaggagcttctggtgatttacaatcttttctccggggagattccggcgagcctcggcacgtgccagagcttgacacgtgtgaggctcggttttaacagactctccggcgaggttcccgcggggatctgggggctgccgcacgtgtacctgctcgagcttgttgataactcgttttccggttccattgcgaggaccattgctggtgctgcgaacttgtcgctgttgattttgtccaagaacaacttcacgggaacgattcccgatgaggttgggtggttggagaatctcgtcgagttttcagctagtgataataaattcactggttcgcttcctgatagtattgtgaatcttgggcagcttgggattcttgattttcataaaaataagctctctggggagcttccgaaagggattcgttcttggaagaagctcaacgatttgaatctggcgaacaatgagattggtgggaggattcctgatgagattgggggtttgtccgtgctgaattttctggacctttctagaaaccggtttttggggaaagtccctcacgggttgcagaatctgaagctgaatcagctcaatttgtcttataaccgattatccggtgaattacctcctttgttggctaaggatatgtataggtctagttttctagggaatcctgggctgtgtggggatttgaaggggttgtgtgatgggaggggtgaggagaagagtgtgggttatgtttggctgcttcgaacgatttttgttgttgccactttggttttccttgttggtgtggtttggttttactttaggtacaagaatttccaggactcgaagagggctatcgataagtcgaaatggacgttgatgtcgtttcataagctgggttttagtgaagatgagattttgaactgtcttgatgaggataatgtgattggaagcggatcgtccgggaaggtctacaaggttgtgcttagcagtggggaggttgtggctgtgaagaagatatggggaggggttaagaaggaggtggagagtggggatgttgagaagggtggtagggttcaggacaatgcttttgatgctgaggttgaaactttaggtaaaatcaggcataagaacattgttaagctgtggtgttgctgtaccactagggattgcaagctcttggtttatgaatatatgcctaatggaagtcttggtgatttgcttcatagcagtaagggagggttgttggattggccaacaaggtacaagatagctgtggatgctgcagaaggcctctcttatctgcaccatgactgtgttcccgcaattgttcatagagatgtgaaatctaacaatattctgttggacgtggactttggtgcgagggtggctgattttggagtagctaaggcggttgaaaccacgcccaaaggagctaaatccatgtccgtcattgctggctcttgtggctatattgcaccagaatatgcatatacacttagagtgaacgagaagagcgacatatacagtttcggggttgtcatactcgagttggtcactggaaaacgccccgtggaccctgaatttggggagaaagacttggttaagtgggtgtgcacaaccttggaccagaaaggcgtggaccatttaattgatccaaggcttgatacttgtttcaaagaagagatttgcaaggtcttcaacattggactcatgtgcactagtcctcttcctatccaccggccttcaatgagaagagtggtgaagatgttgcaagaggtgggaacagagaaccaaaccaagtctgcaaagaaagatggaaagttatccccttattactatgacgatgcctcggatcatggaa

SEQ ID NO: 87468 - DNA, 567 bp, Glycine max
  Peptide Sequence Number=SeqID_204246
atgaaataccaattgcttgttaactacttaaccctaacatatatgtattggaatgtcaaagatgcttatgatgacaaatttgtgcgcatagacactacactagagaaactagtaaagagtgtcagcgacttagcaatgattttttatagtcaaagacaaaacaatacacacaatacgactccttctttagtccacatgaaacaacagaaaagcacaacaccgaagcaatcctcaataaggaaaacaaaaaaggcatccttgtcaaagaaggcaaaagctcacaatactaaatgtgaggctattgtcaatgagggtggtctgaagaagaaattttttgagcatactattactagcaacgattttggactattttcaaatgtagagcctctttacaatgcaacatatgatggaatgactactattgtagacattccaatgtggcttccaatgacttttaggcctccactaaacatgattttggatgaggttcactcactagtagctgcctacatcttcggcaggaataagggtgatgaagataatgggtatgatatgccactcacctga

SEQ ID NO: 87469 - DNA, 675 bp, Glycine max
  Peptide Sequence Number=SeqID_204247
atggatgaactaagagaaaacttaccccatcatgaaaagccgttagatatccaactgtcattattgccatgttgcttgttggtgatcatggttggcgtgccattggatatggctttaatcacatgtattgctatatggaagagtccatacatgctgttcatagggtggaaaaggctattagaagatttgattggaagaaagggaccattcttagaaactgaatgtgtcccatttgctggccttgccatcattctctggcctttggctgttgtagtggctgtattagcagcaaccattttcagcctttttcttgccctatatagtggagtagttgtccatcaggaagactcagtgaagatggggtttgcctacattgtgtctgtggtttcactttttgatgaatatgtaaatgatttactctacttgagagagggatcctgctttcccaggccgatataccgtagaaacaagagtcatgctattgagaggaaaaaccttggaggaggtgataatgatttgagaaattggagggatggttcacaaaattcgaaacatgccatacaacaatccagaagtctgaaatggagaattcagcaatatagacctgtgcaggtatgggactggctgttcaagtcatgtgaggtgaatggaaggatactcctccgcgatggtctg

SEQ ID NO: 87470 - DNA, 654 bp, Glycine max
  Peptide Sequence Number=SeqID_204248
atggatgttatagttcaagaagacatgtatatgtataataattccaagaatcatgatgaacaaaagctaccacttttgcacaatattatggaggtgccagatgatgcaaagagaagcctcattcagagagccatgagtcaagcatttcaaagcacagctcatttggcgaatctcttaccaactggcactgttctctctttccaatttctgtctccaattgtcacaaaccaaggaaactgtgacttggtttgcaagttcatgacttctatgcttgtggctctttgtggagcctcttgtttcttgcaatgcttcactgatagcttcagagatgacaaggggaacgtttgttatgggcttgccacattcaggggcatgtgggtcattgatggatcaaccacaatttcacctgaactcggcgcgaaatatagattgaagcctattgatttcgtgcatgctgtgatgtcaattttggtttttgcagcagttgttttgtttgatcagaatgtagtgagttgtttctttccatcaccttcaaatgaggcacgggaaatcttaacggtgttgcctgtggccattggggctttttgtagcatgctttttgtggcgtttcctacacagagacatggaattggttttccactttcaacaaagtaa

SEQ ID NO: 87471 - DNA, 182 bp, Glycine max
  Peptide Sequence Number=SeqID_204249
taagaatcagtgagactaaacagatgctgtggggaacagacagaacaagaccagctttggtacttgttgttgctaaggacaaaaccaaaggtaccatttgttttgatgatgttgagcagctcaacgagacttggttggaaacacattttggcatgattgttgggaggaagttcactggctag

SEQ ID NO: 87472 - DNA, 225 bp, Glycine max
  Peptide Sequence Number=SeqID_204250
atgttgaaggagcaggatagtgtgagggaggtgagaggaggatgtggattgagtgaagagataggtggggtcctcttatctgttggggagagatttgtctctagggtggagtggatgattggtggtgaagacacgagagtatatgtgtgctcccttttcttcaaatctaggccttatcgcctcctctttctctcctatgtatggcttggaaaagttgtgacggag

SEQ ID NO: 87473 - DNA, 186 bp, Glycine max
  Peptide Sequence Number=SeqID_204251
atggcgggtcacagcaactacacttctgggagatgccatacaggtcacaggcacgggctctctcacgtactcacagcacgagctccactgcacacaatgggcgttgccgagagagcgaggtttcaaggaactttcaggggtttgagcgaaagacacaattgcatagggaaggcaaaacataactaa

SEQ ID NO: 87474 - DNA, 741 bp, Glycine max
  Peptide Sequence Number=SeqID_204252
atgtctctgattccaggtttcttcggtgcccgaaggagcaacgtcttcgatccattctcactcgacatttgggatcccttcaaggattttcatgttcccacttcttctgtttctgctgaaaattctgcattcgtgagcactcgtgtggattggaaggaaaccccagaggcacacgtgttcaaggctgatattccagggctgaagaaagaggaagtcaaggttcagattgaagatgatagggttcttcagattagcggagagaggaacgttgagaaggaagacaagaacgacacgtggcatcgcgtggagcgtagcagtggtaagttcgtgagaaggttcagattgccggagaatgcaaaagtgaatgaagtgaaggcttctatggaaaatggggttctcactgtcactgttcctaaggaagaggttaagaagcctgatgtcaaggccattgaaatctctgaaaaacttcacctccccactagcactcctccgatgccaccaccgcctacagtggcatggcaaccatcgaatgtggaaattgaagatgatagggttcttcagataagcggagagaggaacgttgagaagaaagacaagaacgacacgtggcatcacgtggagcgtagcagtggtaagttcatgagaagattcacattacaggagaatgcaaaagtgaatgaagtgaaggcttctatggagaatggggtccacactgtcactgtttcaaaggaacggaactag

SEQ ID NO: 87475 - DNA, 486 bp, Glycine max
  Peptide Sequence Number=SeqID_204253
atgacgaaggacggtgaaggtgtttgggtcatggcttcgcaaagttatggtgagccaagggaagtgcagaggtggcgaaggagaacgatctttgggggagaaagtggctggcggtgggaggcagacaacgacggaaagatttcaaggcgagtttccactgtccattactctgatcctaaagaacttgaaaatctcaattcaactaacgcaaaacatgcccatggaaattcttctggagtcacagggacaacttcatctcgatattttcctatgcaaagtagtggagcagcttcatcaaaaggtagcagacagagaagctctctaactgaagctagtgagccatctagtatttcaaaacgaagacatgcgtctaaatctaaatccaacttgtccgaggcctcacatggtcacagcactggcatttcctccatgtccccggatcattctcatgaaggaaaagcaaagagaagaaaacataaggaataa

SEQ ID NO: 87476 - DNA, 543 bp, Glycine max
  Peptide Sequence Number=SeqID_204254
atggattctgacttctggacctcgcgtcttgccgccgctaaacgccaatacacgcttcagcatcaccatccaaactctcacttagatcggttgggaatcgatgattttgatatggaagaagaggtgagacccgatttcccttgcccctattgttatgaagactttgacatcgcgtctttgtgttctcatcttgaagatgaacattcttgtgaatcaagagtcacggtgcttcttggtggtggaggtggtggtggataccggtcaaatagtgtagctgcagccgtatctaatgctgctgctactgatccattcctatcctcatttattttgaacttccctgcttgtgaagctgaagaaatttcaaaatctgtggtaacaagtgctgagaattcttctgccaaaaatgcgacgcctgaacatatttggaaatcaagttttggtccctccttgagtactgaagagcgcgagaaacggatgagacaagctgctgggagatctggttttgtgcaggaactgtttctttcaactttgttaggtgaataa

SEQ ID NO: 87477 - DNA, 330 bp, Glycine max
  Peptide Sequence Number=SeqID_204255
atgaagtcatggcatatctatggttcggaattaggacgaaacacttacctatttgaacccaatgtttcctctaaatggtcatttagaaacgaaatgctaaacatccaaaatctcatttgtggttgtgagaaaatttcatcggcatactcaccttccccggtagacacactgtttttcatccggaaagcatatgttgctctgattagttggaagttttctctctttactaaagcatgctcgcattttagtgaagaaaacaccgagactatttttagtctcacaagttatccagaactacgtaggtctgagttcctcattgaggatacgtag

SEQ ID NO: 87478 - DNA, 273 bp, Glycine max
  Peptide Sequence Number=SeqID_204256
atgtctgcaagctatctcctcctgaaaatcaatgtactcatcgtccctgagctggacgcgcctctctcggtggaacaaccatcctttgatggcctcgaagcgctattggtgcacggcgctccggaaacggtgactatcaaactcgggggcggcactggtcccttcagccgcggcgtccttcctagatctctttgcggaaagctttttcgaagccatttcttgttagagatgaataatagagcaaaatggaatcaaaaatgcgaaaaatggtga

SEQ ID NO: 87479 - DNA, 495 bp, Glycine max
  Peptide Sequence Number=SeqID_204257
atgccgccacacctatcttcgacaatacccagatctgggtcgtcttcttcagcgcatcccaaccccggaggtttcgaagttagaaacattaacatgcactcccacgcaccacttctccacgtgtcattctcaagcgtgtgcatcccacgcagccatctccggtcactggaactccgacgtgacacctgggttttgggcaccgatcatttggagaaagatgctagtgaaattccagtagagaacagaaatcagtggaagacacttgacttccaactgtgcattgttttatggcaatcaatagaacctaatgtgttggaaatacttagatccttcaagacttgttgttccctctggaaaaatgctcaagatatttttgctaatgacatccagagtttatttgactcagcaaaccgtgcattttctctcaaacagactaaccatgatatgacctcacacatagccaaagccaaagctgctgttgaagaattaaagtag

SEQ ID NO: 87480 - DNA, 336 bp, Glycine max
  Peptide Sequence Number=SeqID_204258
atggggacactcgaggtatttaaaggaagtgaaaggatactcttgacgggagagagagccaacgcgccggttttgacggcgttgggagtgggattccgtggcacaaactcttcttctcttgcgcgttcagttgcgcgaagcagcgtcagttacgatttctcagtttacgattctgtgacccctttccgagtcggggctctgcaaatgtcaatggtggatttggagggcaaagaaggttacaggccttccacggagtacgtggaagacagcaacgaaacactcattaacttgactgactcaaccgagcttttgtttcttaagttgccttcttccaat

SEQ ID NO: 87481 - DNA, 1206 bp, Glycine max
  Peptide Sequence Number=SeqID_204259
atggctgtgaaaggatcaccacaacggtgggacatgagattagttttgacaattactcttcttttaatctcggtctctgtttctgctcttcaacacgtaagtcacaaaaacattaatcccaccaccgttgagacaacccaaactagttttcttggtaaagtcgtgaactttttgtggagctcatctggctctggataccaacatacttggccggatatagaatttggatggagaataataacgggtacgataattggattcctgggatctgcatttggaaccgtgggtggtgttggtgggggtggcatctttgtcactatgctctcccttattattggatttgatgcaaaatcagctactgcaatctccaagtgtatgattacgggtggagcagcagcgacagttttctacaatttgaagcaaaaacatccaacacttgacatgccagtgatcgactacgacttggcacttcttttccaaccagtgctggtgcttggaatcagcattggagttgccttcaatgtcgcatatgagcctctaccgggaggcccaaacacaagcaatcataatgagcctaaaaaatccaaggaaacgacgggatcagttcttgaaaatgttcgttggaaagcacttggagttcttttcactgtctgggtccttatacttgcctccgagattgcaaaaagtcacacaacaacttgttcagtggaatactggatacttaatctactacaggtccctgtggcattaggagcgacttcatatcaagctgtgcttctgtacacaggcaagagagtgatagcatccaaaggagatcaaagaacacaatggcgagcgcaccagttagttctgtattgttcttgtggcatatgcgctggtatagttggtggcttgcttggtcttggtggaggttttattttgggaccccttttcttggagctaggaatccctcctcaggtgtcaagtgctacagccacttttgccatgacattttcagcatctatgtcagtggtggaatattaccttctaaaacggtttcctattccttatactctttactttgtggctgtatccacttttgcggcctttgttggacaagttttagtgagaaagctggttgccatactagggagagcatctctgatcattttcatcctctccggcaccatttttgttagtgcaatatcactaggcaagtgtcattag

SEQ ID NO: 87482 - DNA, 1557 bp, Glycine max
  Peptide Sequence Number=SeqID_204260
atgaaacccactttaagattcatcgttttcctcctcacccttctcctggtactgaggtttaacgttgccacagaggttaaggatgagttggaggaattgttagcagtggacgaggaagtagaacgggaagccgaaaagggtggcgagaaattatccgaagcagaggttttgagcaaagcccaaaggatcgtaattgagctcaagaacgagaacacagagagggttgtgaatgggaacgagtttgttcttgttctggggtatgcaccttggtgtccaaggagtgctgagctaatgccccattttgcagaggctgcaacttctctcaaggaattgggaagccctcttattatggccaaacttgatgctgacaggtatcccaagccagcttctttccttggtgtcaaaggcttccccactttgcttctctttgtcaatggcacctctcagccctactctggcggtttcacagcagatgatatagtgatatgggcacaaaaaaagactagtactcctgtcattcggataagttcagtggcagaagcagaaaagtttctgacaaagtatcaaacatttcttattggtcggtttgaaaattttgagactagaggttccaaattgacaggaggtgtagatttatgggagttgtggagttgttcaattaacgtaggacctgattatgaagaatttgtgagtgctgcaaagtctgataatgaaatccagtttgtggaaacgagtcaggtagagcttgctcaagttctttatccagatatcaagcctaccgatcgttttcttggaattgttaagagtgaacccgaaagatacagtgcttatgatggagctttcatactgaataaaatactggaatttgtagactacaacaagtttccattagttacaaagctgactgaaatgaattctgtcagagtctactccagtcccatcaagcttcaggttttagtctttgcaaacattgatgacttcaagaatcttcttgatactcttcaagatgttgcaaaaacattcaagtcaaagataatgtttatatatgtggatattaatgacgagaaccttgcaaagcccttcttaacattgtttggtcttgaggaatcaaaaaatactgtggagttctgcaataatctcatgcaaggttctttgtcgccatacttcaagtcacagccaattccagataacacagaagcaagtgttcgtgctattgtcgggaaaacatttgatgatgaaatcttgagcagcaagaaggatgtgctcttggaggtatttacgccttggtgtatgaactgtgaggccacaagcaagcaagtagagaagttggcaaagcactacaaaggatcaagtaatctaatatttgcaaggacagatgcttcagcaaatgaacatccaaaactgcaagtgaatgactaccccacgcttctattttacagagcagatgataaggcaaacccgatcaaactttctacaaaatctagtttgaaagagttggctgcatccatcaacaaatatctaaaagtcaagaatcaagtactcaaagatgagttatag

SEQ ID NO: 87483 - DNA, 423 bp, Glycine max
  Peptide Sequence Number=SeqID_204261
atgtcattgaatcggatgttcatcttgcatgccatctctttgcttgtagcacccacttgttttaacatagttacggaagatgtagcacaactgtggcattgcaagtttgggcacttaagttttaaaggcttgcagactctgcaacaaaaaggaatggtggaagaaaaatcagaggcttttactgttttcaagagcttcaagttacatgttgagaaagcaacagatatgtcacccaagggactgtgcacaaatcgtggtggagagtttacatctcaagaattcaacaacttttgcaaagtgcatggagtgcaaagacaattaacagttgcatattcaccgcaacaaaaaggtgttgcagaacggaagaatcgaacaatcatgaatttagttcacagcatgctatttggaaaaaaaagtgcctaa

SEQ ID NO: 87484 - DNA, 738 bp, Glycine max
  Peptide Sequence Number=SeqID_204262
tttttacactgtgaactatttagaaaccatcctggtatagttctcaaggttgactctggaaaccggcctgtgactggaattcgcttatacttggaaggcaagaaaagtgaccacctggcaatccatcttcagcatctttcagaggttccaggagcccttgaaatttcagaagatcatggttatgatcccgtggacgaaccagaggaacgaggctactatgagccggtgaaatggagcatgttttcccatgtctacacagcacctgtgcagtacagtagctccagcatggacgagtccacggccatcgtgacaaaagcctggtttgaagtgaagctcgtaggcatgaagaaagtccttttcttgagacttggattctccacggtagcatctgccacaattcgcagatcagaatgggatggaccttcaaccacgtcgcgaaagtcaggattcttctcagcactgatgagtactaggctcagcaaggaattgcagtcaccagatcagaagccgaataaggtggatataaactcggcaatttataatgttggaccacctgtgccaacaagggttccaaaaatgcttagttttgtggacacaaaggaaatggttcgaggtcctgaggatacaccagggtattgggtggtgactggggcaaagctgtgtgtagagggtggtagaatctcaatcaaggcaaagtattccttgttgactatattgtcggaagaatctctgctgtag

SEQ ID NO: 87485 - DNA, 744 bp, Glycine max
  Peptide Sequence Number=SeqID_204263
atgacgttgtcagcaaaatctgaatcggatatcacaagcttagctccatcttcaccttcaagatcaccaaagcggcctgtgtactatgtgcagagtccttcaagggattctcatgatggggacaagtcatcttcaatgcaggcaactccaatatcaaacagtcctatggagtctccctcacacccttcattcgggcgtcactcaaggaactcttccgcgagccgcttttcggggattttcaggtcatcttcgggaaggaaagggagtaggaagaggaatgataaggggtggcctgagtgtgatgccttgattacctttgtggttgtcttcgctgtgttttgtttgatcatttggggtgctagcaggccttacaaggcacaaattgctgttaagagtttgacggtgcataatttctatgttggagagggttcagacttcacgagtgtccccacaaaaatgctgacagttaatggcactttacgcatgagcatctacaaccctgctacattgtttgggatccatgtgcactccacacccatcaatcttgttttctcagacatcactgttgctactggcgagctgaagaaacactatcagccaagaaaaagtcaccgcattatatcagtgaacctagagggtactaaggttcccttatatggggctggatccaccataactgtatcccaaactggcgttgaagttggactcacattgaactttgaaatccgttcgcatggaaatgtg

SEQ ID NO: 87486 - DNA, 651 bp, Glycine max
  Peptide Sequence Number=SeqID_204264
atggatgtagagatagcagtttacttagcattctttgccttgtatactgttggtgtcgacccgctcaattttgaagaagctgtgaagattggaaaatggagaaatgtcatggatgcagagattgcggcgattgagaaaaatggcacctgggaattaattaatctgccaacgggagctaaattagttggagtaaagtgggtttacaagactaaactcaatgaaaagggagaagttgacaaggttaaagcaaggttggtagtgaaaggatatgttcagcagtatggtgtagattacagagaagtttttgctctggtagctcgtatggaaactgtacggttgaaggggaatgaagaaaaggtgtacaaattaaagaaagctctttatgggcttaaacagactccacgtgcttggtacagccgcattgaagcatattttgttaaggaaggaaatgacaagtcgatgtttactaagtttaagaacttgatgatgtttgagtttgacatgactgatcttggtaaaatgaagtattttttggatcttgaagccttgcagaaatcaagtggaatctttatctgtcaaaagaagcatgttgaggagatgttacaacggtttgggatgaataatgcaactcagttcaaactccaattgtaa

SEQ ID NO: 87487 - DNA, 993 bp, Glycine max
  Peptide Sequence Number=SeqID_204265
atggggatgatcaatgtgagcattgcggggttggatccccagatggctgcagaaaaagctgtgaatgtgattggtcaagggtatgatctttgcagcgatataaagttctcggcttgtagaaacaggttgatagagatcgacaaaacgcatagtagagaccttgtttttcccggtggggttgttgtttccgatgttcccagctccatcaagtgtgacaaaggtgaacgcaccaggtttcactctgatgtgctcccttttaatcagatgtctgagcatttcaacaaacagatatccttgtctggaaagattccatccggccaatttaatatcatgttcaacatgaaaaaatgttggcctacagacgcagcttctactaaaaaccttgcctatgatggatggttcataacattatataatgtcgaattagatagaaccaacataaccctttctgaaagtgtgaaaaaagatgtgccttattcatggaaccccgcagctcttgctgagttcattgaaaaatatggtacccatataatagttggggtgcagatgggagggaaggatgtggttcatatcaagcagacaaaaaattcagatttacagcaggccgaactgcagaaattgctaaagcaattagctgatgagaggttttctgaggcttcaaatcatagttctaatgtcgatcctgctgacaaatcaagaaaagtaaaggataatcgtgctaagatgtgggggtccaaaccgattcctgttgctggcaggccagttgatattgtgagcatttctgttcgaagagggggtattgataatggtcaatcttacaaccaatggctttcaaccatatcacaatctcctaatgtcatatcaatgtcttttgtgcctattacttccctgctgaattctgttcccggcaatggatttttaagtcacgcaatgaatttgtatcttagatacttgatttctatacgtcgtgatcaagatatctccggggagtaa

SEQ ID NO: 87488 - DNA, 531 bp, Glycine max
  Peptide Sequence Number=SeqID_204266
atggtgcagcgtgcaccgcagtggcacagaatgaaaagagatagagatagagataaatatatggtagagaagagagagtgtgagtgcagtgatagagataagaaaatgtggcttgtgcagctctcaaccccatttctgaacggacatggtcattccaccacccttctctccaagcacagttcggcggtgactcagacccactgggccccaccgagtttcctgcctcaaatcaatgcgatgaagacaatgcaggggagagtggtgtgctccaccagcgacaagacggtggcagtggaggtggtgcggctggcccctcacccaaagtacaagaggcgcgtgaggaagaagaagaagtaccaggcccacgaccccgataaccaattcaaagtcggcgacatcgtccagctccagaagaccaggcccatcagcaagaccaaggcctttctcgcactccccgttcccaaaaggccctccagcaggcccgaggcccagcccgaggaactttccattcccttcgagtcccagccctag

SEQ ID NO: 87489 - DNA, 1605 bp, Glycine max
  Peptide Sequence Number=SeqID_204267
atggttcgagctggggaacaagagcaggaaggttacaaggccaaactgtttaatttcagagggatatttgagggcactggtaggcttactaagagccttagcgttgacactgctaccgtattggaacctacagaagatggagcagcgtcatcaagaagtcaaggatcaaagcctcttaatgatttagataagatgattcccaaagcaagggtaataagcaaggaggaaatttcagtgaaggaagccaaagagaagctattgcaagatatggaacagatgaaggagagattttccaaactgttgttgggtgaggacatgtccggtggaggaaagggtgtttcgtctgctttggcactgtcaaatgctttcacaaaccttgctgcttctatttttggtgaacaaaagcgcctagaaccgatgccggcagaaaggaaagcaaaatggagaaaagaaattgattggcttctatcagtcacggattacgttgttgaaatggttccttcacaacaaaagtctaaggatggttcaaatatggagattatgacgacacgacaacgaacggacctccacatgaatgtccctgccttgcgcaagcttgatgcaatgcttcttgaatgtctagataatttcaaagatcaaaatgagttctattatgtgtcaaaaaattcagatgattcagatcaaggcagtgccaagacaaaaaatgatgataagtggtggttacccacccctaaggttcctgcagaaggtctatctgatatggctagaaaatttctgcagtatcagaaagattgtgttaatcaagtacttaaagcagccatggcaataaatgcccaaattctaacagaaatggagatccccgaaagctatattgactctctgcccaagaatggaagagcaagtctaggggactcgaactacaggagtataacagttgaattttttgatcctgaccagttcctatcaaccatggacttatcatcagaacataaaatcctagatctcaagaatagaattgaagcatcaatagtgatttggaagcgaaagatgcaccaaaaagattccaaatctgcttggggttctgcagtgagtttggaaaaaagagagctctttgaagagagagcagaaaccatattacttctcttaaagcatcgtttccctggccttcctcaatctgcattggatataagcaaaatccaatacaacagggatgtggggcaagctgttctagaaagctattcaagagtattggaaagtttggcttttacagtactttcaagaatagatgatgtactccaagctgattatcaaattcaatctcaaaatctatcagggagaaggagaagctcagtttcaaggccttttagagaagagatagacaaggctagtgcagaagctggttcaatgacattatcagattttatgggttggggctctgatcaaggtgaagcagacatgaagaaggacccctatgcaatttcggatgacttatgcaaagacgatgatgatccaaagcaacaaaaacttccaaccatagtgaccaacaagaaggtgtcatacctggagaccttgggagtcatgagaagcccaacatcgcgtcattaa

SEQ ID NO: 87490 - DNA, 1068 bp, Glycine max
  Peptide Sequence Number=SeqID_204268
atggtttccctcaaaattatacttatagaggaggaaaagacaatcaaggcaattctgcatggttatccacttggacataggctccataattctcaaagctcaaacatcaataatgtcaatgctatgaaagaagaaggtgacaactcaactctaaatcaaaatcaagatgcacagaatgaagatgagccacagatcatgtcaggatgggtacagttgaatatgaaggaaggcttttacaaactcaagatgtctcctgtcaagtctgagtacaatcctgattcaatttgtcctattatctctagtgttttagccttttcatctgctatcaatcagtggtattttaagaaattggatgtgaacaatgctttcttacatggtgatctaaatgaagaggtgtacatgactcttcttcaaggcatgcaagtggcaaaaccaaggcaagtttgcaaacttcaaaggctatcatctttcttgatttcacatggattcaaacagtgtgcttctgatcattcattgtttcttaaacatggttacaagacaatcactgctctgctggtctatgtagatgacattgtcttatcgggtaatgatctagctgagattcaaagcattacacaactattggacaatgctttcaagataaaggacttaggtgatccaaggtattttttaggcttcgaagcagccagaaaatctattggtatcaacctgtgccagagaaaatatgcattggacattttgagtgatgttgggatgcttggatctaagccaatatctactccttctaattatactaccaagctgcatcaacattcaggaactcttatttcaatggaagatgcttccttttttagaagattaattggcaaatacctcaagggaactccaggggtagggatctctctttctgttgcaagtaatattcatttaaaaggctttagtgatttagattgggcaggttgcattgacaccaaaagatctatcattggctatgcaatatacattggtgattcatttatctcgtggaaatccaagaagcaagccattgtgtccaaaagttcatcatag

SEQ ID NO: 87491 - DNA, 2688 bp, Glycine max
  Peptide Sequence Number=SeqID_204269
atgggcgccgacatgtccaacaataataatcctcctcccacttctcacgccaaagacttgtttgcttctccagctctctctctcagcctcgctggcatttttcgccatgctggggtggccgcggctgatgaggctgccacttctgtggaggagggcgaagaagggagtggaggagctgctgagaggttagaggagattagcagcgagaactccggccccacgagatccagatcagaggatgacttcgaaggaggagaagctgaacctgaagatgatgacgatgcccatggagacaacaagaacaagaagacgaagaagaagaggaagaaatatcacaggcacactgctgaccagatcagagaaatggaagcgcttttcaaagagtcaccacatcctgatgaaaagcagaggcaacaactaagcaagcaattaggccttgccccaaggcaagtcaagttttggttccaaaatcgtcgaacccaaatcaaggcaatacaagagcgtcatgaaaattctttgttgaagtcagaaatagagaaactaaaggagaaaaataagagcttacgagagaccataaacaaagcttgttgccccaactgtggcgtgcccaccacaagcagagatggtgtcatgccaactgaagaacaacaactacgtattgaaaatgccaaactcaaagctgaggtagagaaactccgagcagctttagggaaatacgcaccagggtcaacgtccccttcatgttcttctggccatgaccaagagaatagaagctctttggatttttacactggaatttttggacttgataagtcaaggataatggacatagtaaaccaagcaatggaggagctcattaagatggctaccgtgggggaaccattatggcttcgtagcttcgagactggtcgcgaaattcttaactatgatgaatatgttaaggagtttgcagttgaaaattcaagcagtagtggaaagccaaagagatccattgaagcctcaagagacactgcagttgtttttgtggatctccctagtcttgtccaaagttttctagacgtgaatcagtggaaggaaatgtttccgtgtttgatatctaaggcggcaactgttgatgttatatgcaatggagagggtcttagcaggaatggtgcagtgcaactgatgtttgctgagcttcaaatgctgactcctatggttcccacaagagaagtctattttgttcgtttctgcaagcagttgagtgctgaacagtgggcaatcgttgatgtatccatagacaaagtagaagacaacattgacgcgtccctcgtgaaatgcagaaaacgcccttctggttgcattattgaggacaagtccaatggccattgcaaagtaatatgggtggagcactcggaatgccagaagagtgcagtccattcaatgtatcgcaccattgtgaacagtggcctagcttttggggccaggcattggattgcgactcttcaacttcaatgtgaacgtctagttttcttcatggcaacaaatgttcccatgaaggattcaaccggtgttgccaccttggccgggagaaaaagcattctgaagttggcacaaagaatgacatggagtttctgccatgcaattggcgcgtcaagcatccacgcatggactaaggttacaagtaaaactggagaagacataaggataagttctagaaagaacttgaacgatcctggtgaacctcttgggttgatattgtgcgctgtttgttctgtatggttgcctgtctcacctaatgttctgtttgatttcttgagggatgaaaatcgccgaactgaatgggacatcatgtcaagtggtgggacagtgcagtctattgcaaatttagccaaaggacaagaccgaggcaatgccgtagccattcaaacaattaaattgaaagaaaacagtgtgtggatactgcaagatagctgcacaaacctttatgagtcaatggtggcatatgcttgtgtggacattactggcattcagtctgtgatgacaggatgtgattctagcaatcttgccatactgccctcaggattctccattattcctgatggtcttgagtcaaggccattggtgattagttcaaggcaggaagaaaaaaatactgagggaggatctttgtttacaatggcattccagattcttaccaatgcttctcccacagccaagttaacattggaatctgtggactcggtcaacactcttgtatcttgtacattgagaaatatcagaacaagtttacaatgtgaagatgggctgggactcgaagggaatggaaagttcctcgggctgggcctcgggcctgctggagggccttttgggaacggggagtgcgagaaaggccttggtcttgctgatgggcctggtcttctggagctggacgatgtcgccgactttgaattggttatcggggtcgtgggcctggtacttcttcttcttcctcacgcgcctcttgtactttgggtgaggggccagccgcaccacctccactgccaccgtcttgtcgctggtggagcacaccactctcccctgcattgtcttcatcgcattgatttgaggcaggaaactcggtggggcccagtgggtctgagtcaccgccgaactgtgcttggagagaagggtggtggaatgaccatgtccgttcagaaatggggttga

SEQ ID NO: 87492 - DNA, 354 bp, Glycine max
  Peptide Sequence Number=SeqID_204270
gtttgcacccagcagtcttggaaacacccttatggagttggacacctggtagctggattagatgaatcaggagctcacctctattacaactgtcccagtggaaactattttgaatatcaggcttttgctattgggtctcgctctcaagctgcaaagacatatttggaacgcaagtttgagaatttcgtgggttcttcattagaagatctgatcaaagatgcacttattgcaactagggaggaggaagaagccgcaccagctgaagaagaagctcagccagcagccgaacaggatgctcccacagatcagggtgctgctgctgtagaccaaggtggttctcctatggacatctga

SEQ ID NO: 87493 - DNA, 225 bp, Glycine max
  Peptide Sequence Number=SeqID_204271
atgcaggccactgaggatcagaaaattcaacagaatgaacccattggtttaattgctccaagttatgaagctgatacgattccgcaaatagggaatccatggagcactggactatttgactgtcatgagaatcagacaaatggttgtcatctggggagcttcatttacctattaatgatgcctgcttgtgctctcaatggattatggggtcaaagtaccggataa

SEQ ID NO: 87494 - DNA, 573 bp, Glycine max
  Peptide Sequence Number=SeqID_204272
atggttggtccaaattggagggttactatctccaatattgaccgtgaagctaacagagctactgatttcttggcgaatcttggtcattatagcacttcagttccatttgcgttagagcccgggaaacaactccacgcccgattgtgccaattgggtattgcttacaatctagatttggccactaaagttgtcgatttttacagcgtctgcaactctctgtggaatgcccatcacctgttcgacaaaattcccaaagggaatttgtttctgtggaacgtcttgattcgggcttatgcgtggaacgggccccatgaggctgccatttcactctaccatcagatgcttgagtatgggctcaagcccgataatttcactctcccatttgttctcaaagcatgctcagcgctctccacaattggagagggaaggatcattcacgagcttgtgatacgatctgggtgggaaagggatgtgtttgtgggtgcagctcttgttgacatgtatgccaagtgtggttgcgtggtggatgcacgtcacgtgtttgataagattgtcgagagagatgctgtgtga

SEQ ID NO: 87495 - DNA, 3105 bp, Glycine max
  Peptide Sequence Number=SeqID_204273
atggcgtggtttagtgggaaaaatacatgggggaacttccctgatttggcaggagccgtcaataagcttcaggagagtgtgaagaatattgagaagaattttgattctgctcttggattcgaagagaagggtgaatccagcaatgaagatgccggatcatggcctatacctgctgacaggaaaaccctatttaatcccgtcatctcttttatggggaacaaaagtgaggaaactactgaggaaatgtctgaaaaagacgaatcctctcaacaagactctgaaatggagaagtcactggaacagcccgagtctctggatcatacatctgtggctgagggaagcaatgcccttgaaactgataacacagtccatatggaagctgaagaaaacacaacaaaagaagaaaataaagttcttaaggaagaagaagatggcgagcatacagagtcagtggatggaacagttgcacagaacttggatcatggaaaggaggaaaaccatttactggagttgcctgttgaattgcctgaatcccctgttgagaagtttgagagttcagattctgtggaacattctcaagagaaagagattgctgatccgggaacctctgggagtccagtgtcagtgcaatttatgccttctaatcttggggacaatgtagttgagggtattactagggagtctgatgaatcacatgacattagtgatgggcatgaaaattctcaagttgagacaaaagaggagagtaaagaagaagagagggtccaagcagaagaaagtgaaaagagaatttcttctgttcaacccaaagcatcaactgatagtgagaaaggagatgatactgacacttctgttctccaatctgtggcttctgaggaaaccaataacactgatcaatcaaatattgaacacttgtccagtgttactccaccaaatgaatcttctaaggtggtaactgatatgttttcacctgaaaatgaaacatctgcaaaagaaaatgaaagggagcactttgcccatgatgttgaaactgatatgaaagagcatcatttgagttctgaaagaactatgtctgactcaggttccatgcttgaactagagagggtgaaaagggagataaaaatgatggaagctgcactgcaaggtgctgcaaaacaagctcaggctaaagctgatgagattgcaaaattgatgaatgaaaatgaacaattgaaagctgtgattgaggatttcaagagaaaatccaatgaggcagaagttgagtctttgcgagaggaataccatcagagagttgcaactcttgagagaaaggtttatgctctcactaaggaaagggatacactccgccgagagcagaataaaaaaagtgatgcagctgctctcttgaaagaaaaggatgaaataattaatcaagttatggcagaaggttcccttgatggaattgcacttggtttggtgatggaaattgatggggattatgtggcttctgttttgtggggaattcagcatgtcaattctacttgggtttggaacaattctgttggaggtgaagagctttccaaaaaacaggctgctcaagaatccacaattaggaaactaagggctcagattagagattttgaggaggagaagaaaggtttgactactaaacttcaggtagaagagaataaagtagaaagtatcaagagggacaagacagctacagagaagttgttgcaagaaacaatagaaaaacatcaaaatgaaattgcagcacagaaagaatattatacgaatgctttggctgctgctaaggaagctgaagcattagcagaggctcgtgcgaacaatgaagcaagaactgaactagagagtcgtctgagagaagctgaggaacgtgaatctatgctagtccaggcacttgaagaattgaggcaaacattaagtagaaaggaacaacaggcagtcttcaaagaagacatgcttcgcagagacattgaggatcttcaaaaacgttaccaggcaagtgaaagacggtgtgaggaactgattacgcaagttccagaatccacaaggccacttttaaggcaaattgaagccatgcaggaaacaaatgccagaaaagctgaagcttgggctgctgttgaaagaactcttaattctcgacttcaggaagcagaggctaaagctgcaactgcagaggagagagagcgatctgtgaatgaacgcttatctcagaccttatctcgaattaatgtccttgaggctcagatttcatgtcttagagcagaacagactcagttaagtaggacccttgaaaaggagagacaaagggcagctgaaagcaggcaggaatatcttgcagcaaaggaggaagctgacactcaagaaggtcgtgtgagacagcttgaggaagagattagagacattagacagaaatacaagcaagagttacaggaggcattgatgcaaagggaacatcttcagcaggagatagaaaaagaaaaggctgctcgatcagagctggagaagactgtacgtgctcaatctgcaccattatcagatcaaactcctactacaaagctaaattctgcttttgagaatgggaacctgtctcggaaactctctagtgcaagctccctgggaagcttggaagaaagccactttctgcaagcatcgttggactcctctgatggtatatctgagaggagaaacccaggagaattaaacatgagtccttactatgtgaaaagcatgacacccagttcttttgaagctgcacttcgtcagaaggagggtgaacttgcttcatacatgtcacgcctggcatcactggaatctattcgcgattctcttgctgatgagttggtcaaaatgacagaacagtgtgagaagttgcgtggggaggctgctgtattacctggcttacgatcagagctagaagcactaagaaggaggcactctgctgctttggaattgatgggtgaacgtgatgaagaggaacttcgtgcggatattgtagacttgaaggaaatgtacagagaacaagtgaacttgctcgttaataagttcataaccttgatgcaccttttcacagatccagactatgggtccatcaatgggtag

SEQ ID NO: 87496 - DNA, 1311 bp, Glycine max
  Peptide Sequence Number=SeqID_204274
atgaggctcagcagcatggaagcaactgcgtgttccccctctctctccttcgcgcccacgagtagtaaacttgaacgaagacgattttccaagcgtgacccatttgctctgcgcttaagctgcggggctcgtcaaaatgttcattcaaaaccaaccaataccctttggcgtgaagattttgggtatacaggaggcatagctgccaatgcaactcttccaagcctcattaccccaccactcaacactcttcgctatttcccctggtctgaaggtccacaaaattgctacaacattaacaaagtgccaaagggtcactactcaatcaggatcttctttggacttgttggtcagtctaaagatatcagtgagcctctatttgacatttctattgaaggcacgcaattatattctctgaaaccgggttggaactatcagattgatcaagtatttgctgaggcactggtgtttcttacaaatgattcggtctcaatctgtttccatagcactggtcatggggatccagcaatcctttctattgagattcagcaaattgatgataaggcatattattttgacccccagtggagtcaagggataatacttagaacagttaaaagactgagttgtggttttgggcagtcaaagtttgatgtagattatggaggggattccaggggaggggacagattttggcaacacattaaaagttttggcgaggaatatgaatctgatcagcctagatcagttgaaactagaatcaaacatgcttcacatccaccaaacttctatccagaaaccctttatcagtcagcgcttgttagtactgatagtcagcctgatttaacttacacattggaggtggatcccaacagaaactattctatttggttacattttgctgagattgataattcagtgactgctgcggggcaaagagtcttcaatattataataaacgatgatcttgttttcaaagatgttgacattgtagaattgagtggggatatctataatgcccttgtgcttaataccactgttactgttaatgggaggattctgacaataatattgaaaccaaaggaaggtaatctcgccataatcaatgccattgagatatttgaggttataatggccgagtcaaaaactatatcagaggaagttagtgctttacaaacattgaagaaggcattggggcttccacccaggtttgggtggaatggtgatccttgtgttcctcaacaacatccatggattggagtggattgccaattaaacaaaagtagtggaagctgggtcattgatggactgtaa

SEQ ID NO: 87497 - DNA, 1734 bp, Glycine max
  Peptide Sequence Number=SeqID_204275
atgtccgagtggttaaggagacagactcgaaatctgttgggctttgcctgcgcaggttacgcagtgaagagggcggaagagcatcaaattaacaacttctggagaagaagaagaatgtggacgcggatactcgcacgagcaacacgtgctgttgccgttgccggcaactattcactcattaatcaacccatctctgaccctatctttctcaaaatccccaaatcaacttttccccaaattttcaataaccctcgatttttggtcacctccaacctcgacaatgagctctcaccggattcttcagtgaacggcggtgacagacagctcgcagaacaagaagaaggaggaggaggaggagacacgtacgaggttgattccgacacgttggagagtgtgctacgtcttctccaaaccagcgctgatgggtcccttgagtcgtgtttggatgacatggatttgacactgcaccagcaattggtaacgaaaataactgaaactccgtttgttttgagtgagaatctgataaggtttttctggtgggcatggagtgagagatcattggaagtgacaaccccaatggtggagtctcttgttttggccatatgtggaaatgatgatgtgaggaagaagaaagaggtggtgtactcgttgtgggacttggttaaggagattggagagaaggagagtggactcctcaatgtcaggattctcaatgagttgattagttccttctccaggttgcggaaagggaaggctgcattggaggtgtttgataaatttgaggcttttcactgtgtgcccgatgcagacacttattactttacaatcgaagcgctttgtcggcggcgagctttcgattgggcctgtggtgtttgtcagaagatggttgatgcgcggacattgcctgatgctgagaaagttggcgccattttgtcttggttgtgtaaagggaagaaggctaaggaagcccatggagtgtatgtggtggcaacagagaaagggaaactgccacccgttaatgtggttagctttttggttttgaagctttgtggagaagatgaaactgtgaaatctgctctggagatcttggaggatatccctgaggagaagagggagcgggcaataaagccgtttttggcggttgtccgggccttgtgtaggattaaggaagttgataaggccaaggagttgttgttgaagatgattgagaatgggccaccgcctgggaatgctgttttcaattttgttgttacggcgtattcgaaggctggggaaatggggaaagctgtggagatgatgaggttgatggaaagtaggggcttgagaccggatgtgtacacttatactgttcttgctagcgcttattcaaatggtggggagatggaagaggctcagaagatcttggcagaagcaaaaaagaagcatgttaagttggggcctgtgatgtttcacactctgattcgtggatattgcaagttggaacagtttgatgaggctttgaagttattggccgagatgaaagattatggtgtccgtccaagtgttgatgagtatgacaagttaatacagtctctctgcttgaaggctttggattggaaaatggcagaaaagctacaggaggaaatgaaagagagtggtttgcatctcaagggcatcacgaggggtttgattagagctgtcaaagagatggagaaggaggttgtggaggctgagagcattactgcagtggtgtaa

SEQ ID NO: 87498 - DNA, 552 bp, Glycine max
  Peptide Sequence Number=SeqID_204276
atgggcacacgtcaaggaaacaaaccttcctctaaaaaatctcatgctgcagaagatagcatttcagctgactcactctcttttgcaggcctagtttctattcaagaccagaattcaaagcctcctattcctaaccacaccacacactactacaaggtaagcaagcaagacttagattttgaattttccaccatacaagaacacctaaattctggttccaacccattcaagatcacacctgctgatgtgctcatttccaatggaaaaatcaaaccatttcaaccaaatcgacctgtcctcacagatccccccatttccttaagatcattgctagctattgatcatgccaataatagcaagatgtcaaatgtgcaacaagctagaaaatatgatgagcaacgtgtcaaagcaagaatccacaaaagcaaggaaaggagtagtagtgtgacaagaacttggtttggccacaaagtgtttaggtcttttctatctccatgcaggaaatgccaagccactcagccaggtgccgttaaaggacaaagtgtgaaatga

SEQ ID NO: 87499 - DNA, 843 bp, Glycine max
  Peptide Sequence Number=SeqID_204277
atgcccttctttctcctcaagaactccttaggagcaaagatgaagaaaggaatcaaaaccttctgcaacaacaacggttcgacctccactctcaaccaacaaaacagccacaacaacaacagtgacttcacaagcaaggtaagctcatcaaactcaccaaccctagaggatctaatactacaactagagttggaggaagaaatggcaagaaaagcaaagcttaataatattagtgagtatagtggaataatgaggggtaggatgtcatgtgtgaacaactcagacatactgagatctgcaaggaatgcattgaatcagtatccacggttttcgctcgatggaagggacgccatgtaccggtcatctttcgggaacattgagggaaggagatcagtttgcagcgagataagtcttggaggaaagaaagagaatgatttagataataataataatcataagggtatgtgttttttgcctccaacacttgctggggagagtgtggtgtggcaaaaacctggggttgtggcgaagttgatgggtttggaagccatgccagtgccaataggtagtagcagcagaatatcatgtgagaataataataaagagaagttaagtgctgttgttaggaggcagaatctaataaggaggagatttgagaggcatgacttggagagaaagctactaacaatggagatgcagcatcagggttgtggttataataataataataataataataataataatagaagacacaccaacaataataatggttgctctaataatgggtattgtattatgaaaccggtttgctctagaggctctggccggggtcctggctag

SEQ ID NO: 87500 - DNA, 435 bp, Glycine max
  Peptide Sequence Number=SeqID_204278
atgaagcaagcaatttgtggaatcatccatatctcatttggtgaggaggagaatgtttctccaaaaaagcccacttccttgctagagttggccaagcaacgtgacctaagtggaactttgcaaagtgaagactgtatattgaaaaagcaactctctgatgcaaagtgcaatgagcttagcgggcatgacatatttgctccgccaccagaaatcaaacccaagccaataactcctcgcatactggagttgaaaggaagcataaacattggagaatgtcagcaaaggccattaattaagggagtgttgctaggtgcacccagcattattgctggtgcacccagcattcttgaaaaatgccaaaattacccttacttagttttccacttccgaatcagcttgatccgtaagtctcttccggatcaagttaatccataa

SEQ ID NO: 87501 - DNA, 1326 bp, Glycine max
  Peptide Sequence Number=SeqID_204279
atgatgcacaaagagatagaagtgtacgtggatgatatgattgttaagtcaggcactgaagaagaacatgtcgagtacttgctgaagatgtttcaacggctgagaaagtaccaacttcgactgaatcccaacaaatgtacctttggtgttagatctggaaaactcttgggtttcattgtcagtcagaaaggtattgaagtagatcctgacaaggtcaaggccattagagaaatgccggttccacaaacagagaaacaagtgaaaggttttcttgggcgtctaaattacatttctcgtttcatctcgcacatgacagccacgtgcggacctatattcaagttgcttcgaaaagatcaaggggttgtttggaccgaagattgtcaaaaggcttttgatagtatcaagaattatctgctagaacctccaattcttatacctccagttgaaggaaggcctctgattatgtacttgactgtgttagaagattctatgggctgtgtgctcggacaacaggatgagaccggaaggaaagagcatgccatctactacttgagcaagaagtttacagattgtgagtccaggtactccctacttgagaaaacttgttgtgcactagcctgggctgccaagcgtcttcgtcactacatgattaatcacaccacctggttaatatccaagatggacccgatcaagtatatctttgagaaacccgctttgacaggaagaattgctcgttggcagatgttgttatccgagtatgatatcaaataccgcacccagaaggcaattaaggggagtgttcttgcggatcatttggcttatcaaccaattgaggactatcaacccatcaagtttgactttcctgatgaagagattatgtacttgaagatggaggattgtgatgacccattgcttggagaaggtccggatcccgagtctagatggggtttgatttttgatggagcagtgaatgtctttggcaatggaattggggcagttattatcactcctgaaggtaatcatctccctttcgccgcaaggttacagttcgattgcaccaacaatatggcagagtatgaagcatgtatcctgggcattgaaaaagccatcgacttgagaatcaagaaccttgacatttacggggattcagctctcgtaatcaaccaaatcaaaggagaatgggaaactcgccaccccggtttgattccatacaaagattatgcaaggcgtttgctaaccttcttcaacaaagtggagcttcaccacatccctcgtgatgagaaccagatggcagatgcgttagcaactttatcctccatgtacgaa

SEQ ID NO: 87502 - DNA, 216 bp, Glycine max
  Peptide Sequence Number=SeqID_204280
atgaatgaagcacgaagaagaccaatgaaggtcacgaagaagacgcagccaagctttttcgagaggaagaagaaggattcgaagaaggattcgaagaaggatgcgaaggtcaccaatgaaggtcacgaagaagcaacaatggcgaggaagaagaggaatggtgaggaagaggaagaagcagcagaaatcgcgaagaagaagaaatggcagaaatga

SEQ ID NO: 87503 - DNA, 841 bp, Glycine max
  Peptide Sequence Number=SeqID_204281
atggatcaagaagacaacaagatgggcactgtgaatcctcctgaaatgtcttctaatcctctgtcattaggaaaagatgagacaatgggcactgagaatcctctgtcatcaggaaaagatgatgtggtgggtaccgagaatcctccagaagtgtcttctaattctctttcatctgcaaaagatggtatggtggatgctgcaaatcctactaaagtgtcttctaatcatacgccttcagtaaaagacaatatgatgggcactgagaatcatccatcatcaggaaaagatggtgagatgtgtgctgagaatcctcctgaagtgtcttccaattcaccatcatcaggaaaagatagttttatgagctctgtgaatcccactgaagtgttttctaaccctccatcatcaggaaaagatgatatgatgagcactgagaatattcctgaagtgacttctgatcatcctacttctggaaaagatgacggaaagaaggaaactgatcctcctgaaggatctagtaaactagagttgagtgacaagaatactccacaatcattgaaggcaaaatctaaaattgttaagaaatctcaagctgttaaacttaaggcgaagaagaacaatggttctaaacaaatttgtgggaaaataattctgagttcaaaagaagtggtgtgcaatgctgaaagttgtcacagtgcagatgagaaacaaatttcagacaatagtgagctgaagaaaactaatgatgagccacctaaggggaagagtgaggaggctgaaaataaaatgaaagaaagccaaaatatgagcactggtgacaaaagtcctaatgaagagtcagacg

SEQ ID NO: 87504 - DNA, 1553 bp, Glycine max
  Peptide Sequence Number=SeqID_204282
atgagaaacaaatttcagacagcagtgagctgaaggaaactaatgatgaaccacctaaggggaagagtgaggaggctgaaaataaagtgaaagaaggccaaaatacaagcattagtgagaaaagtcctaaggaagagtcagacgttagccagctgaaggatactgatcctcctgatggatctagtaaactagagttgagtgacaagaatactccacaaccattgaaggcaaaatctataattgttaagaaatctcaggctggtaaacttaaggctaagaagaacaatggttctcaacagattcgtgggaaaagaagaattaagacttccaaaaaagtagacaatgctgaaagttgtcataatgccgatgagaagcaaattttagacaatagccagttgaaggaaactaatgatgaactacctaaggggaagagtcaggaggctgaaaataaagtgaaagaaagtcaaaacaggagcactagtggcaaaagtcctagggagaagagccagcaggctcaaaaggataagactagtcagttggataaggttgaacaaaaacaagagagtaaagagaagcatagggagttaagcaagggttctagcagtagaaaaaacaaaggtaagagtagtggcatggaaaggagtcaattaaaaggcgagaagggtgaaaaaattggtggtttcatctttttgtgcaatgcaaagacaaagcctgattgtttccgctatcatgtcatgggtgtttcagctggtaaaaaggatgatgttttacaaatcaaacctgggcttaagctttttctttatgattttgatctgaagctattgtatggcatttacaaggcttcatcttctggcgccatgaagcttgaacccaaagcttttggtggcaaatttcctgctcaggtgcggttcaaaattgcttctgattgtttcccattacccgagagcattttcaaaaaagccatcaaggataattataatgaaaagcacaagttcagaacagaacttaccgttagacaagttaggaagctcactcaacttttccgaccagtcggaattcattcagctgtgcaccctgtgcattcccaaccaaaagtaattattcgggaaagggagattcattcagctgtgcaccctgtccactcccagccaaaaggagactatcaaccccatcacctggaccgtggctacccaagaaatgcccctgctcatgtagaaagtcttcgaactgatcctctttatttggatggcagtagggatccttatcatgcctatcgccgtggtgtttcacctatggatgcatattttgcacctttaagtagggaagaaatttctccaaactcttatttggttgggggaagaccttttgttgggacggataacttgccaaagagagaggctgttcaagataggtgttacccaatatattcggctcctgatgctttgtctgatcatcatcgaaggcggcaatatcatggagacaagttggaagcttcaggtgggccagtttcatctcgttactcttttgctggcccttcatttcaccgccaataa

SEQ ID NO: 87505 - DNA, 237 bp, Glycine max
  Peptide Sequence Number=SeqID_204283
atgttcattctagtcctaattgcgataaactcattccttacttctaagcgggctcacgtgtctattctaacagtgattaggatttctccttccaaaaatattattttgcaaatcccaacggtgcaggaaaaagagagggttttgggaggaggagaagggaaaacaaaattgagagaaagaggaggcgtaggaggtatcatcagtttgaaaactgacctaagatgtctctatttatag

SEQ ID NO: 87506 - DNA, 279 bp, Glycine max
  Peptide Sequence Number=SeqID_204284
atggttgattccgcaatatgtgaaggtattctccggaaaacaaaagcagttatggaatgcatgcaccgcttctgtggaaagtgcatagagaaatccatgcgtcttagtaacaatgaatgtcccgtttgtcgtgtacactgtcctagccgtcgatcacttagagatgacccaaattttgataatataattgctgctatatatccggatattgacaagtatgaggaggaggaggaattggcaatgtatgagagtgaaaggactcataacaaagaggtatga

SEQ ID NO: 87507 - DNA, 408 bp, Glycine max
  Peptide Sequence Number=SeqID_204285
atgtcaccaaaaaggctccctcaccaaacttcagcaaaacttgctcttagaaacaaccatgagcaaccccaagacgaagtgcaacccgaagaaattgatcaaagttgtttgctgagcgatgagtacaaggatgagaacaaagacaaaagcttgtcagatgagagacaagagtttgagaaaaaagtaatagcaacacaaagtctccctcaagagactccaacagagattgctcccagaaatgaccacgagcaactcgaagctgaagtgcaacctgtagaagaagttgacttagatcaaagttattcgatgagtgagggggacaaggatgaggatggggatgaggatggggatgaagatgaggatgaggaagagtatgttaagttgatttgtcattcaaaatttctctag

SEQ ID NO: 87508 - DNA, 465 bp, Glycine max
  Peptide Sequence Number=SeqID_204286
atggaccttggagggagtcctttgtaccaggttaaagtcgcccctttaagggacatttggaagagacgacacatgattgggtcatcgttggtgtatagattcgcctgggtaaggaatacatccagatgttcatctggattagcggttcaatcgtaccgttctaggttgagtggtttccaacctaggggtatgttagcttctatgatgtggtcgacaaaagggtgtcaacaagtagttttcccttcaggacggtgtatgtgggaaagactaggatcgtcttgggtgttgacggtgtgtcagggactacaagataaattttaccgcggccccacggtgggcaccaattgcacttaccaaaatctggagctatcccacgttaggatggacatggccgagataggttccatgatctcgcacgtcggactgagagtatcctttgttaagaggacaagagtggggacatga

SEQ ID NO: 87509 - DNA, 132 bp, Glycine max
  Peptide Sequence Number=SeqID_204287
atggcggagatttcaagttcaggttacaaggaatacgtggccggtttgtccgctggtgttgccgttgtagccactggccacccctttgataccgtcaagttaaagatagtgtctgggattgtgttgagctag

SEQ ID NO: 87510 - DNA, 579 bp, Glycine max
  Peptide Sequence Number=SeqID_204288
atgatagcacttcatttttcccgattcggcagtttgatctatgctatgatttatcattcatggacgttgataagatccttccatctagcagcccccttaggatggcatagccttaaagttaagggcgaggttcaaacgaagaaaggcttatggtggatacctaggcacccagagacgaggaagggcgtagtaaagcgacgaaatgctttcggggagttgaaaataagcgtagatccggggattcccgatataggtcaacctttcgaactgctgctgaatccacgggcaggcaagagacaacctgaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccgtga

SEQ ID NO: 87511 - DNA, 603 bp, Glycine max
  Peptide Sequence Number=SeqID_204289
atgggatttactttggtagaccttcataaggttgcttacaaggacaagcctttcatcatggtagaacaagcaaaacatgtgttttatgtccaagatccgtctgactcaagatggtcaatggttctacaaggaagaacaagttgtatcagtcaccaaaatgatgattcaacagttgatatttgtgagactccttctgtctacacacatatggctttcataactgaagaacatgaagtggatgatgtacacgcaaatcataatgatcatgacgaaggcttatgggagaacattcatacgcaactgcattatataaaaattcatggcaacaccactaaggtccccccttctttggaggatcctttagagtacaaggagggtcaagatgatcagactccttgtgaccagactacttgttttaagtatggtttggatccacagagatgggtggaatttgctgcaagctgcaaaacccctacttggcaaggaatcaaaaagaaggcttgggaaattcaaaaattcaatgattgtccatacatattgtctcgtgagggttatgagttgcttgagaagaaactcatggatgagaaaaggaagaatagataa

SEQ ID NO: 87512 - DNA, 117 bp, Glycine max
  Peptide Sequence Number=SeqID_204290
atgaagactgctaagagaaccatcggaatagttgccactaccgtgaccatagagaacaaccctacgatgccgaggatgaatccatcaaagatcacttaccttcgtgggccacgctaa

SEQ ID NO: 87513 - DNA, 450 bp, Glycine max
  Peptide Sequence Number=SeqID_204291
atggacacaagcaggtctgagggaaaaagggtcatgaggtacaaagaagaagatgatgataatgatgatgaagaagaagaagaggtggtgagtgagatgggttttgaagaagatggaaggaggaataagagagtaataagagatctctatggaaagagagggtccaaaggtggaggctcaataacaccttcttgccaagtggacaattgtgatgctgatctgagtgaagctaagcagtaccacagaagacacaaggtttgtgagtaccatgccaaggctccttccgtacacatggcagggctgcaacaaagaaagttagaaaacaatgacgaaattaatgtgctcagagccaataattctactactataacatttttcaccaaggtagggaatgatctcaaatcaatatcgatcttaattagcactaacatgataagacattgttggtaa

SEQ ID NO: 87514 - DNA, 866 bp, Glycine max
  Peptide Sequence Number=SeqID_204292
attttattgaacctgttattaatttcaggctgttggtttatgagtatgttaacaatggcaatttggagcagtggcttcatggagccatgcgacaacatggctttcttacttgggatgcacggataaaaattctccttggaacagctaaagcgctggcttacttgcatgaggcaattgaaccaaaagttgtgcatcgagatattaagtcgagcaatattctgattgatgaggactttaatgccaaaatatcagactttgggttggctaagttacttggtgctggaaaaagccacattacaaccagagttatgggtacttttggacatgatattatggaaattgaaactgcctctaactttctcattcctctttacatgtttgcattgcttttccccagatatgttgctccagaatatgccaattctggcttgctaaacgagaagagtgatgtttatagctttgggatattgctccttgaagcaattacaggaagagaccctgtggattatagccgaccagcagctgaggtaaatttggttgactggctcaagatgatggtggggtgtcgacgctcagaagaggtgttggatcctaacattgagactaggccatcgacaagtgcccttaagcgtgccctcttgactgctttgaggtgtgttgatccagatgctgaaaaaagaccaaggatgagccaagttgttcgtatgcttgaatcagaggaatatcctatactgcgagaggatcgaagacgccgaaggagtcaggcaggaaacatggaagtggagactcagagggagaattctgatactgataagagcgacaatccagattataagcccagtggcagaaggaaccaacgcatgtag

SEQ ID NO: 87515 - DNA, 213 bp, Glycine max
  Peptide Sequence Number=SeqID_204293
atgaaatacattgcagggaaaaaaatagtacttgaccaggagcaggagcagcaaatgaaaatgaaccatgacaaaacgccagaaactgagaatggtagaatgaacagtggatatgagtatgcgtgcaaatatgtgtatgtatgtgtaagtggtagtggtgcagcatctctatctatctcttggggaaacaaccagcaattttctaatcaatga

SEQ ID NO: 87516 - DNA, 231 bp, Glycine max
  Peptide Sequence Number=SeqID_204294
atggtttccatggatcttgtttatttgattgaagataatgcgcaaaggaggagaatcacagacattataagtgacatcatgtccgaggatactacaacaagtgttctaacctggattctcaagtatcttgaggatgaccataaacttcttgaagcaataaaagcagagaaaatgggagtatatgaagctaatgaaggagggagcatgccattgacatggggtcagacctga

SEQ ID NO: 87517 - DNA, 303 bp, Glycine max
  Peptide Sequence Number=SeqID_204295
atgaaggccaacataaaggccatgaaagagcaaatgaacacaatgatggaagccatgatgagtatgaaaaggatgatggaggtcaatatggctatagtttttgctgcaagtaccgccactgaggtggacccatctcacccttttagcctcaatcaagtaaatcgtcttgtctcagatatggttcagaaaaagcatttcttctcaccatgtggattgccttccatctatacaccacccaatgtcatacacgctcccaatgaaaatgtcgacaactccgaacccatacccattgagagccaataa

SEQ ID NO: 87518 - DNA, 348 bp, Glycine max
  Peptide Sequence Number=SeqID_204296
atgaccttatattctcctaaggtgtggatatggagcacactgaaaatgaggacgcgtagccctctaaaggcgagggcgtgcagccctctgcaggcgaggatgtgcagtcctctgatggcgaggacatatagtcctctaaaggtgataggtactagtacccaagggtccacctttatgagaaagcaagagatcgactcatcgagagggccggtcatccaacaagattggacacgagatattgactgtccttttgaaaaaggtgataattcatgcaaccttatcctatcttttgcaaatctctctgggaactccctcagagtgtatattctgcttgatttagtcacttga

SEQ ID NO: 87519 - DNA, 342 bp, Glycine max
  Peptide Sequence Number=SeqID_204297
atggggcactacagggtaacacataaggtggcctcaccttatcatccacagacaaacggtcaagctgagaccgctttcaaaactcccataggactgtccccatttcaaatggtctatggcaaagcctgccacttgccactcttggagctggaggaaatgcggctgaatgcttatgattcatccaagttgtacaagcagaaggtgaaggcctaccatgacaaaaagctgttgaagaaggactttaatccagaccaacaagttttgctctttaactcaagactcaagttatttccaggaaaactgaagtctaaatggtctgggccgtttaccatcaaagagtga

SEQ ID NO: 87520 - DNA, 528 bp, Glycine max
  Peptide Sequence Number=SeqID_204298
atggcccgcttagtggaagttgcagaccaatcagagctgcataactcgctaagtgcgcacctacgcgttaagcccaaaaacctatcggtgagtctcgctaagcgcccactagcgctaagcttacttccgtttcagttcatagtcgcgctaagcgtaattctctttctgtttggaataaggcttagcgagtcatactcgcttagccactgttatctttcggctaagtgcgctgctggcgttaagccattgttgcttttattttgttgtcgtgctaagcgcgccatgcacgctaagcgaccttcagttatttctatggcttctaaaaagagatgtgcctcatcttccaggccccaagagtcatatgagacatcccgatttgtctctaagattgcatgggagagatatgggacaaacattcatcagaggaacatcctcctagagaggaatgttgaattagcttactcgcattatgatgagttcctccaggagctggagtgccatcagtggcacaaaaatctcacacgctag

SEQ ID NO: 87521 - DNA, 423 bp, Glycine max
  Peptide Sequence Number=SeqID_204299
atggaggcgcaaaagggtgaagacattgtgcgcagtgtccatctcactggaatagtcgaagcttttttgtgtcatctcagattcctcacacacataccctcttcgtgtttggaaagggctgaaatttcgtttgagaaatgtgatcaaacacttggtgtgcaacaaggtatggatatggcatgtgttttatctgaggaagtcaagccatttttaatagaagatcacctgccaaacaatacatatgcagatcaaggagcaaaacatatctgtcaaagtcaagaattttatgggaagaaagggttggacggcgcaatggtggcgatcgacgacagtggtggtggtttccgttggagaaagggaagaaggggaaaaaggaaagaagaaggggaagaaggtgataacgtgacattgaggtgtcagtga

SEQ ID NO: 87522 - DNA, 288 bp, Glycine max
  Peptide Sequence Number=SeqID_204300
atggagctgattaagaacatggctgccaatgaccatgctattttgcgtgacaaaacgcacattcccacaaaaagaaaaaccttaagcaaattgccaacacagttgcaagcagctcaaccgactcattcaacagttatgcaaattgggggctattgtatatgtggaggggctcatgagtctggttgctttatatctcaagatgatgcatctaaagaatttaattatatgactaatcaaagcaggaaaggatttcacataggtgatttttcaggatatcagcagggatga

SEQ ID NO: 87523 - DNA, 1062 bp, Glycine max
  Peptide Sequence Number=SeqID_204301
atgtttggtggtaataactgtgagaaaatggtagcagtagtcacccctcaaacagcgtctaacaaatggacacagacacaacagatagatgatcacaaggccccaatgatgggaagagtcatggaaaaaccaagccaagatcttcttcagcagcaacaacaagccctaaagtgccctcgctgcgagtcttcaaacaccaagttctgctactacaacaactacagcttgtcacagcctaggcacttttgcaaagcctgcaagcgttactggacaagaggtggcactctcagaaacgttcccgttggtggtggctgcagaaaaaacaagcgtgtgaagcgtccaacaaatcacggtgattcttcttcttctgctgctaactctccttcttcgtccaattcaaaccctccttcacagccccacatcgataatattattgcctctagctccaccacgaaccatataaataatatcagccctttcttttatggtggtgatgtgatgagtagtgttcctttcccaaggtttaatcttcattctcaattgaatgctcttgggttaggtttttcaactggggttagtgagaatgggtttagtacttcaaataacaacagctttttttctgcttataactctatgtttggttcttcttcttcctcaacttgtgcaccttcaactcctgttatggcttccttgctgagttcaactcttctgcagcaaaagttaatgagtggtggtggtggtggtggggtgaagggtagtagtgatcatgatcaaggtggcaacactttccatggcttggcaccgctacaagggttgcaagtggaagggaataataataatagtaataatattggcacaaaagaagtgagaggtgagggacaaaacaggtttgattggagtaataataacaataacaacaatggtggtggtggttgtcaaaaccagatggagcatgtgggtttgtctgatcctaattcgctctattggaacactgcaacgggtttgggtgcttggagtgatcaacctaacaacattggtccttcagtcacttctctgatctag

SEQ ID NO: 87524 - DNA, 240 bp, Glycine max
  Peptide Sequence Number=SeqID_204302
atgaagaaaggtgttgaagggatattagtgatagtaaagtggtttagacatttgcaaagaaggccactagagacatcagtgaggagagtagatggcatggtttctaaccattcattgttgtgtgatccaaacccaaattcaccagcaaattctgaagctgctcggatgttcagcgaaaacaagcgcgaatacaacagaaaagtacgcgagattgttgagcaaagttggactgctgattaa

SEQ ID NO: 87525 - DNA, 1191 bp, Glycine max
  Peptide Sequence Number=SeqID_204303
atggagcttgcacctgtgaagtctgaactaagtccaaggagccataggttgctcatgatagatggtagtgaggttattggcactaagtgtgtcaaaaggcggcgaagagattcatctacggccgtgttaggtggcaatggacaacaaggtgaacagttagaagaacagaagcaacttggtggccaatcaactgccaccactgtgaagagaagctcaaggtggactggaaggtttgaagcacatctatgggataaagggacctggaatcccactcagaagaagaaaggaaagcaaggagcttataatgatgaagaagctgcagctagagcttatgatttggctgcactcaagtactggggaatatcaactttcacaaattttcctgtatctgattatgagaaagaaattgagataatgaaaactgtaaccaaagaagaatatcttgcttcattgagaaggaggagcagtggtttttccagaggtgtatcgaagtatagaggagtagcaaggcatcatcacaatggaagatgggaagcaaggattgggagagtgttcggtaacaagtacctctaccttgggacttacagtacacaagaagaagcagctcgcgcatatgacattgcagcaattgaatacagaggcataaatgcagtgacaaactttgacttgagcacctacataagatggctaagaccgggaacacatcctactgcttctcatgatcaaaagcctagcactgatgctcaaccttttgcaacctctaactccatgcaagcaagagggaacattgaggtatccaactccaacaagaattcattcccctcaggtaaattggacagtaccaagaagcgagacttttccaagtacatgaaccctttgagtccatgcaacaagccatcttccccaacagcattaggacttctcctaaaatcctcagtgtttagagaactgatgcagagaaatctgaactcttctagtgaagaagctgaagaagttgaattgaaatatccacatgagggcaatgatggagttggagggatttatgataatgaaaacaccaataactcttacttttgctcttctaatatcagcagattacctaacttggagtcatcagaagagagtccattgcctatgtatcatggaactgtgcaatcactatggaatagtgctttcaacatgtctaactga

SEQ ID NO: 87526 - DNA, 633 bp, Glycine max
  Peptide Sequence Number=SeqID_204304
atggacagtatatcagagagctaccttgtccaagttgccggggaaggggttataccccttgtacagggtatactgacttgccaccagtgctctggagatcgtgttatatgggaggaatcaattgatgaacaaccatgggagagggcccgttctatctccccacttaaagtgaaggaagatgatgaagttgacaaattagacataaagctagatgtgaagaaaaaatccaagcgtgtttaccagtctccacctccagaagttggattaaagatcagtcgttcattaaaaagtctcaatgccaaaactggtctatttagcaacagaatgaagattatccaccaggatcccaagcttcaggcacagcgtgtggctgctatcaagaaagccaagggaactgttgcagcaagaaagcatacttccaaaattatgaaagcttactttagtgatccagtaaaccgtcagaaaaggagcatggccatgaagggtcattttcatagccttgcacctgtgacttcgttgctgggcataggagacactactgtccagaactcaatgatagcttggttgatcggcgattcacgtgtaggctctgcggggggaaaggccacaacagaagaacatgtagaaagttaa

SEQ ID NO: 87527 - DNA, 918 bp, Glycine max
  Peptide Sequence Number=SeqID_204305
atgtcgaatttgcagttacagcttcactctcctccaccatcatccctcttatcatcttcatcatcaccatcatcactatactcttcttcttctcttaagctattcccaaaccaccctttttccacaaagtcccttcctttcaacaatcataaacatttctccctaagatgccgccacactgacctcttcgaccagaacaccatagcctccacaccacgaccaacgagaccctctgcttcagttggagctttgccgcctagggtttatgttggttactccatttacaaagggaaggctgcgcttacattgactcctaggcccccggaattcatgccgctcgattcaggagcatacaaaatatccaaggaaggttatgtgctgcttcagtttgcaccggcggttggtacgcgccaatatgattggaataggaagcagggtaatatctatgctggtgttatttgtcaaaaccgagaaggttgtgcttggttttcagttgggaggtatccaacgtccgttggaaaagtgttttccttatcagtgagtgaaatgggaagtgtgattagccttggtgcaagggactcttatgaactttttcatgatccttttaagggcaaaagatgctggggagtggggctcagtgatgaaggtaaagtcagaaaaattttgaaggtggagcctcttccagatggttctggacacttctttaacctaagtgttcaaaacaaccttgtgaatgtggatgaaagcatctatatccctgttacaaaagcagagttggcagttttgacctcaactttcaattttatcatgccataccttctgggttggcacacctttgcaaactccataaagccagaagataatggagtgaataatgccaacccaagatatggaggagactatgaatggaacagatag

SEQ ID NO: 87528 - DNA, 300 bp, Glycine max
  Peptide Sequence Number=SeqID_204306
atgttgatgaaagaatttaacactttcactgctaataaaagaatgaatcataacagtaataaggcaaagatcaaagaaagaaaggttcttgctcaaataagctgggttgaaaagcttgaaagcatggttgcaaatcttaaagcaaacttatgtcctgtacatgaaacttgggaaatgaagattgctgatggtgaacatcagattggtatatcaattaatactattaaattagttgctaaagatgaagacctactgtctcaagatgatgagattgatgatagaattaagaatctcgattaa

SEQ ID NO: 87529 - DNA, 465 bp, Glycine max
  Peptide Sequence Number=SeqID_204307
ttatccttccacggaaagaaggttcagaaatccgggaggccagctgttaagattgaaggtttccatattccagtaggagaggtcaccatcaccctcgatgatgtggcctctttgcttcatctacccatcacaggcaccttccatagcttcgagactcttcatgtcgacgaagcggtgttgatgttagtggaattacttgaagttagtgtcgatgaagccaaagctgagacagtacagtgtcatgggacatattgttggatttatgagcattttccatttgttgttaaggctattactattgaagattatcatgaaaggtcaccatgtgcctgccgctggacctctacgaaggcattactagggtcgacgtatcagaagcatctagatcgaatgaagtttgatgatgtttgttggatgctttacgattaccaccgtgcagttagagacttcaagttgatttcatga

SEQ ID NO: 87530 - DNA, 294 bp, Glycine max
  Peptide Sequence Number=SeqID_204308
atggccacaatgatggaggccatgatgagcatgaagaagataatggaagccaatgcagttacaattgccgttacaagcactgttgctaaggtgaacccgatgcccccatctggcctcaaccaaatgaatcatccaaccttagatatggtaggcaaagatttgggaagtacgaatgcccccatgatgtgcaaattcaaaacgagcacgccttcccaacatatggcttgcctcccaacttacaccaaccaatgtgatgaaaagaccatgttaagacccaaccttaagctaccttga

SEQ ID NO: 87531 - DNA, 135 bp, Glycine max
  Peptide Sequence Number=SeqID_204309
atgagggtgaaagaaaatgaatttgatgtgcttttaaagaaaagaatactgatgcgacatggagacaatggcgtaagacatggcactgactctcaatgtcaattagcaccttcatcgtatgatggacaatggtga

SEQ ID NO: 87532 - DNA, 270 bp, Glycine max
  Peptide Sequence Number=SeqID_204310
atggaaaaccggaacacaggatcagatgctggagatgtatcttcagccacagcagttctccttggagctttagctcctggtgttaatggtcctacatggattactttaaagtccacttttttattgctgggtctctgtcttgctgttatgctggccttagcattctcttccagtgattcatggttgattttccatgttgcattccttgttctaatttgcctcatcctcttcttgcttctcagctggtactttcatccttacccattgtaa

SEQ ID NO: 87533 - DNA, 2349 bp, Glycine max
  Peptide Sequence Number=SeqID_204311
atgacaactaattcatctcttccttctggagttcataaagaaaaacatattctctttgagattgggaactctgaaaggcagctgtgggcattgatccattctaaaggcctattacactctgatgttcaagtcttgtatcacaacatcaggtcaagttatgagagagcaatcctcaataatcacactcattcagaacttcaagaagttgaatattccttgtggaagcttcactataagcatattgatgaatttcgcaaaataatgaagagaagctctggtaatgcagagaacaagaaatcaggaatgccgaaagatggtgttgtgcagataaacaacgacaatcatatacaggcatttaagtcatttctttcagaagccactgagttttaccaaactctaattgtaaaactcagaaaacattatggagtcccagaagaggctttgtttcataaaaagggttgtgtttcagcttcttttgaaccagaatcgatgctgaaatgtcaatatttacatcatcgctgcttagtctgcatgggggatctggccaggtataaacaacattatgaaaaccttaatgctcaaaagcaaaattggtcagtttcagccacacactacttggaagcaacaaggatttggccagatagtggaaaccctcaaaaccagttggctgtattggcaacatatattggagatgattttcttgctttataccactgtgtaagaagcttagcagttaaagaaccttttcctgatgcctgggataatcttatcttactgttggaaaaacttcacaagctgccatctctaatgatcttgcagaacaggtcatctcatctggaatgtgtttccagtgaagtctgctttgatttcttcaaaccttctcaaaggatcagcaaagagactggaacgcaaccaaataatgatagctcgaatggcaacctgtttgaaggtgaaagtaatcattttacggacacaaagttatggtctcatatagtcagaacagttagttacctcttcataacatcaagtttggagaaattccccattgcattggcatctactattgaagtgttagatgaaataatggagctagaagatataaaactaaagaccatgttggagtcctatggacaaatggatttggccagaaagggtcctttccgagccttacaaatagtttctatactcatatttaccctaaagaatctgattgataagcatgagaaagatgaatcaaaagacaaaaatgattgtcagcaacttgtgctgatacagctggcattagctgctgcattcattttcatgggccgttttgttgaaagatgccagaagtctagtcctttgaatcattgtcccttattgccttctgtacttgttttcatggagtggtgtgcaagcatgcttgataccattgaagtatatgcaactgatcaaaagagtgaaacagctatttcttactttttttatgtgcttattgaacttctaaatcaactcaatgagaatagaaaagaaaccaggaagcttgtagatagtagtaccccactttgggaagactatgagttgaggggctttgcatctgtagctttttctcatgtctcactagatttctcttgtagatgggaacacatcaacaactttgagagtggcactgaattgcgcgctcagcgcatgagtgaagcagcaatgaggattgctaacagatctaataatttgcaaaagtggattatatgtgatgaattagaaagaaaattttactctgctagatctgatgaaaatcacgagaagaaagaaacaggtaatgtagagtccactgacaaatggacaagtggggatgaccctaatcagaaaactcgcaaagacaatggagaagatggaaaatgtgatacaagagacaatccaagtagttccagcactaatggaaaaccttctgctgtggaggaagaagaagtgattctcttcaggcctctagcgaggtataattctgcaccattgtacgcactttttccccctcatgagcagatgtcatcaccaaaagacaaggatgataaagtcttgccttctgatgattgtctgcgccgtactacatctctgcctatggcacaaaatccatttcaaattgatccgtggggattccaaggtgacattacgaattcaaggatgaacaaatcgttccaactgctagaaccttcaatgaaggaatcaaatgcacacacattttctgagggtccaatctctgctgggcatccttcactcaatgcatgggcccttgataccaacaggttgcaccccattgaggaactagcttcttcgtacttggccgatctttccatcgatagaactcagaatgca

SEQ ID NO: 87534 - DNA, 219 bp, Glycine max
  Peptide Sequence Number=SeqID_204312
atggttgccgccaagaagacccatgagagcatcaacaagaggctccttcttgtcatgaagagctccaaagggaaattaattatcattgctaacaactgcacccctttgaggaaatcagagattgaatactatgctatgttggcaaaggttggagttcatcattacaaatgtggacttgggcactgcatgcggcaaatattacagagtgtgctgccttag

SEQ ID NO: 87535 - DNA, 657 bp, Glycine max
  Peptide Sequence Number=SeqID_204313
atggacagagccaggttggtttatggcttggtaacccacatggatatgaacatcgacaccctgatctcaggtcaaatctcttctgttgctcagagtaactcctctaggctcagatttccagccttgatcactaccctctgtagagctagaggaattacctctgatagtctgacttatgagagcctgagcccggccattaacttggcctacattaagaaaaactgttggaatatggattatctgatagttaacttcagaggggcaaggaaagcaagggctcgaccagttgatagcctacaggttgtggctccaccaggtaccatcttgacagttaagcagttcgtggagaaggttcaggatgcatcttcagaggccaccatccctaagccatttgtttttaaggcaggagggacacaggtaaggcaggaggctgctactccagagaggtcaacacagatttcaccagatccacctacaccaatgcatgagatgccagcagacccttctactccattactggagattccagaggaccctgcctcactagtcctgggactgactaccactcctctagccactcttgtgctacattttacagatgaggaaggcactcaggatcaagataaccaacaagatgaccagtcacaggagttttaa

SEQ ID NO: 87536 - DNA, 288 bp, Glycine max
  Peptide Sequence Number=SeqID_204314
atgggcactgacacaataatgcccgcgccggtgccggcgttgatgagcgtattagcggcggtttgccgcgacgcgtcaatttgccggctcacggcactggcgagcgccggggaagccagtccggcaccgagaccagcgataaacagcccaccggcaatcagccatgcactgccggcagcggccagcagcagtaagccgagcatggccgtcagcgctgccagcatggcggtgctgcgcacgccccagcgcgccagcagcagcgtggcgccgggcgtggccaggcagtaa

SEQ ID NO: 87537 - DNA, 372 bp, Glycine max
  Peptide Sequence Number=SeqID_204315
atgtggatgcagatcaatcacccggggcggcagatgccggccgcactcggccaacccgcgctcgcgccgtcagccgttgctttgcagatgggcgcgctgtccaagcagttcgcaccgccgaaggcgatgaccgaggacgacatcgacgcggtgatcgcgcgcttcatccgcagtgccgagctggccgagcgcgccggtttcagcggggtggagatccatgctgcgcacggctacctgctcagccagttcctgtcgccgctgtcgaaccaacgcaatgaccgctggggcggctgcttgcccaaccgcgcgcgcctgctgctggagatcgtgcagggggtgcgcgcggtcgtggcgcccgacttcgtgctggtg

SEQ ID NO: 87538 - DNA, 1356 bp, Glycine max
  Peptide Sequence Number=SeqID_204316
atggcgaactgtcagcaatattattttcttttgctttctctggcaatttttattcctaccctgaatgccaattccttagagaaagatgagtattggcagagccatgtctatgagtttgatagttattggcaggaaagggcaaaagccgctaaagtggacagtcaggcagcttattttgaagacccatattcagtctccagcaacttcacttccagtgttagcgaactcacaattggcaagaaggatttacgaaggaacttgaagggaaaatatcgtggtgacggtccatgcatagccacaaaccccatcgacaggtgttggaggtgtgaccccaattgggccaacaatcgccagaagctcgcagattgcgtccaaggcttcggtagaaacaccgttggaggcaaaggtggaccattctacgtggtcaccgatccctccgacgatgatatggtgaaccctaaacccggcacgctccgccacgcggtcacgcgtgacggcccgttgtggatcatctttgctcgaagcatgttcatcaccctccaacaggagctcatcatgaacagcaacaagaccattgatggaagaggtgtcgatgtttacattgccaagggtgctggcatcacggtgcagtttgtgaagaacatcatcatccatgggatcaaggtctttgacatcgtgattcgtgagggtgggatgatcagagattctgagacacattatggtttcaggactaagagtgatggtgatggcatttccatctttggtagcagcaatgtttggattgaccatgtttccatgagaaattgtagtgatggactcattgatgccatcatgggatccactgctattaccatctccaacagccatttcacagaccacaatgaggtgatgttgtttggtgccagtgacagttattctgatgataagatcatgcaaatcaccttggcattcaaccacttcggcaaaagattagttcaaaggatgcccagagttcgatatggttttgtccattcggtaaataatgactacactcactgggaaatgtatgccattggtggtagcaagaaccccaccattatcagtgagggtaaccgttttattgcccctgacaaccaattcgctaaacagattacaaagagggaatacgcaccagaaaacgtatgggcaaattggcagtggagatcaattaacgatgtgtacatgaatggagcattttttgtgcaatctgggcctgagctggctagcagaccattctcaagagaagacatgatcaccgctaaggtaggaaattatgtaggaaggcttacacgctattctggcaacctgttgaagtgcagagtgggtcgcccttgttaa

SEQ ID NO: 87539 - DNA, 132 bp, Glycine max
  Peptide Sequence Number=SeqID_204317
cctcttgtgattgtcaccctgctgagggaacagtgtaattatctggaagaagtcccgacaaagagacagagtaaatgtggtgccatgcgtttggacctaatttggagcttagaatatgaaatggagatttga

SEQ ID NO: 87540 - DNA, 823 bp, Glycine max
  Peptide Sequence Number=SeqID_204318
ggaagaaattgggtatgatgggtggaggcttgactttgtcaggggattttggggtggctatgtaaaggactacctggaagcaagtgaaccttactttgcggtaggagagtactgggattcccttagttatacatatggtgaaatggatcataatcaagatgcacataggcagaggatcgttgactggatcaatgctactgctggtactgctggtgcatttgatgttacaaccaaagggattcttcactctgctcttaatttattttcaaagttcgaactgaaactcactgcacctcttgtaaggatgcttcaaaagatgagcagaaaaatgtgcatgctgttaacttttttctttttaccagaccagcaggctgctttggaaagatgtgaatattggcgcttgtcagatcagaaggggaaaccccccggtgttcttggatggtggccgtctcgtgctgttacttttatagaaaatcatgacactggctctacccagggtcattggagatttcccagtggaaaagaaatgcagggatatgcctacactcttactcacccaggaacaccatcagtgttctatgaccatattttttctcactataaaactgaaatagcaacacttatctctatcaggaagcggaacaagatccactgcaggagtacacttaaaatttgcaaggcagaaagggatgtttatgcagctatcgttgatgacaaagttgctatgaaaattggacctggtcattttgaaccacctagtggatctcaaagatggtcctcagctttggagggaagggactataagatttgggaggcatcataa

SEQ ID NO: 87541 - DNA, 438 bp, Glycine max
  Peptide Sequence Number=SeqID_204319
atggagcttaaagagaaagctgcagaactggcatcatttggctttactgtgatatggttaccaccacctacagagtctgtttcacctgaaggatatatgccaaaggatttatataatttaaattctagatatggaactattgatgaactgaaggatgtggtgaaaactttgcatgaagttggaatcaaagtgcttggagatgctgttttaaatcaccgctgtgctcacttcaagaaccagagtggtatttggaacttatttggaggtcgtctcaactgggatgatcgtgcaattgtagctgatgatccacattttcaggggagaggcaacaagagtagtggagacaattttcatgctgctccaaacattgatcattcacaggactttgtgagaaaggatcttaaagaatggttatgctggatgaggtttcatttttaa

SEQ ID NO: 87542 - DNA, 1095 bp, Glycine max
  Peptide Sequence Number=SeqID_204320
agattggatcaggggaaggatttgggaaattgggagcttacagtgggttgcaatctaccagggaaatggattcttcactggggagtttcccgtgtggatgatgttggaagtgaatgggatcaacctcctcgcgatatgataccccctggatctattcctattaaggactatgcaatagagacacctatgaagaaatcattgtcatctgctgaaggagatattttacatgaagtcaagattgatcttaaacccaacaatgatatttcagctattaattttgttctcaaggatgaggaaaccggtgcttggtaccaacacaaaggaagagatttcaaggttcctctggtcaactaccttaaagaggatgctaatataattggacctaaaaagggttttagtttgtggccaggggccttggggcagatatctaacattctcctcaagtcagaagcaacacatgacaaagatcaagatgacaacagtggatccataaatacaaaagtggaaaatagtcaactggaaggtttctatgtagacctatcaattaccaaggaagttattgtcgaaaactctatcagtgtctccattaggaagtgctctgagacagctaagaatattttatatttagaaacagatatacctggagatattctccttcactggggtgtttgtagggatgatttgaagtggtgggaaattccacctgctcctcatccaccagaaacaatagcatttaaggacagagctttaagaactaaattacagtcaagagacagtggagagggaagttcagtacaactctctttgggagaagaattttctggatttctttttgttcttaagctaaatgacagtacttggataaatgacatgggagatgacttttatatccctctcccaagttctggaagcataattactggcaacagagaagatcaatcagaaggtgtgcagaaggaagtgactgaagaggcaggtcaagaggaatctatatctgcatttactgatgaaataatcaacgaaataaggcatttggtgacagacatttcctctgagaagaatcgaaagacaaaatccaaaggtgggatcctctag

SEQ ID NO: 87543 - DNA, 1017 bp, Glycine max
  Peptide Sequence Number=SeqID_204321
atggggatagatgatctcatgtatcaattgtccaaactgttagcagatgtcaccaagcctaagcttcgggtatacagaccagctgaaccaaggccatgtgatttcggaaagagccacataggtatcatcgtacactcaggcgtatttggttccgttgtatcagttgatttcaggaccggttcaactaattcagccaaatctgaattagctagctcagccgaattcaaattggctaggtcagctgaatttgtctatctagttcagtcgaattcgaatcagctagttcatccaaatttgaatcaactagttcagacgaatgaggttcaggtaggaccagcactagtacatttgagttatgctcaaataggacaaaatttgcaggtactgaataagttaccaaatcaacataacatacaaaatgggttggttcaattggctaaaggggtcatccagtgtggtatattgcaaccatggagtattactccacctacctctgctgatcaacatggatttcagcctatgaccttatgtgagaagcaacccaagacaattgtcatgcagaattcggctcagtcagcaacttcttcaattgttgaaccaggcatgttacaagtctacggtggaaaggaaaaccgaaatgagtaccataagcttcaattgttcccactatctttaacaagaactgctttcacttggtactcttgtttgccctctaatttggtacaaagtttggctaatatggagagggtaccggagacactatcagccgaggaacttgctaagctgggtgaaccaaccaaggctaagagtgatgtaccaatcattaccccaaatgagctctctaaggctgatggttttttctttggtttcccaataatatttggaaagatggcttctcagtttaaggcttttatagatgaaaccggagatctatggaaagcagaacaacttgcagccaagcctgctgggatcctcatcaccacctgttgccaaggtggtggaaaagagatagtgtaa

SEQ ID NO: 87544 - DNA, 834 bp, Glycine max
  Peptide Sequence Number=SeqID_204322
atggggtttaagcttgcccatgggagactgactacccgaattttttatgaagtgttggagaaggttagtagcagattggcttcttggaaaggtgagattttgaatagacctgggagaatcaccttggccaattctgttttgtttgcgattgctgcttatactatgcatgttcttctgaacctattaggtgtttattctgctcgatctgggtatagatggctcattgacaaaaatcatgagcatagcaatactcggaattggctttggaaatccaagctccccgaaaacattttatttttcatttggcaagtgtgtaatcatgctctgccaaccagcaagatgatccagaatagacatattcctatctcccctacttgtccaaggaaggttgtgtccttttggcaaagcttgagcttggatattgggattagtgacgttgcggggacgactccctccccggattggtgcgtaattctttcaagcattttggttctattttcccagtggctctttgagaagtttggaaagctagaaactcccagtgcatggggatgctttgtcctccaggagtccgagattggtgcagtgtatcctcccttctcccctgcggtagcggtttatgttgatggcagctgcttgggtccccaggaagagactatattgtttcataaatatgcagcaattattgctgctatcaaggagcttttgcgcagacagtggagtgtgaatcttcttcatttcttgaaggacggaaatgcctgtgttgatattcttgctaagatgggtaaccagcatctatggtgcttctcctggatgctgatgcgaggggtgtga

SEQ ID NO: 87545 - DNA, 390 bp, Glycine max
  Peptide Sequence Number=SeqID_204323
atggagaaggttgatggtagagttgagtggacctatttgcagaaaattcccggctttcttcccaaagcgaggtttgaggcaaggggactacctcttcccttatttgtctgttttatgtatgaaagactgggggccaagattagtgaagcttttgtgaatggtgattgggctcctatttctttgtctagaggtgggtctagaggttcttggcagataatgtgcctcttctcccaagaaaaaccttccaagttgagatttgtcttgaatcttttgaatgatttctgtctaggatcaggctttaatgtgaatgttgataagcctaaagcctttgcatctaaaggggtcactaaccaccgtaagagtaaattggctgcttttattggtagttga

SEQ ID NO: 87546 - DNA, 496 bp, Glycine max
  Peptide Sequence Number=SeqID_204324
aaatgataaaggtgacaaccttactgcctcatattaccacattgtaaacccgctgactaacacggctgttggtgcggagctttcacatagcttttctggcaatgaaaatatactcacctttggtacacagcatgctctggatccactaactctgttgaagtcccgggtgaacaactatggtcgggcaagtgctctgatccagcatgactggactccgagaactcgtttctctcttgttggtgaggtggataccggtgccattgaaaagagtgcaaagatccacccgaatgccatcgatttaggttcacctttgcgtaagttttttgagcatggaaaggcaaaccaacactccaagcattcttctataacagatgaaagaaggccttttgaccctaatttgtcaagaccctcgagtcaggaccctaatttgccaaatgaacagcattgctattcctttctctatatgcaggacatgactacgttagggttgaaatga

SEQ ID NO: 87547 - DNA, 423 bp, Glycine max
  Peptide Sequence Number=SeqID_204325
atgggactggctctgggttgtcttcaagtggagcaatcaacagtagctatcaaagaagtctttggcaaacatgatgatgggcttgaacctggtttccactgtgtgccatggttcttttgcactcaagtagccggttacctttctttgcgtgtgcaacagctagatgttcgctgcgaaaccaagacaaagtgtcttgttagtattttgcctataaaaattaccttaacagttatcccaaggattatgttcttatggttgaccatgacaatgtttttggtgacccaatactttgacacgttgaaggagatcggtgcgtcctcaaaatccaattcggtttttgttccacatggaccaggtgctgtgagagatattgcttcacaatttagagatagtcttcttcaaggaaaggtggctcagtcatga

SEQ ID NO: 87548 - DNA, 522 bp, Glycine max
  Peptide Sequence Number=SeqID_204326
atggagaacaaccctagttcatcatcaagaactgatagaaaattcattgaacagaatagaagaaatcatttgaaggatcttttcttcaagctcaactcagttgtgcctcatcaaagctcaagggaggccatttcgcggccggatcagataggtgaagccacaaattacataaagaatttacagattaaattagagaaaatgaaggagaaaaagaacaacctaatagacattaaaagatcaaaaaatgttagcatgaatatgggattgttgaagtctccacaatttaaaatccaacaaatgggttcaactttagaggtttttctaataactgggttggattgtcaattcatgttcaatgagaccgttcgtgttcttcaagaagaaggatcagatgttgttaatgccagttataccgttgttgaaaatgaagtttttcatacaatacactgtcatcaggtaggggaatctgcaaatggagctttgaggatatctgagaaattaaagaagtatttcaatggctga

SEQ ID NO: 87549 - DNA, 460 bp, Glycine max
  Peptide Sequence Number=SeqID_204327
ggaaacatctcttagcactgccatacctcttgagcttgaggttattcctcaagtaaaggagttattggatgagggtttggttcgcaagagcttaaatccttgtgatttgttggtgcctaaaataggtattattaggcaccaaatccctatgataggtggtatgatgaatttgttgagtggtgcaacactcttttgtaaaatcactcatgcacccgacatcttcatgatttgtgtacatagggactcattaggcaggcttgttcttattttttgtttcaatgcaaacctaggtgctcatgtgggacaccttagggcttcccatggtgaaaaatcaccattaaaggacctcattgaagctcaaagacccagcctccatagaagccccacaagcaagcttccatcaagtgaagattgggccaaaggtgcaagagaaggccctagggttctcatgagccttagg

SEQ ID NO: 87550 - DNA, 157 bp, Glycine max
  Peptide Sequence Number=SeqID_204328
atagttgtagcaaactcatatagacctattggaggggctaaagatgatcttggaataggaacaaaaatccaagattgcatcttttctaacaaaggttatgcaagattgctacttctagagaagttcatcaagcatgctggaaagcagcagctgctag

SEQ ID NO: 87551 - DNA, 1290 bp, Glycine max
  Peptide Sequence Number=SeqID_204329
atggatgaagatagcagtaattcttggataaggagggccaaattctcccacacagtatgtcacaggttgaactattccagttctggatttggctctttcagcattcagccaagggcacaacacagttctagtagtctgaaatcaaggcctgaagtggcttttgcttccaacaaggctcagaagaaaccaataatgaacaagcagagatctttgtcccctttgcctcgaacctctctctctgagaccttcaaggaagccagacatgagcagaagaggttctcaacacctggtccaaggaggaaagaacagaacaaggacaagagaatcatggggaagttgctcaacaaggattctcatgtgtccaattccaaatcccctcgcagtagtccaattactactaaatccccttacagcagtccaattaggcaccttgcttcgatgaaattaagctcgaagcagcaccgaaaggatttgggatggacaaagtactttgatcatggagggggaaaggttactgctgtggaaacagctgaggaatggaatgttgacctctccaagctctttgttggtgttaggtttgctcatggtgctcatagcaggctttaccatggcatgtataaagatgaagctgtagctgtgaaaattatcacggtaccggatgatgacgaaaatggaatgttggtggatcgattagagaaacaattcattagagaagtatcgcttttatcgtgcctccaccatcaaaatgttataaagcttgtggcgcagttgttgttttctgataaaaacaagttcgtagcagcatgtagaaagccacatgtttattgtgttatcacagaatatctatcagaaggttcgttgaggtcatatttgcataagttggaaagaaaaactatttctctagggaagctaattgcttttgctctggacattgctcgtggaatggaatatatacactctcaaggtgtcattcaccgagaccttaaaccggagaatgtccttatcaatgaagactttcaccttaaaattgctgattttggcattgcttgtgaggaagcatactgtgacttatttgctgatgaccctggtacctaccgctggatggcacctgagatgatcaaacgaaaatcctatgggagaaaggttgatgtatatagttttgggcttatcttatgggaaatggtgactggaactataccatatgaggatatgactcccatccaggctgcttttgccgtagtaaataaggaaaaggtctacagccccatttatccgcccaaacctctctga

SEQ ID NO: 87552 - DNA, 182 bp, Glycine max
  Peptide Sequence Number=SeqID_204330
ggaaaaatacctcattggtgatcagaggtggtggaggataccgcatcgttctcttgagctgcaatgggaagaatttggttttggaacggttgaataatggcgggaagcctagggtttgggatgtcaacagggaattccccgaggagaacagggaattccatgccattgattttcaagtgaag

SEQ ID NO: 87553 - DNA, 204 bp, Glycine max
  Peptide Sequence Number=SeqID_204331
atgattgagaatgacgaagtgacattgaagagatatgcacaccgatcgaggattgacgcatatccgacatgtggttgtgaagcaagaatcacattgattcattggacaatcctggtggggagtgtcattgaggagtcagtccttagaataaaggatgaccacaaagtggtacctaggaggcaatcacatggtgtgaccgtctga

SEQ ID NO: 87554 - DNA, 451 bp, Glycine max
  Peptide Sequence Number=SeqID_204332
atggacgatagtgtctgtgagaaatacggcataagcaaggaaaaatgggcccagttttgccagactcgtagagacccttcttgggaggatgtgcgcaaaaaggcacaggccatccagaaacagaacactgccccccatgttttgtctcatgggggttatgaatatttggagcagaagctcctggctgagaaaaccaagaagaagttggaggaagctgcacattcaggaagcgttgatggcgtcatcgaccctccatccccggtcagacgtcacgtgaagtggaagatggcccgcacgaagaaaataggggagatgacaactgaggctgcaaaggaaatcgctgagaagatcgcgacacagggatccttcgttccccatgggcgtcaggatgttctcaccactgttattgggcgtccaaagcaccctagacgtgtccgtgctgctggagctg

SEQ ID NO: 87555 - DNA, 411 bp, Glycine max
  Peptide Sequence Number=SeqID_204333
atgtacaacctcaaggtacctaaggaagtgatccatgtctttgattacatcgggtatccatcgtccccaagtacactcaacctcgagatgaagcgttggcttattgcacaccatctgatcctggaaaaaaatgtaatggtgagcattgccatccaacctccgcttcaaaaacttcaacacatcttcagaatcagaacaccctgtcacaacctacccttcgacgggcgggcgcacggaaaaataaaagctcgggttctcatgaagagaatgtgtggagttgccaccaacatttattcaaggaaaacgttagaaaaaccaaaaagaggtctgcgaattttgaaaataagggttcgggaattgtttgcacatagggaaggtattagcaccccatgccctcgccacaagggatga

SEQ ID NO: 87556 - DNA, 238 bp, Glycine max
  Peptide Sequence Number=SeqID_204334
aatgaagaatgcgttcgacaagaaggtgcgcttgcgtaagttccatgagggggaccttgtgctgaagaaaatgtcccacgctgttaaagataatcgagggaagtgggccccgaactacgaagggcctttcgttgtgaaaagggcttttttcggaggggccctggtgcttaccaacatggatggcgatgagctacctttacccgtgaactctgatgttgtcaagcgatactatgcttag

SEQ ID NO: 87557 - DNA, 213 bp, Glycine max
  Peptide Sequence Number=SeqID_204335
atgaggatttttacattagtctatgttctgtttctttttgttccccatgattcagttggaggattgagatgctatgagaatccaaagaataagattactgcagtacctgttgaggaagaggacatctggggtgcattcttcaaggtaatcttagagcttaagaagttagagttgaacatccattatgtaactaggattgccagttgcaactaa

SEQ ID NO: 87558 - DNA, 402 bp, Glycine max
  Peptide Sequence Number=SeqID_204336
atgagctctccgtcaactcctttctacgtccttcagaggcctttcatgttcttgttcatcggtccaaacacagagttctatatatcaaatagaagaaaatttattatagatttcaaaaataagtgttcctcttcgtgtggtggttcgacggcaagcaacaacggctcgtggtggctatcggtggtcgtgggtggtggaaaaagagtttctaggatctcgcttagcgagtcgctaagtggaaatccacttttggcgttaagtgcaatttctctcgggttgggatttgcgctgagcacaacacatagttgtgaaactcgattcagcctagccggtcggaccggtccaaccgagatcgggggcctaaccaagccgattctactattggatcgattacgtaattga

SEQ ID NO: 87559 - DNA, 1485 bp, Glycine max
  Peptide Sequence Number=SeqID_204337
atggggttgggtggtgctgagaatggaaaagtagtggtggagtctttggatgtgtgtaaatcaaaggggaggaagaagaagaagaaagaggatggggaagttgaagaggaagaagagactgggtgttggtttaggttgaggttcattgggagctgcatttcttcaagatccaaagttgatagctcagttagtggcaccagcactaattatgctgaaagtaaatcaactattgatacaagtagagatcaaccaacactccgagtagtctcttcgacaaccactagtaatgccgaaagcaattcatccacttccaaacttgaagaggagcttaaagttgcatccaggctgcgaaaatttgcattcaatgatcttaaattagcaacaagaaattttcggcctgaaagtcttcttggtgaaggtggctttggttgtgtgttcaagggatggattgaagaaaatggaactgctccagtgaaacctggcacggggcttactgttgctgtaaaaaccctcaaccatgatgggctccagggtcataaagaatggctggctgaggtaaattatcttggtgatctagttcatccacaccttgttaaacttattggttactgcattgaagatgatcaaagcttttctgttatgtggatggattatggattggaacttcaaacttctgcttatactctttgttttgattatatccattggtccctgcctcttccatggtccattaggatgaaaattgcacttggagctgcaaagggtcttgcttttcttcatgaggaagctgaacgaccagtaatatatagggatttcaaaacttccaatatactattggatgcagaatacaattctaagctctcagattttggacttgcaaaagatggtccagagggtgataaaacccatgtgtctactcgagtgatgggaacctatggttatgcagcaccagaatatgtcatgacgggacatcttacatcaagaagtgatgtgtacagtttcggagtggtactacttgagatgttgaccggcagaagatcgatggacaaaaaccggcccaacggtgaacacaaccttgtggaatgggctagaccacatctgggagagagaagaaggttctacaagttgatagacccgcgcttggaaggtcacttttccataaaaggggctcagaaagctgcgcatctggccgctcactgccttagcagagatccaaaagcgcgacccttgatgagcgaagttgtggaagctttaaagcctctgccaaacctcaaggacatggctagttcgtcttattatttccagacaatgcaagccgaccgatttagcgtgagtccaaataccagaaacgggagaacacaaggagcgttgctcaccagaaacgggcaacagcaaaggagcctatcaattccacatggcactcatgcatctccatatcaccatcagtttccacaaccatcacctaaacccaatggcaaggcatag

SEQ ID NO: 87560 - DNA, 519 bp, Glycine max
  Peptide Sequence Number=SeqID_204338
atgcccacccctgatgcatttgtctccacgacaaagggtaaggagaagtccggtaaccccaagaccggtgccctgacacagggcttccttcaatttcgaaaaagcatgatcagctgcaggtgtccactggaattgatcattggtcaacagggttgtgaggggagcggtcagcgtggcgtacccttttatgtaacagcggttctacacctcgcttcgaaacgatgtggcccaagtattccacttgctggatggcaaatgagcattttgaaagtggatagagtgattcgtgtctcgcgaaggtgggagggttgtcagagattggaagagaaaggaaaattggttaatcaaggaggtgatgttggggtgggtgttttggggaggtgtaactggggagaagaccctgatgtggaaatattagctagcaccgtgagtttgaagcattcgccgaagttgcgggggagtgatgccatcatggtcatatcggaattgcccttcaactcgatcaaattgccttcatga

SEQ ID NO: 87561 - DNA, 861 bp, Glycine max
  Peptide Sequence Number=SeqID_204339
gctccggatgaaagctctcagttttcaaaggtgcaatctccaaactcagcaaaatcaagtatttcctctaagagtcctgacagaacaaagattgcttcaattgacgatcagtatgcaattatggtgtcttgtcgatgcaattatacagcatcaagattattctttaagcaagcaaccagttggcgaccacgttcatcgagggatattataatctctgttgcatctgagatgtcaggagagtctcctggaccttatgaaagaaattctcaacttcctgtgcaggttttaactcttcaagcttcaaatttgacatctgaagatctaactttgacagtgcttgctccagcctcatttacttcacccccttcagtggtctctctgagttcacccattagtccaatgagtccttttattggtttcaaagagtttttaggaaggataagtgttgaaagacatgttggtgccacccagggggggagctttacttctcttataaaagacaatgagaaacaaaatgatgatgtccgacctcagtcagtttcagtgaatgatgatgtcatttctagttctggcctaagttgtacacatctttggctgcagagtagagttccactcggatgtattccatctcaatccacagccaccattaagcttgagctacttccattgaccgatggcataattacacttgactctttgcaaattgatgtcatggaaaaagaatcactcatgactcatgggcacagcaattttcgtcatgcattttataaggtgttggcttcacctaggtgtgatgtttctgtgccagacactcatttgggtcctttttatatagttgttctgcttgtgactagccattga

SEQ ID NO: 87562 - DNA, 1036 bp, Glycine max
  Peptide Sequence Number=SeqID_204340
atggcggcaatacttgttgggccaccactttctaatcctcacaaaccacataagcttaaaggaattaatggcacagacaggttgtatttggttgccatgaggacgtccatcgttatgttaccaactgcagtacgtgccaacaaacgaaatatgatcaccggcgaccaccagggctctcattttggtagtggtggaccgattctcgaagggaattcatttgggcctattaccgcaacatcatacaacctcttccatggccagaacgaactttttaagctgaatggtatgaagctttgcatgagctcggcgtaccaccctcaaattgacggccagaccgaagccatgaatcgggtcatcgagcaatacctacgggcgtttgttcatcagaaaccagctacgtggggccgctttctgatctgggcagagtggtcatacaacacttctatccattcggccatgggcatgacaccgtttgaggtaactttcggcataaagcctccgagcatacaacaatatttggtaggtgcattgaatgttgaggcagtagatgattggttgatccagcgtgacacgatcttcaccagcttagtcaagaagctgaacaaggcacaacaaaggatgaagaagcttacagaccggcaccagtgggattgggcagggttgttttcggaagacacattgtgggagaactgggatactctcaaggaggactacaactttgaggacaagggtagtgctcctaggatcttcttgtcagctgagtggcacaattccgataatatggtgatttggaagatgagcaaagattttcctgttaaacatgcatattatcatattatggagaacatgttagacaattctgcttattgtgaggatggtgattggatgttaacatggtctctcaatgttcctctgaatgaaaatgttgttgcccagagaatgattggcattgcttctttggctgtcagcatgctagagagaagtttggcagaatcaaatctctggccatttatgcagtggatagataatgcacagg

SEQ ID NO: 87563 - DNA, 1014 bp, Glycine max
  Peptide Sequence Number=SeqID_204341
atggcggaatccactagctctaaatcaaacatggaccgtttggaggaggctatggccaaactttcctctagtcaccttcatgtcaccgaaaaacttgatgatcttcttcttcgagtcgcagctctcgaaaccacaatccaccattccccatccccttcttcttcatttgccatacctacaccaccaaattccaccgttaatcctccccgaatgaaactagatttgaccacatggccatgtttcctgcaagcaattgaagcttgctttgcacaatcaccatacgaggatcctactgaacttctctgcaagttaacgcaaaaagggtatgttccagattacctgacgcagttcgaagcacttgccaatcggattgtggagttgccgacgtccttccttttgagctacttcgtctccggtctggacctagacatcagacgcgaggaccatgctcttcaacctctgaccttagtgcacgctgtcggcctcgcccgtcttcatgaggagaaacttctgacacaccacaaaggtcaccgttgtacctcgcgtttcttccttctcatcgcagatgaggaccacggggaagacatttcgaaccctaaaatagccagcccctacccacttccagataacccgcaccgacccgacccaccaaataacccatcattaaacctgcctcaacttgaaccacttcaagcccaaataagcctccacacacttgctggacaaaccgccccaaaaacgctgcgcatacgtggccggatttctcatcaactggtggtgatcttggtcgacgaaggcagtatgcacaattttatgcaaaaacgcgtggtcaaatccttgggtctccaagctcagtcctctccgaccttgagggtgcttgtcagaaatggcaatgagcttgaatgttgccaggtctgcctcaacgttgcgttgtatgtgcatggacgagtgttcacggtggaccttcatgtgcttcccctgtgcggcgccgacattgttctcggggttcaatga

SEQ ID NO: 87564 - DNA, 1416 bp, Glycine max
  Peptide Sequence Number=SeqID_204342
atgtccgacgacccctacgcccaagtcgagcacttcgacggagaggccgagggcgaaaacggcgctcagagctccagaaacgacgctcccgttctggccaagcacgtggatgtttccgaagacgaagggtggatcaccattccttacaaggaaattcctgagaactggaatcatgtgtcagatatgcagtccttgcgctctctagatcgctcctttctttttcctggtgaacaagttcatatcctagcgtgcctgtctgcttgtaagcaggacatggagattattactccatttaaagttgctgccgtgatgagtaagaatggcatgggtcacggtcctgacaaagaaaatggaaatgttgaaaacaggaatgattcagtatctggagaagggaagctgagtcctagcagacaagagcagaaagaggaaaaacaggaaaaagtgaagactgatcaccaggcggatgcttctgctggtgaatcccttctaaggatggaggttcacaaaagacaaactgcattgttgctgcaaaaatttgagaattctcacttctttgcaacgatttctgagtccgatgagccgctttggtctaaacgaggttcttcagaaaagttcaattcctccgaactaaatgggccaaagatctcatcatttgaaattaaagacactgcaaaaaatgcatcttctattagtgcagttattgatagagcaaattttgatgcaactatttctggtggagtggcgagaaattccgtccagtgttgtgccctaccaaatggagacatagtggtgaatgttggtgttgattttcttagagacccttgtatagaaattctccaatatgaaaagtatcaggagaaagtattgtcttctgagaaccagaacaattcagttcacacaaatcaggatccatgtggagcactattaaaatggatacttccattagataacactctcccccctgctacccgcccgttatctcctcctcaattttctttgaattcaggtatcggtaacacctctcagaggtccaattcttcagcatcacctggctctcaattattttcctttggcagccattttagaagttactccatgtctgcattaccccaaaatacaaatgcaccaagtcctcctttaaaagccgctagttctaagccaagctttgatattgaagattgggatcaattcccatctcagaaattaagaaaaaaaaatggagttgaagaacttttatcttttcgaggtgtttcattggagccagaaaggttttccgtttgctgtggattagaaggtatctacacacctggaagaaggtggagaaggaaatttgaaataatacaacctgtagagattcattcctttgcagctgactgtaattcagaggatcttctgtgcgttcagataaaggtttga

SEQ ID NO: 87565 - DNA, 271 bp, Glycine max
  Peptide Sequence Number=SeqID_204343
atggggttccgccactctcattggcgagataccccatgcccaccatcaactccatgcatccatccatcagcgcaacatcatccatcatccatagcgatttccgccagtcaaagtggcgaaattgcttttgttcatccacgtggatccgctagttggtctggcgagattggcttggccttcatgcagaaaacaaacgacatggcttcatgtagagtaggttcaatcccttgcttcatgcatgcttcatactgttacgtagggttcaatatag

SEQ ID NO: 87566 - DNA, 381 bp, Glycine max
  Peptide Sequence Number=SeqID_204344
atggttacctcaaagaaaaccgtgaaggtcagattgggcttcgttctgaaccgaaaccgtgaggcaagtttggaagattccgctccaattgaagggttcctctcgaagaagcttgggacgttggaaatatttttggaagaaggaaggagaaagaaatggcgtttttccaaggctacacgaatcacaaaggctgacacactcaagttcttctgctctcggaaaaggaagcgtttctcacactccggatgtcgtatcgccgatcgcaacggtcaggtcgtccaaaaatgtcttatgaaccatcagaccaaatctcaagaagatccaacggttaacgaatgcaggagagcatttttaccaagacagcttagacagcttccttga

SEQ ID NO: 87567 - DNA, 1140 bp, Glycine max
  Peptide Sequence Number=SeqID_204345
atgactctgacgctcaaggtggacatgcttttggttatgcaggcgaggtttgacgtgttaggtgggggaggcgagtgcagcgcatgcgcaatactcttgcacatgtttcactcgtggagtggacatgtattggagatgtattcttttttgatcatgtcttccttcctttctggctctgccataggcatcagtaacccctggtggaccgagaggtcatcttcatcagcggttcctcctcagagaaggcttgtcatggggattttgacaactaatcctcttcctcaaataggtcaagggtttcatgtcgtgttggtggaggcacttctcgcctccgtgggagggcatactcttctgctacttttccggggagcaaagaggattggtggcagggacgttagggcatccctccgtgtgcaacgtagccacagtcctaggtcatcttcgtctccccatgccattgctagttatgagtgggtgagagccaatgttttgaagtatcagtcctgtattacttttgcggcgagcgttgttgctctgcaacaccaactgaggttggcaagtcctgaggactcctgcaagatagcagttcaagcatgtgggagcgatgatttcccttttctgagggtgtcgtcgaacagcaaaattggtcggatctccttgaacaatgcatctaagaagctgtttgagtttggctcgaacgtgttttgccgcttcaaagaccatttcttcaaggtcctggctactgacgtcatggctgatggcttgccattgatgttcaagtctaatcccaccaagttcaagtctttcgatgaggatctattaacctttgtggaaagggtcgacaaagctatattagagcaactactagcctcgctggatgcatggaccattttgtctcttcctttggcgaacgattctttcactgccttggatggtattatggaaaagggtcaacttgtcgttgaggttggccctactattggtgttgttgaggtctccctcaatgctcgttcctctgttttggctaagaggaagttgatgcccagtttgggtcgcccttcaagtttgcaagatccacctccggctccattggttgtccaagcttctgctccttcacctcctcctattgcgtctgcttag

SEQ ID NO: 87568 - DNA, 263 bp, Glycine max
  Peptide Sequence Number=SeqID_204346
tcaaagaaagtactacgtcccccaggcaggcgcagggcgaaacaccacagcagcctggggatggccagcagcgggcaacagacgcaccgccatcacctctagagttcacctcagctcatccacaaaaaaggttagagcgttgcttacgacccatggcccgaccaataggcaaccaagtccagagccaaaggacattccctttatccccgaaccgctggccaaaccctgacatatatcatgaccagtcgttctacaagccttga

SEQ ID NO: 87569 - DNA, 324 bp, Glycine max
  Peptide Sequence Number=SeqID_204347
atggatttaaaaaatgctcatccttggttgagggatgacagccgtcccatccctttagatatattagtttttaaactagtgaaggcttatcttcatgcaacaccattcaaacgtgcagcagtgaaggccctttcaaaagccttgccagaggatcaattgccctaccttagtgcacaattcagattgttggaaccaaatagagacgggcacatctcccttgacaatttcaaaatggctcttgtacgcaatgcaactgatgccatgagggagtcaagggttcttgagatcataaatgcggtgaggaattattcttatatgtattga

SEQ ID NO: 87570 - DNA, 279 bp, Glycine max
  Peptide Sequence Number=SeqID_204348
atgtggaacttaggcaccccatacttcccaagtccagaaggttataaaggcaaggcacccacatttgaagtgaattaccatttggcagtctataataacaaaactccactgtttatatggtggaaatgctgtaaagagaatgagaagcttttttttaactgcacaggacttcttttaacttcctggctgatgcaggatggtcaggcgtcaaattacacaatcaacaagatggatgtaattgttcaattttcgatacttgtgcccagacattactctttg

SEQ ID NO: 87571 - DNA, 183 bp, Glycine max
  Peptide Sequence Number=SeqID_204349
atggtgtaccagccaaatcacgctctggtaatctgggggcaactcaacaatctgcaaaggagaagaaggaaaaagggtcagcttggggcactttcagcttgcccaggcgagctaagccttagtcctgaagtaaggagctcacccaggcgagccaaatgctggcctgggcaagctggggcttag

SEQ ID NO: 87572 - DNA, 234 bp, Glycine max
  Peptide Sequence Number=SeqID_204350
atgagggaatttgggactatagcagctcatccaggcgagctgatgcttagtcctgaagaaaatggctcgcccaggctagttggtcccttcagccctaagcaattcgggggcccaggtcctagtcaagaggctcagtctcctcaaaggaagaaatccatcacatctgccatgccaccatcttcctcagctccatcttcatctcctggggcctctatgggacctacctccacctaa

SEQ ID NO: 87573 - DNA, 363 bp, Glycine max
  Peptide Sequence Number=SeqID_204351
atgggtggctggggtcctggcgctattggtgcaggatatactggtagaagctgtcattcaactgcacctagcccttatagttggctgcctggtggtcagccaaatgctgcatgtagagctccatcctctgcatgtgagtcaagatggactctagagatggtggctgcggtagaggtggcggtggatagcatagaccagctgacacttaggcagcgagagatcaaaattatggtcgttgggaaggatgttgctgaggagaagcgtcatccagatctgtgtcaaagtggtcatgctagtgcgcatgatctgcatctgccttcccgtcacgcttcgtgcaaagtcctatcctggggagcacagtag

SEQ ID NO: 87574 - DNA, 500 bp, Glycine max
  Peptide Sequence Number=SeqID_204352
atgttatttgggtatttaggtattggtgactgttgtttgttaagcgtcggtgtggcaaccacaagttctcctgtgatgtctctttctttagctccatcggttcccccctcggccatgttggtgtcggcgttgccttccacctcgtctcacccaacatttctttggatcacatatacactttctgcaatgttgattcgctgttggagaaatttggcgattttgaaggagaataggaaaagagtagagtgtcctaaggtggccaacaccattgtcaccattgctaaggctctgaggtcgaaccatcaattgttctccaaggttggcggtgttcttaccaagctgttgctcaccaggttagatgttgatgagttgctcgagcagtgcaagggcttgtggagggagaagaatgaattggctgacaaggtggagagcactatgacagagaaggacgagcttgccaaggtggtggcggacctcgaggctcggttgaaggagtcaaa

SEQ ID NO: 87575 - DNA, 138 bp, Glycine max
  Peptide Sequence Number=SeqID_204353
atgaggctgaagcgctaccaaattgcgactgtaatcaacttctacatcgttcttcgttcggtgttcttcattcatcatccggttagttttggttttaaggatttaggtccacatggagcgctttggttggagagataa

SEQ ID NO: 87576 - DNA, 2160 bp, Glycine max
  Peptide Sequence Number=SeqID_204354
atggtgttcaaggtcctcatcgaccaaagcaactccattgacatcctatattggaaaacattccataggcttaaagtctcgcctgacaccttccaacctcacgttggtccactccttggctttgtaggagaaagagtagaggccagagactatcttgacctaatgactaacttaggtcaaggccagctatcgaggagctttataaataggaaaattctcaatgagcttggagccatcgtctccacactacatctaaagatgaagttccccaccttgacaggagagattgttactatcaagcctgaaagtgacaccctatcctcccaccagggagcctccaaggcctcacttcaagcgggtggtgccttgactgtctaccaagaaagtctagacgatgtattcgatgtaaatccgcacgatgaaacttctgataaagtcctaaagcctattaaggaactcatcaaactgcaactcagacccaaacccagccagtgtacgcagctcagccgggacctcaccatccatgaatacatactcatagctaatgtcctacacaggaacataaacttatttgcttggaagccatctgacatgtcagtggacaagctccaaaaagccaatttcatcagagaagccaggtactctatcgggctcgccaacttcgtcatgataaaaaaggccaacggatacaatcagattcgaatgcacgccccaaacgaagagaaaatgacattcatcactaaagatatcaacttctactactggcaagttcttaggctttatgatcacacgtcaaggaatagaagccaacccgacaaatgcacaaccatactgaagatgcacagtcctaccaacatccaagaagttcaaaagttaaatgttagactagcatccctatctaggttcctccccaagctccctgaaaaagcaaagccattcaacaatcctatgtcaacccaggccaggagtaccccttcttctatatctctaagttgcgaagttgttagctcaaccctcatacaagacgaaaggaagcaccaacttcccatctacttcactagtcgcatactccatgacgctaagaagtgctaccaaatgatagagaaggtggcgctagcactcattacctcaacccgacatcttaggccatactttcagagtcaccaagtgatagtcaagatgaactaccccatcaaacaggttttgcaaaagcctaaactaatggggaggatggtagcatgcctatatgttgatggttcgtccaacgagaaaggaagcaagacaagaatcatcctcgaaggccctgacaatgtcactctagagcaagccctcaagctcaactttaaagcctcaaacaatcaagctgagtacaaggaacttatattgccaacaaatatataccagaccaaggaaacagtgttgctcaagtactaccacattgccaaaactcttattgataactttgaatgttttgagatgtaccacattcccaaggaaagcaacaccagagcagacttgttctccaagctcgccaacactaaaaagatcgagcacctcaaaactatcatccaagatatgatccaaactcccaccataaatactgaggaagttatggccggagaagaggaggtagactatatcatgagagaacttcatgaagggatatgcggcctctatactgggggaagctccttcacaaccaaagtggtgtgtgccgactactattggccaacactcagggtcgatgcccttggtttcacaaagagatgtagacaataccatgagtttacaaatattccatgcacccctcctaacaatctccatagcatgaactccccattaccctttgccatatggggaatggacatactgggaccattgccaaggaccccaagagcattcaaatatttactagtcgttatcgactacttcaccaaatgggtcgaggcaagaccactacgagaaatcaaaatcaatgaggcttatgacgaattcctaacaaggctaggcatcaatcacctcgtaacctctaccaaacatcctcaggccaacggtcaagtagagatcatcagggccctgcacactggactcaacaagtctaagggtttatggaatgaggaactccctattatactctgggcatatcattgttcaccctag

SEQ ID NO: 87577 - DNA, 762 bp, Glycine max
  Peptide Sequence Number=SeqID_204355
atggggatggctcattttcctatttatgcggaggttgtcgctcgtgtctttgctggtggtgtctctgtcttcctcgatcttttgttctgtctcttcttttgccggcatcgtgattactgtggtgctcctcttggtttccttcggggcccaacaatctttcatattgtgaccataattgaaatggattgtagtgtgattgaccgtcagggactatccgcaaacttaccaggtcttagggcgaggagaatggagtgtaatgctacctctagactggccagagcaaccgatgtcatacgatgtgaccggttggttggatattgcgaattgaaatgcttgacgagagtgttgaagctatcgatggaccttggagggagtccaccataccaagttaatgcttcccctttgagggacgttgggaagaccgaacacaagattatgtcatcattggtgtatagattcgcctgggaaatgtgtgagcggagtgctcatcgccttgggggcgtctggcacaagcctccagctaatcatggtcagcctttagctttccaaactcctcctcatgtatctgtcatggttgttggggaaggattggagccttcaaaaggggtctcgcgtctaaggccaaaccgcgtgctaaccatgggtgaaaaagagaggccgcatggtatgttttaccgtggccctacagcggatgccaaatatacttaccaaaatctggagttgtcccacatcagggtggacgtagacaaggtgggctcctag

SEQ ID NO: 87578 - DNA, 336 bp, Glycine max
  Peptide Sequence Number=SeqID_204356
atggagcgacgtcataaggaggaacttaggaaactgaaggccgaccatgatgacttagaggctcgtgtgcgacagccccaaggggacgagcactccgttcacatgattcatgaacgttactcaagaggaatcacaccctcggtaaaccatcaacacttaagacgatcacaacccctcgcacatacactgccatatgaagggccgacgacttgccgacacccttttgttgactgtatcatggaggtcgagttgcctttaggttggaaacctctcaacctaaagtgctctgatggaactacagatgcggacgaacatctgaatgcattcctcacctag

SEQ ID NO: 87579 - DNA, 411 bp, Glycine max
  Peptide Sequence Number=SeqID_204357
atgcatgatggtgctattagaatcttgactgaagttcatcacgttctaaagcttaagaaaaatcttgtattggtggatgttatggattcaaaagatgagaggaaaagaggagtgtctggtaatgcagactttaagacccccattgaggtatggtctaacaaactaattgaatactcaatgttgaaggtgtttagatgtccgacatactatcacgtaagtgaaggtaagctacaacctagagccaagaagggattctttatgggctatggaaatggagtcaaaggatttcaagtctggtctccatctgaaagaaaggtcattcggaatggagatgtcgcctttgacgaactctctatgttgcattctaaatttgatgaagatttaggcaaggttgagtatgtcactaggtag

SEQ ID NO: 87580 - DNA, 294 bp, Glycine max
  Peptide Sequence Number=SeqID_204358
atgaagggtaggatgtcaacgtccaatagggccttggggtttccggccctaatcacaggcctctgccaatccttcggagttcaggtcacctccaacggagtcgccaactatcacaacctacccttttgcgggcgagcgaggcgaggttcatgggtcgacaaaagcggggcttttgctcctacgtatcctccatcgaagaggaaatcagacctacgtagttctttcaaaaggggcgaatcaagtgattctttttacttggaaggtggtcatttaaggcgttggaccttaaaatga

SEQ ID NO: 87581 - DNA, 375 bp, Glycine max
  Peptide Sequence Number=SeqID_204359
atggagccacttgcctatagaaagatggactttgaagaattttgtgctgctacaatcagcacacatcaattggaagcacatgataggtgggaagatattgcctcaactgcttttgaacattttgagagagaaggcaaccgtctgatatcagttgaagaattagccagagagttgaatcttgggccttcagcttattcagttctcaaagattggataagaaatactgatggaaagcttagtttacttggatatacaaaatttttgcatggtgtgactctccgtagttcaaacccaagacaacaccgttattctagaagccaaaaaaggaagtgcattccagaaggcaaaaagggagtgcaggaagcaatagcctaa

SEQ ID NO: 87582 - DNA, 270 bp, Glycine max
  Peptide Sequence Number=SeqID_204360
atggtggaggtgtccattgatctagatgaagtggtgaagatgaagctgtgggatcaatgtgtagatatcataaaggatgacgtgcaagaagccatgcataaaggagcacattataatcgaaaatttggggagaatatgttgagggagatgttgaagcagctcgaagatgagcttgttgttcccttctgcttggagaacatgattttagataaggtgccaaaggttaactgcaatccatgtttgtcttgctcggtggcattcaaagaatag

SEQ ID NO: 87583 - DNA, 486 bp, Glycine max
  Peptide Sequence Number=SeqID_204361
atgggtataggggagaagagttcgagcaagagtttcaatctgcaccatcgtgaagtgaagaataagcagcaagagttcagaggggtcccaaaagggtgcatggcaatcaaggttggtcaaggggaagagcaacaaaggttcgtggtgcctgtgatttacatcaaccaccctctcttcatgcagcttctgaaagaggcagaggaagagtatggctttgaccaaaagggcaccatcaccatcccttgccatgttgaggaattcagaaacattttttcacgcgctggaataatgggtacaccactctttcggaaaagagagaagaattggaaaagaacggcttatatcctcaatgatggtctaatcaattgtgaacttttgcacggatatgggccagaaagggaaaatgaggtttgcaaggaacaaagcaatgaagtgggtgtgtggaccatttctgtgtctgaaatcagaaataaactgaatcactga

SEQ ID NO: 87584 - DNA, 201 bp, Glycine max
  Peptide Sequence Number=SeqID_204362
atgaacgagttacatgaacgagccaaagactacattcaaatggaggaaatgtcgaagttcagaaacaaggctagatacctagcccaattcttgaagaggtctgacaacaacccaacaggagcacgacccagaggccaccaagatgacaatcacaaggttcataatgctgatagaaagaaggaaatagcgaaagatagatag

SEQ ID NO: 87585 - DNA, 714 bp, Glycine max
  Peptide Sequence Number=SeqID_204363
atgcagggattgattgttctcactgcacaagctcgtgtgccatcactgaagccaccagcatgtgacgcagccactccatgcaacgaagttagtggtggaaaagcagcaatgctgtttgctgggctctatttggtggcacttggagttgggggagttaaggggtcattgccttcacatggtgctgagcaatttgatgacaacactccatctggaagaaggcaaagatcaaccttcttcaactactttgtcttttgcttgtcatgtggtgcccttattgcagtcacatttgtggtgtgggttgaagacaacaaagggtgggaatggggctttggaatctctactatagccatatttgtgtccatcccagtgttcttggcaggttctactacttataggagcaagatcccttctggaagtccacttacaaccattctgaaggtactagttgctgcttcacttaacagttgcttcaacagtagaaattccagcagtgcagtggtgaacatgacttcaagcccttcaaatccacactcaggtagtagaaaacaacaagcagggaaagaagcttctaatacaacaaacaaggaacctgaagccctaacaaacacactcaaattcctcaacaaagcagctgatcagaacaacaacaaacctatctattcatcgatagaatgcacagtggagcaagtaggaggatgtgaagatagtgcttaa

SEQ ID NO: 87586 - DNA, 357 bp, Glycine max
  Peptide Sequence Number=SeqID_204364
atggaattagaacaaaaccagagatcatgggaaggctatgtgaactggaggaacaagcctgctctcagaggccgccatggtggcatgcttgcagcctcctttgtgttagtggttgagatattggagaatctggcatttctagccaatgcaagcaatttggtgctgtatctgaggcagtacatgcatatgtccccttcaaaatctgccaacaatgtcacaaatttcatgggaactgccttcctccttgccctccttggaggtttcttatctgatgctttcttcaccacttatcacatctacctgataagtgcagtcattgaattcctgccaacttatcttatatctcttgacttttga

SEQ ID NO: 87587 - DNA, 464 bp, Glycine max
  Peptide Sequence Number=SeqID_204365
ttactatcagaggggccaggagaacaaggacaaggccagctgaggccccttccacatctatagctcctcctccagcatgtaccctagcagctccttctgccccagcttctgcaaattttcagcatcttgaagccatgcttcaaagcatccatcaagggcagattatcttattacaaagtttacagatggtggcacctccagactctattccttcagtagagcagtttaatgagtgggtagcctggcccaggactcagtcttctcttcacagggaagatgaaggtcccacagcccaggtaccacagcagatggaggatgagtcatccaagactaccactccagaacccttggtcagaaggaagaaggcagatgaaacacaagaagctgcagccacttttgagaaatctcttgaggccacttctgagccttcagaaccagtggcagatacaacttcacatcagtag

SEQ ID NO: 87588 - DNA, 198 bp, Glycine max
  Peptide Sequence Number=SeqID_204366
atggagcaattaatctttgatggaaggatgaatgagtggcacttcattgcatttgttgcactttggcaattgtatctagtaaacgaagtaacaacctcgggaaatcatatctcaagcatacaagcaagtaatgctaaggcttcatttggaatcataatgattgcttgcttcctctttttgcggcatttagttagttag

SEQ ID NO: 87589 - DNA, 369 bp, Glycine max
  Peptide Sequence Number=SeqID_204367
atgcaaaacggtgacgtttggctcttttaccagttccttcagaatgtggttacttttaaccagaccgggtcggtaatgcccgttccattttcgagcgggtcgaccctgatgttgttttgcgagtggggggtgtttgcggatttgattgagatcgatgctggccacgattttttatcggcctgggccgatattaatcgtggatttcggatcctccaacccggtggggttatattcgggcacgattatttcaccgcagcggataatagaggtgttcggagagccgttgatttgtttgccaaagtcaacaatcttaaggaaggaaagacttgcggactttttgttatccattgtcctttcagtggtcaataa

SEQ ID NO: 87590 - DNA, 372 bp, Glycine max
  Peptide Sequence Number=SeqID_204368
atgtgtatcgccgacgcgccgaggaacgtgccaacttccacgacggttcgcggccgcacccggcggatgagattctcgaaaaccttgccggtggagccccatcccttgactttagtcgttcgccggagctttgccgccgcatgcggcggcggaaagttttcaaacggcgaggtgccgttgaagaggcggtcaacgagcgtccggcgaacggactccggcggaattggatcggcgcagcgagttgtgactcggaacgggttcacctcggtggtgttaattgagaaccgaataataggttctaacgacgatggcgatggcgacgatgatggtgagagtggtaatgaagtggaagaagggtggtgggataagtaa

SEQ ID NO: 87591 - DNA, 162 bp, Glycine max
  Peptide Sequence Number=SeqID_204369
atgcagcggtattgggcaccacgagcacgtgaaatgaaagcgaaaggtgcagtgacgcacggagaccatcgcaggctgcactttcatcaccagccacttttgaaggatccatcaacattcactttggaagtatggggaggagatggagccaagagatattga

SEQ ID NO: 87592 - DNA, 1382 bp, Glycine max
  Peptide Sequence Number=SeqID_204370
atggaggatttaatcatatctccttcttcgtcttcctctttggtctctctaccccatgaaaacccaacaccaacaccaacccttctacaaaaactccaattcctcctccaaagccaacccgattggtgggtctacgccattttctggcaagcctcacacgacgacaatggcaacctctacttatccttcggagagggccatttccaaggcaccaaagaaacttccccaaagtcactaaccattcccacaaagaagttcatgagagcccccacaaacgacaccaacaacatcaacgacgccgagtggttctacgtcgtgtcgttgactcgcaccttcgcagtcaacaataatgcttcttcttcttcttcttctctcccgggaaagtcttttgctttaggctcggttctctggctcaacaacatgcacgagctccaattctacaactgcgagagatcaaacgaggcgcaagtgcacgggatcgaaacgttgatctgcatcccgacacaaaatggcgtcgtcgaaatgggatcctacgacaccatcaaacaaaactggaacctcgtacagcacgttaagtctctcttcataacccctccagatccggttcctgtcgaaatcctcgacgaccacaccatctccttcgccgacatcggcatcgttgccggagtccaagaaaccaaaaagcggagaataaaccaaacacaaacacaaaaacctcccaggaaaaacgacaactatgtcaactccgaacactccgattcggattgtcccacgttgccaaccgccaccaccccgacaacctcggagccgaagaaaagagggagaaaaccgattctcggacgcgagactccggtaaaccacgtggaggcagagagacaacgtagggagaagctcaatcatcgattctatgcgcttcgtgctgttgttccgaatgtttcgaggatggacaaggcttcgctgttgtcggacgctgtcgcctacatcagcgagctgaaggcgaagattgagtacttagagtcgcagcagccgagagacagtagtaaaaaagtgaagacagaaatgacggatactctagataaccatagcaccacgacaatatcgacagtggtggatcaaagcgggcctgaacctagattgggcccaagcccgcttggtctcgaggtcgatgtgaaaatcgtggggcccgatgccatggttagggtacaatcagaaaatgtgaaccaccctggggcgaggctaatgggtgctttgagagacctagaatttcaggttcatcacgctagcatgtcttgtgttaacgatctcatgcttcaagatgtggttgttaagcttcccaatggaatgaggagtgaagagggtcttaaatctgcgattctgatgag

SEQ ID NO: 87593 - DNA, 414 bp, Glycine max
  Peptide Sequence Number=SeqID_204371
atgaccactgcaatagcaattgaagatgttcgcagagaggtgaagatattaaaagctctatctggccataaacatctcgtcaaatttcatgatgcttttgaggatgccaacaatgtgtacatagttatggaattgtgtgaaggtggggagcttcttgacagaattttgtcaaggggaggaaagtattctgaggaggatgccaaggttatagttttgcagatcctaagcgtagttgcattttgtcatcttcaaggtgttgtgcaccgtgacttgaaacctgagaatttcctctacacttcgagaagtgaagatgctgacatgaagttgattgattttggtctttctgacttcatccgaccagcctcaggagtggtgtgtttagtcgcccatcgaatggaaatatggcttaaatag

SEQ ID NO: 87594 - DNA, 312 bp, Glycine max
  Peptide Sequence Number=SeqID_204372
ggtgaaaacaacacttttgccaatttgcctagtttacctgtgtcgcaacctacccttttgcgggcaagcgaggcgaggctcacgggtgcgtcttccaaaggaggaaaatgcgcggattcgtcaccaacgtttatttgtggaaaacatcggaaaaaccgaaggaaaatggtcatgaagaatattctagattcgggagttgtgtttacgtttgaggaaggtattaacacttctcacgtcgacataagcggggctcttgctcctacgtaccctccatcgaagaggaaatcagacctacgtagttcttttttaagg

SEQ ID NO: 87595 - DNA, 206 bp, Glycine max
  Peptide Sequence Number=SeqID_204373
gggtgccgccattgctgctggcgggatgggaggggataggagagagagaggtgtcccgcccttggagctggcgggataggagagagagagggtgtcccgcccttggagctggcgggacaggagagagagtgttgcagggtggtaccgccagtggcggttgcgggacagggggagagaggatcccgccactgggttctacgggatag

SEQ ID NO: 87596 - DNA, 183 bp, Glycine max
  Peptide Sequence Number=SeqID_204374
atggaaaaaacgcaggagagaaagagtggacggagcataaatggaaaaaatccaggaaaacagagaatgaacaatgttcaaaatattttgagagagggaaaaataaggagaggtttgagaattgtggagcattcaatggagtatggcaagattggaggtggagagtcatctgaatcattgtga

SEQ ID NO: 87597 - DNA, 262 bp, Glycine max
  Peptide Sequence Number=SeqID_204375
gagaaaacatagagacaatgaaaaaatattgagtctttggttcaacgatcaagctgctaaaatcatgaaaggagtctttgtgctttcttcaagaattgacaaaccattttgtaagtacgatggtttcactacacgaaagtgtgtagcgaaggtttacatcaatattgtggacttatcattggttgaaagtgtgaggattccatacatgaaaaatttacctccatattacattttggatgcatgtggttcggtgtgcatttga

SEQ ID NO: 87598 - DNA, 216 bp, Glycine max
  Peptide Sequence Number=SeqID_204376
atgtcaagacataattttcaagaaaaaaaacaatatacagcaaaatgtatcctgcggaagaatttggcaggttcttctgcgagaaggattgaaagcctgcggaagaaggttccgcaggttcttccacgagaagaaaatggagccggcggaataaggtattcttctttgggctcctacggaagaaggtgttcttccgcgagctcctgcggaagaaag

SEQ ID NO: 87599 - DNA, 519 bp, Glycine max
  Peptide Sequence Number=SeqID_204377
atgtcgaaaatcgaagacgaagagctgcttacctcgacaatgccgacatggagggagaacaccaccctcaaaatgcctgggctactcaacaccaacgagcaccatgatcgcagaacaaaaactcccagcgtggaggaagaagacgatgctcacggtggtagcgcggcacggaggacctcgatggtgggtcaagcttttctgaaaccaacaaccacttcacacaaacaaaacgaaaggaagaagaacacggctaaggtgaggtcaggggtgaggaaggagaccaaaaccacttcacgccagcaagaagaagaaaaaatgttgggtgggctgcatgacggcttgaagatcatcataagtccttttattacaaaaacaaaacccccaaaaacaatgctttcatcggaggttaatttagttaatagaggggtgtggatagataaggatatagcttctcaaagaagtctcttgagaaagcttctcaaagaagccacgaggaagcttctggaagaagcctcttaa

SEQ ID NO: 87600 - DNA, 139 bp, Glycine max
  Peptide Sequence Number=SeqID_204378
atgcagaggggagttgcttgtgcacgacagggtgacctcgacacttgctgcctaattttcctaagtgagagtgtcatgtggacacgcttagggtatttccagataaatggtaccacattgtattttagagttaagtcag

SEQ ID NO: 87601 - DNA, 201 bp, Glycine max
  Peptide Sequence Number=SeqID_204379
atggtctctttccagctgctgccggcatacgccatcctaagaacggccatcacgacagccatgacgacgccacaatcggcacgtcgccgcgccaccaggccgcaagaatgtcgccgagctctgcccagaaaggatcagccaccagccgtaaacgctgccggtaagagggtgccctgtgtgtcgtccgttggctggggctga

SEQ ID NO: 87602 - DNA, 1362 bp, Glycine max
  Peptide Sequence Number=SeqID_204380
cttgaccgttacgaaatgcgtgtttggggctgggctccgggagaggaggcattcctgatcgaccgagtgattatcatgggtaggcacgatgaagaggaaacgttgctgcgtgttgatgaggccatcaacaaacagtaccaacttgccgacggcactatcatgaccattggccgtgtttgctgggactctggcggtatcgacccggcgattgtttataaccgctcgaaaaggctgggtctcttccgggtaatacctatcaagggggccagcgtttatgggaagcctgtggccaacatgccgcgcaagaaaaacagccacggcgtttttctgacagaaatcggcactgacgtcgccaaagaagtcatttacagccgctacaaactagagcgctccgctgatggttcccccgttcctgggcttatccactacccgaataatccagcggttttcgacctggccgaagccgagcagatgacggcagaggaactcatagaaaaatatgagaaagggaaaattaaattgctctgggacgccaaaaaacgccgaaacgaggccctcgactccgccaacaatcaccgtccggccagcaggccagaaataataatgacttggccgctctggcggctcaattgggaggataacgtggcgacactggcacaattggaagaagcccgaaaagccttacacgaactgctaacgggttcaactggggttagccagtcggcgtcgaggtccggcgaggttcggggtatgaataaaaatcaaaccttacttggcccggatggcacgacgccgctgcgtgagtacgccggttataccggtggcggtgtgggctttggtggccaaattgccggctggcaaccgtcttcacaaagcgtagacgccgcattactgccgcaatttgaacgggggaacgcccgggctgatgacctggtacgaaataacggctacgcagccaatggtgtgcagttgcaccaggatcatattgtcggctcattctttcgccttagctatcgaccaaactggcgatatctcggtatcgctgaggaagagtctcgggcgttttctgacgagatagaggcggcctggcgagagtacgcagaggaccctgattgttgcctggacgtggagcgcaaacgtacctttacgatgatgatccgtgaaggcgtggccatgcacgcgtttaacggggaggtctttacccagccttgctgggatcgtgctcctcatcgactgtttcgcacccagtttaaaatggtcagccccaaacgtatccgaaacgcgcccggagtgctcgacagccaaacgcagcgcgccggtgtttcactggacaaatatggcgcagccattggctacaacgtg

SEQ ID NO: 87603 - DNA, 285 bp, Glycine max
  Peptide Sequence Number=SeqID_204381
ccccgagtcatccttcgagtcccagagacagatatccctcacgtgccggagccaagagaaccatcgacatctgcaaggcccgctgtggacgagcctagacatgcagtggaagtttgctatgggattgttgagaggttggagcaccatctaagcctaggggtggtcacgccaggctcatcgacacatgaggttatcgaagaatgcctcaggatggtcaggagtgtcacacaggaccagctagtatatgttaggtctcaacgtaggaggtacacagatcaggcgtag

SEQ ID NO: 87604 - DNA, 318 bp, Glycine max
  Peptide Sequence Number=SeqID_204382
atggagcttacatcacaatgccacacgaaaaacacaaaagcagagaaaaatagctaccaaaaatggagatgtgtgcatttctggaaaaaaaaagcttttataaggaaaaaagaagccaggggcatttttgccatttataaattttgctgggtgcacttggcaccactcttcatcttttcatacaccttaaagacacattgggctggactggaatatgcccttcttggagtgataggagatataggagaaaacaggatatttactgggcaaagagatgtttatggaaatttgaaagtctcagatagagttcaagattga

SEQ ID NO: 87605 - DNA, 588 bp, Glycine max
  Peptide Sequence Number=SeqID_204383
atggcctctttctcactccacgaaaatgcacctccggtgatattgatgatacatgcaggagccatcagccatgctcatgtgggatctgcatctgtgttggttggtgatattgatgatgcattggactctgaaaaaaggtacttgaaaaggggtgtgaatgatcgggggagggttgctaatgatgttgagacagagcagattgtccttgatgaagaatcaggctcttgcaagggaaagatgagttcagttgtgcaaatgcgtggatcaataccacttttctggtcacaagaagcatcaagatttagccccaagcctgatataatttttttaggagctgtagcaagtgaagtgcttgatttaactggtttttactgcagtggtaaacccaacatcattaagagagccaacaagagcaatcaaacaagtacagggagggatacttcaatgagagatctgagagctagttctgtggatcttgtgaggattgggaacagtaatgaaatgctaaattctgtggttaatcaagacaaagagactgacatgaatttaaatatagctccatcattaagcaagaaaagggttttttga

SEQ ID NO: 87606 - DNA, 399 bp, Glycine max
  Peptide Sequence Number=SeqID_204384
atgactcagaactttgtgtgcaagttactagaccggagtcatggagcagtttggaccactacagctccaccaagtggacctttgactttaatatctactggacaagacaattacaaggtagatgcaaattcaaaaggtcggagtcacagattgttcagggaaattatcatatcagactcaattccaaatgataaggatgaagaatgtttatcactccccaccattcaatgggaaacacttgcttccaatcttgaagatttttcaaaagtagctgaaaaatttgcaatcagcaagtctactgtggaagttgctgatagcatgaaacttcaagatgatgctattcctactcttgaaaagcttcggaagggaacaccctcatctttggttgtgatattttga

SEQ ID NO: 87607 - DNA, 384 bp, Glycine max
  Peptide Sequence Number=SeqID_204385
atgtcacgagtttgtgtaggagctgtactcatcaaccgttatatcactgttgcctcccgtttgtttagtcggaagtctcgcgtggctgaagttgtggagacattacaatacatggtgtctcctcaagggaggaatacatggacaggtgatgatctcgtgccttatgtggagaaaattacaattttatccgaagagcaagagagaatcattgagccagtgtcacatggacctgcatcagagcgtcaatttcccgcacaacagtttcacattcttcagtcaagtgttgaaactcagggcatagacagacgaagggaggctgttgaagcggaagaatattcccaacaaatggcggagcgtggccatggaatgtattacatgccataa

SEQ ID NO: 87608 - DNA, 210 bp, Glycine max
  Peptide Sequence Number=SeqID_204386
atgttcaaccctcctgaaaatccaagccgaagcgcttccgtatcgcttccgagatgtttccatgggcgatttcgcaaaggttttccaccgttcttcatcgttcttcggtcttcaactgttctcaaagaactacataggcctgatttccttatcacaattgaggaatacgtaggagcaagggaaacacccttgtcgaccacaaaaagataa

SEQ ID NO: 87609 - DNA, 375 bp, Glycine max
  Peptide Sequence Number=SeqID_204387
atgtatacagagcgtaggcttgctttgagcactgtaatttttcaaagtaacagcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 87610 - DNA, 558 bp, Glycine max
  Peptide Sequence Number=SeqID_204388
atgtcactgtcattctcattgtcaagaaggttaagctcttttcttccaaaccccattttccctctttgctttcactctcagcctccatccattgacaatgttgttgatgatgctgtttcccagttcaatcgcatgctccttatgcgtcataccccacccatcatcaaatttaacaagattttaggatcacctgtaaagatgaagtactatcccgctgccatttccctttctaaacaaatggaagtcaaaggaattgagccaaatcttgttactttgaacatcctcatcaattgtttctgtcacttgggccatatggccttttctttttctgtattgggcaaaattctaaaattaggttatcagccaaataccctaaccttgactacactcataaaaggtctgtgtctcaaggatgaggtcaggaaatcactgcactttcatgacaagctcgtagcacaaggatttcagattaaccatgttagttgcggaaccttgctcaatggactatgtaaaataggagaaatgagaggcgctaatgaagttgctgagggtgattga

SEQ ID NO: 87611 - DNA, 1770 bp, Glycine max
  Peptide Sequence Number=SeqID_204389
atgtcattctcattctcattgtcaagaaggttaagctcttctccctctctttccattcccacctttcctccttctcttccaaaccccactttcactctttgctttcactctcagcctccatccattgaaaatgttgttgatgatgctgtttcccagttcaatcgcatgctccttgtgcgtcgtaccccacccatcattgaatttggcaagattttaggataccttgtaaagatggagcattatcctactgccattcccctttttagacaaatggaagtcaaaggaattgagccaaatcttgttactttgagcatcctcatcaattgtttctgccacttgggccaaatggccttttctttttctgtattggccaaaattctaaaattaggttatcagccggataccataaccttgactacactcctgaaaggtctatgtctcaaaggtgaggtcaagaaatcactgcactttcatgacaaggtcgtagcacaaggatttcagatgaaccaggttagttacgggatcctgctcaatggactatgtaaaataggagaaactagatgcgccatcaagttgctgagaaagattgaagacagatcaattaggcctgatgtggtaatgtacagcacaatcattgatagcttatgcaaagataaacttgtaaacgaggcttatgatttttattctgaaatggatgctagaggaattttccctgatgttatcacttacactactctaatatgtggcttttgccttgccagtcagttaatgggagcattcagtttattaaatgaaatgatattgaagaacatcaacccggatgttcatacctttagtatattgattgatgcattatgtaaagaaggaaaggtgaaagaagccaaaaatttattagctgtgatgatgaaagaaggagtaaaacctaatgttgttacttataatactttaatggatggatattgtttagttggtgaagtgcagaatacaaaacagatattacacgccatggtccaaacgggagtaaatcctaatgttcgtagctacactataatgattaatggattatgtaagagtaaaaggatggatgaggccatgaatctcctaagagaaatgctgtataaagatatgattcctgatacagtgacatacagttctcttattgatggtttctgtaaatcagggagaattacttctgctttgaatcttttgaaggagatgcaccacagaggtcaaccagctgatgtagtcacctacaattccttgttagatggtttatgcaaaaaccaaaaccttgaaaaggcaactgcactattcatgaaaatgaaggagcggggaattcagccaaataagtacacatacacggcacttattgatggattatgtaaaggtggaagacttaagaatgcacaaaaactttttcaaaatctcttagttaaaggctgtcgtataaatgtctggacatataatgtgatgatcagtgggctttgtaaagagggcatgtttgatgaagcattggccatgaagtcaaaaatggaagagaatggttgcatccccgatgctgtaacttttgaaattattattcgttctctttttgtgaaggatcaaaatgataaggccgagaaacttctgcatgaaatgattgctaaaggcctattaccttttagggattttcatggtgagcgatctccagttacaaataaagttattgtgaattttcatgaaaaggaagatttaaaacctacagcatatttgtttgcatcatctgagtag

SEQ ID NO: 87612 - DNA, 1659 bp, Glycine max
  Peptide Sequence Number=SeqID_204390
atgtcattctcattctcattgtcaagaaggttaagctcttctccctctctttccatcccaaactttcctccttttcttccaaaccccactttccctctttgctttcactctcagcctccatccattgaaaatgttgttgatgatactgtttcccagttcaaccgccttctccttgtgcgtcataccccacccatcattgaatttggcaagattttaggataccttgtaaagatgaagcattatcctactgccatttccctttctagacaaatggaagtcaaaggaattgagccaaatcttgttactttgaacatcctcatcaattgtttctgccacttgggccaaatggccttttctttttctgtattgggcaaaattctaaaattaggctatcagccggataccataaccttgaatacactcatgaaaggtctatgtctcaagggtgaggtcaagagatcactgcactttcatgacaaggtcgtagcacaaggatttcagatgaaccaggttagttacgggacactgctcaacggactatgtaaaataggagaaacgagatgcgccgtcaagttgctgagaatgattgaagacagatcaactaggcctgatgtggtaatgtacagcaccatcattgatggcttatgcaaagataaaattgtaaaccaggcttatgattttttttctgaaatgaatgctagaggaatttttcctaatgttattacttacagtactctaatatggggcttttgccttgcgggtcagttgatgggagcattcagtttattaaatgaaatgatattgaaaaacatcaacccgaatgtttatacctataatatattgattgatgcattatgtaaagaaggaaaggtgaaagaagcaaaaaaattattagctgtaatgatgaaagaaggggtaaaacttgatgttgtttcttataatactttaatggatgggtattgtttagttggtgaagtgcagaatgcaaaagagatattccagattatggtccaaacaggagtaaatcctaatgtttgtagctccaatatcatgattaatggattatgtaagagtaaaagggtggatgaggccatgaatctcctaagagaaatgctgcataaaaatatggttcctgatacattgacgtataattctcttattgatggtttgtgtaaatcagggaaaattacttttgctttggatcttatgaaggagatgcaccacaaaggtcaaccagctgatgtagtcacctacaattccgtattagatggtttatgcaaaagccaaaatcttgacaaggcaactgcactattcatgaaaatgaagaaatggggaattcagccaaataagtacacatatacggcacttattgatggattatgtaaaggtggaagacttaagaatgcacaaaagctttttcaacatctcttggttaaaggctgttgtatagatgtccggacatataatgtcatgatcagtgggctttgtaaagagggcatgtttgataaagctttggccatgaagtcaaaaatggaagacaatggttgcatccctaatgctgtaacttttgacatcattattcgttctctttttgagaaggatgagaatgataaggccgagaaacttctccatggaatgattgctaaaggcctattgtag

SEQ ID NO: 87613 - DNA, 2523 bp, Glycine max
  Peptide Sequence Number=SeqID_204391
atggaaaatggagtcattagtgtgcttggccgacaagcagaaactatcattctccctttggaactccttcgccacctaaagccttcagagttcaatgattcccatgagtaccatttgtggcaaaagaggcagctcaagttccttgaagtaggtctcctcttgcacccttcaattcccatacaaaagaccaacacctttgccatgaaccttaaggaaattatacgtagcgccgaattcaaacctttagacactggcaaaaactcagacaccatgagaaccttcagcaactctgtggcttccttatcaatgagaagccctgatgatactcccaccaatgtttgccactgggctaatggatacccagtgaacattcacctctacatttccctccttcagtccatttttgatctaagggatgagacatcagtgcttgatgaagtggatgagcaacttggtctgataaagaaaacatggtcaacactggggatcaataggccaatccacaatgtgtgtttcacatgggtgatgtttcaacaatatgtagaaactgggcagatagaacctgaccttctttgtgcctcacatacattattgaatgaggtggcaaatgatgctaagaaagaaagggagtccttgtatattgagatattgaaatctgtcctcagttcactgcaagagtgggcagataaaaggtttcttaactaccatgagtattttcagggaggtgatattggacaaattgaaaaccttctccctgtggtgttattagcatccaagattttgggagatgttacaaattctgaagaaaggcaagaaaaaggagaaaaaactagagcgaattcctctgagggccggattgatgactatatctgttcttccttgaaaaatgcttttgaaaagatgatggaagcagcaaatgccaaatctgctgagtctgaaacaaagaaagaaataggtgaagttatgcttcaattagctcaggaaactgaatatttggcattgaaagagagacaaaattatagtccaattttgaagaaatggaacacaatagctggtgcagtagcagcattgacactgaacaattgctatggacatttgctaaagcagtatttaagtgaaatgaccacatctataacagttgaggtagttttagtactgcagagggctaaaattctagaagatgttttggttcaaatggtagttgaagactcagctgattgtgaggatggtggcaaaacagtagtgagagagatggttccatttgaagttgagtcaaccataatgatccgtattagaaaatggatagatgaatcactgcacaaaggaaaagagtgtttgcagagagcaaaagaatctgaagcatggaatccaaaatctaaatcagagccatatgcaaaatcagctgtagagcttatgaatttggccaagaagattgtgcaagaattctttcaaattccaataccaataactgaagttttagttcaagaacttgctgatggattacaaaaaatcttccgggagtacacaatgtttgttgctgcatgcggtttgaaagagaactacattccgtctcttcccccactgaccaggtgcaacaggaattcaaagttccacaagctgtggaagatagctagcccctgcagtgttagttgtgaagatccacacatatatggaatatatgaagctaatcatcctcactcatgcacaagccgtggaacacagcgcctctacattcgtctcaacaccttacactacctcctttctcatatcccctcacttgacaaatcactctccctgaccccaggagttgttccttctaaccgtcactgtttcacaagcagcgacaagactcatagtaacagaacttcatactttgaaaccaccaacaccaccatcctagcagcctgccagcatgtctcagaagttgcttcctaccgtctcacgttctttgacacaaacccttttttctatgacagcctctatgttggcgatgtagccaatgctaggattagccaattattgacaattctcaagcataacatcaaattaatgacagcaattctgacagaaagagctcaagcaccggctgcgaaggaagttatgaaggcctccttcgatgcattcctcacagttttgcttgctggtggaaccaccagggtgttcaatgaatcagatcatgaaagtattagagaggattttgacagtttgaagcagctattctgcagttttggagaagaattgatagcagaaactgaggtggagaaagcggctgagatagtggagggagtgatggcactaatgggaatgagtactgaacaattgatggaaaacttaagtaccttatcaaatgagacaagtggaataggagtcattggtaatgctcagaagttgccaatgccaccaactacaggaaagtggaatagagcagaccccaacacaatattgagggtattgtgctatagaaatgatcgaactgcaagtaacttcttaaaaaggacattccaaatagcaaagaggagatga

SEQ ID NO: 87614 - DNA, 423 bp, Glycine max
  Peptide Sequence Number=SeqID_204392
ggtgtttggacaaggccaatcttgaatataactgagaattcagaaatgttcttcaggaatatattggcatttgaggaatgtcacctttcagatgatacaaacatcattactcaatacctagtgattctagattttgttatcaacactgaaaaagatgtgaatgtactagttgataacaaaattattgtcaattggatgggtgatgctaataaagtggctacaatggttaacaatctggactcaaatcttgcaatgccagacttcaattcacactactactctctctgcaatagcttaaatgaattctatgaaaatcctcgcaacaagtacaaggctaggttcagactcttcataaacgagtacttcgacgctccttggacaatagcatctacagttgctgcagttgtgcttcttttgctcaca

SEQ ID NO: 87615 - DNA, 1178 bp, Glycine max
  Peptide Sequence Number=SeqID_204393
atggaaggacaaataagtgattcattaagtaaacaacaatgtttgaagacaacattaaccaacgagcttcaaaatgtccaacctccagaaatgtatgcattcgatatgcaatgcatttatagagtaccaccagtcattcgtgaaactaatcccaaagcttacacacctcaaattgtttcaattggccctttacacaaagcacgtgatgctggaaaggaagacatcatttttgagtcaatggaagagcttaaagtgaagtatctcaaggcatttctaaatcgaacccaaatacctatgggaacctttgttgtcacacttcaagcgttggaagacaaaattcgaagttgttatgcagtgcgtattaaatataacagcgatgatttcttaaagatgattctcattgatggttgcttcataattgagctttttttgagactctatagatacaactattggcggggaaaggaccctgtgttgctaaaagactggatgcgaatgcaaattaagagcgacttgatactactagaaaatcagcttcctttctttgttcttaaacaactttacaacctcgctggtatgaatcaggaatttccctcctttcttcatatttctttcaactgcttgaagcgtgtgggatgtggaacatggtgcccaacagagtccccaaagcacttcaccgatcttatgagaactagcataatatcatcatcaaaatttgttcttagaaaagaagaagaatgcaaagtaataaaacatgtatacagtgcaggccaactgcgggaggcaggtcttaaattcaaggtcagtccaaatgaaaatgaatgcttacttgacttgacctattctagtgacggtgtgttgacaatgccaatcttgaatatagctgacgattcagaagtgttcttcaggaatatagtggcatttgaggaatgtcacctttcagatgatacaaacatcattactcaataccgaaagattctagattttcttatcaacactgaaaaagatgtgaatgtactagttgataagaaaattattgtcaattggatgggtgatgctaatgcagtggctacaatggttaacagtctgggctcaaatattgggatgccacgtttcaatccagtgtatttctctctctgcaatagcttaaatgatttctatgaaagtccttgcaacaa

SEQ ID NO: 87616 - DNA, 189 bp, Glycine max
  Peptide Sequence Number=SeqID_204394
atggagaatatagctggtggccaaggcaaatcaaagagagcaacagtgaaagttagggctcgctgtagcttcctaggagaaaatgtctcaacttcaaccatatatttggcagtcacagggttaaatattgatcaaattttgacagaagttgataagtttaagatcttgtctcctgtgaccaaagcttga

SEQ ID NO: 87617 - DNA, 2885 bp, Glycine max
  Peptide Sequence Number=SeqID_204395
atggctcggccacttgtaatgatccaccctctaccaaacaattattcacatattggcttcactcttgtgagccttatggtgtgtgccattgcattgctcacgtgtgcttctcattcgcaaaaatggcatcagtggatctcttgctatgcctttgcagaagaacctgtcatagaattcaacaatgaagctgtcatgagcacttgtgatgatgagcaagaagaagatggttcactttggcagaagaacattctaatgggtgggaagtgtcagctccctgatttctctgctgcattcaacaatgtcgagagttatttgtaccttcatcctagtgaaaatccagctgctgctcttgtctccccagtgctggactcaaccaactaccattcatggagtcgctccatgatcactgcacttagtgctaagaacaagctagaattcgtggacggaagcgcgccggaaccacttaaaacggacagaacatacgttgctgcttctataagacaaagcgtgctctggatggacaaagccgaagacatctggagagacctgaagtcgagatactcgcagggagatcttctgagaatctccgatttgcagcaagaagcatcgacattaaagcaaggagccctctcggtgacaaaatatttcactaagttacgcgtaatttgggacgagattgagaacttcagacctgatccagcttgcacctgtaacagcaggtgttcctgctcagctttcgccattatcgcgcaaagaaagcttgaggaccgagctatgcaattcttgcgtggcttgaatgaacagtatacaaacatccgatcccacgtattgcttatggatcctataccagccatatcaaagatcttttcgtatgtggcacaacaagaacggcaactgctgggtaattcctcttctcccaattttaatttcgagtctaaagaaatctccattaatgctacgaagtccatttgtgattactgtggtcgaatggggcacactgaaagtgtgtgctataagaagcatggtatgcctcccaatcacgagatgagaaacaaaggcaatggaggaaggaagacttgtacacactgtggaaggataggacacactgttgatgtgtgttaccggaagcacggatacccaccgggatataaacccttcaatggaagatccacagtcaataacatggtgacgatggataacaaaaccatggataatcagactcagcatcacgaatcccaggatctcgttcaattttccccagagcaatataaggctttacttgctttaatccagcggccatcaatcggaaacacggcgtcggagcaaaccaaacaagttgcttcaatgtcgtcttgcaccactgataagcttcctaacccagttgaaccttcctcctatgctgaagcttctcagcatgactgctggcttaaagcaatgaaagctgaattgcaagctctgcaattgaacgagacttggcagcttactcctcttcctcctcataagaccgccattgggtgcagatgggtatacaaggttaagcataaagcggatggctccatagaaaggtacaaagcacgtcttgtagcaaaaggctacacacaaatggaagggcttgattatcttgacacgttctctccagtggcgaagctaaccaccgttcgtctcctccttgctgttgctgccatgaaccattggcatctaagacagttagatgttaataatgcctttttgcatggcgagctcgaagaagaagtctatatgcaggttccacctggtttaacggttacaaatccgaatctggtatgtcgtttgcagcgttcgctttatgggctcaagcaggcaagccgtcaatggttcatgaaactttccggttttctaacagtgcatgggttccaacagtctcactcagaccattctctttttctccgctttaatggttcagtcaccacgatactcttagtctatgtagacgacattattttaacaggtaacagcaacactgccatacaggaggtgctcacattgcttgatcaagcttttaaaatcaaggatctcggaaacttaaagtacttccttggcctggaaatcgcgcgttcctctgagggaattcatttgtcccaaagaaagtacactttggacatattgtctgactcaggaatgttgggttgtcggccaaacacaaccccgatggattcctctaccaagcttcacgccacgacaggaactccgttatcggcagaggcttcttcttcttaccggagactcattggccgactcatatacctcaataacactcatcccgacatcgcgtacgcagtacaacagcttagccaatacatgtctagtcccacgaatgcccatctccaagcagcctaccgcatattacgatacctcaagggcacaccaggctccgacatcttcttttccgccaccggaacccctcagctccgagctttcagtgactcggattgggccggatgccaggattccaggagatccaccactggtttcgtcgtttatttcggttcttcccttatttcatggcaatctaagaagcagtccaccgtttcacgaagctcgtcggaggctgaatatcgagccctagcctcaaccacatgtgaacttcagtggttaacttaccttcttcatgattttcgaatgacatttgttgaaccagctaccatttactgtgacaaccattcagcaattcggattgccaccaatcctgtctttcacgaacgaacaaagcatatcgagatcgattgccatgttgtccgtcaacaggtcacctcgggtcatctcaaattgctcccagtatcatcctccttgcaactcgcggatattttcaccaaagctctaccttccactatctttcaagcctcttt

SEQ ID NO: 87618 - DNA, 1115 bp, Glycine max
  Peptide Sequence Number=SeqID_204396
agcgaggaagacagtcgcagtttgcggacaacagatgtaatgaagatgaagcttcatctgaatcatcagaatttcttccaaagttaaggaggcaaaagtcatcaacttatagatctcagtatataaacaaaaatgagctgagggtatgtgttgggacgtggaatgttggaggaaagcttccacctgatgaccttgatattgatgattggcttggcatcaacgaaccagctgacatctatgtcctgggtcttcaagagattgtacccttaaaccctggtaacatatttggtgctgaagatacccgtcctgttccaaaatgggagaatattattcgagaaacactgaatagagttcgacctgaaatgccaaagataaaatcctttagtgaccctccatctccatcaaaatttaagccctcagatgacgtccctgatatagaagaagaaatattacttgaaagtgatagtgacattggtgaggaagtccatcctttggatgaagaaaacaatatttgtgatggaacattcatgggtgaaactgtgaatacaaatttattagcttccgatgctgctgatattgcaaacaccactttgccagttaaaactgacttacagaggcagttttcttttccaaagatgtttgataggcaaaaaagtttttcagaaaacatggacacatcatttgcccaacaggccactaaactaactcgaatgcttagtgggtctgaaagggtgggtttgagctggccagagcctccactacatctgctatctcagcgagttttggatagaccaacttcttttaaatcactcagatcctttaaatcatctaagtcgttcaaaacatacaactctttcaagtcaattatggatgaaatgccagggattgtaagtcttcctgaaattgaccttgaagctttgataaagagaaaaagaagatcatcatatgtaaggattgtgagcaagcaaatggttgggattttcatcaccatttgggttcgtcggagcttgcgtaaacaaattcagaatttaaaggtttcaactgttggagttggtgtaatgggctacattggtaacaagagtgaccatctgaccgatattgcagtagattattaa

SEQ ID NO: 87619 - DNA, 348 bp, Glycine max
  Peptide Sequence Number=SeqID_204397
atgggaaaagcagataccagactgcaaaagaacacaggacaatgtctatcacagagtagacgaataatttggtttggtgatctgaattatcgtatcaacttatcaaatgtggaaacaaaagctcttatctcaaaaaaacagtggtcaaaattggttgagaaagaccagctcatgctagaactcaagaacggtgtgtttggaggatggtcagaaggcgtcttaaactttccaccaacttataagtatgaggtcaattcagataagtactacggagaggatcccaaggttggaaagcgctcaccagcatggtatgcttttattctgagattctgcttccatgtttgctaa

SEQ ID NO: 87620 - DNA, 168 bp, Glycine max
  Peptide Sequence Number=SeqID_204398
atgacgcttcatcactgttcaaaatgggtaccaggaataactaacaagagtgagaaaaatgaagatggggtgatagagaagattgttaagttgtcaatacacaacagtgagggaacaaaagaatttgcagttgtagattctggagctttgactgtgcaatttagttga

SEQ ID NO: 87621 - DNA, 714 bp, Glycine max
  Peptide Sequence Number=SeqID_204399
atggaaaaggaagggtcgttgcttaaggacttcttcttagccacccatgttccattttgctccaggaatgaggaatttgtggttgatgataggatccaggagcttgaaacgcttgagctgcaggacaagccttcactggttcccattaaaaacgagtccttttctgaaattgatgtacactcagagaatgattctaccgaagaggatgttttggcaccctttttgaagtttttcaaagggagtaatgattctgtggtggaggaggaagaagctggtggggtgttagaaggttccaaagaaaggggtaatgagagtgaaaatgctgagaagttttgtgctgagtactatgagcccaaacctggggattttgtggttggtgttgttgtttcaggtaatgagaacaagctcaatgtgaatgtggggtcagagttaccagggacaatgttgacaaaggaggtgcttcccttgtatagtaaagaaatggagcacttgttgtgtgatgtgaacaatgctgaagagagtcctacggttcaggggaagatagggattctgaagaatgatgatgcaataaatggggtgccagtgcctgggggaactgttgtagagattggaaccattttatttgctgaggttctcggtaggacacttgctggtaggccgttgctttctacaaggaggctctttcgccggattgcctggcatcggctgaggcag

SEQ ID NO: 87622 - DNA, 2544 bp, Glycine max
  Peptide Sequence Number=SeqID_204400
atggtgcagtcgctgttcgccgacttcgcccggctgttccccaatcgtttctgcaacaaaaccaacggggtgacgccgcgccgttggctggcgctggccaacccgccgctggcggcggtgttggacgactgcatcggccaaacctggcgcaccgatctcagccagctgagcgagatcaaagccaacgtcgattacccgagtttcctgcaggcggtgcagcgcgccaagcggcagaacaaggagcggctggcgctgtacatcgccaaaacgctcaacgtggtggtcaacccggatgcgctgttcgacgtgcagatcaagcgcatccacgagtacaaacggcagctgctcaacgtgctgcacgtcatcacgctgtataaccgtctgctggacgatccggagatcgatcgcgtgccgcgggtggtgatcttcgccggcaaggcggcctcggcctactatgccgccaagcagatcatccgcttgatcaacgacgtggccaaagtgatcaacaacgatccgcgcgtgcatacccagctgaaggtggtgttcattccgaactacggcgtcagcctggcgcagatcattatcccggcggcggatctgtccgaacagatctcgctggcgggcaccgaggcctcgggcaccagcaacatgaaattcgcgctgaacggcgcgctgaccatcggtacgctggacggcgccaacgtcgagatgcgcgagcacgtgggggaggagaatatctttatcttcggcaataccgccgagcaggtcgaggaactgcgccgcaacggttacaacccgcgccagtactatgagcaagacccggagctgcatcaggcgctgacgcagatcgccaccggcgtgttcagcccggaagagccgaaacgctatggcaatttgttcgactcgctggtcaacctcggcgatcactatcagctgttggcggattaccgcagctacgtggacacgcaggacaaggtggacgaggtgtatctcaatcaggacgagtggacgcggcgcgcggtgctgaatatcgccaacatgggctacttctcctccgatcgcaccattcaggaatatgcggatgaaatctggcacattcagccgccaggctttcactcgcgcctgctgcgcttcgtccagccacatgccgagcttggtgcggcgccagatggcgtcggccagctctacgacccactctttctcggtcaggtagcgcagttcggcttcatacagaccgtggccgaaatcttcgcccagatcggcgaggccgttggcgccggccaggatcagctcgctctggctaccgtaggtgcgggcatagcggcgcgccagcgcttccggcaaccagccgtgggcgcggcgcaatttggccgcgtagccgtcgcgatcgccgccgaggtcaccgcccggcagcgtggcgtttttggtccacgccgggccgcagcctgggtagtagtgggccagtttttccatcgcgtgctcggccagcttgcggtaggtggtcagcttgccgccgaagaccgacagcagcggcgccttgccttgttcgtcgtgcacgtccagcgtgtaatcgcgggtgatcgcctgcggcgaatcggattcgtcgtcgcacagcggacgcacgccggagtaagtccagacgatgtcgtcgcggcccagctgcttcttgaagtgatcgttgtacactttcagcagataagcgatttcgttctcgtcgatcttcacgtccttcggatcgcctttgtactccacgtcggtggtgccgatgatggagaactcgtcattccacgggatcacgaacacgatgcggtggtcttcgttctgcagaatgtaagactgcggctgatcgtgtacgcgcggcaccacgatgtggctgcctttgatcaggcggatgccgtaaggcgatttcagcttcaggccgtcgtcgaagaagtttttcacccacgggccggtggcgttcaccaggcctttggcgcgccaggtgaaggttttgccgctgtcgatatcgaccgcttccaccatccacatgccgttttcacgccatgcgcgggtcactttggtgcgggtgcgcacttcgccgccgcgtttttccacttcctgcgcgttcagcaccaccaggcgagcatcgtcgacccagcagtcggaatattcgaaaccgcgcttcaattcaggcttcagcaccgactctggtccaaagcgcaagcccttgctgcccggcaggctggtgcgtttgcccaggtgatcgtacaggaacaggccgatacggatcatccaggccgggcgcaggtgcggctggtgcggcaggcggaaacgcattgggaacgcgatgtgcggcgccagcttcagcagcacttcgcgttcggccagcgcttcgctcaccaaacggaattcgtagtgttccaggccaagtcttgcgcttccagtagcagtaccgacagcccgcgcccggcagcatccgccgcgatgccggcaccgttgatgccgccaccgataacgatcaagtctttggtttccacgtcatcttcctccagatgttcgaaatag

SEQ ID NO: 87623 - DNA, 345 bp, Glycine max
  Peptide Sequence Number=SeqID_204401
atgagaattcaagggactaaccgcctaagaattctttgtcttaacacattggagggtacatccattgtggcacaagtagagggtacatctacttgggttgttatactgagaacaagagagggtacatctcttgtggatcagttcaagtggagggtacatccacttggttgttcaaagagaacaagggagggtacatcccttgtggatctttggcttgtaaaggattttacaagggtgacagaaatctcaagaaccgttggttgcttggggactggatgtaggcataggttgttgccgaaccagtacaaatcttgtgtttgtcttcttcttccctacactctttaa

SEQ ID NO: 87624 - DNA, 981 bp, Glycine max
  Peptide Sequence Number=SeqID_204402
atggcctctgggaaacgcaagagtatcggttcaagacccacagctcaatatgatacatggagatttcgctccttagatgcatggaaccggtacacgaataatgtattggggagaaacatcttgccagagaggaaggtggagctctaccatactgagtttgatgattttaagactgagttggagaggcgtaatctccataaatgcctcaccaatttggttgatgggagcatagatgtggctttggtgaaagagttctatgcaaacctatacagctctgagggtccttcaccaaagcaagccagggtcagaggccatctagtgaagatcgacgttgatagcctcaacacattcctagagacacctgtggtgttggaagagggtgagactttgcccatatactccagatattgcaggctaccttcagatcctagggagattaaggctaccctatgcataccaggccgagggtttatcttgaatgttgagggccatcctgggaggatcttagcccaggtttggagtgttctctcatactccaacctagccgccacatctcacacatctgacctgataatggatagagctaggctgatcttcggcttagtctcccgcatggacatgaacatagaagctctcatttttggccagatgacttctatagcccagtctaactcttctagacttggttttcttgctctaatcaccaccctatgtcgagccagaggggttgtctctgacagcctcacttttgagcatctgagcccggtcattaacttggcctacttcaggaagaactgttggaatcctgatgatctgacagttgttatccgaggggctaggagggcgagaccaaggccagttgatcttccttccacatctgcagttcctactccaggatccacttcagcagctccttcagtccaagctcagactgattctcagcgctttgaagctatacttcagagcattcatcagggataa

SEQ ID NO: 87625 - DNA, 294 bp, Glycine max
  Peptide Sequence Number=SeqID_204403
atgtggctccgcatgccaccggactcttgggtcacggtaacaaaaagtggggtggtcaacaaaagcagggcttttgctcctacgtatcctcaattttgtgatgaggatctcagatctacgaagttcttgctaactgtgagactaaaaatagtctcggtgttttcttcaccaaaatgcgaacatgctttagtaaagagacaaaacttccaactgatcagagcaacatatgccttttggatgaaaaacaatgtgtctatcggggaaggagagtatgctgatgaaattttctcataa

SEQ ID NO: 87626 - DNA, 426 bp, Glycine max
  Peptide Sequence Number=SeqID_204404
atggcagattcaatggatgactcctcagccattgaagaaactaaggtaaattctgaatttgaagaagttttggaagcatttaatgaaatgcatgaagaagcgcaaaggcttgctgttttgaacaataagttgagaagtgatttaaaattgcataacactaaattggcttcaacacaaagtgagttggataaattgagacaagaaaatgaaaatcttgtttcaagttataaagccactggttgtgtttgttcttctgcttctcttaatatggatgattacaaatcttggcagattgagtttggaaagttaaaaaaggatcactatgaagaacgtatgaagttgcaaattgagctttcctatcttaaatatcttttaagaaaaatgaacaaaggaaagagtgatcttagtcacttgctcagtgtgtaa

SEQ ID NO: 87627 - DNA, 363 bp, Glycine max
  Peptide Sequence Number=SeqID_204405
atgacgttgccacttagcaacattctgcctagcgaccacaatgccgatctccccctacggaagtatcagttggtctgtgccatcgtgacatatgggtcgcgcccacaagacacccagtggacccggagaagtccaacagggccctggggtttccagctcgggttacgggcctttgtcagtcctatagggtgctcgtccccccagcaagggatcgtgcccgcaagacacccagtggacccgaagaagtccaacagggtcttggggtttctagctctgattacgggcctttgtcagttctatgaagcgcccgtcacccccaacaaggtcattaggccccccattaaccgggctttcatcaagtag

SEQ ID NO: 87628 - DNA, 268 bp, Glycine max
  Peptide Sequence Number=SeqID_204406
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtctggcgaacgtgaggacccattccatccaggcctctttgttggggacgctggaggatttcaaagtcccacacgtgaaccac

SEQ ID NO: 87629 - DNA, 210 bp, Glycine max
  Peptide Sequence Number=SeqID_204407
atgggggaaaaaagcgctatgaatcgaaggtttcgcgaatcgaacctggagctggaggtgtgggaggaacaaatcgaaggcgatgaatttcagaaggcgactaatccagagcgttcaagacgatgcacggcacagaaggtggagacagcgcgtgaggaacagtcgaacagaaacacaggcttcaggaatgaagaaatacattttagataa

SEQ ID NO: 87630 - DNA, 246 bp, Glycine max
  Peptide Sequence Number=SeqID_204408
gggaaccaaagtagttcctcagcaagcatgatggtagcactcaatgagggtcatgaggttatctctaaggagtccactaccttgaagctctcggcagtggtggctgtgaggaatagtaatgataacaaggtgtttgcaaatgagatggtgaataaccttctaacatttttcatgcgtttgtgtaaccgtttgcatcaggcgatgaaaccggacgttggcaaaaggaaggaaccccttatgtgttga

SEQ ID NO: 87631 - DNA, 1644 bp, Glycine max
  Peptide Sequence Number=SeqID_204409
atgtctgctccattgggtattggaattcgttctggaagttatgggtctttggataaacaggtacatcagaacgggactgcacggaaggcttcaaagatgctcaaggagaaggagaaggagaggctgttcctttggatctgcaagttcgccggccgcaagaaggtcggaatgctcttcctctgcctcatctccgccgcggttttcatctgggttttgtatgttggaaaagctgaagattctcaggacggaaacactgtgtcaagcattaatgttaatgaaagtgtatctgcaagtgattctacatctgagaactcaacgacaaatgcaatgggcttaactaagagatcggtattaccccctccacccgcgggttattttttgggctaccgtcttcctccagggcatccgtgtaatagcttcacactccctcccccacctgctgataaaaagcgtactgggccacgtccatgcccggtgtgttaccttcctgtggaagaagccattggactgatgccagccttgccctcaccttcaccagtccttgggaatttaacatatgtctatgaagaaaatttaagtagagatggagaatttggtggttcagactttggagggtatcctactttgaagcagagaaatgattcttttgatatacgagagtcgatgagtgtgcactgtggatttgttagaggaattaaacctggtcgcaacacaggatttgacattgatgaagctgaccattttgaaatggagcagtgtaatggagtggttgttgcatcagccatatttggaaactttgacgagataaatgagccaaacaatataagtgattattcgaggaagactgtatgcttccttatgtttgttgatgaagaaacagaaaaatatctgattagttctggcaaattgggaatcagcaagaaaattggtttatggagaattattgttgctcgtaatcttccttacccagatgcaagacggacaggaaagattccaaagcttctgttgcatagattggttccgaatgctcgctattctatatggcttgatgggaagcttgagcttgttgtggatccatatcaaattcttgaaaggtatactccggctgaggcaaataaagctgctggaaagtatgaaaatgcctctattgactttcagatagagttttacaagaatgagggattgacaccatacacagaggctaagcttcctcttataagtgatgttcctgaaggatgtgtgatagtacgagagcatgttcctattagcaacctctttacttgtctttggttcaatgaagttgaccgatttacttcaagggaccagattagtttctcaaccgtcagggacaaaattttgtcgagggtagattttcattttaacatgttcttggattgtgagagacgcaactttgttgttcagaaataccacagggatctattgctgcgcctggctccaccagcttcacctcctccaccatctcctcctcctcctcctccattgcctgtgcttgaaacatcacctgaaaagggtgcaaactctcccattagaagaggccctggaaggcgtggaagagatcgaagagctggttcacggcaccaccgcaaagttgttgctggaagcagagagatggaaccaagttaa

SEQ ID NO: 87632 - DNA, 204 bp, Glycine max
  Peptide Sequence Number=SeqID_204410
atgacaacgaagctcggtaaaggctatggcaatgtgggtggggattgcagactaaggtggctcaaagattataacggtacggtgattaggttagaccagaggtttggtgcgttgtggttatggttggagttggtggcattttcatggttcgaggtggaagttggcacggtgggggtgatggtgatgtggtggtgtccaagttga

SEQ ID NO: 87633 - DNA, 264 bp, Glycine max
  Peptide Sequence Number=SeqID_204411
atggatactaatgcgtggtggtcttgcttgatggtcggaggggggagtgccgccgctttcacgacaatgaggaagaaggaagtggtgaagaatggttgtaaatcacacactgtcagaggggagagggggagtagaaggagattggggacagagaaaaggattttgaacaaggggcaaagaaacatgctaagcttgacagacttaattaggaaacatgataagcttgacagacttaatgattgcaagtggtggagtgtaaagtga

SEQ ID NO: 87634 - DNA, 1749 bp, Glycine max
  Peptide Sequence Number=SeqID_204412
atggacggaaaagaaaggaaaataaaatctgcagaatacgaagcagtggtaagtgcaggcccacacctgagacgcctccagcaagcccacgctcacctggtggtgacgggttgtcaccggagccgcgctctgctgacgaaactcctcacgctatcgtgcgctgcgggttccatcgcctacactcgccgcctcttccgctccgtttccgacccagattctttcctcttcaattccctcatcaaagcctcttcaaaattcggtttttccctcgacgccgttctcttctaccgtcgcatgctcctctctcgcatcgttccttccacttacaccttcacctccgtcatcaaggcctgcgccgatctttccctcctctgtatcggcacgctcgttcattcccacgttttcgtttctggctatgcctcagattccttcgtccaagccgcattaatcgcgttttacgcgaaatcgtgcacccctcgtgttgcacggaaggtgttcgatgaaatgcctcagagaagtatcgttgcttggaactccatgatttcggggtacgagcagaacgggcttgccaatgaggctgtagaggtttttaacaagatgcgtgagtctagggtcgagccggattccgcgacttttgtttcggtgttatccgcttgctctcaactggggtcgcttgactttgggtgttggctgcatgactgcatcgttgggagtggaattacaatgaacgtggttcttgctacctcgttggtgaacatgttttcgcggtgcggggatgtgggaagagcacgtgcggttttttattcgatgatcgaagggaatgttgttttgtggacggctatgatatccgggtacgggatgcatggctatggtgttgaggcaatggaggtttttcatcgaatgaaggcacgtggggtggtgcctaacagtgtcacctttgttgccgtgttatctgcatgtgcgcatgcagggctaatagatgaagggcgttcagtttttgcaagcatgaagcaagagtatggtgtggttccaggagtggagcaccatgtttgcatggttgatatgttcgggcgaggtgggttgctcaatgaggcataccagtttgttaaagggcttaattctgatgagcttgttccggccgtgtggactgcaatgcttggagcttgcaagatgcataagaattttgatcttggtgtggaggttgctgagaatctcatcaatgcagagccagagaatcctggccattatgtgttgctttctaacatgtatgcattggcggggaggatggatagagtggaatcggttaggaatgtgatgatccaaagaggccttaagaagcaagtgggttatagcaccatagatgttgacaatagaagttatctttttagcatgggtgacaagtctcaccctgagactaatgagatttattgtttcttggatgagttgatatggaggtgcaaggatgcaggctatgcacccgtgccagagtccgcgatgcacgagttggaaggggaagaaagggagtatgccctcaggtaccacagtgagaagcttgcggtggcatttgggctgatgaaaactggcgatggagtgactctcaggattgtcaagaaccttaggatatgtgaagactgtcattcagcaattaagttcatctctgctgtaatgaatagagagataattgttcgggataagcttcgtttccatcattttagagaaggctcgtgttcttgttcagattattggtga

SEQ ID NO: 87635 - DNA, 192 bp, Glycine max
  Peptide Sequence Number=SeqID_204413
atggtggcgtttctagtgctctctagagctcatccaccggttgctctgttagggtggaataatggcaatggcggcaacaatgacgatggaggcggcaaaagtgaggtgctgtggcagtggcaatggaatggtggaggtcatagtggtggtggttgtagtggtggcgacagtgtggtaatgaaggaatggtga

SEQ ID NO: 87636 - DNA, 498 bp, Glycine max
  Peptide Sequence Number=SeqID_204414
atgagggtgaaagagaatgaatgcagagaaaagaaaatatatgattggtgtgtttccagagagaagaatattgatgcgacatggcccaagccctccacgtcgatgaacacttccgccatgcgattggcattgacggtttccctgactggaggctacaattctacgtgttcccctacgtccgcaccaatcaacacttcacgagctcagatgatgttttttgaagaaaatgatcatcgacgtgagggaagagttgcgagttcaaaaatgagatttcaaaatcttttagtgacaatctttaagttatttattgcaactgaaatcgacattgatgggtttatggcaaacaaaaaagaagttatcagcacttcagcagtgtttcaccattgccgttgctgtgcttgtgccattgctaggtgtattgctccatatatggttgatatgtctaatttggatgacttggagaaaaagactattgacttagctaaggtcatcacttaa

SEQ ID NO: 87637 - DNA, 645 bp, Glycine max
  Peptide Sequence Number=SeqID_204415
atgtctgcaaccaaatctgcgtcaaggaagcgagcatccgaatccgaacgtgcaaaatctgacaagaacaagcgatcagccccagataacttcgatctcgatttggatttcgatctctcagagttcgtattcgccgcttttgctttttcgtttatttttttcggaatcgtgcttacagtttcttatattgcgcgaatctgcagtgacatcaaaggaatcgtgtcggcgctgcacctgatcagagacaaggcacagaaggacggtcagaagaagaacgaagagacaatttccagtgtgggttctgaggttaagtctatgatcgagggattgaggtcaaaaattgagaaggacaggcaaagctttgctaaggcactttcaaagagttccaaagaggaaggaatttgcgtgttgttcaaaactggtttaatcattgctgtgactgcaagcatgcagtatgaaagttcattgaagaatgaaactgctaagtttcaagcacttcatgagaatttttgcaaagagaaagctagttctctgcaggcgctgaaaggtatactccctgtaacattgtcatcgggtggactaattagcttcatgagtgttatcttattaggattgatgattcttttgacagtttctgaaaattga

SEQ ID NO: 87638 - DNA, 414 bp, Glycine max
  Peptide Sequence Number=SeqID_204416
atgtcgttcaacgccggtgtgtcaaagtttcttccggcgattccgtgcaaatttgtgccccctgaagacttcaacctcgcactgctaactcttgatttggaatttgttaaaaaggggagtaagagtgaacagattgatgctgttctactggctaagcaacttcggaagagatttatgaaccaggttatgactgtggggcagaaagtattatttgagtatcatggaaataattatagctttactgtcagtaatgctgctgttgagggccaagaaaagtctaattctcttgaaagagggatgatttcagatgatacatacattgtttttgaaacatcacgtgatagtggaattaagaatcagcaacgtagtggtgccattgccatacaaagacactatgttggaaagccgctttaa

SEQ ID NO: 87639 - DNA, 282 bp, Glycine max
  Peptide Sequence Number=SeqID_204417
atgcttcaacgtcaatcttctgatgagccctcagtatatgtggctttatatggaatatgtgatatcttcaacctcagtcttctgataagtcggatatcttttgtgattgcatatggaagacaagatgttgtccttgagactctgatattggatactttctttatagcctttgatatgtcttctatggatgtggattcaacactatcatgggcttgggaaccacaagcagttagagctctaaggaagctctattacaaggaaggtccaatttggttttcctaa

SEQ ID NO: 87640 - DNA, 465 bp, Glycine max
  Peptide Sequence Number=SeqID_204418
atgacagtcccttttgactttgagccctttgtcaaagtcaagagatccttctctatcggtgtgaatgtagtctcctctttcggataccacaaagagagggatggctcttgggtgaagaaagatgctctagtacaggccacagaagaccgctctccatcaccaccgcctcagagagatgattcttcatcttttatgcacagcatacttgacaggttggatggactccacacttttgtaggagagcgctttgactcgttggatagccgtattgatgccatggatgcacgatttgcagggatggacacacgcattaccaaacttgaggaggatattgtcatcatcaaaaaaggtgagattctggaagcaatgccttccaagattattttgatgatgccaaagaatcaagagtcaaacaagtttcaagattcaagaatcaagagaagactcaatcaagataagtattaa

SEQ ID NO: 87641 - DNA, 1046 bp, Glycine max
  Peptide Sequence Number=SeqID_204419
attgtcatcaacgtgagggtgccactagcaacattttcaagcagaaagaatttaaccttcagtcgctaggtattggtggcctgagtgcagaatttgcagatatatttcgaagagctttcgcctctcgtgttttccctccccatgtgacatctaaattaggaatcaagcatgtgaagggcatgcttctttatgggccacctggaactggaaagacacttatggcacgtcaaattggaaaaattttgaatgggaaggaaccaaagattgtaaatggtcctgaagttttgagcaaatttgttggtgaaactgaaaagaatgtgagagacctttttgctgatgctgaacaagatcagaggacccgaggggatgaaagtgatttgcatgttataatcttcgatgaaattgatgctatttgcaagtcaagaggttcaactcgagatggtactggagttcatgatagcattgtaaatcagcttcttactaagatagatggtgtggagtcactaaataatgttttacttattggaatgactaacagaaaggacatgcttgatgaagctctcttaagaccagggaggttggaagtccaggttgagataagccttcctgacgaaaatggtcgattgcaaattcttcaaattcatactaacaaaatgaaagagaattcttttctagctgctgatgtgaaccttcaagagcttgctgctcgaacgaaaaactacagtggtgcagaacttgaaggtgttgtgaaaagtgctgtctcatatgctttaaatagacaattgagtctagaggatctcactaagccagtggaggaagagaacattaaggttacaatggatgactttttgaatgcactccatgaagttacttctgcatttggagcttcaactgatgatcttgaaagatgcaggcatcagcccattgatccagagcagttacatatcgataaacaaggtgcttggccagaactttctctcggacaaaaaacagatcaatttccacatgctttcttcttgcataaagaacaggcatgggcaacatga

SEQ ID NO: 87642 - DNA, 900 bp, Glycine max
  Peptide Sequence Number=SeqID_204420
atgaaacgcctgttggccccgctttcgatcgtgaatcaggtcgccctgctgatgttgctgtcgggcattctgggcgtggccggcatggggatttccgcctggatgtcgcaaagcattcagggcaatgcgcacgccatcaacaaggccggctcactgcgtatgcaaagctaccgtctgctggcgcaggtgccgctggatgaacggcatgaagcgttgattcgcgaactggagcgcgacgaaaacagccccgatctgcagcgttcggtggagcaggaagggttgacgcaacctttcgacgccttgcgcgactactggcaacagaccctgcaaccacgcctgcgcagcgcgcagcgcccggccgacgccgcgccgcaggtggcgcacttcgtgcagctgctggataagctggtgtcggatatcgacaggcaaaccgagcgccgcctgctgatggtgacgctggtgcaggccggcttcatcgcgctgaccctgctgctgctgatcggcaccacctgctacctgcgccgccggttgctgcatccgtggcgacagctggtggaaatggcgctggcggtgggccgcggcgattttagccgccgcttcgcgcagcgcggccatcaggatgaaatggcgtcgctcggcggcgcgttgaacaccatgtccgacgaactgtcggccacctacagcgggctggagcagcgcgtggccgagaagaccgcggacctgcagcaaaagaatcaggtgctgagcttcctttatcgcgccagccgcctgctgcacgccagcgagccgctgtgcagccgcctgacgccgctgctcaaccagctgcaaaccctgacgccgctgcgcgccattcaggtgcgactgtatgaaacgacagccgggaaccgctgctgcagctga

SEQ ID NO: 87643 - DNA, 258 bp, Glycine max
  Peptide Sequence Number=SeqID_204421
atggatttcttttctgatgagagtttcgaatgcattcaagcatttcaaaactcaaatctcattccctttatgtctttaaaactacctgtgtattctgaattggaaaaagccttttgtcgcaacctacccttcggcgggagggcgacgcgagggttcacgggtgcgtcttccatgggaggaagatgcgcggagtcgccaccaacgtttattcgaggaaaacgtcaaaaaaactggaaagctatggtctacgaactttaa

SEQ ID NO: 87644 - DNA, 390 bp, Glycine max
  Peptide Sequence Number=SeqID_204422
atgttgtggctggccagtttgaacgtggactattggttggaggttgtctttcggcaagtttcaggaaaaggtagaagggtagttttcaaattaaaggacttgagccagcaattgctatcttgcactttgtgggatgattattgcttgcagtttgtgaagttcttagatgattataaaggtgatggtccaattacagttctattaagccattgtaggatcaaggaagcgcagggcttgcagagttgggcattgaggcccggtcaggttttaaatcccatggtgaagggagtacacagctttcaggttctatccaattatcatcaaaagaatcattctttggcaaggctgaggcaaagactattgttgagattaacaccatctctgaagtaa

SEQ ID NO: 87645 - DNA, 420 bp, Glycine max
  Peptide Sequence Number=SeqID_204423
atgaatactatatgtgcctcctgtcaggcaactaaccgcgttcccgaggaacgtctggccgacggagccaaatgcggtcgctgcggcgatgcgctgtttagcggtgaagtggtgaatgccacggcggccacgctggataaatacctgcaggacgatctgccggtcgtggtcgacttctgggcgccatggtgcggcccgtgcgtgaacttcgcgccggtgtttaaagacgtcgctgacgagcggcgcggcaaagtgcgcttcgtgaaagtgaacactgaggcggaacctgcgctcagcacgcgttttcgcatccgcagcatcccaaccattatgctgttcaaaaacggtgagatggtggacatgctgaacggtgcgatgccgaaagcgccattcaacgaatggctcgacgaatcactctaa

SEQ ID NO: 87646 - DNA, 1017 bp, Glycine max
  Peptide Sequence Number=SeqID_204424
atgtctgaaaatgccgtcctgcgcctgcgtgcgcagcgtttagcgcgtgccacgcgcccgtttctcgcccgaggcaaccgcgtgctgcgctgtcagcgctgcctgctgccgcataaaaactgtctgtgcgcgaccctgcagccgcaacaggcgcgcagccggttttgcctggtgatgtttgatactgaaccaatgaaacccagtaataccggccggctgattgccgacattctgccggaaacccaggcctttggctggtcgcgcaccgagcccgacgccgcgctgctggcggcagtgcagacggcggattatcagccgatggtggtttttcccggtgcctacgccgatgccgatcgccaggtgctgaccacgccacccaccggcggcaagcccccgctgtttattatgctcgacggcacctggaccgaagcgcgcaaaatgttccgcaaaagtccgtggctggatagttttccggtgatgtcactgaatgtggcgacgccgtcgcgctacacgctgcgcgaagcccatgcgccggtccagcactgcaccgccgaagtggccgccgcgctactggaacaggcaggtgacgtcccggcggcgcaggcgttgctgcagcactttgaacgcttccgtcaggcctatctggccgctggctcgcagcctgacatcgacaaatcggcaaccggcgtaaaagcgtttacaatcatgccaatcccgagagcaggagcgaatgatgagccaacgtggactggaagcgctgttacgaccgaaatcaattgcggtgctgggtgcgtcggtaaaaccgggccgcgctggctatctgatgatgcgcaatctgctggcgggcggctttggcggtccggtgttgccggtcacgcccaaatacaaggcggtcagcggcgtgctggcctggccggatgtggccaccctgcccttcgcccccgatctggcgattatctgcacccacgccagacgcaatctggaacttttacagcagctgggagaaaaaggctgtaa

SEQ ID NO: 87647 - DNA, 321 bp, Glycine max
  Peptide Sequence Number=SeqID_204425
atgaggagggcggtcagaagccaaatccccgtaccggcaaaggcggccgtcctgctgcgcgccaggaagagaatcgtcgctctggtcctcgcagcacccgtaataatgaagagagcggtcgtccgcgcaccgcccgtggcgatgatgccgggcgttcgcgtggtccgcgtgacgatagcgcgcgcggtcgccgcagcgatcgggacgatcgcggcttcagtgattcaccgtggcgcaccgtgtcacgtccgccagtcgccgctgaagcggatgcgggtgacgaagcggccagcagcaagccggttatcgacccggaactga

SEQ ID NO: 87648 - DNA, 1302 bp, Glycine max
  Peptide Sequence Number=SeqID_204426
atgaccgacttacaacaaaactcggcccagccggaagcggcagccgtcagtaaacaacgcatctgggccattgtcggcgcgtcgtccggcaatctggtcgaatggtttgatttctacgtctactcgttcttttcgctctattttgcccatgtatttttcccggccggcgacaccactacccagctgctgcaaacggccggcgtgttttcggcgggcttcttaatgcgccccatcggtggctggctattcggctacatcgcggaccgtcacggccgaaaaagttcgatgctgatctcggtatgcatgatgtgttttggttcgctggtcatcgcctgtttacccggctatggcgaaatcggcattgcggcaccggtgattttgttgctggcgcgcatgtttcagggcttatcggtgggcggtgaatatggtaccagtgctacctacatgagtgaggtggcactggaagggcgcaaaggcttctacgcgtcgttccagtacgtcacactgattggcggtcagctgttagccgtgctgacggtcgtggtactgcaacaaattctcagtgatgaagcgctgcgcagctggggctggcgaattccgttctttcttggcgcggttctggccgtggtcgctctgtggttgcgtcgctcactgaatgaaacctccgagaaaaagcaccgggaacatcgcgatgccggcagcatccttggcctgctgcgtaaccattcgcgcgccttcctgatggtgcttggctttaccgccggcggatcgctgagcttctataccttcacaacctacatgcagaaatatctggtgaacacggcgggtatggatgcgcgcagcgccagtgcgttgatgaccggcgcgttgctggtattcatgctgattcagccaattgtgggcgcgctgtcagataagattggccggcgggcatcaatgatgatcttcggcgctggcgcggctatctgtaccgtgccgattttgatgttgctgcagaatgtgcaaagtagcgggctggcgttcgtgctggtgatgctggcgctgattattaccagtttctacaccgccatcagcggcatccttaaagcggagatgttcccgccggaagtgcgggcgctcggcgtggggctttcctatgcggtagctaacgctatctttggcggttcggccgagtacgtggcgctgttactgaagaagcacggcatcgaaaccactttcttctggtatgtctcggcaatgggcgcgctggcatttctggtatcgctgatgctgcaccgcaaaggcaaggggattgcgctgtga

SEQ ID NO: 87649 - DNA, 372 bp, Glycine max
  Peptide Sequence Number=SeqID_204427
atgttagcgtatttcctttataactttcgtcctcttttccacctgaaagttctggaaatcttattctcaaactcgcaactcttctctcacgctgataatgctcttcttcaagaaacaccgtctgagctcgcgaagcgtcgatcgggtgtgggcgtagggggacacgtagaactgcatgtggaagcaatgctttccaagattattttgatgatgccaaagactcaggtcaagaatcaagagtcaagcaagtttcaagaatcaaagatttgttcaatcaaagcatgtttcaagaatcaaagagtcgttcaatcaaagcaagtttcaagaatcaagattaaagtgaagattcaagagaagactcaattaagataa

SEQ ID NO: 87650 - DNA, 489 bp, Glycine max
  Peptide Sequence Number=SeqID_204428
atggtcattgaccaatccctcttctatgatttgacccaattatctagcgacggtataccatttaaaggtacattgaacgataattggaagtttgatttttctgtgcatgatgcccgccaattggtttgcaccaaccaagcggatatgaccggaagacttcttgccggttcattggctcttgaaattcacattcttcactatcttattgttcgtattttacttccaagatcttcaaaccttgcacagtcactctttttccttcaacatttcaacatccctcttgattctgaaccttatgttccaatcaagagatctttcttgatcggtgctgctgtgcttgcatcctttggttaccgcaaagagcgtgatggctcttgggtaaaaagggtactcaacaaaatgatgatgaaggacaattacctgttgaaggagactcttctctccttcaaagtattttggacaggttcgatggactccacacttatgttg

SEQ ID NO: 87651 - DNA, 860 bp, Glycine max
  Peptide Sequence Number=SeqID_204429
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccacaatccgaggatcttcctcataggagatgaaaatatccttgtatttaggattgatcgataccagacgcaagccattctcctctcgatagacccgtttgatatagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 87652 - DNA, 1007 bp, Glycine max
  Peptide Sequence Number=SeqID_204430
tctgcctctggtcatgggtccttcaagtgcttcatggtccttgcccttagttgtgtcctcatcactgtgttgggcctgtttaagtctgcctctggtcatgggcccttcaagtgcttcatggtccttgcccttagttgtgtcctcatcaatgagcccatggtagatgctgccgcacaagacaccggtgcagagactgacgcacaggataccggtgcagagactgacggggacgagtctgtgggatttcctggtggacccaaggacccatcagtgcttacagagtatgctgaccatgttgcgggcagtatatggtctggacagaaacgttctgagttgaagttatgctcccatgggaggaaggtgcataaattgggcaggcctgttcctgtaattgaggacatggagacttctagtttccatcttcctgtggggaaggtgtcgatcacgctggacgacatcgtgtctcttctccatttgcctatcattggcgcattccatgacttccagcctctgcgcaccgacgaggtggtggtgttgttggttgagttactgatggtcttagcagaggtggtcttggccgagagaggccaatatggtgtaccatatgcgttccatgacctcactcttgttgggaggtatgcatggggagctgctggcctcgtccatatgtacgatcaacttaatgatgccagcctcagcaccagccaacagcttgttggttacatcaccttgttacagtgcaatgctgatccggactatgatgaggtgtcaccatgtgcgtgtcgatgcattgcgacgaagaagactgtgaagaaggtatctacagcgacgtacaggcagcgcctggatcgtctgaggatcccaaatgtttgctggatgtcatatgcgaagcaccgacctgtgcaggactttcatccaatttcgtgcttctcgggacagctcccttgggggcctgttgttgtcagatacagaccagagagggttatgcgtcagttcggttacgtcca

SEQ ID NO: 87653 - DNA, 225 bp, Glycine max
  Peptide Sequence Number=SeqID_204431
atgaccaaacttggtctctgcttgtcatcgggcccgccgcctctggatgacaaaagggtgcgaataaccataagaatgaccaaacttggtctctgcttgtcatcgggcccgccgcctctggatgacaaaaggggtgcgaataaccataaggtatctctcgcgtatcatggggtgcagaatgaccaaacttggtctctgcgtgccatcggacacgactgtgtctga

SEQ ID NO: 87654 - DNA, 515 bp, Glycine max
  Peptide Sequence Number=SeqID_204432
ggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatatcttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacacctgatcaaaagactctcagacaatggcattgatgatggagaagcagctgaggaagaagaagatgcagcagaggatacagaatcagatgatgatgattctgatgccaccccatga

SEQ ID NO: 87655 - DNA, 351 bp, Glycine max
  Peptide Sequence Number=SeqID_204433
gactgttcatgtgttctccacttttgagtttggagctgtgatcgatgattgcctaagagaggatcctcaaggcaatcctccattctcatccttttctggagccacagaggaccctcaaggcaatcctccatactccacctttgttcggagcaccatgaatgtcattgccttgcgctgttcatgtgtctccattatcaagtgcgaagcttatggtgattgggaagcacgttattctgttgttttccagatcgaagaaaaagaagaagtagagatgagagtcgtcatcacggaaggggcaggacggacgaaatcagtgtcctatctttgctttcctcttatcttcgatgagag

SEQ ID NO: 87656 - DNA, 261 bp, Glycine max
  Peptide Sequence Number=SeqID_204434
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggatccattccatccaggcctctttgctggggacgctggaggatttcaaagtcccacacgtgaaccac

SEQ ID NO: 87657 - DNA, 249 bp, Glycine max
  Peptide Sequence Number=SeqID_204435
atggcatctaagaaaaggaaggcttcttctacacctacccaggccagatatgacagatccaggaatgtggtagtttattacactaagtttgatgagttcaaggaggaactcgagagaagacactgggatgagaagttgactgattttgctaacaacaacatggacattgctattgtcaaggaattttacgccaacctctatgaccccaaggataaaccacctaagcaggtttgcactcctgaggcctga

SEQ ID NO: 87658 - DNA, 1072 bp, Glycine max
  Peptide Sequence Number=SeqID_204436
atgccgtatgcttttctaaaagcggtcccttacaggtatagtgccacgatgttggaaggtgggcaggaggtgcctttgccctccctaactcctgcgatttctgtggacaacattgctagtgacggtaaagttctgaggaatggacgtgttatccccactttgtttgcaaagaaagtgaatgatccggcagttaaacaggcgacagtgaatggccctggtacaaggaaggaagtaggccaatccaatgggactagcaagaattctgatcatgacgaaattctgaaactgatccagaagagtgagtataaagtagtagaccagctgttgcaaactccctctaagatatccattttgtctctgctattgaactcaaaagcacaccgtgaggctctaatgaaggtgttggaccaagcttttgtggagagggacgtgactgttaatcaattggacagtatagtaggaaacattactgcctgcaataatttgagttttagtgatgaagaacttcctgaggaggggagaaaccacaatctggcgttacatatatcggtgaactgcaagtctgatgctctgtcgaatgtacttgtggacactggttcctcattgaatgtaatggccaaatccatattagatcaactttcctaccgggggcctcccatgagaagaagcggggtggttgtcaaagcgtttgatggatcaagaaagtctgttatcggggaggttgatttgcccattacaattgggccgtttgttttccaaattacattccaggtgatggatatccaagccgcatatagttgccttttgggtaggccatggatccatgaagctggggccgtgacatccaccttgcatcaaaagctgaagtttgtcagaaatgggaaattgatcactatgagtggagaggaagccttgttggttagtcatttgtcagctttttcctttattggtgctgatgaaaccgaaggaacctctttccaaggcctgactttagagggtaaaaagccggagaaaaatgaagtatcttttgctacttggaagagcgcacagaaagtggtgcaggaaggaacag

SEQ ID NO: 87659 - DNA, 243 bp, Glycine max
  Peptide Sequence Number=SeqID_204437
atggaacacgcatcccgcgagtcacgcgtcgccctcccgccgaagggtaggttgcgacaatggggctctggacttgatgatggaggatgcatgaacagcgctaggcaatcaattcatggggatccgaacttgatgcgctacacaatcaattcatggggctccggacttgatgatggaggatgcacgaacaacactaggcaatcaatttgtggggctccggacttgatggtggaggatgcatga

SEQ ID NO: 87660 - DNA, 246 bp, Glycine max
  Peptide Sequence Number=SeqID_204438
atgactgccgacaaagggaaaacccatttcgaagtggttcttcctttggattgctattcaaggtcgttcccaactggcgatgtcctgccccacataaacaaagaggaaaagaccgaaacaccaagaaatcatgtgcaaaataaagtcatggtgcagctatggtttggaattagggtgaaagaacccggtggaccattcggtcctaaattcagatcttattcggagccccatggattgattgcctag

SEQ ID NO: 87661 - DNA, 480 bp, Glycine max
  Peptide Sequence Number=SeqID_204439
tctgtgcctcggtggtggatcatcatgtcataacatggcaagacacaaggtcacacgcacacacacacacacacactcacgcaggcacaaggggagaggaggggcttggtcgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggtcctctc

SEQ ID NO: 87662 - DNA, 371 bp, Glycine max
  Peptide Sequence Number=SeqID_204440
agacaggcccagggggatgctccgcaggtcgcagacgcgtcgccacctcatcaggctggcccagctggatcattgatacggagcagtatttacggcatttggttcaccagcaggcggccaaccaccgggctcatgtacagacccatgattgtctttaccagttgagcctcagcctgcagagccagggttttacttcttttccgtgccctactccggatcagttcagggcagaggccgcatggcccggagattggcctgaggcccgggcaagagaggcaccagcagaggcttccgacgaggcagatgaggcccgcgaggacgaggagatgaccgatttacttgatttcttgggagggagcagagccacatga

SEQ ID NO: 87663 - DNA, 600 bp, Glycine max
  Peptide Sequence Number=SeqID_204441
atggaatacgcacgggcagacgtacttaaatccattgaagagaacccctctgctgcttttgggcacctgaactttttgaagaaattgcacaacccccttacctctgatgagattctaggcaaagttatccaaatcgagtccattatcaatcaatttgcaagtactgtgcagaaaaagcgcgagaatgacgccagactagatgcccagaaacaggcacatatccttctgctcgagaaagcccaaactgctcaacatgaagtcgaacgtctcaccaaagaggcgaaagaaggatcttctgagatcaaagcctgtgatgataacatctcttcctgggaggcaactattatggatttgctgtctcaggttgatgatttaaggcagaaaattgtgacagagcaggccaaacgcaaggaactccaggagaaggccgctcactcgattcagaaactgattgctgaaaaagggagggaaggcctgaaggcctttagcgcatctcaagctgtagcagatgaggcaagagttatggagggtgctgaccaggtcttaactaaagaaatggccaccttgaagaagctatatgaggatttgatcatgacttag

SEQ ID NO: 87664 - DNA, 417 bp, Glycine max
  Peptide Sequence Number=SeqID_204442
atgaagatgaaagcaaacaaaaaaagaaatgaattgaaagtctcggattcgaaaacttatcggttgaagaacgaagaacagatgaagaatggcagaaaatcttcacgaaatcgcttacgaaaacgtctcggaagcattacggaagcacctcgacttggattttcttcacggaaacacgttttttcacccaaaacagctgaaatgcatagcatagggggaaaaaggggtggtgcttgccaccctgctcgcccatgtgagcagggttatgggaattttacggaagcattacggaagtcccggaagccatttttttacaaaacgggggaggagcttgtcgtccagctcgcccaggcgagcaggtggcttcctcaggaagcaaccaagcttccaaaatgttgtggaagggcccagatttga

SEQ ID NO: 87665 - DNA, 330 bp, Glycine max
  Peptide Sequence Number=SeqID_204443
atgaacttctactggggcaacgccgtattccttggtttatgggatggaagcgcatttgacggccatgagccatgggcgcctgtatcaacaaaggataaagaacgcgttcgacaagaaggtacgcccgcgcaagttcaattagggggaccttgcctcaaaaagacatcccatgctattgaagataatcgagggaagtgggccccgaattacgaaggacctttctttgtgaaaaaggctttttgtgggggggctctggcgctcaccaacatggatggcgaggagctacccttgcccgtgaactccgatgtcgttaagcgatattacgcttga

SEQ ID NO: 87666 - DNA, 189 bp, Glycine max
  Peptide Sequence Number=SeqID_204444
atgacacctcttacatataggttgaagcagaagtggggactatggagcacagcattatattacgcatacttgcgggagacagacacgtatcgtcccttctgggcagtaggcagagttatcctgctttttttttctttttcgggacaggaggcagaattaattgttagaaatagaacattgaaaatctga

SEQ ID NO: 87667 - DNA, 993 bp, Glycine max
  Peptide Sequence Number=SeqID_204445
atgtccaatgtcaaagaagtcacactaaccctagctccaccaaaactatcatgtggtgtcacacaccataccccagcccttgtattcagtgtgggaggttacaccggaaactttcaccatgaaataaatgagaacttcatcccactcttcatcaccatcaattccttgtcccctaatcaaaatgtaatacttgtggtcctggaaggtaagagttggtggttcaaaaaatatgccgaattattatcagcctttagtcccaaccacatgatcatcaacacaaataacatatccactgtccattgctttccatcagcaaccatagggttgataaagcatggagacatgaccatagacccaaaattgctaccaaaccctaaaacccttctagattttcgtgcatttctagacaaagtatataccaaagatgatgataccccatttgtgtaccctaatgaaaatgggaagccacgtttgacattgataagtagaagaggcaatgtgagtcgtttgcttttgaacgaaaatgatgtgatcaaggtggctgaggagatagggttcaatgtgcatgtgtttgagccaaaaaacacgcctatggccaaagtttataggctaattcatgctagtgatgtattgttaggggtgcatggagcagggttaacaaattttttgttccttaggccaggctcggtgttggtacaagtggtgcctattgaactctattgggcttcaagaacttactatgagaaaccacccaaattcttgggggtggattacatagagtacaagattgaacctaatgaaagcagcttgttagagaggtttggtgctaatagcttggtgttcaaggacccgccagcttttcataaaggcaactggtctaagcaacgggtatatttgaaggagcaaaatgtgaaaattaatgtagttagatttagaaagtatttgacaaaagcatatgagaaggccaaaatatttattagcaaagttaattag

SEQ ID NO: 87668 - DNA, 150 bp, Glycine max
  Peptide Sequence Number=SeqID_204446
atgcagaatgtaatgaatccaattcatccaaatttgaagacagtaggagtaactttatgcggtactgtcataagaggtaataatggtagctttgtttgggcttactctagaaggttggggcactgtttgattttagaagcagagctatga

SEQ ID NO: 87669 - DNA, 363 bp, Glycine max
  Peptide Sequence Number=SeqID_204447
atgacatgtttattggcttttgctgtcaataagttatcccaatacatgcaagcacccccatccattcacatgcaagctctcaagtgcattctatgttatctcaagcacaccattttccatggtctccaccttgttgttacaagaaatcttgatctcaatgcattttgtgatgcggattggggtggtgacaatgttgattggaagtctactggtgcctacattgtttatcttggccctaataccatttcatggtcatgcaaaaaacagtccacaggtgaataccgctcaatcggaaccaccacatctaaactcttatggatacaacaacttctcatggagcttcgaatccaaatacctaaatag

SEQ ID NO: 87670 - DNA, 693 bp, Glycine max
  Peptide Sequence Number=SeqID_204448
atgggtggaattagtatgggtaaaaaacttgatcgagttattgttgatacttttgagcacattatatttcctgatgcctacgctatagaacctatgtggggtgcactcggatcgctaccctatgtgggatgcactcgtaacaaattggataaactgaaggatacatccaaaattttgaatccatctgatgttgatggaagttgtttatatccattgaatcttattggttcaggtggtgtattgcataatcacaattctcaatggcttttgggattctcatcctttgctggtactagagacgcagagaaggcaaaacttatggctattcttaacggtctacggacgaagaagaggaacccaatcttggtgggggaatcggagctcaaggcagcgatcaaagaagtgataaagaagattgagaacaaggaattgggagatggggctttcgcgaatgtgaatgtgattcatttggacaaggttttcattgacttgggtgtcttcaagtggctggtggagcagcctgtggggtttggcgttgccggtggtttgggtaacatgcagcaactgaccctcacgaaggccaacaaggtggcagtggcggtggcggtggcggtagcggcagcggagatgagaaagatggtgagcaagttcggtgagggtggcattggaggattgttaggtcatgctacttag

SEQ ID NO: 87671 - DNA, 699 bp, Glycine max
  Peptide Sequence Number=SeqID_204449
atggaagcagtgttacggttgcatcagccccaccttggatttggaagcagacccataacctatttttcttcgaaatccaccatttttcaccgccaaaactctctttccataaaaaggtgccaagttcgagtcattgctgcttcttcttctccttctccttcctttccattcggagattcaggtaaaaagagggtggatgagagcaagatcttgattttagacggcatcaggcactctttgattagggaagaggatagcataatagtcagtcttttggagagagctaagtattcttacaatgcaaatgcgtatgacaaagatgcattcctcgtggacggttttagcgggtctttggtcgagtacatggtcctggaaactgaaaagcttcatgcacagttgggaatatacaaaaagccagatgagcatcctttcttccctgaatacttacctgagccaatgattccacctatgcagcaccctcaggttctgcatcactgtggtgattccatcaatataaacaatacgatttggaatatgtattttaagcatctcctcccaagactggtaaaagcaggaaatgatgataactgtggatgtgttgctgcttgtgacattctttgcttgcagctcaccccttcatacaagagccacatggttgattttatattacatctcaaacatgtccccgatctcacatga

SEQ ID NO: 87672 - DNA, 180 bp, Glycine max
  Peptide Sequence Number=SeqID_204450
atggagagagctctcactaaagtcagcagcttgaaggtggggttggggagttcatggatctccaagaaggccaaggaggagttctctaacatctctgaagacatctctgagagggaacgggaaatgtgtgaaagggtattggttgaacatggggaatacaggagaatgaatggttgctag

SEQ ID NO: 87673 - DNA, 545 bp, Glycine max
  Peptide Sequence Number=SeqID_204451
atgccggatttgggtcagttggtcacatccggatttgacaagaagttactgttatgggacatgcatacgaagaagacttctttatgtttgagaagtctagatgcagaggtagactccatgtctgtctctgggtttaatgttaccatagccattggagcatcaatgcatgtttatgatttacgttactttgaccaaccagttgagtcaaaagaggcattcaatggaacacacttaagatgtgtcagttcaattccagatgcagaagatattaagtctgatgctcttgcaggatttgcagttgggtctgtagatggacgagtatcactgcagatttcctatccatccggttcagatgaaattagtgtatccggtgcttttgccactggtgataatgaaggttatgttaccatatgggatgctggaagtaggagaagactagttgagttgcccagatacccaaatagtgttgcatccttatcatacaaccacacgggacagcttctggcagttgcatcaagccatacttaccaagaagcaaaggaaat

SEQ ID NO: 87674 - DNA, 927 bp, Glycine max
  Peptide Sequence Number=SeqID_204452
atggcgatttccggcgatctcagagtctcagcaacacttcctctgtatcgctcccactcgcctccactccgaacctcttctcagtcttccccaaagtatgcatatattctccttgcaattccgctcatgctgatttcaacgcctaattacacgcaaaccgtaccattcgaggccttgtctcgattaagatcctatgatttttctgccttttccgtgctcgttcatgccaggattgctagtatgcgagattggagcaggattgtggggattgcttgcgaagtttgcggaattaataaggccttgagctctccaactataacagttagcttttgtgatgtggttctcccaagagcttgtagcatctctgaattcactccaaaatgcccttacctgacaattgtacgatgcaatatgcgtgggtattgcaagccagttgctgcggtccttggaggtcctaaatttacatcaaattcagttagccaagaaaccgagaactttctccttgatgctgttaaaatgaacttctttgagcggttaaatttggcttggaagataattttcccatcggcaacatctagaaaaaactccaatgctaggattgctaagcaacgcttgaagatgattctgttctctgatcggtgtgaagtaagtgatgaggcaaagcgaaaaattgttagcaatgttgtgcgtgctctatcagattttgtggaaatagaatcacaggataaagttcagctgagtgtctctgctgatacagatcttggaactatttactctgtcacagtgcctgtacggcgggttaaaccagaatatcaagaaatggatgaatttgggacaataacaaatgttgagtataaggacaccggagagacttctggttctgttgatgttacatttgatttctatgttccagacgaaaggtcttga

SEQ ID NO: 87675 - DNA, 303 bp, Glycine max
  Peptide Sequence Number=SeqID_204453
atgaagggaaattggtcggaattggagttggagaaggaattcggagacgccatttcccgaacccgtttcgcgccccactccaacaaccttctcatctcttcttgggactccaatcttcgcctctacgacgtcgacgcctccctcctcagactccaagctccctcgcaagctcctcttctcgattgctgcttccaggacgacgccgtcgctttcgccgccgcctctgatggactaatccgaaggaccattatgggtcagggtgataaaactctcctccgagtatttaacataactgagtactag

SEQ ID NO: 87676 - DNA, 879 bp, Glycine max
  Peptide Sequence Number=SeqID_204454
atgggcggaagatggagaaccctctcttcgttctataaccgcataaccacttctttttcttattcttccaaaccccattttccctccttcaaccgctccatctctctcgccgccgccgcaacttctgaaatacccgacccggatcaattcgggttcgtagacccggaactcgatccctgcgtcaaaatcccagtcaaagcttatttcctctccaccagtataaatttgaagggcattcaggctgataatcacagaaacgttgttcctccatcttcccgctcatcttcaaactatgttgctctccgcttctgtgacttcaatttggactccaatagtctgaacaactttagtcatttgattcagggacatgggtttcacatgaaagcaagcaactgtcgttacatggttgtatatcagtatgggtcagctgttttgtttaatattgaggatcatgaagtggaaagttacctggaattagttaagaggcatgcatctggtttacttcaagatatgaggaaagatgattatgcaataaaggagaagccactgcaagttgaggacatgcaaggaggtccagactacatagttctgaaatcgttggatactgatggtatccgtataattggaagtgtattgggacaaagcatagctctggattattttgtctcacaggttgatggtttagttgaagagtttgctggcataaaccgcggaatggagaaaactggaaccttcactatggataagaagaagctacttcagctagttgggaaggctaactcaaatttggccgatgtgattcttaaagttggtctctttgagaggtattttatccttgttttagaaaaatacacatacggcagtgtaagaatatattga

SEQ ID NO: 87677 - DNA, 1065 bp, Glycine max
  Peptide Sequence Number=SeqID_204455
atgacagctgttgctgaagatggaagctggtcagttgtaaaaccgaagttgcagaactcaattgaactaactgttgctgctcatgatacaactggtgggatgaaaacaaagatagcagaagctgcaatgatagccaaacttggaattgatgtctacattgtaaaggcagcaacaagccactcattaagggccttaaatggagatctgagaagcagcatccctgacgactggctcgggacgttagctaaaagtgcttttaacaatatcagaaaggatactcttaagataaacaagcggtattggattgatctaaaagatgcagcttatgagctggatgacatcatggatgagtgtgcctatgaagaattggggatggaatacggaggagtcaagtgttgtctatcagaaatgacaactccagagagaagaaatgctgtcactgatcaacgccaaaccaacccattcatcaacgaaccacaagtctatggaagaaatgcagagacagaaaaaattgtagactttttgcttggtgatgcctctcattctgcagacttatctgtctatcccatcctagggttaggaggacttggaaaaacaacactggcccaactcatttacaatcatgagaggggtgcttccattttggttacaactcgcctttcaaaggttgcaggaatcatgggaacaatgcctcctcatgaattatcagagctatccaagaattattgttgggaatttgtggggagtgctgctttcagcaaaagagagaaaaaagagtggctctatgttaaggaaagcaacctatggagtttatctggcgatgcaaactctataatgcctatgctgagactgagttacttgaacttaccgataaaacacctaaggtacttgaatctttctgaagctcttcaggagctatctttgattgagtgctcaacactatcaagcttgcctcctcaaatagggaagttggcaaggagagagagttcccaattcttgatctcaagatattctttaagcttcaatcttcccaattctgccaaaagaggccaatatgtcaagtaa

SEQ ID NO: 87678 - DNA, 135 bp, Glycine max
  Peptide Sequence Number=SeqID_204456
atggtgacggtagccacgaaagcaacttcgtggcagcttaagcgaaggtggcgcggcgtgtgcgacggcaacaacatgaccctaatggcgacctggtggctgggaaagtgggggaacatggactcagggtgttga

SEQ ID NO: 87679 - DNA, 240 bp, Glycine max
  Peptide Sequence Number=SeqID_204457
atgtatcctcttccaaatctttccttcatcctcatacacaagatccaccaagtataccctaggtggtacctaagactaaataagatggcgtgggctgggtccaccacacatagaaataaactatacaaggactataatctagtgtgtccatcgacgcactacaatagcgaaggaaaccgtagaagtgatccacatgaagcgtatcgtcatgcccccactacatctcgatggcataaatga

SEQ ID NO: 87680 - DNA, 552 bp, Glycine max
  Peptide Sequence Number=SeqID_204458
atgtgtcctcctccaattcctaacagtaaccgttcttcccccgaacccaaaagtgtgaaccagaatctcgatatgggtgaactgacctcgatcactgtgagggagagactgatgttgacagtggtggtagttgccattgaggatcttgatcattacgagggagaggctggtggtcttgcctacactacccttgccaaaggtgatgacgatgatgcagggggtgaagccggagagctcgggcttgcggttccactggagggtggagggggtttgggttttcgaggggacgaggggagaatgggggtggggaggaatacggagttggaggcggtggtggtgccaaaaagaatgtggagagagggaatcaggaaggggagagagggagaggaagaagatgaagatgaatcaagaaaaaaaagaagcacagtggtgttgctggataagctttacaagattgaccagatcaaagttgagatgaagaacaatgtgctcaaggtcgttgtgcctaaaatgaaggagaggaaagatgtcatcaaggttaatgttgagtag

SEQ ID NO: 87681 - DNA, 288 bp, Glycine max
  Peptide Sequence Number=SeqID_204459
atggtgaaaggtggtcagtggttctatacggaaaaaacaattggtgttaatattgaagatgatgattcaactattgatacttgtcttagtcctttctccatacaaatgccgccaaatgtcaacgaagaagaagaagaagttgacgacgtcctcgcaaatcataatgatcatgatgaaggagaattaattaacatcgtccctgttgttagtcaagatccgttatctgcttacatggtcgttaaccgaacacattggcacacgacgtatgctgccacgtgtactcattga

SEQ ID NO: 87682 - DNA, 936 bp, Glycine max
  Peptide Sequence Number=SeqID_204460
atggctacaccattcagttcccctcctcctcctcctcttgagtcagtagcaccttcgccatctacatcgaagaagacaagaaaagcaacacagctcagatcattggctactgaaccaattaggccaaagagaccagtggttcatgtggatcctaccacttggaaagtcgatagtccccacagaaagaaattaagaatttatgtggggatcatcgctcacaataagattgaatttgatattcctaaagcatttgatttgaggacggagaaaaaaatacttcagaccgtaagaaagcggtggatgcaatttaagttagatttgaactccaaatgggctctagtagaaggcaaggagggcgaggatgacaaaggttatgattttctagaagaaaagttgatggaggaaaagaaaaagaaaagatccaaggaagtagcccaatctgggagcaatgacactattgttgatcctttatgtcccattagacaacatgtgaagtggaagatggccttcacgaaaaaatttggtcaaatgacgtttgaggcggtaaaggaaattgcagataggattgaagagcaaggctcacaaggaagctttgttgtccatggacgtcaggatgtactgactgctagcattgggtggctagagcaccctagtcgtgtctatgctgttggaaccgatgtcacgatcaaacaatactttggagtggcttcaaggagctcccgcatgtctacgtccatggctcccaaagacctggagaagatgacacaaaaaattaaggaccagcatgaggagtcattaaaaaaaaaatcctccccacctggtttcccttggaagacgactgtccacaatgtccctttgggcaatgatcaagtgaaggttggtgttgaggaagataaactgagagccaagagaccagcgaaacctgtagataggtag

SEQ ID NO: 87683 - DNA, 915 bp, Glycine max
  Peptide Sequence Number=SeqID_204461
atgtctgtcgtagtctctggttgctctttgttattttggtcacagacttgtcaagtacatggccatctgaatttcaacaaccccatgccaaggtggaggcagaacttggctgtaataagatgttgtaatagaggaacatgggagattccaatgactcaaaataattactatgatttgcttggagtttctgttgattcaaatgcccatgaaatcaaagaagcttaccggaagctgcaaaagaagtatcatccggatatttttggccaaaagggccatgagtatactctgatgctaaataaggcttatgaagtgctgatgacagaagatctaaggagaaaatatgatgaatccataggtccaatgaggctaagatttgggggaaataacactcaagccttgggttacagcatttggaaagggcctgtaaagccacaagccttatttgttgatgaaaatgcgtgcataggttgcagagaatgtgtgcatcatgcaagtcatacattcaccatggatgaaactcagggaagtgcacgggttaaagttcaatatggagacaatgaccaaagtattgaggtttctgttgagtcatgtccagtcaattgcatacattgggtggagacagaagaattgccagtgcttgagttcctgatccagcctcagccgaaagacgggtatggcgtatttggaggaggttgggaaaggcctgcaaatgtgttcactgcagctaagtctttcaacaaacaactgaagaggaagtccacaattagacacgatcaaagccctggagggacttttgaggaaagccctgctcaagctgaagctcaagctcgtgctgatatgaagataaagatggagggtttcttgaaaatttggaactgggtgaaagaaaccttgggcatgaatattaacaagtaa

SEQ ID NO: 87684 - DNA, 504 bp, Glycine max
  Peptide Sequence Number=SeqID_204462
ccaaaagtccaacaaaggctaaacactcaatcaatccaaggatccactccaactaaactctatttgagtttagatttattctgtgttttcgcatttctatccagtgcctaccagtgcttagcggaaaaggagtggaggactcacctctacaaccaacaactttcaggtattgatgatgacgaggagactaccatatcctattacattatgtggggattcacatctatttcgaagctccgttactatgaagaagttctcctgtactttggacttgaggaacctcgtcacgacttggagttcaggttgactctgatggagtacgacgaatggggcaacgctcttagctgccgcatggggctagtgagagtaactaaagttatcgaggatagaggagaccctttgaatatgacgttcaaggataatgaggagtacaaagaactattatggcagttagagcattcgtatgaggaggagtgtgacattcttcgtgaggacatgtcttag

SEQ ID NO: 87685 - DNA, 660 bp, Glycine max
  Peptide Sequence Number=SeqID_204463
atgaatgtagaagcaggagaggtatggcagcgtctagtgtttgcccgagatgcaatcagcattcagaaagccttatgcattgcctgcgtgattgtgattttgcaaatcagcatacctgagaattgggaagataaccattggcctttgtattttggtatagctctttcttgttcgtggagtaaattcaagttgaactgccatgctgcagttgatatgaatggaaatgcaggcacaggaggtgtgcttcgggataataatggcaatgtagtggtgacctttgtgtttaagattggccgatgttctgttacacaagctgagctttgggcaattgttctgggcatccaagttgcaaaatcaagaggtttctcagaatcgctggtggaatctgattcgaagttagctatatcactaattcaacataggtgttctcctagttatgtatgtttccagcttgttgagatgatcagaaaatttgagagtgatggaggtcgtttcacctggatccctgcttacccggaggccaatcaagttgcagaaattctgtcaaagtttggattatcatctgatactcattccagaatttttcctttatgtcctagctttgttttctcagctgtaatggctgatatagccagtgtaagtgtccctcgtggttattaa

SEQ ID NO: 87686 - DNA, 306 bp, Glycine max
  Peptide Sequence Number=SeqID_204464
atggcacggagcatgtttgctctttgcccctatttggaaacctatagttcaatgaaagcacacataaagtttcacaattccacaattcctaagataggcctaactcacaaaagtccccagtggagtcgccaactatcgcaacgtgcccttcgcgggcgagcgagggcgaggctcacaggtgcgctttccaaaggaggaaagatgcgcggagtcgccaccaacgtttatttgtggaaaacgtcgggaaaaccgaaggaaaccggtcaaaatgaaaattctaagttcgggagttgtatttacgcttga

SEQ ID NO: 87687 - DNA, 681 bp, Glycine max
  Peptide Sequence Number=SeqID_204465
atggttggatcacgatcatggataggaggactctttcaccgcacaaccaccaagcgagatgacaaattcattgattatcctttgagtcctattgaggaggaaagacttcaaaggcttcaagaacggctgcaagttccttatgatgagactcgacctgatcatcaagaatcactaagagctttgtggcattgttcctttcctaatgtatctctggaaggcctaatatctgaccaatggaaagatatgggatggcaaggtcctaatccatcgactgactttagggggtgtggcttcatttcccttgaaaatctactgtttttcgcaaggaaatatccggaatcttttcacaagctgttgttgaaaaaagatggaaagagagcaacctgggaatatccatttgctgttgctggcattaatatatcatttatgttgatacagatgttggatttatgctcagaaaagccacgatgtcttccaggcatgaattttgttaagttattaggagaaaatgaagaagcattcgatgttctatactgtatagcatttgagatgatggatgcacaatggctggctatgcatgcttcctacatggattttaacgtacgcttttttattccctgcgttttctgtatctccaatccttcatgtcttttccctcctagtccaatgttaggaacgtaa

SEQ ID NO: 87688 - DNA, 207 bp, Glycine max
  Peptide Sequence Number=SeqID_204466
atgttaccaaagatagttaagacaattgtgcccgtgtctgatggagcttccccccagctccatggagaattaactaaattagttgcttttccacttctcactagtgttggagatccttctacccttgaggaggctatgaatagccaggaaaaagacagatggatgggtgtcatggtggaggagatgaagtctttacaaaagaattag

SEQ ID NO: 87689 - DNA, 360 bp, Glycine max
  Peptide Sequence Number=SeqID_204467
atgattttcgatgaagggtcaatgcaatctaagtccaaccttgactgcttcctccggcgtacgacacctgttgtgccgtctcagtttcttcccaagcacgagattcgaaaccttaaccgattgtggcacccgtgggagagagaagctgttgagtacttcactttgggtgatctatggaatcgtttccacgaatggagtgcttatggagctggagttcccatcacgttgtccaatggggagacacttgttcagtactatgttccttacctctccgcaattcagatattcaccagcaacactttcagttttgaatcaaatcatggcctgagggtattcgttgatgtaagaatagtcatataa

SEQ ID NO: 87690 - DNA, 216 bp, Glycine max
  Peptide Sequence Number=SeqID_204468
atgaagaaaagagatacaggccgtcaaagtgtgtcattggagaataagagaggagatttaactgtgctggagataggaaattcgggtaaagttgtgataaaacaagacatgaagggaagaaggcataaatatgggtttaacaacaacaaacttgagaaggcagagaagaaaagggtggtggatgatgaaactagcgataaacatcagctgcatgaa

SEQ ID NO: 87691 - DNA, 1089 bp, Glycine max
  Peptide Sequence Number=SeqID_204469
atggttatagaggtcgagggagaaatcgaagaggccacaaagatagttgaggatgaaacaatcaaggagaaagacaaaagcaagacaagtcacactcatggtgctacagaactcgaaaccacctttggagtgggaaaattgtctaggacattactcgtccagtatgttcttataaatgcatgcacatcctacaacatacttattggacaaacttctctgaatgttctaagagccattgtctccatcctacatctcgccaagaaatttcccaacccaaaagggagagggaaaatattaggtttcaagatcgcctatagaggtattgaagctaacccagataagtgtgaggtcgtagttgccatgaggagtccacacaatttgaaggagacatttcttgcaactccaccaattcccactcggtcaacccctgaagccgagtttctattctacttatatgtctcaaactcgacaataagcttagcccttttgcaagaagatgcactaatcaactcgaccaaaaggcttagaccatttttccaaagccatcaaatcaaggtgaacactgatcatcctcttaaacaagtcatgagaaaacctaagtttacgggtaggattgtaccatggtcagtcaaactttttgagttcaatttaaagtgtgaacccaaatgtcccatcaaagggcaatgcttggttgacttcattgtcaaatttgcttccactgaaagcgacattgaaggttgttggacattgtatgttgatggagcttcaaacaacaaaggtagtgataccgaagttactttagaaggactagatgacatatcaatagaacaatcattgaggtttaattggaaagtttcaaacaatcaagccgaatataaagcccttattacaagtttgaagttgacaatagaggttgatgtaaaaaagttaaaatgcataagtgattctaagctcgtcattgagcaggtcaacaaagttttccaagctagacaagcacaaacacaaaaaaattatcatttgatcaaaaggttgttggaacactttgaaaaccataagctcatacatgttgatagagaaaagaatgattga

SEQ ID NO: 87692 - DNA, 267 bp, Glycine max
  Peptide Sequence Number=SeqID_204470
atgaggcaattttccctgtttagggtgcttttagaaacaaattcccaaaatagggctcttctggagatatttcccagggggtgctttttttgcacgtaccctacatgggaagcgccagttgaagtggcgacttcatgcatgtgcgacaagtggcaagctctggacgaaagcgcagacatggttggcgatttcacgttgcaagtcgccattcccattagcgctttgactgcagcagggtcaggcagcaacagcaccgtcaggcagtag

SEQ ID NO: 87693 - DNA, 724 bp, Glycine max
  Peptide Sequence Number=SeqID_204471
atggagggacagagtttgtactcactagtgtttcttgtgcttgctctggccattgtgaacacagtgcatgggcaagggacgcgtgtagggttctattcgagtacatgcccacgggctgagttcattgttaggtccacagttcaatcccacgttaggtctgatcctaccttggctgctgggttgcttcggatgcacttccatgattgctttgtgcaaggttgcgatgcttctgttctcattgccggtgatggaactgagagaacagcatttgcaaaccttggtttacgaggatttgaggttattgataatgcaaagacacagctcgaggctgcgtgccccggtgttgtgtcttgtgctgatatccttgctcttgcagctcgtgattccgtttctctgagtggtggaccgaattggcaagtgcctactggacgcagagatggacgcatatcacaggcttccgatgtgagtaacttgcctgctccttttgactctgttgatgttcagaaacaaaagttcgcagcaaagggtctcaacactcaagacctcgtcacccttgtcggtggacatagcattggtactacagcatgccaattcttcagtaatagattatacaacttcactgcaaatggtcctgactcttccatcaaccctttatttctttctcaacttagagcactctgcccacaaaatagtggcggttcaaaccgagtggctcttgatacgg

SEQ ID NO: 87694 - DNA, 888 bp, Glycine max
  Peptide Sequence Number=SeqID_204472
atgactccattaccaaggccacagagtgccttagggagggaagcacttatcaagaagggtagggttgaagacttgtctattctccacaagtttgtacgctttcacttgatggaaaaccttccattcaacttgcctcacactatttacatcaacatcctcagaaatccgaagggcttaggaggtgttgatgatatctactatgttgccctaatcaacaacatgctatgggatcaaagagtctttcatgtttttgaaaagatggacaatgactccaaacacactgtcataaccaaagctgaagagaagtcaattccacaaaggttgatagacctcagtgaaactattgatgataaagaagaaatgcacaaactattttctagaagtgaaagcaacaaggagagtgttgcctcatcatcatcaggcaatgagtcctttgaaggctctcatgtctcccctctccgcaagcgtccattttctacaccaaaacaatgtccaactccatcccctatccacttagagaatccatcaactaaggtcacaccagcaatagcatggagaaacctccaaaagtacaaggataagaggagcactcaaaacaatatccctaaagatctatttgagaaatataggagggatccttcacaagaagtggaaccacttaaaaactactctatgcttggtggaccacatgcacaaatgtacattcgaaataaagcatctgtctatcaaccaggactatacatctcaaaggccaccgaaatcaaagttgttgtagatatggtgtccatttgggatactgctaagaaaaaaggcttcaaattgtactataataaagaaatgccttcaaggaaagtgaaagttgaactagtgaactattcaaggaactag

SEQ ID NO: 87695 - DNA, 258 bp, Glycine max
  Peptide Sequence Number=SeqID_204473
atgaggaaatcagacctacatagttctttcatttttgtgtgtgagactaaaaaagtctcggtgttcaacaggcttgcttgccccaagttgacaaaggctcgcttgcctctagttgacaaaggtgcagataacccttgggtatctccgcatgtcatcacactcatgggtcggggtgacagaactgtggggtggtcgacaaaagcggggcttttgctcttacgtatcctcaattgcgatgaggaactcaaacctatgtag

SEQ ID NO: 87696 - DNA, 639 bp, Glycine max
  Peptide Sequence Number=SeqID_204474
atgactccaaagaaacttgccactaagagagccaggaagactgttgcaggagaaggatctagcataactccacctgcatattttgattttgatggacatcaattttgtagtgaggagcaccaatgtcattttgagttgatcaaagattggtctttccccaacatagcagggaagcggttgcggataatgcccacaaatatgatcactcttactcaaatttggatgacctttctcctggaacctccttggcacccagtggaccaagaaaaatccaacaaagcattgggtttccccaccttaatcacaggtctctaccagttctatggagtgtctgtcacaccagccaaacccattcgacctcccattaacagatcatttattgacaaatattgcatgccaagtcaggtgcaacaacaagagcaatttcaccagcctcaaccaatagcagatcctaatccatacccttggcctactcctgagaaatttagaactactgttgcatggcctggaggcagacctatttttcaggaggaggtaggtcctacagatgccctagaagatgcccaaggggatggagtaagagcagaggaggatgaaaacatgatagatcctattgactatttcattggaggagactga

SEQ ID NO: 87697 - DNA, 414 bp, Glycine max
  Peptide Sequence Number=SeqID_204475
atggaagggaggaaaacccaacatatcatacttccattcatttggattgataatggaatatttcttggatattttgaaacatctaaggcattgagagtttacaactcaagaaccttagaagttgaggaagctattcatgtgaagtttaatgaaaatgagcttgataaaggtttaccaaagatagatgagtcttttgtagatcttagattggatgatgagataaaggaaaaaatgtacatccagttaaggatcagagaccgaagtgatgcaatcctccctaggaagggaccagtcactagagccatcagcaagaggctccaagaggattgggctagagctgctgaagaaggctctagggttctcatgtgtggaagcaatgccttccaaggttattttgatgatgccaaagaataa

SEQ ID NO: 87698 - DNA, 528 bp, Glycine max
  Peptide Sequence Number=SeqID_204476
atggctttgcagttagctgacagaacaaccaagcttccttatggcattgttgaagatgtattgataaaagttgacaaatttgtctttccagtcaactttgcagtgatggatatggatgaagacaatgaagttcaattgattcttagtagatctttcatcaagatttctaaagttatgattgatgttgatgatggaaaactcactgtcaaggagatgagggaagttgaagcaaatgagaattcaaaatgtctccaacagctaaaagctttcagagaaattccttaccaccaacatctttttgaagaattgaaagaagagaagccgaatgaagaaacaaaaatgaagctgaaagcattaccttcacatttgaaatatgtttttcttgtaggtgattcacaaaaaccagtcactagtaattcaagtatctctgaagaagaagaagagaccggtgaaaattttgtaggacaacataagaggttggaccttatcagatgtcataggtatcagtccttcttattctattcataa

SEQ ID NO: 87699 - DNA, 960 bp, Glycine max
  Peptide Sequence Number=SeqID_204477
atgggctctgtttcaactgcgacgagaaataccataggggccatcgttgcgcctctaggcgggccatttggccccagagacactccattttctgggtcttgtcagggatcatcaggtgatgcttctggtggacggatgaagcacacacaacttcattcaacagcaattggggccaatgttgtcctcgggatgcagtggctgaaatctcttgggccagtcctcaccgattacaactccttgtccatgaagttctttcatgatggctgtttggttgagcttaaggtgctctctgacgatcatcctgtcagcactagcaaggatcttcctctagccattcaagctctgctcaacaagtttaattccctgttccaggctccccaccaacttccgtcggaaagggacaccgaccatcatattcatctgctacctaattctactccagtgaactacaaaccccttttcttctccggtactattggtgaagaagcaggatgggttgcggagtatcactctactcctacaggtggacacatgggcgtcgcaaaaacagtagctcgcatatctgaaaatttatgttggcctggccttcgtgacgatgtagcacaatttgtggctcagtgtgtcaatttccaacacaccaagtatgaagccaagaagatggcgggactgttgtgcccccttccagtgcctcatcatccctgggaggatctctccctcgacttcatcactggatttcccccttatcatgacaatttggtcatccttgtagttgtcgaccgcttctccaaaggtatccatctgggcatgttgccttcctcacatacaactcatgtagtggcctctctgttcatgggcatcgttggaaagattcatgggttaccacgaagcctggtctccgatagggaccctctgctcgtcaataagttggcaggagctattccaactcagtggcacagttaa

SEQ ID NO: 87700 - DNA, 618 bp, Glycine max
  Peptide Sequence Number=SeqID_204478
atggaaggaaactttctgacaagaaacaggtttgggtttgaggagcattcatggcctactagaaactatgcttgtagcttttgcaagagagagttcaagtctgctcaagctttgggtggtcacatgaatgttcacagaagggatagggcaagattgagatcttgcttacccccgtcatcatgggtttctgagtgtcctaataaacctaactccattaagcctaatccaactcatctttcaccttcatctccatcatcattatgtctatctaataaccttttgaattgtgctcatacttttccactttatagcccttctttgactttgtcttcttcactgactccagcttctcccaatggagacaataaaccaagaagagtatctccggatccacatcttcttcctcttttgattcctcaaagcagtgaggaaattaagatgaataagaataaagtaagtggtttaggagttgaagaagtacagggttgtgcaataggggaaaaactcaaggttttcaagactagtactagtgagcataacatcaagctggagttgggaatagggttgcttaaacaaccagagatgttagatttggagctacgattggggcacagctag

SEQ ID NO: 87701 - DNA, 291 bp, Glycine max
  Peptide Sequence Number=SeqID_204479
atggagaagctcatcgattttgagggtcatggtctacatggatttgccaagggaaagttgatgggtggtgagtcagaggatagcatcctcgagtttgtctggaggacttgtggttttagtggaatcgatcatgtcaacgagaaacgagaaatgagagtaccaaaatgcttgtctctccctaaacgaccaccatcattccagcaggatacgttgtaccatcttgcttttctttcatacataatccttgaggcaaatagacattttaattattcttttggtcttgccttctaa

SEQ ID NO: 87702 - DNA, 981 bp, Glycine max
  Peptide Sequence Number=SeqID_204480
atggtttctgcaaaagaagaaccagatcgtcccataccacctgctattgatggtttgttaagggttcataagcaagttatcaatgttgaccgtgaccttgtggatagtgctttggcagctgggcgatcagttgttaccaggcttctagtagcagatactcaagcaggaagcttgatcggaaagcagggatcaaccataaaatccattcaagatggctctggttgtactatacgtgttcttggatcagaaaacctgccagtatttgctttgcgagatgatagtattgttgaaatacaaggggaatctgctggtgttcacaaggcagttgaacttattgcagttcatttacgcaagttcttgatgcaaaggccagatgttagagttaaccagaatgtgccaccacatcaaaattggggtcctcctcctcaagggtttcctgctcctgctggtggtggtggtggaggacctgcttttgcaccaaatcatcaatatatgccaccttcacatcactatgatagctattatccacctactgagttgcctcccatggacaaacaccttcatcaaggtccaccacctgcctatgcaaaggatgcttcaatgggaattcattcatcaagtgcaccaccacaacaatctgttgtaactaaggtcacacaacacatgcaaattcctcttacatatgcagatgctgttataggagcatcaggcacaaatatcagctatatacgtcgtgctagtggagcaagtattacaattcaggaaacaaggggtgtgccaggtgagatgactgttgagataagcgggacttcttctcaaatacaggcagcccagcagctggttcaggtatttgattttaaagtcaaaagcacttcttgtattcttcttgtgacctgtattgtcgttggcaaagtgttaaaagtctatgaggcagtccttgattttgttgtcgctggtacacagcatgacaagagctgttga

SEQ ID NO: 87703 - DNA, 279 bp, Glycine max
  Peptide Sequence Number=SeqID_204481
atggaagatgaacactgggtcaaggccatgcaagaagaacttgaccaatttcaaaagaatgatgtttggaagcttgaggaactacccaaaggaaataaggcagtgggtgcgaaatgggtattaagaaacaagttggacgaggcagctcataataaaatgaagttgtgtcaaatggatgtgaaaagtgcattccttaatggacttacccaagaggaagtctatgtagaaaaaccccttgggtttgagagtggtacattcccaatcatgttctcaaactaa

SEQ ID NO: 87704 - DNA, 318 bp, Glycine max
  Peptide Sequence Number=SeqID_204482
atggtgcgatggtgccattctcagagaccaagatgggtggtggtgaggaggactctaggtggtgaaaccggagtgattatggaacaggacacaagaaacaaggaaagcgagttgaacacaaataaaggcaccaagtttgacatgataaaatacaggagcttagaacagcagggaaaggcaaaaaactcatgcaagcccaaagacatttctttctcttctagatggttttatgctgaactgaagcttcctgagatcatagctgatgacacaacagctcctacatggctcaactcgatagaatatgtgtctagattttaa

SEQ ID NO: 87705 - DNA, 579 bp, Glycine max
  Peptide Sequence Number=SeqID_204483
atggccgagcacgattttgatggacatgttgtaggatatgtgcccgaggaccctaattttcctcagaatcattctgatgaacatgatgtagggactgtgattgatagctctggatttcctcacctgctgcctgatgaagatgatgcaggcaatttggtggaggatgccaattttcctgaaaatcattttgatggacatgaacatgatgttggaggttttcctggggacacggactctccacagaaggaggagcatgttgaagaaggtcatggtgctggagatgtgcctgaggattttgattctctgctgaaacaggaatctgagattgattcgaaagggaatgaaattaaaaagtggcccggatggcctggcgagaatgtgttcaggatgttggttccggtgcaaaaggttggcagtattattggccgaaagggcgagtttataaagaaaattacagaagagactaaggcgcggattaaaattcttgatggtccacctggaatctcagaaagagcagtgagtctcgatttctctgttatttatgtactgaaggatgacctgggatatatatcagtgtct

SEQ ID NO: 87706 - DNA, 354 bp, Glycine max
  Peptide Sequence Number=SeqID_204484
atgactcctaccaaagatgagaaaaggctaaaggaactaccttgggctttgcttgttgatggatcattcagtgggacacgttgtgggatgacaatctttacaaagaggattcacttagccactattgaaatgcttaagagtggcagagcaaaggttcacctccatagagcatccgcaaacaaacagacaagtcaaggaaaaaaatcaattattctacgaggattgaggaaaagagtaaaagaggctaaaggaaccttggtagaacaagtgccatatgtcttatgggcataccagagaacaccccattctgccgtaggggaaattggtttccctaaccaggataagcaaatataa

SEQ ID NO: 87707 - DNA, 450 bp, Glycine max
  Peptide Sequence Number=SeqID_204485
atgacaagaagtgataatagtagtgatgattttgaagttgtcaatgtgggttatggtgagagcagcaccaacaatattagtgtcaatggtgatgttgttgttgagaattcagcatttgtgaacacaagtattgaccggaaagaaactcaagaagctcacgtgttcaaggctgatgtgccaaggcttaagaaagacgaattgaaggtggaagttgaggatcacagggtcctccaaataagtggaaaaaggaaccttgagaaagaagacaagaatgacacgtggcatcatgtggagcgtagcagtggcaagttcatgagaagattaaggttaccagaaaatgctaagatggatcagatcgaggcatccatggaaaatggggttctcactgttactatttctaaggaagaaatgaagaagccagaaaccaaagcagctgaaatatccggttaa

SEQ ID NO: 87708 - DNA, 159 bp, Glycine max
  Peptide Sequence Number=SeqID_204486
atgaaaaagcgcttcaacaaacaaggaaggtgtgatgatagtgacaactataacagagacaatgataaaggtaaagggaatgatgataattatatgatagtcatcaatggtgatcgtgattatggtgatggaggtgacgacatgagtgatgataaatga

SEQ ID NO: 87709 - DNA, 819 bp, Glycine max
  Peptide Sequence Number=SeqID_204487
atgtcgaatgacaaagaccagaggaatgaagaatcaaacaactacagaatcatatcttcgaaaagacaaaatcaaaagacacaaaaattctcctacattacagatcctgtggtctctggttctttgatttatggaagatatgcagaatgttttactcagatcattgtaacctctttcattgggttgatatttgccgtggtcttccattttggtctgaaacagactagagatcgaaagatcatcccacgtataagattgtcacgcgcaggccacttaccaaagcttgaaaggttctcccattacgtagctaggcaaatgggattcaaagataggagaaattgtcctcatctatgtagattggcttctgaatacatacggaaatacgagggatttgaagatgatatatacgccttctttgagaatgaaccagatgctgattcactttatgtgaagctcgtagaggagtttgagagatgcattcttagttacttaggattccattggaactacggtgatctagttatgagtcaggtgttgagctcggaaaatgagccaaaaaagaagctcaagagcatagttatggcagctacaagggaacaaaggattgagagacttgccaagaatctgaaggtagctagagtttttaatacattagtagaagagatgaaagcaatgagagttgctacaagtgatgactctcgatgtacagaagtgatggctccagtagctcatagcgataggagtccagtgcttctgttaatgggtggaggtatgggagctggcaagagcaccgtgctcaaagatattctcaaagagtaa

SEQ ID NO: 87710 - DNA, 394 bp, Glycine max
  Peptide Sequence Number=SeqID_204488
atgcattttgagcattctgagtattctgttgctggtgattctgaatattctgattttgagcatttgactactaattttcatactgagaacatagctcaacctccacctcatgagaggactcttagggaaatgactgcacctgatttcacttatgaaagcttgtgcattcaatatcctgatgagggtgttccatatgttctcaagactggactaatacatttgctgcccaagtttcatggtcttataggtgaagatcctcataagcatctcaaggagttccatattgtttgttccaccatgaagccccctgatgtccaagaagatcatatctttctaaaggcttttcctcattctctggaatggcaaaagattgactatactaccttgctcccag

SEQ ID NO: 87711 - DNA, 315 bp, Glycine max
  Peptide Sequence Number=SeqID_204489
atgtctttatctgctgacattgagcctttaagttatcagaaagcccttcaaaaacaatgttggagggatgtaatgaaggctgaaattgaagctttgattatgaatgaaacctggactgttgttgagactcctcccaatgtccaacccattggatgcaaatgggtggataagatcaagagaaatccagaagggagtattgagaggtacaaggtgtggcttgtagctaaaggaattaatgaagctttgggcttgaatctagaattgagcttgggcttgaatccagaattgggcttggacttgaagagggcagactaa

SEQ ID NO: 87712 - DNA, 252 bp, Glycine max
  Peptide Sequence Number=SeqID_204490
atgtctgccacctcctcctctatgctatcacgaccactccatgaccctctaccaccccaggtttgcacacacgacaatcaccaccaaccttgtcatcacatgcccttacttgctagattgcaccaccgcatgcgaatgatggtaatggtgttggggaacagtttgatgaaggactgtgatggtggtatttggatgactccacccttttccttgtcagatctctcttccttctcaaatagttgcggtttttag

SEQ ID NO: 87713 - DNA, 846 bp, Glycine max
  Peptide Sequence Number=SeqID_204491
atggggatgaagtccttcaaggctccaggcctagatggattccaaccattcttctttaagcaatattggccgataatggggaaagacttgcaacatatggtgcacatgtcatttcaggtgatcactaaggtgcttgtgtgtcatctctgtccttacttggatgagcttattggaaccttccaaggtagtttcataccaagaagaggtacaatgcagaatgtaattcttgctcataaggccctttacactatcaagaagtctaaggctaagaaagggctcatggctatcaaggtggacctagaaaaagcgtataaccaagttagttgggattatctaaaagttactcttgttgattttggcttccctagtatcattactaacctcattttgtgggcagtgcaaggttcatcccctttagtgctttggaatggcttaaggttggatgggtttctgctaagtagaggcctccgacaaagagatccattattgccttatctatttgtcatgtgcatggagagattgacacttagtatccagaatcagcttaatacggatgtccagtatcctgggattatgtgcactaatcacttaggaaagtgcttgggttttcaatttttgactgatcaagtgaccaaatccaattttgatgatgtcatggaaaaggtgaaatctagattggcttcttggaaagattatgcactccccaaagaaatattgggtgtggatattaagtacatgattttgattgccaaagtgaatccaaaggtgtcctatgtgtggcagagtgttattaaggcaagggatgccctccttgatggttttagcctaccgcttgatgacagctag

SEQ ID NO: 87714 - DNA, 471 bp, Glycine max
  Peptide Sequence Number=SeqID_204492
atgtgtagttgtgaggattacactcatttttgtactagcaatcatggtgcaaggaataatatgcgttggcagtgtccctctccttccttggttaaagttaatgttgatgtttatgggatctatcgaaactcgtgcatgggttttggtggtgtagttcgtgatcattttggcctatggaggaaagggtttgcagtgcaatttgatggtggggatgccttgataatggagttcttggaatttaaaaagggtcttcaacatgcatgggagttaggggagcaacatattatttgtgagtctgattgttgtgatgttgtgaatgcaatcacaaatggagatgataggggaagcattctacaccttcatcatgattttgtgcttaatatccaaggacttatccataaggattggcaggtcgaccttcacgtaataccaagagaggcaaacacaatggtacatactattgtgagttag

SEQ ID NO: 87715 - DNA, 285 bp, Glycine max
  Peptide Sequence Number=SeqID_204493
atggatggtcaaggaggagaaggaaatagaccaccaaggaggactcttggtgactatgcttatcaacaaggaccaaagcattataacaacatagtcattcctcttttcagcaacaaggtcgtggaattgaagccagcaccgcttagtctaattggctcagattcctttgatggaatggatcatgaggatccagctatcattgcatggtctggggacatgcctatttttcagaaggaggatgaagacatggcagatcctgttgattatttcattggaggagactaa

SEQ ID NO: 87716 - DNA, 159 bp, Glycine max
  Peptide Sequence Number=SeqID_204494
atgacgaaggaagagatctgcagtcccaattctgcagcgcctcgactccacttttccttttcgccttttcctttccgcggtcacgaaggagtttgttttagagacaaccatgggaaaattggtggagaagcccttatcggttgccatcagtggtggtga

SEQ ID NO: 87717 - DNA, 1026 bp, Glycine max
  Peptide Sequence Number=SeqID_204495
atggaggatgttgaagaagctaatagagcagctgttgagagctgtcatagagttctgagtatgatgtctcagccagggaatgaagttcattgtaggaatttgatggtggaaactggaggggctatagtgaggttcaagaaagttgtttcactcctaagtagtggtttgggtcatgcaagagtaaggaagcacaaaaaacttcaaatccctttttctgaaaatattctcttggacaaccaaatttgcaaaaccgatcatcattcaaaatgtctgcagtttcctcatacaatttttactgagaattcagttcagggattgggtcaaacagttagaaattcaatctatatgatgggaaaccctagtttggagttgagctccaatgagagaagccctctaaaccttacccgacaaacttcagcaacacattaccacttccttcagcagcaacaaatgaaacatcaagcagaaatgatgtttcgaaggaacaacagtgtcgtaaatttgaattttgacagctctagctgcacaccatcgatgtcgtcgtctactaggtctttcatttcttccttgagcatagatggaagcgtggctaacatggatggaaatggaagtgcattccatttattaggagctgcacactcttcttatcagaattcacaacagcaaaagagaaagtgttctgccagaggtgatgagggtagtgtgaagtgtgggagcagtgcaagatgtcattgctcaaagaagaggaaacatagagtgaaaagatcagttaaggtgcctgctaccagcaacaaacttgcggatatccctcccgatgattattcatggaggaagtatgggcagaaaccaatcaagggatcacctcaccctaggggatactataagtgcagcagcaccagagggtgtcctgctaggaagcatgttgagaggtgcttggaagagccttccatgctaattgttacctatgaaggcgatcacaaccatcccaagttacaacacaatccacaaatacgtgaactacattga

SEQ ID NO: 87718 - DNA, 606 bp, Glycine max
  Peptide Sequence Number=SeqID_204496
atgacgtcaacgtcttcttcagcgcctcattacagttctctcccctcgccctcatcatctaactccactgcctcctatttcgtcacacgccccgcgacaaccacgcgctcttctttcgccacgcgccgaccatgggaagaggtgttcgcgctcttctcattcacgcgcccttactcgatcggcgaagcgacgatgcgcgtgaggcgcaacctcgatcacttccgcgtgaactacttcatgatcgtgctgttcgttttgttcctgagcctcctctggcacccggtctcgatcatcgtgtacttggtggcgctcgtggtgtggttcttcctctacttcttccgcgacgagcccttggtggtgttgggcactgcggtggatgatagggcggtggcgacggttcttgcggcggcgaccgtcgtgggattggtgctcaccggcgtgtgggtgaacgtggtgggttcggtgatcattgggattgtgctggtggtgttgcacgcttcgtttaggagcacggaggatttgtacgtggatgagcacgatggagggttgctttcgttcgttgggggtacccctacgaaaggaacgggagggtacacacttatataa

SEQ ID NO: 87719 - DNA, 336 bp, Glycine max
  Peptide Sequence Number=SeqID_204497
atgaagaagaagaagaatgtgcaaagggtgtcaatatgcgtgagtgtgtatgtgtgtttttggtgtttacttaaagggtcggggggggatgtgaatttgagaggaggaaaaagtggaagatttttagaggtggggcccgtgggaaaaatgaatagtttgttcactttgttggagtcagagaaagatggggtaatgagtatgatgtgcataaaatcagtaaagatgagagcaatgtgttggcctagtgtcacccttgtcgacgctctctgccttgcgcaaccatggtcatccctcctccggtgtgcccatgacccttcctattctagtctgatttaa

SEQ ID NO: 87720 - DNA, 219 bp, Glycine max
  Peptide Sequence Number=SeqID_204498
atgacgtctcgtgatggccaccaatggtcgtgggtggtggatgaggaggtgttagggcttgggtggatgtttggagagaaaaatagtggaaaaatcatgtttttcacgctaaagaaccgcaatactccctttcgggttggaattgtgcttagcgcacttctcacactaagcgagaggtcaaaaattattatttgtcaaatcccaacggccaaaccatga

SEQ ID NO: 87721 - DNA, 588 bp, Glycine max
  Peptide Sequence Number=SeqID_204499
agtatctctccttgtgagggtagtcaatccataccaaataaaggatcagagaatggtgccgaaccatgggatgcaaaattggatctttggaaacctttgaatttcttagtagaggttgcaagtaggagtaaatctttcaagtcgaataatgtgcaagggtctgatgctaaattagaaaccaatcaagtaaatgagagtgattctcaagttcagaaaaccaaaaataaggaaaataaacgtaaggcaaaaattgaagatgaaaagagtagcccttatcctgtctcttcagatacagcaaaaccaaataaattgcgcagaatacgcaagaaaaaggagactgcttctggagaatctggcatatcaccccaagctgtgctggattctgccagcaatagactctcaaggactggtccaatttggttctccttagtggcttctgaaaaccaggaaggagatgctcccttgcctcaaattcctgcaagttatttgagaataaaaggaatgccattcttggagcaatgtatagctcatgttagtttattgacactgactactatatatgtgaatttctatacaaatattcattaa

SEQ ID NO: 87722 - DNA, 258 bp, Glycine max
  Peptide Sequence Number=SeqID_204500
atgtgtaatcgattacacttggatgggaattatttgagtgcttcattgttcaatctatctctttcaagagagatttcttcttctcttcttcttacttctaaaaagggattaagagaccgatggtctcttgttgtaaagcaatttgaatacaaaggatgggttgtccttgtctggttcagaacttgtaaagggtttttgcaagttagtggaactctcaagcaggttgcttggggactggacgtaggcataagggtatga

SEQ ID NO: 87723 - DNA, 156 bp, Glycine max
  Peptide Sequence Number=SeqID_204501
atgagggttctggggaaggggatgagaagaagaagagacagtgatggaggaatgaaggaacaacgtacaacgttggagattgtaattgatagatgtaaccaaagaaaagattatggaatcgcctgtaaaaatatctgtactttcttaaaattctga

SEQ ID NO: 87724 - DNA, 672 bp, Glycine max
  Peptide Sequence Number=SeqID_204502
atggaaaaactagtggatcgcagaccactagcctttcttgtaggttttgttcttcttcccgtcatagctgcttgtgtagatacccttggagtgctgaccaccaaagatgaaagagatctctcctttctcctagccggtaatggtactgaggtgacaacttcaggtgccttcacctttctcccctttaaggggaaaactttggcccttacatcttgcaaactgtggtctggcctgattttgaaagatcaacagtactcaacagtggtgggtgtagtcaaaagttcaaacaccttttccacaagtgcacaacaatacagaaccgctgaatacgcggccaatcaaaacaacaatgtttctgaccagcattcacgtcctcactcctcgacggagtgggcaagtcatgcatgctacaattgtgttccttcgcactttgaccacctgattcgacatgctgcttctccttccctcctcgctcgcactcactccctgctgctgcatgctatgctatgctatcaccgagccggcacctcccgaatttacgtccatttcgacgcaatcaggctctgcattaagaatacgaacgcgcagtgtgagaaggaaaaggaagaagctagcgagcgtggagaatggattgaggtgttggtaatggtagcgatcggtggagatggatga

SEQ ID NO: 87725 - DNA, 978 bp, Glycine max
  Peptide Sequence Number=SeqID_204503
atggctcttgctagctctgtggttgagcttcaaccctcttcagtgaagaagaaaactgcagtttccagaagttggattctgctggaccactatggcaagggcactgttctggatgccgataagtatgctatcatgcgcctggttcaaattcacgcaagagatcttcggattctcgaccctctcttatcttatccttccaccattttgggcagagagaaacacattaaagctatcatcactgcagatgaggtgttactaagagacccaatggatgatgacgttgtgccaattgttgaggaacttcgacgacggttaccccaagtaagtgctgctgagcaaggccaaggaaaagaagaggcttgtgctcaagatggtgaagaatttccatttgagatacgggctttggaagctttatttgaggcaatttgtagttttcttgacgcacgaacgagagaattagagacttctgcttatccagctttggacgaactgatctctaaggttttaaactgcggctgtgatctccatttagttgcacttattgatattgtgggcaaatgtgtccgatgtggccacaattgcaatcaccaacaattgaaaaaccttgatgctgtggacaaagtcacgatcagcagtcgtaatttggatagagtgcgaaaattgaaatgtgcaatgacgaggttgacaattcgagttcaaaagattagagacgaactagaaagcctacttgatgatgacgacgacatggctgatctttacttatcaagaaaattggatgcttcatcctctccaactagtagctctgatgctccatactggctttatgggtctccaaatacaggttcaaaaagacacaaatcaagcagagttagtggaacaacagttcaaagggagaatgatgttgaggagctcgaaatgttacttgaggcctatttcatgcaaattgacggcacattaaataaattggccacagtatga

SEQ ID NO: 87726 - DNA, 324 bp, Glycine max
  Peptide Sequence Number=SeqID_204504
atggtccccccatattcagacagggtttctcgtgccccgccctacttttctctagctcagtaccaccagtcggttttcacatacagggctatcacctactatggccggactttccattccgttttgttaaccatgtttcagttctccaggttcgcctcgcatacctatgtattcagtatgcgatacccttgcgggtgggtttccccattcagaaatctccggatcaaagcttatttgccagctccccgaagcttatcgcaggctatcacgtctttcgtcgcctatcatcgccaaggcatccaccacatgctcttagtcacttga

SEQ ID NO: 87727 - DNA, 216 bp, Glycine max
  Peptide Sequence Number=SeqID_204505
atggatagcgatttgcaaagccagcgattgaagcttttgcttcttggtcatggtggtgtgaagggaaatttaacaactccactttgtgatcgccatgtgactgcccaccctcatctaggtcccaaaaagcgagcttcttatattaataagtatgaggatgaggctgaacccgggtcctcagcaagtctcaatcttgatggacaaaatttaagttga

SEQ ID NO: 87728 - DNA, 471 bp, Glycine max
  Peptide Sequence Number=SeqID_204506
atgacagaggactttccattccaagctcacaaaccgcacatccatacatggctctcactaacactgctcagtaacaacatcaacatcacattgtggcatggccgtcacgctttcaacccttcttctctccttcctcgaacgcctccaacaaacagccttcaaaacctttatgaaatctgcaatccctcatctcttgccatggctacaacaccgagtcgtgacggagaagaggaaactctaatcacagaaacagggccaaacagattgaagcttttgctttttggtgatggtggtgtgaaggtttcagagagggaaattgagagtgaaaaggttgaaggagagatgggagcagaggggcaagccggaaaagaaaatatactgaaaaaacctactactaatactatagtcggttattttttttactatcaaacacaaaaatttctttatccacagcctgcgccgtttggttga

SEQ ID NO: 87729 - DNA, 300 bp, Glycine max
  Peptide Sequence Number=SeqID_204507
atgaccacagattcacctccactccttatgttcccatggacccagtggagtcgccaactatcacaacctacccttcggcgagagggcgacgtgagcctcacgggtgcatcttccaagaaaggaaaatgcacggagtcgccaccaacatttattcgaggaaaacatcaaaaaaaccggaaaaggtgtggtctacaaaatttaagtgtgaaaggttcgggagttgtatttacgcacggggaagggtgtttccctcgctcctacgtattcctcaattgtgataaggaaatcaaacctatgtag

SEQ ID NO: 87730 - DNA, 333 bp, Glycine max
  Peptide Sequence Number=SeqID_204508
atggaccaaaagggggattcactactgttcaaacgtcgttcacagacttcacagcatggactgacagagtggcaataccatgggaagaatcgtggatttgagcgaacaagtgagagggaccttgctctggtgaacaaggactgtgacttcttgaaagatgagcattcggtgccaccacggtggaggcaagacttgaacaaaaacatggtcaggactgaagatggacgctgggtgctcgctgatcgtccactagctcaagatccacatgaagatattgatcatcatctcggagagctaggcctcgcttcttctcatactcacactcataattga

SEQ ID NO: 87731 - DNA, 441 bp, Glycine max
  Peptide Sequence Number=SeqID_204509
gtcttcgtccagaggagcctagctattttggatgagaatggacaaaggcataaggaggctttgagtaatattactaccttggaggtcgaggtcaccaaatggagagccactgctcagattttgtggaaagtgaagtttcccaaagtggccaatgctattgttgccctagttgaagccattaggtctaactaccagttgttgtccagggttgatgatgtctttgctaagctagtgagcacaagattggatggtaatgaggtgttcaaacgctacaaatatttattgaaagaaaagaatgatttcacaggcaaggtggagcgcgcttttaaggagaaagaagtgcttaaagcgacagtgaccaaatccgccaaggtgattgctgatccccaagcccagctaatagagtcaaagctcactgagtctagctccaaactaagctaa

SEQ ID NO: 87732 - DNA, 1716 bp, Glycine max
  Peptide Sequence Number=SeqID_204510
atggattgtgaccctaaacgcaagcttagtgaaatgcaacattttgagtgcatttgtgctgagtcacctaaagtagaagtcacattgaaagacaaagaacagaaagttcatatcgaacatttcttcaacattgaatctttggagaatgttgggactgccaaggtttaccgaaatgaagttattggaggatacttcgctggacagggcactccctttgaattgccacaaattctcttcaactgctttgcaactaaacttatgacggacaagagcattaggaaagacatctaccacagtgttgtcctgaccaaggcgtttgaaacacatggagtgataaggaaattcttgtatgagacatctatggtagaacaagagagaatatggatgctcctttgtccaaagctactcatgttcaacaacatccacctcccactctcgttgctcctaaggcaacaaacactcagtgagactaagagtgacaatgatggtttagcattcaggaaaccaaaagctacaccccctttagatgagacccatgagcctcaagtgaagaagcgtctagaggccaagaaatcctcaattgttgttgataccaacaaccctccaccattagagattccattgagaactgattccattgttgatttggacgatgaagttcaacatgacgtacctctatctccaatccactttgatcacttccaccatgaaggaccacctgccatcgaccccaacctaacagatgaagacattgcaaggatgcagtttccagtggcctttctctctaagaatgcttacaacattcaaagaagactacacgtgaaattccaaacttcaatagattggacacaatttccattggatgttgaagaagaagttgttacctgccctctgtccatacataaaactgatcaagctgcatcctcttctgctaagctggatccaccaaccgggattgaagttcttccttcaccaacatggaaagaaatggtgagctacaataaggacatcattggatggtgtcagaagattgatgccctacatatcaacccatcctctgatgatttcctagcaccgtttccaaagcatatccaactcttcactcctatgtccaagtacttcaccaaggatgctactaagaagatggtttctttgaagctagacactgagtttcctgcactcaatgagcgttcattctctccttatcagaacccttgggttccaggacaaggaataactgctgaactacaacggaaacaagacaaattcaaccatcagttgatggagatgcaaaaggaagctgaagctaaacaacagcagcagaagcttgcatttgaagagttgttcaacaacctacatgctcatcttggaccccaaattgatgtttttggacctctgttggttgaagtcacttcccaacctcaaccccttattgaagatgcactcaccataatcagcacttccagtattcctcttgagataacccttttgaccaccatttcttcaactagtgtgtctaaggagcgcattcaagagttgttgcgccttctacaggtcgacctagaagaaaccatggaaagaaggtttccttcatctgtccaaccacctttggcaccaccaacaactattcctccacctacaaccactgaaaatcttgtgtctatgcttgcgccttcaccaccaactatccctcaacctttgtccactaaaggttga

SEQ ID NO: 87733 - DNA, 126 bp, Glycine max
  Peptide Sequence Number=SeqID_204511
atggatcttcatggagggagtttgtcaacagttagcacaggagcacaagcaattccaggacattcaacacgagatgatggacactgcatgttttggtactgcattgatggattttctgacatgtga

SEQ ID NO: 87734 - DNA, 742 bp, Glycine max
  Peptide Sequence Number=SeqID_204512
atgaatatattgcctagcgctattcatgcatcctccactaatgagtctagaggcccgcgaattgattgcctagcgctgttcgccagttctccattctccactcttattcggagtcccatgaatttatttcctagcgctgttcatgtgtcctccacctttgagtgtggagccccacgaattgattgcctagcgaagttcgccaattctccattctccacttttattcggagccccatgaatccattgcctaacgctgttcatgtgtcctccaccttcgagtctggagccccgcgaattgatcgcctagcgctgttcgccaattctccattctccacttttattcggagccccatgaatttattgcctagcgctgttcatgtgtcctccaccttcgagtctggagcccggcgaattgattgcctcgcgctgttcgccaattctccattctccacttttattcggagccccaagaatttattgcctagcgttgttcatgtgtcctccaccttcgagtctggagccccgcgaattgattgtctggcgctattcgccaattctccattctccacttttattcggagccccatgaattcattgcctaacgctgttcatgtgtcctccaccttcgagtctggagccgcgcgaattgattgcctagcgctattcgccaattctccattctccacttttaatcggagccccatgaattcattgcctagcgctattcatgcatcctccacct

SEQ ID NO: 87735 - DNA, 408 bp, Glycine max
  Peptide Sequence Number=SeqID_204513
atgggtccccaacttggtgatggaaagatccacacagtttgtaagaaaggagaagatgttccttcttggacaaaaatacctacacctgctgtatttgctgatactcttttgttctctcttacatcccatttcgattacgaaaacactgctgagcctttgtcatcatatatacctccgtgccagagcgaagacccgcggcacgagggcaaaggccgtgaggatgacgtagacgaagacggcaatgacggtggcgtggacggcggcagtgagagagagggggaaggagaggagggtgaagagggcgcgtgtgcagaggaacaagacaatggtgtcacaagactcgtgccagacgacaatgcgcgcgacgacttcgaggtagaggacgcggaaccggagggtgaagattaa

SEQ ID NO: 87736 - DNA, 267 bp, Glycine max
  Peptide Sequence Number=SeqID_204514
atgatgaacaaaacaaggccatgcaatgcatacttttatctagaggctaaaagcatcaatatatttgtacctcttgagatagaggaaagcactgcagtgaagaacttggatggatgtataggatgtggaaccttgaaaattaattttcaacgtcccactcactttgacattgcatcaaacagtttcaaagttcaaacattcagcaagtacaagttatcagaactcaaagggtggatatggactggaagaatatcccaagatcattaa

SEQ ID NO: 87737 - DNA, 804 bp, Glycine max
  Peptide Sequence Number=SeqID_204515
atgggcccgaaatctaccctaaggctcatgagaactctagggccttttcttgcatttttggcccaatcttcttggagtcttctatccaatgcccttgggggcccaagctttgaattgggtgtcattgttggtgacaatggcataagggaggccatacctgcatatgaggcgtttctagttgaacttctccacctcgctcattgtgatttctcgcaatggtcttgcctcgatccacttgggctaaggggaactcgggttgtggagattgtcaggagaggtgcgcggaatgtcagcgaattcctggcatcgtctacacttctttgtgaagtggatggcgtttgccatgagtgttggctaatagtagcttgcgttcaccactttggttgtaaaggagtgttcccattctggttcctcttcttctccggccataacttcctcagtgtctatggtgggaacttggagcatctagtggatgatagtcttaaggtgcccagtccttttggtgcttgccagcttggagagcaagtctgctctggtgtttctctccctgggtatgtagtacatctcaaagcatttgaagtgatgcaatcctacccagcaagggcattgcatagaagactccaagaagattggaccggagatgcaagagaaggccctagggttctcatgagccttaggaacaagagagggtacatctcttgtggatcagttctagtggagggtacatccaataggttcaaagagaacaagggagggtacatcccttgtggatctttgcttgtaaaaggatttttacaaggttga

SEQ ID NO: 87738 - DNA, 390 bp, Glycine max
  Peptide Sequence Number=SeqID_204516
atgcggtgtggagatgatggctcaaagctcatcgagcgttttcctaccaatcaaagcaaagtaagagatgctaatggtgatgccccagttgatgaggaccctggacaccatgaagttcatgattatgatggagacaaccataggctcgacacagttgatgtcgacgtcttagatggcatggaagtgggtcattctcaagtttctgtggagcttatcgcttgcgtctttgctaatggtgtctttgtcttcctcaatcttctgggaggtgatgcaatcctccctaggaagggaccagccactagagccatgagcaagaggctccaagaggattgggctagagctgctgaagaaggccctagggttctcatgaacctcagggtagatttctga

SEQ ID NO: 87739 - DNA, 276 bp, Glycine max
  Peptide Sequence Number=SeqID_204517
atggttgagaaagagaagccacaaggtatgttttacaacaaccccatggtgagcgccaaatgtacttaccaaaatccggagctatcccatgttagggtggacgtggctaaggagagtatgagtgagtatgaaaagagtgagagggaacctggtacttatagagttgaggaattgcgggcccttgtttataggggttgttacggtgatgtaacaacccttgcagataattaccggcttgtacataatagtcagtggataactatggcttatagataa

SEQ ID NO: 87740 - DNA, 906 bp, Glycine max
  Peptide Sequence Number=SeqID_204518
atgaagttcccctccttcatgggagagatcgtgactgtcaaggcaaatcacaagcaggcacgacgatactatgcggaaagcctaaaagtggaaccctatcctcccaccagggagcctccaaggcctcacctcacaataggtggtggtactcaagtgatgagcgtggatgaatgctcggaccctgacctgggcaatgcatgtagctcaagagggaccttaccagcaataaacatagacacattgctaacgtcttttataggaacatggacttgttcgcatggcatccatctgacatatcgtgtatccaccacaactgatgaagtcgttagctcagccttcatacaagaggaagggaagtaccagcttcccatctacttcactagtcggatactctatgatgttgagaagcgctaccaaatgatagagaaggtggcgctagcactaattaccttggcacgacatctaaggccatactttcagagtgacaaagtgccccatgaagacgcagttcatggaaaattttctggaaacgaccaaaccaccctagactggtggagcctctacattgacagtgcgtccaacatgaaaggatgcggggccgagtatgaggcactcattgcaggtctaaaactagcaagagaaatcagggtcaagaagctgcgatgctacactaactcgcaacttgtccaggggcaagttgccaacagatatcaaaccaaggaaatagtgctgctcaagaagagagagaggagacaccacttcaaggagaagatgagtctagaagaagctcaccaccataagaggccatggataagagctcggaggaagaaggagatgaatgaagggagaggaagagaagaacaagaaattttgtgctctaaaagagctctgaaatctgaagtttaa

SEQ ID NO: 87741 - DNA, 492 bp, Glycine max
  Peptide Sequence Number=SeqID_204519
atggaagctaagatacccctagattggaaaccactcaacctagagcgatatgatggaaccattgatcccgatgaacatctagacgtttttctcacccaggcaaatctatacaccaatgatgatgtgatcttatgtcatgtcttcctaacatccctcaaagggtgctgtaagaaagaaagagttaccaagaccgagtcacataagtcgaacaaaaggcacaagtcagacaagcgccagtctctcccaaaagggcctagatatgaacgttacacacttgtgacgaccaattatactacaatccttgaggaagccttcaatgcggagttatggtcacaacacggaagactgttgggccctcctgatgtaagctccattggagcttgtaggcctaggatcttcttcatcaatggattcctttgcttcttggaagataaatggaagcagaatggagaaggaagagagagaggagatgccacttcaaggagaagatga

SEQ ID NO: 87742 - DNA, 159 bp, Glycine max
  Peptide Sequence Number=SeqID_204520
atgaagccttcaggagcagaaagttgctactcacagtgcggaagaagaagtgaagatgtgaagaggcttacgaagggggttcaagtggctaagttgcagtgcaatgaactagggttagtcgcatacagggtcaaggttttgggtattgaagtattataa

SEQ ID NO: 87743 - DNA, 189 bp, Glycine max
  Peptide Sequence Number=SeqID_204521
atggatggtaattgtggttattgggaaatagctgtgttattgggtatgggtgaagaatcatggtcattggtgcgcaaccatatgcataaagaactgacaagctggtccgaagagtatatcaacctggttggtggcataaagagatttgaggaattaaagcgttccctacttgttgacagattatctatg

SEQ ID NO: 87744 - DNA, 336 bp, Glycine max
  Peptide Sequence Number=SeqID_204522
atggaatcgagagctccaagtgggccattggtaagcagaactggatgcgggatgaaccggaagctgggttacggtgcccaactgcgcgctaacctagaccccacaaagggtgttggtcgattaagacagcaggacggtggtcatggaagtcgaaatccgctaaggagtgtcctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggtga

SEQ ID NO: 87745 - DNA, 171 bp, Glycine max
  Peptide Sequence Number=SeqID_204523
atgagggctcatgatagtcaggagagtccaagacccagcgtgagactcgttagacctccactccccatggctcactcagactcgagtatagggcccatcatctcaaagtgtttgataaggtggaaagtgctagcacctcaagcgcccgtcacaaagaacaacaacctttaa

SEQ ID NO: 87746 - DNA, 817 bp, Glycine max
  Peptide Sequence Number=SeqID_204524
atccagtgttagtgacagtggtgttagcatgatttgcaatgtgttctctgaaacattgacaagactccttctcgccctttgccccaatgtgacttcaagtggcattcaatttgctacggctcaattgccacatcttgaacttatggactgtggcatgaccatatgtgaacctaattctcaccatccaactgctgatgaaaataaccgcaaattacagaaaacatctagtactaatctacaccttacaaaccaaaagttaatcatcaaacatagctgtttaaagaaacttagtttgtggggatgctcaggcttggatgccttgtatttgaactgcccacaactcaatgatctaaatctaaattcttgtagaaatttacatccagagagactgttgcttcagtgccccagtttagaaaatgtgcatgcatctggttgtcaagacatgttaattgaggccatccaaagtcaggggctgttttgcaattgtttacctggggggtctgtttttttattacaaagcgccccccagacaggcgctttcatggagcacgcgacacgtgacacagtgcggcgcacgaggcagcaggagggtagcgcccctgacgcgggcgcgtctggtagcgccctgccacggccgcgtctggtagcgccctgccgctggacgcgactggcgcctgggtcgtgctcgcgtcaggggcactaccagtcgcgcccacgcgctgggcactatcagtcgcgcccagcggcagggcgctaccagacgcgcccgcgtcaggggcgctaccctgttgctgcctcgtgcgccgcgctgtgtcac

SEQ ID NO: 87747 - DNA, 306 bp, Glycine max
  Peptide Sequence Number=SeqID_204525
atgggcgatctcatatgtgcccagcggcagggcgctaccagaggtttccgcgtcaggggcgctatgcggatgatgcctcgtgcgccgcgctgtgtcaatgtgtcgcgttctccatggaagcgccttcctggggggcgctttgtttgcaatgcttttactgatatggaaaacccttcaccttgtaagcgtttacctgatggctccaaaagggttcaggttcctcatttggttaatagtgagtcgcctgaggatgagaagaagcaaaggagaaagaagagacgtctttgtaatgttgttgtggattga

SEQ ID NO: 87748 - DNA, 189 bp, Glycine max
  Peptide Sequence Number=SeqID_204526
atgaatttctccatgtcacccaggatgtttgttgaatcataccgcgtttccgcaccacgaaaggaaaggaggccattggtctcggtcttgcaccaagagccatggcaaaatccaagaacaggagctagactagtcgcacaattcatgacctgccccatcctttgtaattgcggtgcccagttggcttag

SEQ ID NO: 87749 - DNA, 576 bp, Glycine max
  Peptide Sequence Number=SeqID_204527
atgaagataggatataaatgtcaagtttgtttgtggagtacggtgcagcgaacctattattcatacccaagttttgctaatcgttttaagggaaatgtaaaccatagttattcaaacgcatgtttagctgccatcgttgaaacttatggagctgttgattcctcggggaaaaaaagaattagccgtgttgatgagttatatgatacattggttacacgtcttctgccttcagtgtcagtgtcatcaaatcctaatcacaagcttttagttgggctggctggtcctcctggtgctggaaaaagcactctagcacatgaagtagccagacgtataaacaaactttggccagagaaagcttcttcctttgactctctggttgaacctccagatgttgctattgtggttcccatggatggttttcatctttatcgttttgaactagacgcaatggagaatctcgaggaagcacatgccagaaggggaggtaagggatcagtttatgtaccatcatttgaccatggtgttggggacccagttaagatgtggtccactcatcagcattttataaatttctga

SEQ ID NO: 87750 - DNA, 537 bp, Glycine max
  Peptide Sequence Number=SeqID_204528
atggaacacaaggcgtattggactctaaaatttctgaattttgatgaagttctgtttggtgggaagaggaagctacaacccttggagctagaagagatggggcttaatgcatatgaatcatccaagttgtacaatcagaaggtgaaggcctaccatgaccagaagttgttgaagaagaatttccaaccaagccagcaagtcttgcttttcaattcaagactcaagttatttccggataatccaaagagaagctgggtggtgaatggtcaaagacttaaactgtatcatggtggaaacattgagaggctttcagatgaactcgctaagcgcaccttgcgcgctaaacgtggccatgaaatggcatctaaaaagaagtgtgcatcatcatctagaccccaagagccctatgcatcaagatttttttttcagaaattgcttgggagtgatatgagactaatgtccatctcagaaaatccctccaggagcggaatgttgagctggcctactcccactatgatgaattctttcaggaattaa

SEQ ID NO: 87751 - DNA, 459 bp, Glycine max
  Peptide Sequence Number=SeqID_204529
atgaatgttgttgaagcacaatatggtggagttttcttcctttatggatatggaggtactggaaagactttcatgtggaaaacattggcatcgacaatccgatcaataggtgacattatgttgactgttgcttcaagtggtattgcctctcttttgctacctggaagaagaactgcacattcaaaatttgtcattcctctcagacttaagggcattttcgaaatggatgctagatataggagatggtatacttgtgagcctaatgatggatatgttgaaataactattccagatgaatttctcataaatgattacaataatcctttagaggaaattgtgaacagaacatatcctaatttgctacagttctacaacaatcctgagtacttacaatcaagatccatacttgcctctacaattgaagttgttgataaagtcaatgagtatgtcatgtcttga

SEQ ID NO: 87752 - DNA, 711 bp, Glycine max
  Peptide Sequence Number=SeqID_204530
atggtgggatctaagattggggctactctaagtgaggattattttgcagaatttagacacttgctgcaacgtgaagaacgccttgaaatccttgtgaatgtctatgatttcacatattttgaagacatcattgtgggtgaggcaaaactggacactttagttgatattatcagtgtggtggtggatatcatagaacaacatacgcaatcacctccttatagagtaattgttgttcttagagacgaaaaggatgtggatatgacaatcactgtttgggaaagttatgttgcagaacttggagcatctctgagtaaaaacaaaattgagaagcagccattaattgtgatgttaacacttgccaaaatcaaactacctactgaattcatactaaactcttggtatataattgcatataaatatccacttagtgttcataacactaagatagcatccaagatgtatattaatgctgacatgttagaaattcatgatttcctaaaacggtataagttggtcattgtgatgaagcatgaaggtgaaaccaaaagatttcatttttgggatagtgtttgcataaaaatgttcaacagaagtgttgtagagactaggaaacaattgcaaggtcttgaacaaatcatagacaagggcaagtctatttttactgatactcaatctcaagaaaccttcttgacagtacgactcaccatgtga

SEQ ID NO: 87753 - DNA, 354 bp, Glycine max
  Peptide Sequence Number=SeqID_204531
atgaagattcaggcaggagacaccattctgaaaatgggaggaaaaaccctccaggatctatttctagtcgggagcttggggatgcaacacacagactcatgtgatcaaaccgccattaccaatggcgagtttgctgagcaacgcccatgtggcatggaaaacgccactcgtgatggcgacttggtgtcaggtggaactcgccaccatgactggcgagtctgtgcatgggggtgctcaggcgtaggcggtgcagctacggtgcaagctgcagcaggcgcagaaggagcattgactggcttggaaatcgccagtcatggtggcgatttggttgttcaaaaattttttggcctataa

SEQ ID NO: 87754 - DNA, 348 bp, Glycine max
  Peptide Sequence Number=SeqID_204532
atggaaaaagatgaaggagaatgtcttctccagcccttctgcccttcttctctctatttttcaagtagcaaaaatggttggctagactgtggttgtggtgcgagagtaagtgaaaatccgttaagagagcttgggcgcgctaagcgcgagaagagacaacgtgctccgtgggcaggctcacttagccaatctgccttgctaagcgatgccatcaatgtgaccaaacatttggatgccgaagatgagagtagtaacctaacatttccaagcatggtagctgattcgaggcagtttgaaggtgatgctagcagtgagaagaagagaatatgtgcagctgataccaagtaa

SEQ ID NO: 87755 - DNA, 150 bp, Glycine max
  Peptide Sequence Number=SeqID_204533
atgaaggatgagacttcagataaatacaggagaaatgaggcttttggaattggaggtagtagtacgggttggggtccacaacgcaggaagaaaaaaggttggcaaaaaaatgaaaattttagtggggctgatgtggtgattggtgaatga

SEQ ID NO: 87756 - DNA, 1161 bp, Glycine max
  Peptide Sequence Number=SeqID_204534
atgggtaactataggttcaaattatcagatataatccccaatgcctggttttacaaactcaaggacatgggaaaaacaagaaagcaaacccaaacaactaattccaggaagaaaaagcaaccttcaccagtctcaaccacaaaaccatcaaaaccaaagcaaccccaccaatacaatctcagaaagtcttactatttcactagggagcttaccccaaatgatagaatctactcctcaccaacaccaacaaataaccaaaatgccaaagacaacaattcccctgaaccccccagaaaatcatccaaacaaagactgaagaaaagaacttcaaggacttcttcacctaagcttcttgttgtctctaacaataacaactcctcctcatcaccacatgataatagctctactgaatcttcagagcaccctgacccagaattcagaacagaccgtgttcttccaaccgagtcattcgatgaaacggttccttgggcaaactcttgtgcctgcagggtacactccaacaccaaggacatcatcattgatgttgacaacaattccatagccagaaaagatgataagctagaaggatatgattatgaatgtgattccttctcagaccttgtgcttccaccaattgtgacaaagcctgcaaaattcaatgacttgctcagtgatgccaagaagaaagaaaccaaaaccagaagcaagatggctgcacatgaagaagaaccaaacctcaataagggccctctgagggttaaaattgtgaaggaagacactgcatcaatgaagggacagaagaacaactatggaaggagattctctgtgagttctcctggagtgaggcttcggatgaattctccgcgaatcgccagccggagagttcaggcaaacggccggagaagcgtgtcctcggccgccgccgccgccgccgcccggagaagcctctccgatagctttgcagttgtgaagtcatcactgaatccacagagggatttcagagaatcaatggtggagatgattgtgcagaacaacataaggacatcaaaggatttggaggatcttctagcttgctatctttctttgaattcagatgagtatcatgatctcattatcaaagtgttcaagcaaatatggtttgatttaactgataacaattag

SEQ ID NO: 87757 - DNA, 180 bp, Glycine max
  Peptide Sequence Number=SeqID_204535
atggtgggagaggggagagcaactagtgggggaattgtcgactttagcggattcattcggcataaccatgaactatatactttgtttcatttttggtcagtatggtgctctcctactcattttaagggaacagaaataggaatcccctccactgtaaccgaaatgggatacagtcactag

SEQ ID NO: 87758 - DNA, 306 bp, Glycine max
  Peptide Sequence Number=SeqID_204536
atggctaagtttgaccctgagatagtcttggagttttatgctaatgcttggcccatagaagagggagtgcaagacatgcggtcatgggtgaggggtcagtggattccctttgacgcagatgccctcagccagttcctgggtgacccgctagtgctggaggaaggccaggagtgtgagttcaatcagaggaggaacagggccgatgggttcgacgaggaggccattgcccaactgttatgcataccggggcaggatttcgccagaccgctgcagggaggcgggtgcggatcatgcgcaccagcatga

SEQ ID NO: 87759 - DNA, 219 bp, Glycine max
  Peptide Sequence Number=SeqID_204537
atgactcgttcacttgtctcaatgttattgctgaaagttatctttgcagccatgctttttgttctattttcacttggtgttggcaacagattgccttttcccaactgtcatggaacatgccttgaatttcctgactgtgctgtccactgcaagaccataggctatgagatagatgggaaatgcctcccatcttcaaaaggctggtgttgttgctactaa

SEQ ID NO: 87760 - DNA, 282 bp, Glycine max
  Peptide Sequence Number=SeqID_204538
atgccaagtatctcaaagcggccgatcaaaggttgcatattatcaagtaataatccccggacgaaattagggtatgacaaaatgaaaagagaaaaatatgcctcctatagtagtcatgactcttgcaagagtttaagtgaagaacttagtgactattatagagggcgacataggtcacatactaaacatcactcccaaagaagagaaaaggatagaaggcctcaagaggttaacattagcctcccatatttccatggaaaagatcatgttgaggcctactga

SEQ ID NO: 87761 - DNA, 321 bp, Glycine max
  Peptide Sequence Number=SeqID_204539
atggctactccacccagctctcctcctcctcctactaaagcagcatcacagtcgctgtttaccttgaaaccagctggggcagacagacccgtggtccacgttgatcctgcgaccaggaaggctaacgatccccacaagaagaaattaagaacatatttggggattgtcgctcgtgataaggctgaatttgatatccctgaagcatctgacgttaggacaaaaaagaaagtacttcagactgtgggggagcggatgtgcggaaaaaggcacaggtcatccaaaagcaaaacactgcccccacgtgtctcatgggggttatga

SEQ ID NO: 87762 - DNA, 411 bp, Glycine max
  Peptide Sequence Number=SeqID_204540
atgtcgaagaactgggtcttgaaaaagcataacaagactttccttgattggtttaaagacataatatttgctgatgaaaatgcttctaaaatgttaagaaagctagcatataggcttaaaagaaatgttataacttggcaaggatacgacataaacaagtattcattttatacaaaagcacaagacgagaaaagtacaatgcaaaacagtgggatcaccctaagggctgaatctcaacacttcaccacggttctacacgggaaaacaattggtgttaatgtagaagatgatgattcatacattgatacttatgttagtcctttgtccacacaaatgtcgactaacatcgtcggagaagaagaagttgatgatgttcatactaatcgtaatgatcatgatgaaggagaatga

SEQ ID NO: 87763 - DNA, 268 bp, Glycine max
  Peptide Sequence Number=SeqID_204541
atgcaatcacagggacttgcactgccttcgaagcctgaggttggtccctcagctgctcatgttagcacaatggaaagttgtgttgattcctcagggaatgatccagacacggagggtacatctacttgggttgttgtgaatgagaacaagagagggtacatctcttgtggatcagttctagtggagggtacatcccctaggttgttcaaagagaacaagggagggtacatcccttgtggatctttgcttgtaaaaggatttttacaag

SEQ ID NO: 87764 - DNA, 925 bp, Glycine max
  Peptide Sequence Number=SeqID_204542
atggctgatggaaaactgatagagatgaagggtagagttaacctagggttagaaagtgagaatggagttaatcctagtttgaaatgtcatttaggacttatgagaaagcttagactattgggttctggacgttttcaagcagatcccaacggtcacaatgtagacttttgtgctagagacttccagaacgaggataagggctacgtgggagtacgtgagctcagtgaaggtgggcaactggggatggtgggtttatgtgtgatctgtggatgtggagagttgacttgcaccatcgcccgaccgccacctagtaccacatgtgatggagtggtacctagagatatgtcgcgggggtcaggagaccttggggacgtcaggcgagctcctggcagtcaaccgataaaagaacaaagaccacaaagcaaggaggcttgtgtggtggctggccagttgcttagaaatgggactggaatgttgaaagggcctctggtaatcgattaccagtgttgtgtaatcgattacacagaggaacaggtcactgtggagatggagtgcctagagggagcttgggagaccctcgaaggcaatgcgaggtgccgattctggggcacgattcgattcacggctacttcattagtgcatccagaggaacccgcgcgcacgcttcaacgcactgtggagtggatattacccacgcctacaccatatcatctagtggagccagttcaagtgatcgaggtgacatcatctgaggaagaccctgaggaagacccagaggagctacctcctgagcccgctgtggatgctcttgactttctagagggtgatgaggactcactccctgaggtggactctcccgaggacgtcatgtcggcatctgaggcagactctacggaagaatgcggccctggagagatggcgacta

SEQ ID NO: 87765 - DNA, 300 bp, Glycine max
  Peptide Sequence Number=SeqID_204543
atgatagatgtcggagttttgattcgcactagattttatttcactttagtaaaacatgggatcaatcaaaagccttcacttaaaaagaggttttatccagtcaaggtcaagagcctagggatcaccagtctaagagagttagggcgattgatgggtcagctccagcggcaagctttccgcaaagcctatggtaagatttgggacctagctagggtagaagtctccatggaaccgatcgcatccctttcccagtattatgaccagcccctaaggtgcttcacatttaggacttccagctag

SEQ ID NO: 87766 - DNA, 369 bp, Glycine max
  Peptide Sequence Number=SeqID_204544
atgttttctgggttggaccttgtcgtacccaaattttgtccggggacaattgttgtcggcgcgtggaccttggttgatcactttgagacacttgacacccatcatcgcgtaattcgtaaagttccacgatgtttcaaaaagaaatcagccaaaaatacaaaaacggggctgcacttatcaaacttgggagtgaaacttcatccagaacattctagaaggtggggtgtacttatcaattgtgggctgcgctcagaaaacttcctcaggaatcctttggagagggacgtgaacttatcaattggagggtgcgctcagaaatcttccttaggaagcctctgggccgcaaccacctccctttttctcctataa

SEQ ID NO: 87767 - DNA, 252 bp, Glycine max
  Peptide Sequence Number=SeqID_204545
atgcgggagagttacgcgaacatagtcgcgttgatggagaaacacctgggaaagtcgatagcgacggagggaggtacgccggagaagaaggacaaaccggaatctagtgaggtgaaaaacgatgtaacactagagttccgtcagtcagccaagaaggtggagctgccgtcgttcgacggtgacgatcctgctggttggatctcgcgtgctgaggtgtactttcgagtacaaggaactacgccggcggtaaag

SEQ ID NO: 87768 - DNA, 564 bp, Glycine max
  Peptide Sequence Number=SeqID_204546
atggctgctgcacgagggttggtactgtcacgtcctgttacttttgtaactgccaatgccaaaaagcttgaagaagttcgtgccatcttgggcaattccattccttttcagtccctcaaacttgacttgccagagttgcaaggagaacctgaagatatctccaaagagaaggctcgaattgctgctcttcaggtgaatggacctgtgttggttgaagacacttgcctctgtttcaatgccttgaagggtcttccagggccttacatgttttcccacgggaaaaagaacagatacaaattggaagcacaagcagtcaagcacaaaggtgcaatgttgggaataatggttcaaaatcttgcattcatttggcaatggttgctcaatttgggaaatccgcaagggttgcttctaaaatttggtattagaaaatatgacatggctactgatatgttaatgcagctcctcctaaggccattttacacagaaaaactaatttggacagctagcacaagggttcgactttcgagcaataggcaggataatgcatatatcttccaaacttga

SEQ ID NO: 87769 - DNA, 150 bp, Glycine max
  Peptide Sequence Number=SeqID_204547
atgacgttgaagcgatataggagacggcgggacagcttgggattgatgaagggcacgatctcagtgagggcgcagaggcattgttgggcaattggacagattgcattatgtggctgcatatggcttgtaaaactgatttggcaagtgtga

SEQ ID NO: 87770 - DNA, 342 bp, Glycine max
  Peptide Sequence Number=SeqID_204548
atgttcgatcacgctgatgcttggccattcaaggaaccagttgatgcacgggatgtccctgattattatgacatcatcaaagatccaatggatttgaagacaatgtctaagagggtggattcagagcaatattatgtaacatttgagatgtttgttgcggatgccagaagaatgtttgcgaatgcacgcacctataattctccagaaaccatttattacaaatgttctacaaggcatgtgctcgtgcttccacctcctggatgggttagaagcccactttcaaagcaaagtgcaagcaggcctccagcctggtaccaaaattcagtagggacacttcaatag

SEQ ID NO: 87771 - DNA, 1386 bp, Glycine max
  Peptide Sequence Number=SeqID_204549
atggatttccacggcggaggaccactccgttcccgcagttcccagtccccttctccctctcactccgcctccgcctccgccacctcctccatccacaagcgcaagctcgtgtccgaggaccacgcgcctcccttccccccctcctccttctccgccgacacccgcgacggtgccctcacctccaacgacgacctcgagagcatctccgcccgcggcgccgactccgactccgactccgaatccgaggacgccgtcgtcgacgacgacgaggacgactacgacaacgacaacgacaacgactcctccatgcgcaccttcaccgcctccaggctcagcaaccctccctccgctccccgcaacaccaagctcaagaccgaaaactccaccgtcaaaattgagaattctgacggcgccaaagacgccggagccgtcggatctggcgccgccgccgccgcgggaccggtccccgggattgtggttaaggaggacccgactaagatttttactgataatttgcaaaccagtggggcttacactgccagggaggagagtctcaagaaagaggaggaagcaggaaagctcaaatttgtatgcctttcaaacgatggtgttgatgaacatatggtttggttgattggattgaagaatatatttgctaggcaacttcccaatatgcccaaggagtacattgtccgacttgttatggataggagccataagtctgtaatggttataaggcgcaatcacgttgttggaggcattacatatcgcccatatgctagccagaggttcggtgagatagccttttgtgcaattacagctgatgagcaagtaaagggttatggtacccgattgatgaatcacttaaaacagtttgcacgtgatatggatgggctgacacatttcctcacatatgctgacaataatgctgttggctattttatcaaacagaaaaacagggtgacatggctaaaggggctgacagtactttggaatctttatcttgtcctcagatacagtaggagtgatgcaggaatctgtatatttcttttggttttatcttttgattctcttgaagggatttacaaaagagattcacttggagaaagatcgatggcaagggattacgatggaggaattctcatggaatgcaagattgatccaaagctcccttacactgatttgtcaactatgatccgtcgtcaaaggcaggcaattgatgaaaaaatcagagagctgtcaaactgtcacatcgtttatgctggaattgattttcagaagaaagaagctggtattcctaaaaaaattattgatgacatccctggtttgaatgtcaacctcctgtccaagttcctgtgcacaggggctaacctttttgctgcttaa

SEQ ID NO: 87772 - DNA, 1131 bp, Glycine max
  Peptide Sequence Number=SeqID_204550
atggctgattcttcttccaatttctctttaccttgtgatgcattaagcctaagacaaaagagtttctcaattttccataccggtggttctaggttgggggttggtgctaaaggtttgccagattctgaatctgtttggagccctacatctcctctggattgcagactcttctcaaatcttagcaacccgtttagtgccaagtcttctaggccatcatttcaaactgggcataagaagcagtttgatggcagtaaagtaggccttggcatcataagttcccttgctaatgaaaccaaacttaacaatgacatccttgctaaatttaagaggaaaggcataatttttggaccacaggtgaaaactggcatccttaaattctcaaacaacaaccaggaatcccttgtgccttatttgaaatctaattccttgccaaaaaactatgtaatttcacttccttctgaaaccacaattcccaaatctgaactggaaaactttgatgatgtctctggaaagaaagatgactattgggaatgcgaagctttcaaaagtaccataacttctttgcctgattcctttagcccttcctcattgatcaactcaactcaaaactccaatttgggaatcaatgaattaggtgttggaaataatgcatctgtattaatgagtttgcctcaagtgacaagcaaagtttcacaggtaggctcactctctgcgagagagatagagctttctgaggattatacctgtataatttctcatggtccaaaccctaagagaacacacatttttggtgactgcattttggaatgtcacaaccatgacttcactgagttcagcaagaaggaagaacctgctttcagctattctcaagttccttcattttcagatggatcagccccttatccttctgacaatgttttgagcttttgttactcatgtaataagaaattagtgaaggaggaagacatttatagatacagaggtgagaaagcattttgcagttttgaatgtggatcagaggaaattttgacaggggaggaattggagaaaacttgtactaactcagcagagagctctcctgactcaagttaccatgatctcttcctcacgggtctgcttttgtccaaataa

SEQ ID NO: 87773 - DNA, 159 bp, Glycine max
  Peptide Sequence Number=SeqID_204551
atgtgtcctcccaccacctccgatgccattgcataccgtgccgtcaataggtcctcctctatcatcaccaccacgagccgcattttggagatacacacgatggaagatgaggaaaggggaaggacaacggataagaagaggaggatgaaggaaaaataa

SEQ ID NO: 87774 - DNA, 483 bp, Glycine max
  Peptide Sequence Number=SeqID_204552
atgaaagtggtggaaactgttgcaggcgtaaatgtaccgatcaagctaaagggaaagttttatcggactgcggtaagaccggcgattttgtacggaacagaatgttgggcggtcaagagccaacatgagaataaagtaggtgtagcggagatgaggatgttgcggtggatgtgtggtaagactggacaggataaaattaaaaacgaagctattagagagagggttggagtagcgcctattgtagagaagatggtgaaaaatagacttaggtggtttgggcatgtagagagaagaccggtagactctgtagtgaggagagtagaccagatggagagaagacaaacaattcgaggcagaggaagacccaaaaagactataagagaggttatcaaaaaggatctcgaaattaatggtttggatagaagtatgatacttgatagaacattatggtggaagttgagccgaccccacctagtgggataa

SEQ ID NO: 87775 - DNA, 506 bp, Glycine max
  Peptide Sequence Number=SeqID_204553
atggatggcattgaggatgatgcaaggtatccccctaacccatatggttatggttatcagaattctctatattcccccccagttgatactgaatatgccctagatgataatgatgaaaatgaagagcatgtgcagttagaaggggaagatgaggttgatgttgatcaaagtaacaaccttcagcttccccaaaaggatgatgatgaagaagatggcatggatgggggtggtgatgaaaatgatgatgatgaggaggaggaggcggaagagaataagcagattgattattatcccactaagagtgatgaagatgaggtagaatggcacccaaaaaagcaaaagctcaagagtttgatttcgacctatgaacttgcgcctagagtgccagcaccatcagttgcagctacagctccctcagttcctaaaccatcttctggtggtaggaattcactaactgactggactgagcgagagacgtttgttcttcttgatgcatggggtgatag

SEQ ID NO: 87776 - DNA, 1761 bp, Glycine max
  Peptide Sequence Number=SeqID_204554
atgggtgtgaactccaacagagtggaacactttgctagccatgatagcgccatcgaggagacaatgcaaatccatgcagtgcagttgccaccacaccagaccacactccacaaactcaggcacagagtctccgaaatcttcttcccagatgaccctctccaccgtttcaagaaccaaactcgctttaaaaagttcctcctcgcacttcagtatctcttccccattttcgactgggccccaaactacaatcttacccttctccgctctgacctcatctctggcctcaccattgccagcctcgccattcctcagggaatcagttatgccaagcttgccaacttgccacctattcttggattatattcgagttttgttcccccattgatatactcgctgcttggaagttctagacatcttggtgttggacctgtttccattgcgtctttggtcatgggatcaatgttaagtgataaaatttcttacactcaagaacctattctctatctgggattggctttcaccgccactttctttgctggtgtattccaagcttctctgggtatattaaggctaggcttcgtaattgattttctgtcgaaggcaacgctggttggattcacaggcggtgctgccattattgtgtcactgcagcagctgaaaggtttacttggaatagtgcactttaccagcaagatgcaaataattccagtaacgatctctgttttcaagcaaagacacgagattgggcacttaccaaagggagttaatccaccatcagcaaacatgttatacttcaatggtccttacttggctcttgctatcaaaactggcatcatcacagggatcttatctctcactgaaggaattgcagtagggagaacatttgcttcacttaagaactaccaggtggatggaaacaaagaaatgatggccattggtctaatgaacatagctggctcttgttcttcatgttatgttacaacgggatccttttctcgatcggctgttaactataatgctggagcacagacaacagtttcaaatataatcatggctgcagctgttctagtgacacttctgtttctcatgcctcttttctactatacaccaaatgttgtcttagcggccattatcatcactgctgtgattggtctaatagattatcaatctgcatataaattgtggaaggttgacaaacttgatttcttggcctgtttgtgctccttttttggggttctgttcatttcagtgcctttaggtcttggtatagcggttatcatatcagtcctcaagatcctgcttcatgtcactcgaccaaacactttggttttggggaatataccaggaacacaaatattccacaacataaaccaatacaaaaaagctttaagagttccttcatttctcattttggctgttgagtctccaatctattttgctaactcaacttatcttcaagaaaggatactgagatgggttcgagaagaggaagagcatataaaagctaataatggagctccattgaagtgcataattttagacatgacagccacagacacaagtgggcttgacactttatgtgaacttagaaagatgctggagaagagatcacttgagtttgtgctggcaaatcctgttggaaatgtgatggaaaaattgcataagtcaaacattttggattcttttggattaaaaggagtctatctcacagtgggagaagctgtgactgacatttcatcaatctggaaagctcagccttga

SEQ ID NO: 87777 - DNA, 1896 bp, Glycine max
  Peptide Sequence Number=SeqID_204555
atgaggaggatatcaacttttcctcctttctgtcagagattaaaacaaacagaaaatgagattgcccaaatgtttcgcttgcctaattcccatgaaggaaaccaccttaacaattccatgaaaggaggacatgtgttaaggagggacccttattcccggacattggatgagaggttcattagaattttgaaaatattcaaatggggacctgatgcagaaaaggccttggaagtgctgaagctgaaggtcgatcctcgcttggttcgcgagattcttaagatagatgttgaggtcagtgttaagattcagttttttaagtgggctgggaagaggaggaattttgaacatgactcgaccacttacatggccttgattcgctgcttggatgaacataggatgtttggtgaagtgtggaagacaatacaagacatggttaaaggttcatgtgcaatggctcctgctgagttgtctgaaattgtgagaatcttggggaaggccaagatggtcaacagggcattatctgtcttttaccaggttaagggtcgcaagtgcagacctacggcgagcacttataactctatcatcttgatgctgatgcaagaggggcatcatgaaaaggtccatgagctgtacaatgaaatgtgcagtgaagtgcattgtttccctgacactgttacatatagtgcacttatatcagcatttgcaaaactaaatcgcgatgactctgctattagattgtttgatgagatgaaggagaatggattgcagcccactgctaaaatttatacaaccttaatgggaatatactttaaggtgggtaaggttgaagaagctttgggactagtcaaggagatgagagcacggcggtgtctcctaactgtttttacttatacagaattgataagggggctggggaaatctgggagggttgaagatgcatacatgacatacaagaatatgctgaaagatggttgtaaacctgatgtggttctgatgaataatttgattaacattttgggaagatcaaatcacttaagagatgctattaagctttttgatgaaatgaaattgctgaactgtgcacctaatgttgtgacatataataccatcatcaaatctttatttgaggccaaagctcctctttctgaagcttcttcatggtttgagaggatgaaaaaagatggaatagtccccagctcatttacttattcaattcttatcgacggttactgcaaaacaaatcgagttgagaaggctttgttgcttcttgaggagatggatgaaaaaggctttccaccttgtcctgctgcctactgcagcctgatcaatacccttggagtagcaaaacgctatgatgttgcaaatgagctattccaggagttgaaagagaactgtggatgttcaagcgctcgtgtatatgctgtaatgattaagcattttggaaaatgtgggcgactcaatgaagctatcaatctgtttaatgagatgaaaaaacttggatgcacccctgatgtttatgcttataatgctctcatgacaggaatggtaagggcagaaagaatggatgaagctttctccttgtttagaactatggaagaaaatggttgcaccccagatataaattctcataatattatcctaaatggcttggctaggacaggtggaccaaagggtgctttggaaatgtttacaaaaatgaagaactctactattaagccagatgtggtttctttcaacaccattcttggttgtcttagccgagcaggtctgtttgaagaggctgcaaaacttatgcaagaaatgagttctaaaggattccagtatgacctcatcacctactcttcaatacttgaggcagtcggtaaggttgatgattgtaaaatggtagagtcatga

SEQ ID NO: 87778 - DNA, 2181 bp, Glycine max
  Peptide Sequence Number=SeqID_204556
atggccaattgggccaacatggacagcccaaatgtcgttcgacatagcccaagaagaatgtgcttcctctcacattgtcccaagctgaggaagaaagaacctttcttcgctatagtcagtgataccgagccgtcacctccattcattcatgccttcatgtgtcttctgagcaaggtgatgggtctggaaaagaatcctcgtgtgtttttcgatgtctcaatcgacggagaccctgtggaaagaattgttattcagctttttgccagtatagttcctaggacagcggagaattttcgggcactttgtacaggtgagaagggcattggagaatcaacggggaaacctttgcattataaagggacaagccttcatcgtataattagaggttttatggctcaagagaagatttttgatcctgcatgcacaggtggagaaagtatatatggggggaaatttgcagatgaaaatttcaaactaacacatgatggacctggcattctttctatggctaatagtggtcctaacacaaatggatctcagttctttattacattcaagcgccaacctcatcttgacgggaaacatgttgtttttggaaaagttgtcaacggaatagacattttgaagaaaattgagcaggtgggaacatctgatgggaaacctacccagccagttaaaattattgattgtggtgaagtctctgaaacaaaaattcagcatactgcagagaaggagaaaggaaaaaggagaaaatctgggaagtccttatcttctgatgatggttctgacaaaaaatcaaggggaaaaaggaaaaaatcttccaaagacacaaggaagagaaggaggagatactcaacatctgatagtgatagctattcctcagattctgagtcagattcagattctgaatcggattcatcagtttctgattctagttcctctagtgatgggaaacaccagaagaggaggagaaataagcacaagcatgggaagaagaggaaaattggacgaaagcagcggaagagaagccagcacggtagaactaaaaaatcaagacacaagtctaggcggagctctgaggattcaagtgatacaaatagtgatagcgctagtggcagtagttctagcgatgagaaagctgatcgtcatgcctcaggtcgtaaagcacctgctgacaataaagcccaaagaaatctagacacaggaaagcaattttccaacccttcttgtcaaaggcaaactattcctgaacaaacaatggatcccaaggtaagaagaattgtggacaagcaatcacatgaagaaggtgaattctctccggagaatggtgcatttgtgaataacaggcatgatactcaagctgaatttagtaaacctgctaagcaacatgctaattcagatgattcaaatcacaatagaggtgcaagtcctggaagaagtcctaccagggattctggggagctaaaccaaggacgtgctttgttgttggctagtcctggcaaaaaaagtcctggccaaaaagcatctgaacctcctgcccccaaacatggtcagggattttcaaaaagcccttcaccaaatagcatgcctaagcgtattaaaaaagggcgtggctttactgagcgttatgcctttgcacgaagatatcgcactccatctccagagcggtctcctcctcattcatatcgttatggtgatagaaatataagaaggaactttgatagaaacacaagctacagaagttattctgggcgctctccaccacgacgttttcgaagcccgccagggggcaggaatcgtccaagataccaaagcagaagaagtaggagtaggagcatctctggcagtccagtgcgtgggcgttttagagagcgtgaccgcagcaggagtccaagacgtagtcctagtccagaagacaggctgcctctgataagtgacagattaaaatccagacttggtccaagaagtgacgaaggactgcgagacagggggaggtcgaggtcgaggtcgaaatctaggagcaaaggctcttctcactccagatcccctgatgccacaccaccaaaacgatatgataaaaggacttctgtacctcgtagcaggtctagatccagctctgcatccggccaaaagggtttagtttcttatggagatgccagtcctgattctggctcaaggtag

SEQ ID NO: 87779 - DNA, 123 bp, Glycine max
  Peptide Sequence Number=SeqID_204557
atgtactcctccaggcctagagacatagatgccctaagattaggggtggataagcgggcttgggtccatgaactggcccgtgggatcgcagtccgcgcggtactttgggtccgtcctgcttaa

SEQ ID NO: 87780 - DNA, 327 bp, Glycine max
  Peptide Sequence Number=SeqID_204558
atgaccatgattacgccaagctcgaaattaaccctcactaaagggaacaaaagctggtaccgggccccccctcgaggtcgacggtttttagaggagacaaattgtgtagggatgtgtattaatctctgcaaaatgccatctcaatcgtttataaaggacactctggggatgccagtcaacatggtgcccaattttgacgacatgagttgtgagatgatatttggacaggagcctccagcatcaaccgatgatccagcactgaagcaaccatgctataaactatgcaaggcatataaaaagcatggaacagactgcctcagtagttaa

SEQ ID NO: 87781 - DNA, 3003 bp, Glycine max
  Peptide Sequence Number=SeqID_204559
atgccgacatacaagataaggggaatcgacgtagattttccgtatgaagcctatgaatcccagctcgtttacatggacaaagtcattcaatcacttcaggagaaatgtaatgcactattggagagtcccacaggaactggaaaaacactttgtcttctctgtgctaccttagcatggaggaagagtttgggtagtttcacaactggtgtgagcatgcaggctgacgacaagtcagagggtaaaaatgacgtttcatcgtcacaatctgagtcctcaagattttctacaattgtatatgcttcacgcactcacagccaaatccgtcaagtaattcaagaattgaaaagaacatcttacaggcctaagatggtagtcctgggatctcgggagcaactttgcattcatgatgaagtgaagttacttcggggaaaaacacaaacaaatgcttgccgattactctgtcgaaggcgtgggaagcgtcattgtaaccattttaaaaaagttcctgagtacatgaaggataatccccagcttggagaagaacctgtagatattgaggatttggtcaatattggtagaagatttgggccgtgtccttattatttatctaaggagctacacaagtttgttgatatagtatttgctccatacaactatcttatagatcgtgggtatagaaaatctctgcaactttcttggagcaatagcatactcatatttgatgaagctcacaacctggaaagcatatgtgctgatgcagcctcctttgacttgccttcttggcttctaactgcttgcatttctgaggcagaaagttgtattgacctttcaatagaaagaagagataaatcaaatgataagtcacaaaatccagatgattttgctatccttagagcacttcttctaaaacttgaaaagcgtattgctgaggtgcctattgaatctaaggagttggggtacaccaaacctgggccttacatctatgaactgctggctgatcttaacatcacgcacaaaactgcttctaagctcagggatatagttgcagtagcctcaacccttcttgaggaacataatcagcagaaatcaactggcacggtctgcaggttggatagaattggtgaaattcttgatatggtgttcagggatggaagaactgctcatgctaaatattatcgtgttcacttgcgggaggttgaggcttggtctggcaatggttcgaaaggcaaggtgtcaaggacactcagctggtggtgctttaatccaggaatagccatggaagactttcctaagtatggggttagatctattatattgacttcaggcacattatcccctatggaatcttttgcccaggaactgaaattagatttccccattcggttggaaaatccacatgtaataaccgcaaatcagatatgggctggagtcttaccagttggtccttcaggacgtacttttaactcctcttaccgcactcgcgattcaccagagtacaagcaggagcttggaaatgcgattgtaaatttggctcgaattgttcctgatggacttcttgtattcttcccttcttattaccttttggaccaaatcatcgcatgctggaaaagtagtaatgaaaattcaacatcaatatgggacagaatttgcaaacacaagaaacctgttatagaacctagggattcctcatcatttcccttgtcaattaaggactacatgactacgttgaatgacacctctgcctctggagcaattttttttgctgtttgtcgtgggaaggtaagtgaaggattagattttgctgatcatgctggaagagctgtggtaattactggtttgccatttgccacaagcactgatcctaaggttcgactaaaacgtgaatacttagatcaacaatctcggccacagggagaactgttcaagcatatatgtttaactggagatgaatggtataaccaacaagcctcccgagctgtgaatcaagctgttggacgtgtaattcgccatcgctatgactacggagcaattattttctgtgatgaaaggttttcacatccacatcgtcagtcgcaagtctcacgttggatacaacctcacatcaagtgtttctcaagatttggagaagtcgttttcactctaactcgatttttccgagatgtaggaactcagggtcctactaaggtgtcaatgttagaagctaaaaatgggggaaatataggagaaataccatcatcagatcagaacatggacaaatttcataaggaaaaacttttgtcacatctggctacaccaatgactcaaaatttctctgcttcatctttgcttgatactaaaaaaggctgtacatcattcctgggggaaattgtgcctgccaatcgctcatctctgttttctgacaatggcaagactgtacactgtgaaagttcaagaaatatatgtggcaaggttctgcttggagaaaggaagactctgcaatcacaagaatgtgacaggcttgatttggctgatgattgtcaactaggtgaaaaatcaaaggatacaccaatagctccttgttcttccaagaagcgtagatttataacaggagattatgacttaaagcaatattttggaaattctaatgagcattcatcatctgctagccaaagtgctcaaggtggtgtagatctgcgacataaagatggggtggcctctgacagtcttgagttgattagacaaaagggcaatcttcctgatgattttgtgccttctgttggtgatgaaaccaaaggatcagcattccttgctcaggttcgagataagcttagtgctgcagaatatataaactttgtgggttatatgaaggcgctgaaaaccaaaacgatgaaaattagtgaagttttacagtgtatttctagattgttcactggacctgacaggctaccacttcttaaaaggttcaaggattacatccccgcaaaatatcattctttgtatgagcactatgttgaaaaaaaataa

SEQ ID NO: 87782 - DNA, 522 bp, Glycine max
  Peptide Sequence Number=SeqID_204560
atggcaaggccggggaataagatcattcaagccaagctggtggtgagatatccaataccctctcaggtacttcttggagacatgggaactggaaagaccagtatagcactgagatttgtaaaaggccatttctttcctaaccagcacagtttaggaatcttaccattaatctacgcacaggaaccaaccataggagctgcttttttcactcaaatattgtcattatctgaagcaactgtgaagttcgatgtatgggacacagccggacaggaacgttatcatagtttggctcctatgtactaccgtggtgcagcagcagcaattgttgtctatgacatctcaagcgttgatacatttgttcgagccaaaaaaatgggttcaggaattgcaaacacatgcaacaccagcactagtaatggcagtgaggaaaccagcactagaaatggcagcaaggaaacccacgaagggaggcccaagaggaatgctacaagacccacttacatgaacgattacagcacctag

SEQ ID NO: 87783 - DNA, 3162 bp, Glycine max
  Peptide Sequence Number=SeqID_204561
atgtcgaatagccaaaatccgaattacgatggtagctcatttctcattgacataaccaccactgtgaattacaccatcagcacagccaaaaaaagatggcgttttgcttatactgctatttattctagaagggtcatgctttccttggccaaagaaatcatatctaagagaaatacaaacactcatccttactctaaactattccaaactcaatctaccggttccggaagcactcttgatatcattgagccactaattccccaacatggtaccaataatcattattctttggttcctgatgttgacaaagccagacttgctagcatggtaaaggacaaaaacttggaagcctttgttgagtttggaagagttgaaggtgttgcaaatactcttggaaccattcctgcaaagggaattagtggcgacgacgatgacgttgcgaaacggtgtgaattgtttggttcaaacacttaccagaggcctccacccaaggtatttgttagctttgtagtggaggctttcaatgacactactattctgatccttcttgtttgtgctggcctttcccttggttttggaataaaagaacatggtccaggggaaggttggtatgaaggagggagtatatttgtagcagtgtttcttgtagttgttgtcactgcactcagcaacttcagacaagagagacagtttgataaattgtctaagataagcaacaacatcaaagttggagttgtgagaaatggaaggccacaacagatatccatctttgaggtacttgtgggggatgttgtgtcacttaagattggtgatcaaattccagctgatggattgttcttaagtggtcattctttgcaagtggatgaatcaagtatgacaggtgagagcgaccatgtagaaattgagccttcaaatagcccctttttgttgtccggtgcgaaagtggtggatggctttgctcagatgcttgtgacatctgttggaaccaacacagcatggggtgaaatgatgagctcgatatcgcgagacaccaaggaaaggacaccattgcaggctcgccttgacaagctaacctcttctattggaaaggtaggcctcgcagtcgcttttcttgtgctcatagtcttgttaattcgttatttcactggaaactcggaggatgataaagggaatcaggagttccaggggagtaaaaccgatgtaaacgatgttttcaacgcagttgtgcgaattgttgctgctgctgtcactattgtggttgtggcaatccctgagggtctgcctttggctgttaccctcacacttgcatactccatgaaaagaatgatggctgatcaagcaatggtgaggaaactttctgcttgtgaaactatggggtcagcaacagttatttgcacagataaaactggcaccttaactttgaatcaaatgagagtcaccaagttttggcttggcctagaaaatggtatggaaaacttttccaatgcaatggctcctaatgttcttgagctatttcaccaaggagttggcctcaacacaactggcagcatctataaaccttcatcagaatctgaacctgaaatttctggtagcccaacagagaaagctatactcttgtgggccgtgtcagatttaggcatggacatggatgaactgaagcgcacacatgaagttctccatgttgaaacgtttaactcggagaagaaacgaagtggtgtcgcaataaggaaggagaccaacaacacagtccacgtgcattggaaaggtgctgcagagattatacttgcaatgtgttctaattacattgactataacggcatagagaagtcccttgatgaagatcggagtaaacttgagaagataattcaaggcatggctgctagtagccttagatgtattgcttttgcttgcatgaaaatttcagaagacattgattataacgataaggagaaagtgcatcaaatccttagaaaagatggcttgaccttgctaggtattgttggcctaaaggatccatgccgaccagacgtcaagaaggctgtggaaacttgtaaacttgcaggtgttagcatcaagatgatcactggagacaacattttcactgcaaaggccatagcaacagaatgcggaattttagaccttgatggccatgtgaatgcaggagaagtggttcaaggtgtggaattcaggaactacacagaggaagagagaatggagaaagtcgagaagatccgcgtgatggcaagatcgtcccctttggacaaacttttgatggtgcaatgcttgaaaaagaaaggtcatgttgttgcagtcacaggagatggcacaaatgatgcacctgctctaaaagaagctgatattggactctctatggggatccaaggaactgaagttgccaaggagagttctgacattgtgatcttagatgacaacttcaattctgttgccactgtcttaaggtgggggagatgtgtctataacaacatccagaaattcatccagtttcaactaaccgtgaatgttgcagcactagtgatcaattttattgcagcagtttcttcgggagacgttcccctaacaacagttcaactattatgggtaaatctcattatggatactctaggagcattggcactagctacagaaaggcctacaaaggagttaatggagaaaaggccagtgggtagaactgagcctcttattactagtattatgtggagaaaccttttagctcaagctttatatcagattgctgttctcttggttttacaattcaaaggaaagtcaatcttcaatgtaaatgggaaggtaaaggatactctaattttcaatacttttgttctctgccaagttttcaacgagttcaactctagaagtatggagaaacttaatgtgttccaaggcattcacaaaaaccacttatttcttggaattgtggggattactttggttcttcaagtattgatggtggaactcctaaggaagtttgctgatacggagagattgacatgggagcaatggggaatttgtattgtaattgcagctgtgtcgtggccaattgcttggattacaaagctcgtacctgtttcagatagaacgttcttcagccaccacgttaagtgggtaaaattatgggtcttcaagattaagcatttgttttaa

SEQ ID NO: 87784 - DNA, 273 bp, Glycine max
  Peptide Sequence Number=SeqID_204562
atggaattttggccagaatttcttgctagtagtacgggtaaagagtttgtggctggaggatttggaggcactgctggtataatctcaggttacccattagacacgctccgtgtgatgcaacaaagctccaacaatggctctgctgccttcaccatcctcagaaatttggtggccaaggaaggaccaactgctctgtaccgtggcatggctgcacctttggcctctgttacatttcagatgtacaattgtggaagccacctcaatggcagatag

SEQ ID NO: 87785 - DNA, 2502 bp, Glycine max
  Peptide Sequence Number=SeqID_204563
atggctttggtggagagggttcaagttcgaattcctctcctgttattattaacactaacaccaacggctgtagctgtaggctttcggtgttgggaaaggaccacgtgtccagcgttgcttggttacaagtcaccagtcccaaccaccataggggccattcagagactcttcaacgtcactggcgtcgcagacattctcgccgctaacaacctccctgagtggaccctaccaaacaatttcacggtggaggagaatcgccttttacggattcccttggagtgcgattgcagtgggcctgggttgtacggagagccctctaaccccctcgtttacactgtgcggaagggtgacaatatttcttatctagcaaccactgtgttctccggtttggtggcttcaacggatatccaacatgggaacaacgtgaccaatttaaggacgggacaagaactgcgagtgccactaccttgtagctgtgggaaggtcaacgggcttgacgttctccattttggattgacgctggaatacgggagcactaccttggaacagatagctcatgagtaccatgtctcttcacaaaccattacaacttccaaccaacctcatcttatgtttggtcgggctttggatattccactcccagtttgttcctcgatggtcagaaaagactctttggaccaccctttacttgttccaaatggttcttatgtctacaccgcaaatggctgtgtgaaatgctactgtgatgctaccaaaaattggaaattaacatgtgagccatccaagcttagaccaactaattggtctacttgcccatccatgaaatgtgacagttcaatttcaagcaacatgtatattggtgacaccacatattcaagttctcacaatcttgcaatttgtgcctacgctggttatggaactcaaactatcttcactactctaacagcagtgtatattcctcctgtcctagatgccattgtagacaaaggttattccgaattaataggggcaattacaacaagttgctactcgcattttgtccaaatcagaaactacaggctacgtcccttccatgttgctactccaattagtccaacggcttccagaaggagttggcactcaaaagtcggttgtaagctctgtgatatgagaataacatccaccgatggcttcgattactttccctctaataagccaaccctcactcttcaattacaacactcaaactcccaaacggcgtcgttaatgagaaggtgttatgtttgtgtttgtgagtggcatgccatgaagcactgccactgccactgggcctttcaagggcctcacctgaccatcaccaacaatgcacactgggcgaggcctggtgcagcggtaaagttgtgccttggtgacttgttggtcatgagttcgaatccggaaacagcctctttgcatatgcaaggcttgtttaccatgaatgtagaaagcagatggtgggcctggcttattgtgatagcaggagtttttgttgtacttatattcggctacttgtgctgcatcatctggagaaaatgcaaaatagaagctgacagaaaaaagaagcagaaggaactactattagaaattggagtcagttctgtggcttgcattgtgtatcacaaaacaaaaagacacagaaaacgtagcaaggtcaactatgaaatgcaaatatttagctttccaatcattgctgctgcaacaggcaacttttcagttgcaaacaagttagggcagggtggttttggaccagtttacaagggagtacttcctgatggacaagaaatagcaataaagagactttctagtagatcggggcaagggttggtggagtttaagaatgaggctgaactggtagcaaaattgcagcatactaatcttgtaaggctttcggggctctgcatacaaaatgaagaaaacatattaatctacgagtacttgcccaacaaaagtttagactttcatctctttgtaatattggattcagaagtagtagaagtgaaaacaaaaagagttgttggaacatatggttacatgtctcctgagtacgtcataaaaggcattatctcaacaaagactgatgtgtttagctatggagtcctagtgcttgagattgtaagtgggaagaaaaataattctcgctatcaggctgattaccccctcaaccttattggatttgcatggcaactatggaatgaaggtaaaggtgttgagttgatagattcatcaatgcttgaatcatgccggacagctgaagtattgcgatgcactcaggttgccctgttatgtgtacaggccaatgcagcagatagaccaagcatgttagaagtttattcaatgcttgcaaatgaaactctcttcctccctgtccctaaacagcctgcatattttactgacgcatgtgcaaatgaaaagaatgcattagtaggaaacggaaaatcttattctacaaatgaagtgacaatttcaatgatggatgcgagataa

SEQ ID NO: 87786 - DNA, 603 bp, Glycine max
  Peptide Sequence Number=SeqID_204564
atgcgattctcaaaagcttccttctacactcttcttctccgcaaacctcataaccatcaccatcaaaactacgtcgttttatcgcggcgtcgcgtagtgaccttgccagtgggtgtgttgatcttgctgagtgctctctacattttctggccatcgggtcctgatctgaagatcgtggggctgaaactgaggcgcataaaggtgcaccctgtgccgccaatcaccatagacatctccatgcttctcacgctgagggtgcacaacgttgacgtctacttcatggacttcggagcggttaacgtcgccgtcgcctacagggggaagatgctgggccacgtgacgtccaggcgcatgcacgtgagggccagggggtcttcctacgtggatgctgacgtggaatttgctggcatcagcgtgctaccggagcttgtgttgctgctggaggacgtggccagagagacgatatttagagacggacagtccgtcgctgtttcaatcgtctcaagatccgtctctgaattggttagttattatcagatacgtatttttgaggcgtatgacgaaacccgtcactgttttattcgtctcaagatccgtctctga

SEQ ID NO: 87787 - DNA, 2253 bp, Glycine max
  Peptide Sequence Number=SeqID_204565
atgggttgcaatcaatccaagatcgagaacgaggaagcggtggcgcgatgcaaggagcggaagcgcttcatgaaggactccgtgtcctcccgcaacgccttcgccgccgcccactcctcctacgccacctgcctcaagaacaccggcgccgcccttggcgacttcgcccatggcgaggtccaaaaccctcaattacactcaaacgacaacaacaccaccagcagcagctcctcctacgtgccggccccacagcccttcgagattcctctcccgccgccccctctccccgatttctcccccgcccaacctctccagcgtgccgccagcatgcccgagatcaagatcaacaatcccgactccaggcccaggcccgagcccgtcactactatcatcgaagaggacgacgaagaagacaaggagttagagaacgaagggtctttaaggaaaagaagaagcaacagagttaatagtaataatagaagggtgccagaagaagaacaacaacgacagcctcctcctccttcttccaaacaacctgatcacgtgacacatcaccaccaccactcctccatggcgccggacactcagagtggtgcttgggagtacttcttcccttccatggagaacattgccgggaccagcctcaatgcggccgaagaagatgctgtccataaggtgcacgaaattgagaggaaggtgtttgaggaaaagcccagcagggttgtccttgaggaagatgaggctgtcacgcctgtcaggaaggttcaggttcctgagcctgaacccgagcccaaaccccagcccgatccagagcccgagcctctgaatgtgccggaggaaatgatggagacgccggtgtcgatgaagatgaagcagacgccgagttctgtggatgggaagaggattgttgtgcaacgttctgtgaatctgctgcagatatttgctaaccttgatgatcattttctcaaggcttctgaggctgctcatgaggtttcaaagatgcttgaggccacgagattgcactatcactccaattttgcggataatagaggacacattgatcactctgcacgagtcatgcgagttattacatggaaccgatcctttaagggaatacctaatttggatgatgggaaggatgattttgactcggatgagcatgagacgcatgccaccatcttggacaagttgttagcatgggagaagaaactctacgatgaagttaaggctggtgaactaatgaaatttgagtaccaaagaaaagttgctgcacttaataagctgaagaaaaggggcacgcactctgaagcattggagaaagcaaaagcagttgtcagtcatttgcatacaagatacattgtagatatgcaatccttggattcaacagtctccgagattaaccgattacgtgatgaacagttgtatccaagacttattcagcttgttgatgggatggccactatgtggaaaaccatgctagagcaccatgtgaagcaatcagatactgtgacatcgctaagaaatttagatatttcccagtctcctaagacaactagtgaacaccattatgaccgaacataccagctagttcttgttgtgcaacagtggcattcacactttgagaagcttgtcaaccatcaaaagggatacataaaggcgctaaacacttggttaaaattaaacatcatccctattgaaagcaatttaaaggaaaaggtttcttcgcctccaagagttagaagtccacccatacaaggccttctcaatgcatggaatgaccgtcttgataaacttcctgatgagcttgctaggactgctataggaaactttgttaatgtgatagagactatttaccatcagcaagaagaagaaatagctttgaagaggaaatgtgaggatacacgaaaggagctatcccgcaaaaccaggcaatttgaagattggtataacaagtatatgcaaaagaaaataccagatgaatacaatccagacagggcagaagatgctaatgctcctgatgaagttgttacagagaggcagtttgcagttgaactagtgaagaagagattggaagatgaggaagaagcctatgcaaggcaatgcctccaactaggtgctgtaatcgttcatgtaagtgggtcttgtagcattcctcttgggcctcccttcgtgggtttccttgctgccatttctagtgctggtttcctcactgccattactagtgctggtgttgcttacacaaagataacatag

SEQ ID NO: 87788 - DNA, 334 bp, Glycine max
  Peptide Sequence Number=SeqID_204566
atggttctcccgttaaataaatcgttttcacccactcatgtgaatgcagcagggcgttacaccgttgtgccaacccttcggatggaaaaatgtgctatgatcaattggtgcgctcttgattcattatcaggagatgcacgtgcagcacgtcatgctattgttaagcatggcatcagatgtggcagtaaagtagaagttgcaacaccctgtgctattgctttgaatttggtaatctcaaatttgagtgctacaagtgagaaggcagttatggaagcattgaaagaaacagagacttccatgcgtattgttggaaatagaaaagattttgctgaag

SEQ ID NO: 87789 - DNA, 1620 bp, Glycine max
  Peptide Sequence Number=SeqID_204567
atgccagcctccaatgcatatgatgccaactccctgtatcaacctggtgggggtagaagctttgatgactctgaaccttacatgctgagcaaacagactggcagagctcgtgctcctgaaaacatattgaaaagtttccctgcagacaaagagaaaactaattctgtagcaaagattaaagttgtggttgacctaactcagtatgtagaaaagcatgaatttgtctttgatgctgttttaaatgaagaggttacgaatgatgaggtgtatcgtgaaacagtagagcccatagttccaataatatttgaacgcactaaggcaacttgctttgcatacgggcaaacaggaagtggaaaaacttacacaatgaagccactgccacttaaagcatcaagggacatccttagattgatgcatcatacttacaggaaccagggatttcaattgtttgtgagtttctttgaaatatatggtggcaagctctttgatcttcttaatgatcgaaaaaaactttgcatgagggaggatggtaagcagcaagtttgcattgtgggtttgcaagagtaccgagtatcagatgtggagaacatcaaagacctgattgagaaaggaaattccacaagaagtacaggcaccacgggtgcaaatgaggaatcatcacggtcacatgcaatacttcagcttgctatcaagaggtcagttgatggcaatgaatccaaacctccccgtttggttggcaagctctccttcatagatcttgctggaagtgaacgtggagcagataccactgataatgacaaacagacaagaatagaaggtgctgaaatcaataagagcttacttgccctaaaggaatgcattagagctcttgacaatgaccaaggacacatccctttcagaggcagtaaactgactgaagttttgagggattcatttgttggcaactcccgcaccgttatgatatcatgcatatcaccaagcactggttcatgcgaacatactctgaatacattaagatatgctgacagggtaaaaagcctatcaaaagggaacaattcaaagaaggatgttttatcatcaaatttcaaccttaaagaatcaagtacagttcccttatcttccgttactgggtctgcctatgaggatcgcacgacagatggatggcctgatgaaaatgaatgggatgattttagcccatctgaagagtattacgagcaggtgaaaccaccattgaagaaaaatggaaagatggagttatatgctacgacagatgacaaattgaagaaacccagtggtcagatcaaatggaaggacctcccaaaatttgaacctcaaaccacacatgcagaggatgatttaaatgcccttttacaggaagaagaggaccttgtaaatgctcaccggacacaagtagaggagaccatgaacattgttagagaggagatgaacctcttggttgaagcagatcaaccagggaatcagctggatgattacataacaagactaaatgccattctttctcagaaggctgctggcatcctgcagttgcaaacccgtttggctcattttcagaaacgtttaaaggaacataatgttttggtttcatctaccggttactga

SEQ ID NO: 87790 - DNA, 354 bp, Glycine max
  Peptide Sequence Number=SeqID_204568
atggcgaaagcacctaatcgctacccttcaccactcactcgcatcttagtactcatcctagtgaatgagacacaaaatgacagagagattagagagaatgagacacatagattggcattttgcttaattgtgaatacaagtctgattgaagttacaaccatttttcatcatccgcgcgccatggttggaatgccggttttatggcttgttatggacgaattggatcgggactggatggcttcacagggccccgtggaagagactgcaacaaaagcccattgtattctctcaaccactcatcttcttgtaatgctctgcaagctccaaattgaggaaaagctaccaaaatggtga

SEQ ID NO: 87791 - DNA, 1425 bp, Glycine max
  Peptide Sequence Number=SeqID_204569
atgatgacaaaggtgatgacagaaaagttcaaagatcaatcaaagaacaactcaagtaaatcaaagatcaatcaaagaacaactcaagtaaatcaagaagaattcaagactcaagaagaaagtttagagtcaagaatcaagattcaaggttcaagatctcaagaatcaagtttcaaggttcaagatctcaagaatcaagatcaagattcaagactcaagagaaggcttaatcaagataaagggtacatctacttgggtttgattgagaacaagagagggtacatctcttgtggatcagttctagtggagggtacatccactaggttcaaagagaacaagggagggtacatcccttgtggatctttgcttgtaaaaggatttttacaaggccactcgatccaacatcaagcccctaagcatggacaagtgttgtctggtgtcgagtgcggtaacctcgacaactgtgaaagttgcaagtgtctgaagcttttcaggcccccgagcttggacaagtgttgtctagactgctttcgtcatgttgttcgaggtaggcatgtttttgggtttgcaaatgaggatacttgtcgtggtgccttcgacagtgaatcctcttcctcgaagagtttgagagcttctcgtcgtactggtggaggcatttctcacctctgcgagagggcacaaccttctgctacttccccgaccaaggagcctatcctgatcacgatggttctccccccttctgcctctagggagcaaggagaagcagtggagacgttagggtgtcaccctgcgtgcggtgtagccatagcgctaggaattatgggtgacatcccttggaggccaccatctaatgtgccctctattgttggagaagggggtcaacctgttggtgagactagccctgttgttgttgttgttgttgttgctaagaggaagcaagatgactatgctgaggtgttgagccccaagaagtcaagggcccttatgagccttcatgcactgaggcaagctgtagggttgacgcctggttcgactcacccttcaattttacaagatctgccttcggccgttgaggctcctactcctgctatttttgttattgctactcctgctcctccacctcctcttgtcgtacctattcgggaggttacttctaccaatgaagttggtgcgctaactattttggatggttatgttacggcatcttcgcccaccgctgccacacccttgctaagtgttggtgtggccaccactattgcttctatgataccaccttctccttcttcggctcactcggttccaccctctgttgcgttggcggcgaagtcaccttccccgtcttctcctccccatgtctctttggatcacttgtacacttccactaatgttgattcactgtggggtgcaaattacaagccaaagtag

SEQ ID NO: 87792 - DNA, 3210 bp, Glycine max
  Peptide Sequence Number=SeqID_204570
atgaatgtcaagctaggtaatggatttcaaatctccacacaaggggtgtgtagagggttggagatgtgtattggagacttgaaaatgaatccggaaatgcacttgtttgagttgggaggtattgatgtggttttgggcattgattggcttaagactttaggagacactatcaccaattggaaacaacaaaccatgagcttttggaaggacaaatcatgggttactctcaagggacacgaggggtgcaggagacaaactgtggcgttacaaagtattttaaataggcccaaacccacttctcaaggcctgctatgggaaatggacaatgtaaaacacaaagggaaaggggtaaatgaattatccatacaacagcaagcagagatggaggtgttgttgaataagtttgagcacgtgttccgaacaccgaccggtttgcccccaaagcgaaacagagaccacgctatcaccctcactgacggacatggaccggtgaatgttcgtccctacagataccctcatcatcacaaaaatgagatagagaagcaagtcaaggagatgttagcggcagggataattcgtcacagtaccagctcgttttccagccccgttattcttgtcaaaaagaaagatggtacatggaggatgtgtatagattatcgggcattgaacaaggctaccattccggataagttcccaattccggtgattgaagaattgttggatgagcttcacggagccaggtatttctccaaactagatctgaaatcagggtatcaccaagtgagagttaaagactcagatgtgggaaaaacagctttcagaactcatgaaggccactatgagtttcttgtaatgccgtttgggcttaccaatgcgccggccacgtttcaaggtctgatgaacgatatcttccgtcccttattgagaaagaatgttctggtgttttttgacgacattctagtttacagcaaggactgggagacacatttgcatcacttagaggaagtgttaaggttgttagcagctcacagtttggttgctaaccagaagaagtgttattttgggcaaagaagtattgagtatttcgggcatatgattacggaagaaggagtagcagtggattccaggaaggtggacagcctcaccggttattatcgtaagttcattcgtgattatggaaaaatagccaaacctctcactgaacttaccaagaaggacggattcaaatggggggtggaagctcaaaaagcttttgatgaattgaagaagagactcaccaccgcgccagttttgaccttgcccaatttttctaaagaattcgtaattgaatgtgatgcttcagggagtggaataggcgcgatattgatgcaggacaaaaaacccatagcatacttcagtaaagcgctgggggttagaaatctaaccaagtcagcttacaagatagaattgatggctgtagttttggcaattcaacattggcgtccttacttgcttgggaggaagttcgtggtttccaccgaccagaaatctctcaaacaattattgcagcagagaatagtcaccaaagaacaacaaaattggacggccaaattgctgggttatgatttcgaaattgtgtataagcagggaaggctaaacaagggtgctgatgccttgtctagaatacatgaaacaggggaattgcaggttttacactcccaaattaagtggctgcaggaagatcaaatcaaggcagaaaatgataaagacgaaaggttgcggaagattatgtctgaagtgcaacaaaacccagataagtggcccggttatgagtatcgacacggggtgttgttatatgaaggaaggttagttttatccgctcattcaatagtgattcctacacttctagaagagttccattccacaccacaagggggacattccggattctacaaaacctatagaagattggctgccaatgtttattggattggtatgaaaaatcatgtgcaggagtttgtgagacggtgtgacacttgccaacgacagaaatacatggcaacctcacccgggggcttactacaacccctacctgtacccaaccaaatttgggaagatatatccatggatttcatcaccggattaccaaaatctaagggatacgaagctgtctttgtagtggtcaatcgtttgtccaagtatgtgcacttcattcccctcaagcacccgtacacagcaaggagtattgcagaggtcttttgtaaggaagtagtgagattacacggcatgcccttatcaatagtcagtgacagggacccgattttcattagtagtttttggaaagaaattttcaaactacagggcaccaaattgagaatgagtacggcgtatcacccggaaacggatggacaaacggaagtggccgaatattggtttaacactactttccatagcgcaaccgaaaagaccccctttgagatagtctatggaagaccacccccatcattgtacaggtgggtgcaaggggaaactagagtggaagctgtacaaagagacctggtggatagagatgaggctctcagacagctaaggaaccaattgttgagggcgcaagagaaaatgaaagctcaagctgacaagagaagaagtgaccagagtttcgtatgtagtgaatgggtgtttgtcaagttgagagcacaccgtcagcagtccgtagttactcgtatcaatgcaaagttggctgcaaggtattatggcccctatcctattgttgaaaaaatcgggcctgtggcatataagctgaagctaccaaaaggatcaagagtacaccccgttttccacgtctcgctgctcaaaaaagctgtgggtacctatcaagatgatgctgagcttcctgaactgatagaagagcccatagaagtttacagtccggaggccgtattagccacacgaaaggtgaaacatcagaatgaggaggtccgacaagtcttgattcattggaaaggaaggactgcagaagaagcaatgtgggaagatgaaattatgattagaagtcagtttcccagctttgaccttgaggacaaggtcaatattgaaggagggggtgttgataggatccacgtggcagcagaagataggacaccagaacaattaattcatcacaccacaggtggtcccaggatcttatatgtctattctagaaggaagggcacaaagggaattagtggctga

SEQ ID NO: 87793 - DNA, 207 bp, Glycine max
  Peptide Sequence Number=SeqID_204571
atggatgaacaagagagagttgacaagagatcgcaggggtggacttggccaaagtggactccaggactttacacgttcggtttgaggatggcctttattgagaggacaagaggggagacttgtaaaacaaataactctaacgctcagtgtgtgaatgatcgtgcagagggtttgatggaacttgatatttataggaatggagcgtag

SEQ ID NO: 87794 - DNA, 504 bp, Glycine max
  Peptide Sequence Number=SeqID_204572
atggcttgtgaggtccttattgagccgcgtgcactgcttcggtttaggtctgagttgcagcttgacaagttctttgatgaccctttgtccatgctcatgactcgagtgcctttagtcattgttagggtagggaatttcattttcaaatggggcgtggagactatggcttcaagctcgttaagtgtgctcctacgggttaaagcaaaagagcttgccttgactgaaggtggtcatcaagtccatgtagcctctagtctctactatctcgcctgcaaatccgaggagtggaccggcgtgagggtggacagtgttgggggagactttgagtctttgaaaagtcttccaatgctggatatcagtggaattttcctagtcgataagaaccctgggcaccatgaagtttgcaatgatgatggagacaacaacgaggtcatcatggttgacagggttggtacccttgaagttcctattcataaaggtgataggaaagagactcagttctag

SEQ ID NO: 87795 - DNA, 420 bp, Glycine max
  Peptide Sequence Number=SeqID_204573
atgccgagaatttatcccagcataatctaccacaaacttgctatttgtctccaggccaaaccaatatcacagaagaaaaggaagatgagagaagaacgacgtaaagccatcaaagaagaagtcgacaaactccttaatgaaagcttcataagagaagttagggcgtgccccaaagacgcattccctctgcccagcatcgacaagctagtcaatggagggtctgggttccaagtgctaagcttcttagacacttactccggatttgaccagatcaggatgcatcctccaaacgaggagaaaatgaaatttatcattgaagatgacaacttttgctatagggtcatgccttttggcctaaaaactacaggcgctacataccaacgactaatggaccgagtctttgaacaacagatcggatga

SEQ ID NO: 87796 - DNA, 867 bp, Glycine max
  Peptide Sequence Number=SeqID_204574
atgggactcaccaagggcaaaccatggtttaacgagcctggtgtatgcagagcacgtgtcatgctcttgcatacatgtcattcatggactagcatgagagatggtggcgagctcttgcatacgtgtcactcgtggagtggtatgtactgcagacgtggtggcattgtagaagctaagcttcatgatgaatcaagattgattcaaagatgttttgatgataacaaagatgatgacaaagatgttcaagatagaatcaagaacacttcaagattcaagaggaaagttgaagaacacttcaagactcaagaggaaaagttgaagaacacttcaagattcaagaggaaagttgaattcaagaatcaagattcaaggatcaagcttcaagaatcaagatcaagattcaagactcaagattcaagaatcaagagaaggcttaatcaagataagtatgaaaagagggtacatctacttgggttgttgactgagaacaagagagggtacatctcttgtggatcagttctagtggagggtacatccgctaggttcaaagagaacaagggagggtacatcccttgtggatctttgcttagacgtggtgggagtttggagcatctcctagatgatattcttaaggtgtccgaccttcttggtgctggccagcttggagagcaggataactctagtgttgctttccctggggatatagtacattttgaaacatttgaaattgttaatgagagtcttcgcgatgtgatagtacttgagcagcactgtttccttggtctggtatatgttggcaacctgtccatggacaagttgggagtctatgtagcatcgcaacttcttagctctaacttctcttactag

SEQ ID NO: 87797 - DNA, 192 bp, Glycine max
  Peptide Sequence Number=SeqID_204575
atggatggcgcttctgcacctgctcctacaattgcattgcttgtttcagctggagcaagtcgagcagctaaggttgaccaacaacaatacacacggtgtggcaaagggaatactgcaggatatgatgatggaggtgtgaggaaagaaagcaatggattatggatatatgatgatgatgatgttctactataa

SEQ ID NO: 87798 - DNA, 690 bp, Glycine max
  Peptide Sequence Number=SeqID_204576
atgggaatcacaccatcgatgcatagtcaatactgcaaatggcttaagtctctcccatatgcattgtccaacagggcagactacgtgtcaacatcctttgtcgaccctattatggagatagacataccattggggtggaaatcgcttaacctcgagcggtacgatgggacaatagatccagacaagcatctagatgccttccagactcaggcgaacctctacactaataacgatgtgattctatgttgtgtctttccatcgtcccttaagggggcgacattgacctggcacggtggacttccacctaggtcgataaacaactttgacaccctcatcgaacgattcagtgtttatttgcgaacagtctatgcaaactcccccccggtagcatggatgagttgtgtgaacgagctagaggctacatctagatggaagaaatgtccaaattcaggaatggagcctaacaagcccgacagaagcacgacaagtgagaaactaagactgacttacataagttgggcaagaggcacaagccagacaagcgccatcctctccccaacgggcccagaagctttcaacttggaggtacccattaggctacccctgatgaaaccttctaggccagggtcagacacaaccaaatactgcagatatcgtcgcgatatttgtcataacatagaagactgctag

SEQ ID NO: 87799 - DNA, 453 bp, Glycine max
  Peptide Sequence Number=SeqID_204577
atggctttcaagaagaccatagtcataccgccaattttgagtcaacacaggccaagggtacccctacttctatatctctcagtagctgacaaagttgttagctcagcccttgtacaagaggaagggaagcaccaactccctatctatttcactagccgtatacttcatgatgccgagaagtcctaccaaatgatagaaaagcctgtagaactttcagagtttgacatccaatacgaatcacccggccctatgaagacacaactcatggctgactttatggcaaaattcgttggaaacgacatagccaacctagattggtggaccttttactttgacggtgtctccaacgtgaaaggaagcggggcagggatcatccttgaaggtcacgacaatatcactctagaacaagccctcaagcttaacctcagagcctcaaacaaccaagtagagtaa

SEQ ID NO: 87800 - DNA, 552 bp, Glycine max
  Peptide Sequence Number=SeqID_204578
atgaacctatattggaaatcaggaattaaagagaggcttttagatttaggcgttgaggtcggcccagttttaccacttggcgatcatggaagttcacaagtttcagggggaagccaactatcatcaaaggatgcatttctctcgaaagctgaagtcaaaactgattccgagaacaatggcatttctgaggatgttgtttgtgttacgttgggcactattagcaaaatagtcatggataatcattcatggtgttatccagcttgcattcaatgtcataggaaaattgacatccaaacaggaccattcacatgcggatgtggcaaggataatgatcagcctgttctgagcatgtacattgctaggtatagagttgaagtaatggatggtgatcttgatttgaatgtttcccctcaagcacttgataggctgttaggttatgtgcttgcttttaaggtcaggattcaatcaaaattcaagaatgtcgttgttcttagatactcaaatgaactagatttgatcaatgttgtgctcgagatgttggctgatagtgag

SEQ ID NO: 87801 - DNA, 309 bp, Glycine max
  Peptide Sequence Number=SeqID_204579
atgacacctcacttaggaaatagccctaagcgtgtctacacgacacctcacttaggaaaccatgcagtatttgtcgaggccacccagtcgtgcaccgtaactcccccacccctaggtgatcaacctagggccacaaggagtttcctaccaggtgacacaccccctagtacaaggtacatactgccacagtttatactatttcccatgtcatatgagggacgtccgacaaggtcaatgaaccctcccatggacatacacaacatacgatgtatgaacgtgggcaccatcaagtacaatgaccatggatga

SEQ ID NO: 87802 - DNA, 201 bp, Glycine max
  Peptide Sequence Number=SeqID_204580
atgtgtgttcagcaagaagaaaggcttttaatggagatgggtgaaagtgcattactgacaactacttatgggaaggacaaagcaactgagtccaagctaatcaaatgtggaatagtaaaaataccacctcaagcttatattaagaaggtggcaaagtgtttattctggtatgcaaaacctaaggaaaccagtgggaagtga

SEQ ID NO: 87803 - DNA, 222 bp, Glycine max
  Peptide Sequence Number=SeqID_204581
atgaacatcgcggagttgagagaagcactagagtctatcatatcagaacaaaagtacttgaaagcacgtgatgctagacatcgacacacaagcgaaagcaccagaaagcgtgttgtcttctacacaatcttggagtatgttttgttcgctgctacaagtttattacaagtggtatacattcgacgtctattcagcaaatcatttgcttacaaccgagtgtag

SEQ ID NO: 87804 - DNA, 318 bp, Glycine max
  Peptide Sequence Number=SeqID_204582
atgtcctttgttggatttgactcttcatctaaggacactaagaccactctgatgtctccccgcttggtgttgcctgagtcttgggaaccaccccgggtggacttggtggatctcatgtcagagggcgagagagaggatctagaggaggacacatcttacgaggaggatccctctatggatgaggaggacccagtcacagagcgagaggtttcactgagacttacatgttttgctaactctttatggcacacgatacttatctatttatatttggtgactaggggtggaaatgagtcaagtcaagccaagctttactag

SEQ ID NO: 87805 - DNA, 156 bp, Glycine max
  Peptide Sequence Number=SeqID_204583
atggagtgcacatcatcatgctcccaccgtgtcttgatgacactaatgtatagaatgagggagtcaacgttgggctcatcatctggtcctaaaaatggacatggcattctcatcaaccatggatacaacttcactctagtcaggaatgccaagtga

SEQ ID NO: 87806 - DNA, 111 bp, Glycine max
  Peptide Sequence Number=SeqID_204584
atgaagctatcagttgttgatggtcatctttgtaacatgggaaggatgattgaagaaatggagagtaagctgaggaactcactagatcaggttatcgtgagcaaggaatag

SEQ ID NO: 87807 - DNA, 2217 bp, Glycine max
  Peptide Sequence Number=SeqID_204585
atgaggagtttcttccctgctgaatcctgtaaagaggctcacccaaatgctttgaatcctcagtcatggcttcaaattgaaagagggaaacttcccaagttgtcatcatcatcacacccctcatctgcctcaattgaatctctgatcaaggtcccacagccagctatactgcctttctttaagcctgttgattatgtggaggttttagctcaaatccatgaagaacttgagtcttgtcctccgcaggagaggtcaaacttgtttttgttgcaataccaggtcttcaggggccttggggaagttaaactgatgcgtagaagcctccagggagcatggcagagagcccacactgttcatgagaagattatatttggggcatggttgaaatatgagaagcaagaggaagagctaatagctgacttgcttgcagcttgtggtaaatgtgcgaaggagtttgcgcctgtagatatagcgtctcttcttccatttgatgtaaatgcaggttccgaggggagaacgaccaatgagaactgcatttctcaaaatgttacttttacgattggaagtgaaaagataatttgtgagagacaaaaaatttcggaactttcggcaccatttcgtgcaatgctcaaggggcatttcagtgaatcactctccgagactatagatttgtctgaaaataatatctccccctcaggtatgaaggcaataagtgatttcagtttgaatggcagtttaattgaggtccttccaaatcttttgttggagatattagttttcgcaaacaagtattgttgtgaaagacttaaagatgcttgcgatagaagacttgcatccttagtttcctccaaagaagatgctgtggagctcatggaatatgctcttgatgagcattcaactgtccttgctgcatcttgtttacaagtccttttgcgtgatcttccaaactgtttgaatgacaatcgggtggtggagatatttgttcatgctaataagcagcagctagcagtcatggttgggccagacacaacagctcatatcctggaacggttagttgagtttgctgagaatgaccagcagagactactcgctttacatcaattgggatgtgtaagactcttaaggaaagagtatgatgaagcacgttgtctttttgaaggggctgtaaatgcaggccatatatattctgtggcaggtttagctagactggactatataaagggtgacaagcttttatcttatgggcagctcaactcagtcatttcatctgttactccacttggatggatgtatcaggaaagatcactatactgtgacggtgacaaaaggtgggaggaccttgagaaagcaagtaatctggatcctactcttatatatccttacacgtacagggctgcctctttaatgagaactcagaatgctcaagctgcactagcagaaatcaatcggattcttgggttcaaactttcaccagaatgtttggaagtacgattttttatccacctttctcttgaggactacaaagcagctctatgtgatgttcaaacaattcttactttgcgttcagattatagaatgtttgaggggcgtgttgctgcatcccaactctgtactcttgtgcgtgagcatgttgagcgttggacaactgcagattgttgggcacggttatatgattgttggtctgcagttgatgatattggatctctatctgttatctaccagatgcttgaatctgatgcagcaaaaggtattctatacttcagacagtcattgcttctcctaaggttgaactgtcctgaggctgctatgcggagtttacagttagctcggcaacatgcatcaagtgagcatgaacgtcttgtatatgaggggtggatcttatatgatacaggtcattatgaggaagggctctggaaagctgaagagtctatcaatatcaaaagatcttttgaggcctttttcctgaaggcctatgcattggctgactctagtatagatccatcatgttcaccaactgttatttcacttctggaagatgccttgaagtgtccttcagataatctgcgcaaaggtcagctaacagctgcccttattctgtcctctttatacatcctaacaatgcttccttttcatccgaattcacattttttgccaaaagacttccaatggacttggctatcaactgaaagtctgaaacccactttggctatctattag

SEQ ID NO: 87808 - DNA, 180 bp, Glycine max
  Peptide Sequence Number=SeqID_204586
atgagagacccgagacaagcattggagagagatgccgccgtaaatgcccagaggcctatgccggagagcacgctgctgcaaatgtatggccacatgaagaatgatttaggcattagttttaggattccagttttaggagttagagagagagagagtgtgagattaagcgttaagtgttaa

SEQ ID NO: 87809 - DNA, 550 bp, Glycine max
  Peptide Sequence Number=SeqID_204587
atgggtgaagatacttttcagtatttgcgctgctgcaatgccactccatatcttccatgcaatatgttccccactgctatttcctattcaacttctttgtctgaggatgccagtgtttcttctggtacaaaagttcaggacttgggaggactcaatcatggggtctcaagcatttctcctcagcaacagcctcaaaagatcaagaaaaagaggagcctccctggaaatccagacccagatgctgaagtgatagccttatctccgaagacccttatggccacaaacagatttgtttgtgagatctgtcacaagggtttcccgagagatcagaacctgcagctacataagaggggccacaacctcccttggaagctgaagcaaaggagcagcaaagaggaatcaagaaacacttctgcagaaagcatggagagaagaagtggaaatgtgaaaagtgctcaaagatatacgcggttcagtcagattggaaagctcactcaaaaacctgtggtactagagaatatagatgtgattgtggaacacttttttccag

SEQ ID NO: 87810 - DNA, 1335 bp, Glycine max
  Peptide Sequence Number=SeqID_204588
atgaactacttgtatcctgtgaaagaagagtacttggaatggccaccaccgtcgtcgtcgccgccaacaacgggaggagttgatgagtcagcaatggttcctcctcctcggccaatgggggggcttcacgaaatagggccacccccatttctgaccaagacttacgatgcagtggaggatcccaccactagccacatggtttcatggaacagaggaggtgccagctttgttgtttgggatccacacgctttctccagagaccttcttcctagatacttcaagcacaacaatttctcaagctttgttagacaactaaacacttactggaatacctatagtttcactgttctatggttttatattttctttactcctagtcacggacttctagatttctctttttctcctatcccatctgttcctgctgtggccggtggtacagtttggcttcacgctcaaccactttgtccatttcctatcataattatagcaattatgggttttagaaaaattgatccagataggtgggagtttgcaaatgaaggattccttagagggcacaggcacctgttggcaaacataaggagaaggaaacaaccttcttctcagccttcttcttcttcttcttcatcctcttattattattattcttcttcttctcaacaagcacaacaaggtcactgtgttgaagttggtcgctttggacttgatgaagagattgatcgtttgaggcgtgacaagcacgtgttgatgatggagcttgtgaagctgagacagcagcaacagaacacaaggtcataccttcaagcaatggaggagaggctaagagggacggaaattaagcagcaacaaatgatggctttcttggctagagctttgaaaaatccaacctttattcagcagctacttcagcagaaggagaagaggaaggagcttgaagaggccatgtccaagaagaggagaaggccaattgagagagggccaaaccatggggttgttggagaagaatcaagcagtgttaaggttgagtctcttgtgtttggtgatgaatatggttttggagtgtcagagttggaagtgttagctatggagatgcaaggttatggtaagggaaggagggaacaagaggaggagcctgatgaggcactagatcaatcacaagagaggctggagaaagagcttgatgaagggttctgggaagaacttttcagtgagggttttgagggtgaattggatactaatccaactaattcccaagaccaagatgaagaagaagaagatcatgtcaatgtgttggccaatcgctttggttacttgggttcaagtcctaaatga

SEQ ID NO: 87811 - DNA, 450 bp, Glycine max
  Peptide Sequence Number=SeqID_204589
atgaatagcactatgataaaacttccttcgagctctgtagggccaaagcacctgagaagaccaaggagattgacgctgatgtgcaaaagcagattatcaattgatccaaattccaaggataagggaagtaccgtcagatccatattcgggagagaaggaaactacagtactcttgttgaggagaagaatggagaattccatgcagtcaatgaaaagcaagaaactaaaccagaacccagcagtggccatagtagagttctgtgctcagagaagtcatggaaattgctgaagaagcaaggaatcgatcttgagagtgaacacatgaacgaacaaaggaatgcaatgcagcatgtgagtgatgtgactaagagggaggatgagaactcaaatggtagcggttttgagtgtgatggtgccctgttgcaattcttggagccagaacagaagtaa

SEQ ID NO: 87812 - DNA, 1128 bp, Glycine max
  Peptide Sequence Number=SeqID_204590
gaagtgtctccattaacttctggaagattatctcacagcagcgagcctttgaatggtggtggttccttaaccggaacagatagccctccgatttcaccttcagatgaattcgacgatgttgttaagttttttcgggcaaacaattccattcaccctttattcaatggtggaagaaccagtgcaaccattggcaatggcacggcttgctcaggacctaaaactgttggaagatggttgaaggagcgaagagaaaagaagaaagaagaaaacagaacccacaatgctcagctgcatgccactatttcagtggcagcagtggctgctgctgtagcagccattgcggccgcaacagcagctggctcatctgcaccaagcaaggatgagaagatggcaaagactgacatggctgttgcttctgcagcaacattggttgctgcacagtgtgtagaggctgctgaagcaatgggggctgagcgtgaccaccttgcttcagtggttagctctgctgtgaatgttcgttctcctgatgatatcactactcttactgctgcagctgccacagctctaagaggggcagcaaccttgaaagcaagagctttgaaggaggtatggaatattgctacagtgacaccactagagagaggcataggggggattggactatgtggtaaaagtattaacagcaataccagcaataccagcactagtgacagtggggaaattttcaatggagaaaattttctagggtcctgcagccaagagctacttgctaagggcagtgaattactcaagcgcacccgtaaaggtgatcttcactggaaaatagtgtctgtttatatacatagaactggccaggtaatgctgaaaatgaagagcagacatgttgcaggaaccattaccaaaaagaaaaagaatgttgtgctagatatatgcacggatttaccagcatggccaggaagacatcttcttggcgatggtgagaagcgacggtactttggattgaagacagacgcaagggggattgtggagtttgagtgtcgaaatcaaagagaatatgacctctggacacaaggggtttcaaggcttctttccgttgttgcacaaagacaaaacagatatggaaattga

SEQ ID NO: 87813 - DNA, 111 bp, Glycine max
  Peptide Sequence Number=SeqID_204591
gctgagagactcgaaggtgagagagtcggatatgactcctctggccacgcacaaggcggtgatgagggctgggaagccgagtcgagaggagttggactaggccatctgtga

SEQ ID NO: 87814 - DNA, 162 bp, Glycine max
  Peptide Sequence Number=SeqID_204592
atgggcatacacttgattccttctctctctttggcttctctgtgctgtggttttcggtcaacattccctactgctacatatttggttgtcaggagatatatgtcgggcaaggtaagtctggccaaaaatagcacacctgctaagtggtgtgggggtttgtaa

SEQ ID NO: 87815 - DNA, 357 bp, Glycine max
  Peptide Sequence Number=SeqID_204593
aaattccactggaagttggatgacagaaattcttcctcaaattgtgaatcacgcagacatccaaaccatccaagcatcacctcccctaaacaccaattcgcaagattcattgacttggaagttcagcagcactggagtatacacactaagaaaattcgtggcatgtgttttttggttgtcaacaagttcaacgattctggcttgcctcagatctcgcaagacatcaacaacgctacaaccttgactgatacagtgttcaaattgctgcaaaatctctccaccgaattggcatcaagtttgctatgctactttggtgtatctggcgacgtagaaacgacaagatctggaatcatatag

SEQ ID NO: 87816 - DNA, 255 bp, Glycine max
  Peptide Sequence Number=SeqID_204594
atgtttgatactttgcacctaagtaacgtgggaaatgcttttcaatggaaatggccccgacgaagcttgcctcaaagagatccaggaaggataaagcggctgaaggaaccagttccactcctgaatatgacagccaccgttataggagcgctgagcaccagcagcgctttgaggccatcaagggatggtcatttctccgggagcgacgcgtccagctcagggacgacgagtataccgacttccaggaggaggtag

SEQ ID NO: 87817 - DNA, 441 bp, Glycine max
  Peptide Sequence Number=SeqID_204595
atgaagcttgcttctacagctttgtgtatacctgatcgaggagctagaggggttgtctctgacaaccttaccttcgagcgcctgagcccgatcattaacctggcctacatcaagaagaactgttggaatcctgaggatctaacagtctctatccgaggggctaggagagcaagggcaaggccaattgaggctccttccacatctgcagctcctcctccagcacataccttagtagctccttctaccctatcttctacagactttcaacatcttgaagccatgcttcaaagcatacatcaggggcagattgttttattacaaagtttacagctggtagcacctccagactctatcccttctgttgaacaatttaatgaatgggtagcctggcctgagactcagcctccccttcacagggaggatgaaggtctcaccgctcag

SEQ ID NO: 87818 - DNA, 261 bp, Glycine max
  Peptide Sequence Number=SeqID_204596
atgacatcgtctcaagcaacctatcggtccagtctgagtactagtgactcttggctctctctttctcccaataagtccatagagttgcaattgcgagtgcaggaggaggagcgtggaatgcgccaagaaggtgtgggtgtgggtgtggactttgcggcgaaggtgagtggtggagtgatggtgataggagtgagtgagagtggggttcgtggtgttcggtgggggttgttggagatgaatgtttggtttggaatggggtga

SEQ ID NO: 87819 - DNA, 1278 bp, Glycine max
  Peptide Sequence Number=SeqID_204597
atggtggtgattcaagcaaatccagagttggatactggaaatcagtatggtgtcatgagggagtcaggggtgacgggtatgaagggttttgctggtctggtaaacgacattattcgtgaatatgacctcaaggctttgctgggggcatctggtgtttatggaactcatctttgtggaaggcttgcagcaaatatggatatcccctggtgctcattgggggattttaatgcagttcttagagattttgagaggaatggtgggtcctctacaacctctatgagaggagaccatgctttccagaactgtgttcttgattgtaacctcctggatattgggtaccaaggtgcacccttttcttggagacgtgggaatacatttgagcgactagatcgtgcactagccttcttccattgtccgattctgattagatttcagcctggaattagacctatcagcttctgtaatgtgtcttacaaggtgattcctgaggtcttggctcaacgtttgaaggttgtgatggagacactggtgatccgaactcaatgtagttttgtttcgcatagacatagcagtgataatataatcgtcacaaaagaagttattcattctatgaggcacaaaaaggaaaataaggggtggatggctataaaaatagacttggaaaaggcctacgataggttgagttgggagtttgtgagagagattcttcaagatattgggtttccagaaagttttgtgagtttggtgcaggtgtatatctcaaccacgactatgaggatgatatggaatagggattgtcttgaggaattcaaaccttccggagggcttctaacattctctaaatctgtgttggaggttttgtcatctaataccatgcaaacgacattcctgcccaagtatatatgtgaggagatagacataaagtgtagagagttctccatattttatgcacattggttggatgagggaccaatttatgaggagataccttatgtgcacatttatgatactcaactgcatgtaaaagatgttcttgttaatgaggatactcttgtttggggaccgtctaattctggtacctacactactaagtctgcctatgagtggttactgcctgagccgatcaatcatttaactttcacagggagttggacatgggtttggaaacagaaactacctgagaaaataaagtgtggcttggaagaggagaacatcacttatctccttcgtgactgttttcgaaatacaagtcccacgttgactgcctatacttcttag

SEQ ID NO: 87820 - DNA, 189 bp, Glycine max
  Peptide Sequence Number=SeqID_204598
atgaggggagtgtgttttttggaggacttatgtgggagggagggtggtggcgaggaagatctgttggcttccgtaggaggtgttagaggaaagggaatttcagcttcctgggatcgatgtgtgggtgtcacaagactgagtgaccagggtaaagggaaaagtcataaggaaagaaagttccacacctaa

SEQ ID NO: 87821 - DNA, 1008 bp, Glycine max
  Peptide Sequence Number=SeqID_204599
atggaaccacaaaaccgcagcaatagcatcctatgcaaatacactgaacacgaaaccgttacaaaaaaacacatgaaatcaaaaaacaatacttctctttcgcctaaagtcatttccatattgatgacggatcaatatgctacagactcatccagcgacgaagaaagagtcacgagccgccggcgcatcaagcgttatgtcaatagaatcgagcttcagccggcgattaaatccgtcgctaccagaaagagacacgttggagacgccacgaaactacggccgccgcaggtgaaggtgaagaattctggcagcgtgaaaaaattccgcggtgtgaggcaacgcccatggggtaaatgggcggcggagatacgggatcctgtgcagcgcgtgagaatctggctgggaaccttcgaaaccgcggaggaggccgccttgtgttacgacaatgccgcaatcatgctccgcggcccggacgccctaacgaatttcgggatacggtcaaaggaaacgttggagaaagaagaaagaaaagagttggatgaaaaggaagaaatcagaaccgaaaaaccggaaatgaaggtggtcgtgaaaccggagattgaaactgctttggtctcctgcttctacgactcggcggacgagttttgtctgaacctctcgtcacccacttcagttctccggttcaacgaatcagctgaactggagaaacagtacgagccgtttcccggtcgaaccgaagcccacaccgtgctggaagagtgtcaaggacaaactgtgtcgtttcatgaaagtagtgagtttatgttacaagacatgccgtgggatgatgtgtttaattttccggtaatgttcgacgagccggtgtcgcacttgtttgacgaaacgacgcggttttcgagtagtgaggttttcagtgaggaaaagtttttgccgtcagcaacgttgtgccaagtggacgattatttccaagacattttgttagggtcagatcctctggtggctctgtga

SEQ ID NO: 87822 - DNA, 528 bp, Glycine max
  Peptide Sequence Number=SeqID_204600
atgttgttgaagatcaaggttgctagatatcatggacagtacctgggtctctcggctcttattggaagatcgaaatctcaagttttccaatttttctgggagaggcctaaatcgttgggagggctaggctttagacgaatgaagaagttcaacaagtcattgttggccaagcaaatgtggagacttattaccaatgaagagagcctagctactcaagttttgagagcaagatactttccctggggttctcctttggatgcccaaaaggctcacaggcccagctacacatggagcaacatcttttcttccaaagaccttattgacaatggtgttgtgtggagaattggtaatggggattcggctctagcactacctaccatgtctcaacctctaccttctgaggcctgcaacctccgatggaaaaaaccgcagatgtactgcatcaaggagaattttgatgcttctgttgtgcaggataaaggtctaggtattggagttgtttatagagaccaccagggggagttctag

SEQ ID NO: 87823 - DNA, 177 bp, Glycine max
  Peptide Sequence Number=SeqID_204601
atggaggcggtgaaatcgaagaaggaagagctgcaaaaagatattgacggaaggctctacctagcgttgaaggagggagaggaaggcgttgcaaatgtagcgatgaaggagaaggcgaatgtggcgacgaagcagaaggagaatgcgctcttaaccctagttgacatttcaatttga

SEQ ID NO: 87824 - DNA, 369 bp, Glycine max
  Peptide Sequence Number=SeqID_204602
atggagcttcggccttacatcgaggaacccatttcaaatgatgcagcatctttaaattttatatctcttgatcttcgaccaagagtcaggcatgattttattctatctaatagaggtgcagttgatgaatattggcgaacattggagaattgctatgctactgctgatcgaaaagctgcttcatatgcatttcctggatctgtggtccatgagcttttccgcttccgttcatgggcatctactcgtcttatgacagctgaacaacgtgctgaacttttaaagcatgtaaccaaggataatcttagtgaaaatatttcatatagggactgtgagaagattgcaaaagatctgaatcttaccacagagcag

SEQ ID NO: 87825 - DNA, 231 bp, Glycine max
  Peptide Sequence Number=SeqID_204603
atggccaccattttggccgtgaaaagcaccgttccagccacaacggccaggtgggatatgatgacgcttggaggaggggtatatggtataggatttagggttaggtttagggttagggttatgattggggtttgggatatggggcatgggggtcggggcttgggttcggggtttgggagttggggtttggggtttgggttgagggtttggggtttagggtttgggttttag

SEQ ID NO: 87826 - DNA, 340 bp, Glycine max
  Peptide Sequence Number=SeqID_204604
acgccctcagtcaattcttgggccacccgctgatcttggaagagggccagcagtgcaaattcagccaaaggaagaggagacgggtgcggatcatgcgcaccagcatgaccacctttacccagatatggatgatgttgctgctcagcaacatcctacccaggacggcacctacaagacaccctatggacctggagaggtccaacaaggccctagggttcccagctctgatcatgggcctctgccaattctacagagtgcctgtcgcccccagcaaggtcatttggcctcccattaccagagccttcatcaagaagtactgcatccccgggcaccgcagtag

SEQ ID NO: 87827 - DNA, 531 bp, Glycine max
  Peptide Sequence Number=SeqID_204605
atgttgaaaggaagacgaatcacaagtttggcgatctggtcatccttgtccttctcagaggaggaaatccagcatgtctgccatgtcctgatcgtcctgggctttgtccccacctccaaaggtccccgcaggccctgccagcgtcttaaactcggcctcgtccacaggctaggccatcgtggcctcgaactgctcgggagtgggccaagggaaaggactgaggtcctgactttgctggtgcaggttgtaacgatagaacatctcgttcagccgcccctaccctctgtgattagctgcttgctgtctaatcacgtgacacatatacctatccatccggagctctatcctatccaggtgatcagagaaggacctcaaagatggtgcctcctctcgtggcggcagtggcgcatctgcccctggctgctgatcctcctcgagctactgcggtgcccggggatgcagtacttcttgatgaaggctctggtaatgggaggccaaatgaccttgctgggggcgacaggcactctgtag

SEQ ID NO: 87828 - DNA, 702 bp, Glycine max
  Peptide Sequence Number=SeqID_204606
atggagcagtatgaaattctagaacagatcggcaaaggtgcatttggttctgcccttcttgtgaggcacaagcacgaaaagaaaaagtatgttcttaaaaagatccgccttgctcgtcaaactgacagaacccgtagatctgcccaccaggagatggagcttatatctaaagttcgaaatccatttattgtggagtataaagattcctgggtagaaaagggttgttttgtatgtatcatcattggctattgtgaaggaggggatatggccgaagctataaaaaaggctaatggtattaactttcctgaagagaaactttgtaagtggcttgttcaattgctgatggcacttgattatttgcatggaaatcatattcttcatcgtgatgtcaagtgctcaaatatattcttgacaaaagatcaagatatacgtctaggtgactttggtcttgctaaaatgttgtcatctgatgatcttgcttcctcggttgttggcactccaagttatatgtgcccagagcttcttgctgatataccctatggctctaagtcagatatctggtctttgggatgttgtatctatgaaatggctgcttacaagccagcttttaaagcttttatattgatcaaaatcgtaattggtaagagtcatcagcagcaggaagaaggaggaagactctttggatgcatgcatggctattag

SEQ ID NO: 87829 - DNA, 534 bp, Glycine max
  Peptide Sequence Number=SeqID_204607
atgacgttgctgcttagcaacattctccccaacaaccataattcagacctccccctgccgaagtggatcacgtctcctagacacccactggacctagttctatggagtgccagtcacccccaccaagcttatccagccccccatcagcagggctttcatagagaaatatttcatgcccaagcaggcccagcagcagtaggaggaaggccaacaacaaccaaccacagatgcactgtccccccctccacaggagacaccatccctagggtccatctccgttcatctgtgaaggttagagctccagatgcacaggtgcagctgaatgagactttctaccggtacactatgcaccagcagagccaagaccccagtcctttcccttggcctacccccgagcagtttggggccacagttgcttggcctggggatgagcgtgattttgagataggggcaggacccgcaggggcccctggggacgacgagggagcccatgaggacgataatatggctgatgtgctagatttcttcacttga

SEQ ID NO: 87830 - DNA, 159 bp, Glycine max
  Peptide Sequence Number=SeqID_204608
atgggaaaatatgagttgatatatgagaacattatgtccgaagaaattaatatgaatgaagacactggaaaggaacttgttgtggttgaaaatatcaattgttctgatgccttcaatacttctcaggtgtttgcaaccagtgaagacgtattgcagtga

SEQ ID NO: 87831 - DNA, 231 bp, Glycine max
  Peptide Sequence Number=SeqID_204609
atgcaatcacagggacttgcactgcctcctaagattgaggttggtccttcagctgcttatgtcaacacaaaggagagttgtgttgatccctcagggaacgacccagacacgggtcaaagaaatgcgggttgtacgtcgaagaaagtcctccccgcctggcatatgactgagacaaatatgcgagcagggaatgctgattgcacattggcaaatggtcgtcattttgcctaa

SEQ ID NO: 87832 - DNA, 432 bp, Glycine max
  Peptide Sequence Number=SeqID_204610
atgaaggctgaacccattccttcaaccctctcatgcctatttataggaaatgaggggacttggttgattagcagctcacccaggcgagctggttacttcacccttatgtcatttgggggcccaggcgagccagaggctggcttgggcgagccaggggtcagaaaaagcttgcaaatgacccttttgccctcccttttgggcactgtttgctcttctttgtgcattgggacttctgtttttttttttcatttgcattcacgttctttccattccaaatgcaaaatccagagccattttttctctcggtttcactttgtacaagacgacgagcttaggtatttttttagtcccaccagcactgagacaactatcagacatctcactacaccaatttcaggtcttaattcagctaagagtggatttgactggtga

SEQ ID NO: 87833 - DNA, 201 bp, Glycine max
  Peptide Sequence Number=SeqID_204611
atgactccccaaactatccaaacggacaattcaagactcaatacaacgattaatgcaaactgtccgcaagaatcattgtattcaatctcaaacgggaatctaagtgaacaagtaataaaaacattggtaacaaacaacaacatcaaaagtttacgaaaaacatttgtacctgtgatgatgagcagcacggtcgaaaaatag

SEQ ID NO: 87834 - DNA, 967 bp, Glycine max
  Peptide Sequence Number=SeqID_204612
atgaaggacatgctttgtgtgcagcagcaacttctggaaaagctatatgctgaattggatgaggaaagagaagcttcagccactgcaacaagtgaagcactggacatgatactgcgtttgcagggagagatagccctggtgaagatggaggcaagtcactacaagagagtggcagaggagaagataggccatgctgaggtctctcttgaggcttttgaggaaataatgtatcagaaggaagtgcaaattgcgtcgctcgagtttcaagtgcatgcttatagacacaaacttatgagcttggggtgtgaactcgaagaggatcttttgttgttgaataggagtgatcaaagaaatggagaaaatgggggtcagagtagcactgttagaaggttacaatcaatgcccgcaattcagtttctgagttctttaagagctgctgcaaagaggggaagatcacctagtccagttcttgatgtgattcctaagataatggaggagagtactactgacaaagaagttgctcaacctggcagtggaactcttgattcatatttgaaccagataaaggagttgaatgaacaagtgagggtgatttctgattgtgctgaaggagaaaagagtgcaaatttgagaagtagaagagggaggtcttgttcaattttaccgcatgctagtgctaagatggcatgtgatcaaacacacagattgatctctactaacttagatgaagtgagtcaaggtgaaagtacacccaatagaggagtagctaatgattctcctcgcatccttaatgttcatgatgtgtatgaagtcccacaaactagtgaaaatcatgaagtcagtgaacatgggggaaaaaggtttgagaaatggaattctgatgcagagaatagattaacaaaaccagattctgtgtctgagggaatggttgaatctcctcttaaacatgatgcagaaaagaaaaagg

SEQ ID NO: 87835 - DNA, 213 bp, Glycine max
  Peptide Sequence Number=SeqID_204613
atggctactattggccatatgagaaaagctttgaatatagaagaaatggaaataagagaattatttgaagatgggatacaaatgatgaggatgaattattacccccatctcctcaaccagaaaaggtggtctatcccaaatgacatttacttccaatttttctcgttagatgttttacatgacagattgctagtagtggacatatcgaagtaa

SEQ ID NO: 87836 - DNA, 699 bp, Glycine max
  Peptide Sequence Number=SeqID_204614
atggaatcaatgatcttagtgtcgagagtatctgaagctgagatagggagtgaagtcataagccataagaagatgcgtgagcttcctggcttttacttccatcatcgtttatatgtgttgagaaagagggcaggtccagaggcatatatgggtaacgcagactatgcttacccttcgggtatgaacgtggagagcgtgcaccgagtggccattccaccccctcaacccttcttcaagtccctaaagtactctatgaaagagacttttttcccagatgacccgtttagaaagttcaagaaccagccagcttctaagaggttcatgcttgggcttcagtacttcttccccatcttcgagtgggctcccaagtacaccctccacttcctgaaatcagacctcatatctggcatcaccattgctagcttggccattcctcagggcatcagttatgccaagctagccaacctccctccaattcttggactttattcgagctttacaccgccattgatttatgcaatgatgggaagctcaagggatttggcagtgggaacagtggcggttggatcgcttctgatggcttccatgttgggtcgagtggttaatttcaacgagaatccaaagctttttctccacttggctttcactgctacgttctttgctggagttttgcaggcatcactcggtctcttcaggtga

SEQ ID NO: 87837 - DNA, 267 bp, Glycine max
  Peptide Sequence Number=SeqID_204615
atgcaaagggaacagtcaagggatcaaggaattgaagccatgaagagtgttggaatgattggaacttgcttgagaaaatttttgcttaagaatggaataattttattctttttatttgcttggggacaagcaaaatgtgaaaaagggaggtacaacaagcaaaaaggagcagaaataaagaaaaaaagaagaaaattagaagaagcccaagtccagcaaggcgctaagcgcgagacacgcccagcgcgcaagaagacaaggcgctaa

SEQ ID NO: 87838 - DNA, 111 bp, Glycine max
  Peptide Sequence Number=SeqID_204616
atgaagggtgttataatgttcatcaagattgatatgatagccttgagagttgctaagcgtctcgaagatcaacgggttatcctgggaatgcatttgggactcatgatttaa

SEQ ID NO: 87839 - DNA, 234 bp, Glycine max
  Peptide Sequence Number=SeqID_204617
atgatgccttcaaaatgtacctcatgcgtttgggaaaaaacagagcgcataactgacacgagatcggcctcgtgggtaaaatgctctaggccaaggattgatttcaactgttgcagacaaaccactgtagctgctcctcccatgaaccctactatggttgcatgtgacacaaaatccacgataaaccctaacctgcactcctccatcacatgcttcctcatcaaacacatataa

SEQ ID NO: 87840 - DNA, 1116 bp, Glycine max
  Peptide Sequence Number=SeqID_204618
ataggaaatttgaagaaggggctgaatccaccttcggcaacggatttggtgtttgtgtcaccttacatgggcactgccataaaaactggattcgtcactggcattatagcacttgcggttaagtatctctcaatctcatttcctttggtagagggtaaccttgaaggaatagcagtgggaagaagctttgcaatgtttaaaaattatcatattgatggcaacaaagagatgatagctattggaaccatgaatattttcggatcgttcacttcttgctatctcaccacaggaccattttcgcggtcagcagtgaactacaatgctgggtgcaaaactgctgcatcaaacattgtaatggcaatagcagtgatgttgacattgttattcttaacacccttgttccatttcactcccctggtggtgctatcagccataattgtatcagcaatgctcgggctcatagattatcaagcagccattcatttgtggaaaatcgacaaatttgatttcttagtgtgcttcactgcttatgttggcgtagtctttggcagtgttgaaattggcctagtcatagcagttgcagtatctctgcttcgagtacttctatttattgcaaggccaaggacatttctcttaggcaacattccaaattctgcagtatacagaaatgtggaacaatatccaaatgcaaatcatattcctggaatcctaattcttgaaattgatgcacccatttactttgccaatgcaagctatttaagggaaaggatcacaaggtggattgatgaagaggaagatagaatcaaagctacagagcaaaccagtttgcaatatgttataatggacatgaccgctgttgctaacattgatacaagtggaataagcatgcttgaagagtgcaagaagactgttgacagaagagggttacaacttgctttggtgaatccaggaagcgaggtgatgaagaagctgaacaaatccaagttccttgatgaactggggcaaaaatggatctatctgacagttgaagaggctgttggtgcgtgcaacttcatgctccattcctacaaaccgaaccccatgaaggatgaatcagaaggttggaacaatgcctaa

SEQ ID NO: 87841 - DNA, 456 bp, Glycine max
  Peptide Sequence Number=SeqID_204619
atgtctggctgtatttctgacattttcaagggatctgccaaggatcaccatgggaggggagttggtggggaaagtggtgatgaggccctggatgaggatactggaggaaacaaagaggttcaggtgagagttcttgtgaagcggggaaacaagcagcaaacaaagcagatgttcatcccacggaattcctcactggtgcagagtacaaaacagaaagaagcagcggagcttcaagagaaagaagacatcaagaggcttgtcttggagtataatgatagagaagaggaggagcataatggattagggacccagccaacaaactggatgcagagtgtaggttacaaaggtggtggccgtggcagcactttggaaggaaacagtggcaggggtagtggatcaagacatcggcatcataattattctggcagtggaatctattacagtagaagaaagtga

SEQ ID NO: 87842 - DNA, 1842 bp, Glycine max
  Peptide Sequence Number=SeqID_204620
atggatcaccacgaggatgaaagtaacagcaaacaagacgatgagacttgcttgaggcttaacttctctaatcttacacaggaagctgttgctcgccttgaggaaataaaaaaatctattgaggcgaagctggctttacggcaaagcaatttgaatccagaaaggcctgattcaggatttttaaggacattggattctagcattaagcgcaacactgctgttattaagaaactgaagcagattaatgaagagcagcgtgaagctctgatggacgagttgcgaagtgtcaacttaagcaaatttgtcagtgaagctgtggctgctatatgtgatgccaagcttagaagttctgatatacaagctgcagttcagatctgttctttgcttcatcaaaggtacaaggactttgcaccaagcctggttcaagggcttctcaaagtcttctctcctggaaaacctggtgatgaatcagatacagacagaaatttgaaggcaatgaagaagcgcagctctctaaagcttctattggaacttttttttgttggagttattgaagatggtgggatttttatcaatatcataaaagatcttagcagtggggaacagctaaaagatcgggatgctgcacaaacaagtttgacccttctttcgagttttgctcgccaagggagaatttttctaggactttctgttagtgggccggaaattcatgaggagttttttaaaggccttaacatcacagcagatcagaagaaagttttccggaaagcatgctattccttttatgatgctgcagctgaactacttcagtctgagcattcttcacttcgcttaatggagcatgaaaattctaagattttgaatgcaaaaggagagctcagtgatgaaaatattgcttcatatgaaaagcttcgtaaatcctatgaccatctgtaccgtaatgttgcatcattagcagaagcacttgatatgcagcctcctgtaatgccagaggatggccacacaactagggttaccagtggtgaggatggagtttcttctgcttctggtaaagattcttctgttgttgaacccatatgggatgatgaagatacaaggactttctatgaatgtttacctgatcttagagcttttgttcctgctgtgcttttgggagaaacggagccaaaaagcagcgagcaatctgcgaagaatcaagacctaacaactgaaatattacctgaatcagacaaaggtcaacagaccactcatgaaagtggagaggtctctacagagtctaatgctttgccagaggcagaaagcacagaaagagtgaaggataaggaggaaaaagacaagtctaacgaattggacagagagaaggaaaaagaaaaagataatgacaaaaagggagaaaatgaaaaagacaaactcagaagtcttgaagggacaaatttggatgctctactgcagaggcttccgggttgtgtgagccgagaccttattgatcaattaactgtggagttctgttatctaaattcaaaatcaaatcggaaaaagcttgtgagggctttgttcaatgtaccaaggacatctctggagctgttaccatattattcccgcatggttgccacactctcaacttctatgaaggatgtctcctccattcttttgcagatgttggaggaggaattcaacttcttaataaataaaaaggatcagatgaacattgagtccaagataaggaacatcaggttcattggagaactttgcaagttcaaaattgcccctcctggcctagtcttcagctgtttgaagggggagaaactgaagaagaggtcagaggttcaggcaagggcttga

SEQ ID NO: 87843 - DNA, 780 bp, Glycine max
  Peptide Sequence Number=SeqID_204621
atgtcgaactccaacactcaaccgaaacctctgcttcccaacccatttaatttgagtgacactgagatcgttgaaaaagtttacgtattatcccacacttacgatgaccaagtgtttgataatgagcccctcttcaacgtcgtgtccaacgttatcaagctatcaactcaaattgttggggctcttcataagcttcagttcagagtgacgagctatatatacagcaacctgattaaaattttcggtgtcttgcagatagatgagcccaatggatttataggaaatccaatatctacaaccagtttcaaaccagaattctccacactgaagctgatgtcatgccagatgatgacactaccttgggggccagaaaacgcacaccaaacaacacttgggattcttcaacaactgagagactactcttgggacgcaaaagtgctgatagcaatagcggctttggcgttggagtatggaaatttctggaatcttcagcaggtatcagagcctcagggaaactcattgagactgctgaatcaaatccaacacagacagattctcgtgactaatataaacacaacagtgaagctcgtcatggcagacggtggggagccttgtattctgctgaaacctaggagactgaggatgttcccgctctctcagatgccttgcagctcatccccctccttgtttactgtttgtcgcttgcaacaccaacatccagcctgtttcgaactatgcattatcggacttccgtgccaaactttctcccgctctggatga

SEQ ID NO: 87844 - DNA, 822 bp, Glycine max
  Peptide Sequence Number=SeqID_204622
atgggtaccaaaggcgaaagtggtggcagaggaggcgatggagacgtcatggctggcggaggttgcacagtcgtgggtgcgatgagcatgggtgatggagttgacttgagcggaggaggtgatggcggaggcaacggtggaggcgacggcggagtctgcgacagaggcagtaatggtgtggagcatggaggtcgggtcgatatggagagcggagacggcgatgctgactacgcaagggaagacaatggaaggcggcctcaagacggtcctcaacagccatggaagtttcgtttggcgacgagtagtgtgggtggtggtagtggaaggtggaagcttcgtacggcgagtggcagccatgaaagcttcatatggtcagcacctccagaagaagaagacgaagagaaggagaaaaatgctaagggaagggactatgctatttctcattcattcatgcccatgctgttattacatatccctatttatattgaattctatacaactaattttggcattttgtgctcttctagaatattcagcatgcccgcctacattacccctgcttcaaacgaaatccctgaggtagcaggcctcacaattctcctcatgtttgttgttgtttacatccgtgtgtttgctgcccctgtgcctccttctacctatcaacactccaccaccacgtaccactttatgtcactcttcaaagtgttgaaaagttccctcctagcatccccccatttgttctcgatcgggatccacaaaatcttgaattcctctttcttgaaaccgctcttgtcatttggatcttccacaagtctctcatag

SEQ ID NO: 87845 - DNA, 2097 bp, Glycine max
  Peptide Sequence Number=SeqID_204623
atggcattagtgacttcactttctcctgcgaccccttcttcggttcaaaccaacactttgaacccattgggttggactgatgatcagatcctggagaaggtttacattacccacgtccacaccgctgaaaggtacgatgtggaatcgcttttcaacgttactacaaacatcatcaagcgtgctactgcacttgctgacagtgttgctgttaagactggcacacccgttggtcttattgaagacaaggttcctttgtccactttcgacccaccgttccttaaacttaagcatattgcttctcagatgatgaacacacctcacggtgagcatcacgcacacaacacagcaatgtcgatcctcgaccagctgagaacctacacatgggacggaaaagcgataatgggtctggcggctttggctttggagtatggaaacttctggcacctggtccagactccgacaggagaccatctgggaagatcattggcacagatgagccgagttcacatcgtggagaggaacaggcaagccgtggctgactacaacagcttggttaagaacttgctcatcgcggttgagtgcatcaccgagttggagaggctttccaccaaaggttatgacttgaaggacgtcccagccttggcagaagccatgcaagagacccctgttgctgtctactgggccatcgtcaccactgttgtctgtgctaatcattttgatttcctccttggtgaatcggactctagatacgaaatagcaaattttgacgacaagcttgctgctgttatcagcaagttaaaggcgaatctgaccaggagcagaaagaaaataggtgacctagaagactactggaggcgtaagaagctgcttcaaactccgacagaaatcgtagaggttctcaaggttctgatctaccacaacgaagttcacgacccccatgtctacgatggcatcaccagacaaatggttagcatcgaagtgttcaggaagaagcacgtgttactcttcatttcggggcttgacagtatcagagacgaggttcggcttctgcaatcaatctacgagggattgcaggaagatccaagggaagtgaagggatacagaaaagaggacttcaggattctgtgggtcccagttgtggatgagtggaatcttctgcacagggccgagtatgataacctgaagcttgaaatgccgtggtatgtggcggaatacttctaccccttggccggaataaggctcataagggaggacttgaattacaagaacaaacccatcatccctgtgctcaaccctcaaggaagagtggtcaactacaatgccatgcacatgattttcgtctggggcatcgatgcattccctttcagaccctctgatgatgatgtcctcacccagaaatggaattggttctgggcagaaatgaagaaagtcaatcccaagctacaagacctcatcaaagcggacagtttcatcttcatctatggaggcagtgacaagaagtggctgcaagatttcactcagacagtggaaaaaatcaaaaggcatgagataatcaagagggcagacgcggtgatagagcactatccattcggaagggaagatcacaggatcgttcctcgcttctggattggcatagagagcttgttcgcgaacatgattcagaagacacaaaaggaccctaccattgaagaaataaagagcttgctctgcctcaaacagcaacaacccgggtgggttcttctcagcaaaggatcgaacgtgaagctgttggggggtggggacccaatgctggccactgcagctgatttcgagatatggaaggaaaaggtgctggagaaagcagggtttgacgtggctttcaaggaatactatgagcagaagcgtcgcaactaccctcaggaatgctcgcacatgcagttggctaactaccctgctgatattcttcacccaattaactgccctgatgctgcttgtggcagatccatggagatagcttctgtcagttacaagtgctgccacggtcaaacagctcatcacaaggctgaagttccagagagtggcgatgtcatgattgagaagaagctctacgcttcttaa

SEQ ID NO: 87846 - DNA, 699 bp, Glycine max
  Peptide Sequence Number=SeqID_204624
atggatcgcttttttcctgagaaaattctcggtgagattttctgggatgaaccttttttggccactgatcaaagtgatttagttcaatattcccagattaacaaggctgaagcttcccctcctgcagcaactccaagcgcttttgttcaatatagagacctacccagaagaattaattctctaaacgggtcaaattcccagatcatgagtaagaaaatgcttgcgttcttgagaaaaagttggccttggcctgtggagagaaataacgtacaagagaatgagagaaaccgtagtttcaggcacatgatcaacgaaagaatgagaagacagaggcagaggcagtgttgtttggcgctgcattcaatattaccacaaggaacaaaaacggataataattctgtaattcaaatggcggcaaaggagattgtacggctacaaggatgcagagaagagttgcaaaggaaaaatgttgagcttgaagcaaatcttgaaggtgttgagagcagcaaaggtagcggaagtaaagttcaatatttgagagttccacatcctaagtctggaattgattctatggttgagatcctcaaatgcttgaaagacaaaggagtcgataccagaagcatcaaatcaactttctccccacaggagttgtttgcagtgttagagacagaaactgatgaggtagcaccttctgaatag

SEQ ID NO: 87847 - DNA, 435 bp, Glycine max
  Peptide Sequence Number=SeqID_204625
atgttgaacgatgatgccttggacatcattttcgaatggggatccacgcattccctttcaggaaatccgaagcttacctacttgctcagaaatggaaatgcttacttacttgctcagaaatggaaatggttctggcatgaggccaagaaaacaaaccttcatggtatacaagtgaaaggtgataggtatatcttcagtggagccgagaattcactgcggcagtggataaaaataaaaggcacgatatacacaataaggagggcagatgcaataatagactattaccatttaggaaaggaagaccccaagatagttcctcgattctggattggcatagaaggcaagaggcaaaagaagcactccgagaatttggactgtgattgctctgcctcaagcaaagtggaaagaaagagtgctcctgaaagaaggctttga

SEQ ID NO: 87848 - DNA, 132 bp, Glycine max
  Peptide Sequence Number=SeqID_204626
atgactgagcaaaagacaatgaagcaaacgtgcgcagaagaagtgttaccagaggaggagcttgagaatgcttgctggaggttgaactacaaaaatgagaacgtgagtgcgaaaaagatgcaagaacgttaa

SEQ ID NO: 87849 - DNA, 205 bp, Glycine max
  Peptide Sequence Number=SeqID_204627
atggaaaactcagatacgaagctgacaacttcatccctgcctccaccacctccagtatctgcggaggagccagagcccaagaagttgaagatgtccaccacaacttctgatgatgaagaatgtgcagctggcacaggcaccaagaaaagatacaagcgccgtaaggttgctattttctttgcttactgtggtgttggttatcagg

SEQ ID NO: 87850 - DNA, 2637 bp, Glycine max
  Peptide Sequence Number=SeqID_204628
atggaagaccatgttagtgagatgtctaaggaggtgactattccaattgatggggcaatagataagtctgttgattgtagtgatgcattcaacactacagaggtttttccttcccgagaagctatgttgaattgggctcgagatgttgcaaaagagaatggatttgtccttattattttgagatcagagacatctacaagatccacaaaatatactagatctacaagatgtaatcaaaggaagacatttgtaattatgggttgtgatagaagtggaaaatatagaggaccatacaagaatgcattatcccggaaggtgagtggtactagaaaatgtgagtgtcccttcaagctaaagggaaaagcattgaaaaaggctgaaggatggattgttaaggtaatgtgtggttgtcacaaccatgacttagaggaaacattagtgggtcatccatatgctggtcggttgagtgctgaagagaagtctttggttgatgctttgacaaagagcatgatgaagcctaaagacattttattaacattgaaagatcataacatgggtaatgtcactactatcaagcagatttacaatgcccgacaggcttatcgatcctctaaaaaaggttcagaaatgcagcacctgttgaaattattggaacatgatcgatatgtgtattggcacagaaaagtggacgattccgatgctattagagatatattctggacacatccagatgccattaaacttctgggtgctttcaacactgtattgatcattgatagtacttataaaaccactaggtatcagttaccactgcttgagattgttggtgttacttcaacagagttaacattctctgttgcatttgcttttgtggagtctgagcgagctgataacttcacttgggcactacaaaagctaagaggattgattgtcaaagaggatgacatgccccaagtgattgtgactgtcggagacattgctttgatgagtgcagtgcaggtggtctttccgagctcttctaatttgttatgtcgttttcatatcaaccaaaatgtgaaggctaaatgcaagtcaatagttcattcaaaggagaaacaagacatggtgatggatgcatgggatgttattgtgaattctcctaatgaaggtgaatatatgcagcgtctggcattttttgaaaatgtttgcttagactttcctatttttggtgattatgtgaaaaatacatggctgattccacacaaggaaaaatttgtcactgcatggacaaatcgggtgatgcatttgggtaacacagcaaccaatagggttgaggcgacacattggaggttgaagactttgcttcaagatagcaaggaggatatgtgtagttattgggatgctatgaagaacatgattacattgcaacacacagagattgaggcatcattcgagaaaagcaaaaacgtagtggaacaccggcataatactccattctacgtcaaattggtgggatttgtatcaaggagtgcattgagtcatataactgaggagtatgatcgagttaagactgctggtattgatagttctatctgtgggtgcatagttagaactacacatggtctaccttgtgcatgtgaacttgctaggtacagcacgatgtgtcacccaattcccttggaggcaattcatgctcattggaggaagttaaagtttagtgaccacggaacaaatgacaatgggtctgagttatcattgcaacctgaagttgatgctttgtacaagcgatttcaggaacttgattatgctgggaaaattattctaatggctaaattgcatgaaatggcatttcctgatacagctttgaagtgtctacctcctgaagaggtaggaacaaagggtgctccagagggtctacggtggaaaagtgatggatcaactaaatttgacccttcatatttggagcttgcattgcgtcctgcccgtgatagcacatcatctctctcttcatctcagaaaacagtccatgagtctaaacgcaggagagttctgccaatgatggaccaatttccggttgagatccatccatttattgaagacattattgatgtgaaaggagattcaaattgtggttatcgtgctgttgcagctcaacttggtatgggtgaggagtcatgggctctagtccgtcaggatttaattagagagcttcaacagtggcaagataattatgcgaaactctttggtagcaatgaccgagtggctgaactgaggaaatctttgtatgttggcaagcaggcatctgtcgctagttggatgaccataccagatatgggctatgtaattgcctcaagatataacgtggtcctagtcactttatccttgcaggagtgcatgacctttttccctcttagaggacgaccaccactatctcagtcaagtcaccgtcttatttccattgggtttgtgcataaatgtcactttgtacaggttgttttgaaggctgactcagcaatacctcccaccgctttgcagtggtcaagatactgtaatgctgaatctcgctcttgggaaacttcatatgttagtcgcatgcaacaatttaggtcgttgtttccacaaaaagaaataggttatgtagacattattgaggattag

SEQ ID NO: 87851 - DNA, 429 bp, Glycine max
  Peptide Sequence Number=SeqID_204629
atgcagtgcgattctcattggatggatgttaacattaatgtgcctactgcccctgaggttggattatatttggatgagtgcttctttacttcatataaccagaagtggaaagatcatgaagagttgtccatgaaagcatatgaaaaagatgctgaggagttcaaaatgaagtacatatactctcatattgcttccacagaacagaaggaaggaactgtcgctctttggttgcattctttgaaccatagaaattatccagatctgcatgttatcaatgaggaagccatccccgataacaagagtgctgatcccaaagaagccatcactgataacaagagtgctgatcccaaagatgccatcaccgataacaagggtgctgatctcgaagaacacatcaccgataacaatcctgtagttgtgactcagtga

SEQ ID NO: 87852 - DNA, 483 bp, Glycine max
  Peptide Sequence Number=SeqID_204630
atgcatgttcagccatcggttttaaggaggataaatgtggatggttctcaaccacaaacttctcaaggtacttatccaaatcaagttggtgctagtgcaagtgtcaatcctgttgatccaaatcaaggtgctgctactgcaagtgtcaatcctgctgatccaaatcatggtgttgctactgcaactgtcaatccttttgatccaaatcaaggtgcttctaatgcaaatgtcaatcatgttgaacaaaatcaagctgcttccagttcaagtgtggatcctgctcaagcaaaaaaggttgcttccagttcaattgttattcttaatcaagcaaaagaggttgttgccaattcaagtgtgattactccaccaaggagaaaagttgctaaacaaaatgcaaagtcaactaggggaaataacaaatcaaccccgaagactaaaggaaatatgccaaaggttttaccgcacttgatcatctctcattga

SEQ ID NO: 87853 - DNA, 674 bp, Glycine max
  Peptide Sequence Number=SeqID_204631
attcactagcttcaggcatacgccaacttctgaagcagctgggaaggtcactgaagaaaaaggaaaagcagaccgtagttgaagttctatctagtgctcaggttgtgcttgccactaatactggagcagctgaccctttgattcgaaggctagatacttttgacttggttgtcatagatgaagctggacaggcaattgaaccctcttgctggattcctatattgcagggaaagcgctgtattcttgctggtgatcaatgccaacttgctcctgtcatattatctagaaaggccttagaaggtggtctaggaatatctctactggagagagctgcaactttgcatgaagggattctcaccactaggttaacaacacaataccgtatgaatgatgcaattgctagttgggcttcaaaggagatgtacggaggattattgaagtcctctgagactgtcttttctcatcttctagtgaactctccttttgttaagcctacttggataacacaatgcccactgctattgctagatactagaatgccatatggaagtctgtcagttggttgcgaagagcatctagacccggctggaacaggctcactttataacgaaggagaagctgagatagttttgcagcatgtattttccttaatctatgctggtaatcatatttga

SEQ ID NO: 87854 - DNA, 1038 bp, Glycine max
  Peptide Sequence Number=SeqID_204632
atgggaaggcctccttgttgtgacaaatccaatgtgaaaaggggtctttggactcctgaggaagatgctaaaatacttgcctatgtggtcaatcatggaactggaaactggacattggttccgaagaaagcagggcttaacaggtgtggtaaaagctgcaggctaagatggaccaactacctaagacctgacctcaagcatgatggttttactccccaagaagaagagctcattattaacctacatggagccataggaagcagatggtctataattgcaaaaagactacccggaagaacagacaatgatgtcaagaactactggaacacaaagctaaggaagaagcttatgaagatgggaattgatccggtaacacataagccggtatcacaagtcctctctgacttgggaagcattagtggcctcccaaacaccaccacataccaaattgcttttatcaacaaggacttgatgatgagcaacatgctaccaattaccaaaactgaaccatcaggttccaacaagtcaacggtggagcacacacaagagggtcaagttccctcatgggaacaccacattccttaccaagttatcatcaactccgaaaatattcaatcacatgtcttaagtgaagctgcatcctcaacctcatcctcatcttcctctaatatcacgcaattaggatcaccacaatcctactcttgccaaacccctcaggctcaaattgcccctccttgttcctcctttgattggagtgagtttcttcaaagtgactcatttaattggtcattgaacccctcctcaggtataattcaaagtgaagctgaactttccaacaatgccaaaagcaatggcaatgacatgcaaggaggtgcaagtgagggttctggttctggtgctgttgcttgcggtgcaagcatggaatatcaaattaacaagcagtgtgaagctcattcatttgtggatggtattttggacagggatagtgagataagagcagcattccctgagcttttggatgcttcttttgactgctaa

SEQ ID NO: 87855 - DNA, 1011 bp, Glycine max
  Peptide Sequence Number=SeqID_204633
atggcggttttgtcgcctccaacactctccttactccttcaaaaaaccaagattattaattttcgggtcaccaccacttcctcttctcaccttcttctcctcctaacccctcctaacccctcttcgtctcttacaccaattattgcattgcaatctcgtatttttgcagaatccggaaatgggttggccagtgaggacaaaaaaatcttgcttgacaagtatggctgcgatgttgacgctgatgagtacttttctcagtcgtcttctaagtccaagaggagaaaggactcaaaggagcaaccaaggagaagaggagggaagcaagtgcaggacccaccagaggaccctaagcctcctcgtactacccataaattgcttcaggttcttggtggaacagctcgaagagtgaagctactctcaccaaagggcatggatgtacgccccatgatggaagtggtgaaaggtgcagcctttgatatattacaggcagctggtggctgtcctgcagctctgagacctggtcactggttagacttgtatagtggtacaggttctgttggaattgaagcactcagccgaggatgttctgaggtgcatttagttgagatggatccatgggttgtatcagacgtgttacgcccaaacttagaggaaactggattccttgatgcctcagtcatacatactgtccgtgtggaaaaattcttcgaacgtgcagagcaatttatgttttctacattgtcatccaatcatattgccatgaatggaaaccgtggcccatttgattacattagtgtcacccctccatatacacaagttgactatggggtgctgatgaggcaaatatcagaatcatccttgattggagagaacacatttattgtagttgagtatgctttaaaaactgacatgctggattcttgtggaagccttgtaaagataactgacaggcggtttggccggacactcttggcaatttatggaccaacatggtcccagaataagagatga

SEQ ID NO: 87856 - DNA, 156 bp, Glycine max
  Peptide Sequence Number=SeqID_204634
atggcagaggcttcccaatggcaccaactaaaaatggagaacaatgatgagggtgagcaaagcacgagagacactagggtaaaagtaagtgatgagtgcataactgaggaagatgaatgtgggtcaaaggtggaaaaagattctcaatcaagatga

SEQ ID NO: 87857 - DNA, 993 bp, Glycine max
  Peptide Sequence Number=SeqID_204635
atggaaacagcgctcacttgcttcttctgtggtagactccctcctgcaactgcaagtagtcagcacttccgttgtagtaatgcttccgcctccggactcgtgcgtttctctttgcctccttcatttaggctgattcgaaacgccactaacaccagtgaaactaatgtcaaaagtagaagaaggagaagaagaacttgtccacctctggaggtggaggagggtattcttcatcagaacggagaccctttcgggaagaaggatctcgggaagagtgtgatgagttggattcgtgatagcatgagggccatggcgtctgatttagctgctgcggaattagagggaggagagggagagtttgagttgtgggagcgcatgggtccgggtctcacttttattatgctggcacagccatatctcaatgctgttcctatgcccattggcctcgagggtctctgcttgaaggtctgcactcactatcccactcttttcgaccattttcagagggagcttcgccaagttctccgagactccttcattcaggactggcgggacaccaagtcttggaaactgcttaaggacctcgctaattcggctcagcatagggcggttgtaagaaagataacacaacccaagagtgtccaaggcgttttaggaatggactttgaaaaggtcaaaacaatacagcacaggattgatgaattcacctcccacatgtcagaactactccgtattgaaagggatgctgaattggagtttactcaggaggaattggatgctgttcctaaaccagatgatacttctgattcttcaaaaccgattgatttcttggtttggggtcctagctgtagtgcttctactttggagtccaaatattttgttgattgtatcaacccttactcttatgtctctgcatttgatagcaacaaggcaatggacaattgcaggcctaggagaaccataaggaaaccggtccactacagagacttcgtgtga

SEQ ID NO: 87858 - DNA, 743 bp, Glycine max
  Peptide Sequence Number=SeqID_204636
atgcatttggtgttattcaaggttgaagggaaccaccggttaccacctaccgctctttcacctggagacatggtttgtgtgagaacatatgacagcacaggtgcaattacaacttcttgcatacaaggatttgtgaacagttttggcgatgatggctatagtattacagttgctttagagtcacgccatggtgatcctacattctctaaactatttgggaagagtgtgcgcattgaccgtattcaaggactggctgatacacttacctatgagaagaatggtttaagaaagaagaatccttctatttctgttgttgctacactgtttggagatggggaagatgttgcatggcttgagaaaaatcaattggttgactgggcagaagaaaatttggatgcaagattaggaaatgaaacctttgatgattctcagcagagagcaattgcaatgggtttgaataaaaagagacctgtattggttatccaaggccctcctggtacaggcaagactggtttgctcaagcaacttatagtatgtgctgttcagcaaggtgaaagggttcttgttacagcacctactaatgcagctgttgataacatggttgaaaagctttcaaatgttggattaaatattgtgcgggttggaaatccagctcgtatatcaaaaacagtgggatcaaagtctttggaagaaattgtaaatgctaagcttgcaagttttcgagaagagtatgagaggacgaa

SEQ ID NO: 87859 - DNA, 261 bp, Glycine max
  Peptide Sequence Number=SeqID_204637
atgggtgttggtggtgtcattagttgtaaaaagttgcttcttggagccttggtatctttaggagtcatctggtttatgttccttgcaatctcagtgaaccgtcaaaccaagaggacagtgctagttccaatgaatgttatctcaaagcatttgaagttggttagcatgcagaggcatgccctgcattcaaattctggactattcattgtgagcaagagaagagtgccaaatggacctgatccaatacacaacaggacatag

SEQ ID NO: 87860 - DNA, 129 bp, Glycine max
  Peptide Sequence Number=SeqID_204638
atggcgggagattcggcggcacatggaggggatggtggggaggtggctgacataaaggttgtagaagatgacatcgcaggactaggtccgcagtcgcgacgacaatactttcattgtcgtggaaaataa

SEQ ID NO: 87861 - DNA, 258 bp, Glycine max
  Peptide Sequence Number=SeqID_204639
atgactgaaggaaacagagtaagacaagatgacatactgaatcttttgaggaaagaatggcatttagtaggtggagagcttcaaatttcaaggaattgtgcaagacagcaaactgccttgctagtgctgccacctgtagagagacatgtcaaaaacttctggaacaatatcttgttgatatcagttccagagctcaaacacacggatagttatgcacacaatatacagcctcagcttaagttaccttacaattcctag

SEQ ID NO: 87862 - DNA, 1563 bp, Glycine max
  Peptide Sequence Number=SeqID_204640
atggttggattggaactcatacccataggtacaatattgactgttctaaacagccagattgtgaaaacagctaatgcagcaatcgatgttgttattgataaagaaagtttcaaagtcctctcaaaacacctgcttgatattgccccagtcctaaaggaattgcagcttcaggaattgaatgagtctgaagctgcaagggttgctctggagtctcttgaatcagatatcaaaaaggcgaataatttggttgagaagtacaggaaccgtggccgtttctacctgctgttgaggtgcagatacatagtcaaggaagttgaacaagtcacaagagacattggaaggtctctggctgcactgtccattgcaaacactgaagtcctatcaagaatttctgatcaggtcaacaggttacagagtgaaatgcaaacggtggagtttgaggcttcacaatctcagcttcaaattgttgacaagttgaaccatggaattagggagcagaaactcgatcaggcttttgcaaatgacgtgcttgaggaaataggaagggcagttggggtgccggtggagccttcagaggtaagcaaagagctagccagcattaggaaggaaatggaagaagcagccaccaggaaagaaagagctgagtttatttttttggagcagatcattgagctactatctcgagctgatgctgcaagggattatgaagaagttaagaagcaatactttagaagggttcaggtaattgagagatatgattcaagggaaaaatatatccgaccacttaattctttcctttgtcccataactggagctgttatggtagatcctgtcagcctttgcactggtactacatgtgagagatccgccattgaagcttggtttgatgatggaaacaggattgacccagaaacaaaagaggttcttgaagatactaccttgagatccaatgttcgattaagagaatccatagaagagtggagagaagtcaattactgctttggaataaggtctatcaaggaaagcctattatccaattctgacttattagtgaaagaatctctgagccaaattcaggctctcattagagagaattccattaacaaggattggatttctataggagagcttactgatattattatctctatccttggggaatctgattccacagatgccaagatgaagatcttgattactttgaaggattctgtacaggggcatgcaagaaacaaggaaaaagtggttgaatctcaaggttggtatcacattatttcctgcttagggagtgactctagaatttcaaaggaagcaattgatttgctatatgagttacttcaaaaccgatctggttggaataaaagcttctgcaaaaaactctctgatcatcctagtgcagtttcttaccttgttactcttctaaagggtcctgtaagcaattcagctggggtttcagaaaagattttgatggagctttctgagatagacgaggaaaacatttcagctgctgcaaagtttggctggtacaaacctcttactgatcgcatgattcaagtgcaatga

SEQ ID NO: 87863 - DNA, 804 bp, Glycine max
  Peptide Sequence Number=SeqID_204641
atggcttcgtctactctcatctgtgacactcagcaatggaaggagttaaaggctcatgctgaggatgtagaaaagactcatttacgtgatttattgagcgatgatgagagatcccagtcaatggtggttgaatttgatggaattctattggactactcaaggcagcaagccactcttgaaacaagggaaaaactcttcaaattggcagaggttgcatccctcaagcaaaagataaaccagatgtacaatggggagtatataaacagcactgaaaatagatcagtacttcatgtagctcttcgtgctccaagagatgctgttatacagagtgatggaaacaatgttgtcccagatgtttggaatgttctggacaagatccaggagttctctgagcgggtccgcagtggatcttgggttggagctacaggaaaggaattgaaggatgttgttgccgttggtattggtggcagtttcttaggtccattatttgtgcacacagctcttcaaacagatcctgaagcaattgaatctgcaagagggcgtcagctacgctttcttgcaaatgttgatccaattgatgttgctagaaacatcacaggattaaatcctgaaacaaccctagtggtgattgtttcaaagacttttacgaccgccgaaaccatgttgaatgcccgaacactcagggaatggatttctaatgctctagggggcctgctcaatagaatctggggcctataccttttagactttagtattatgaacattatgcccccatcccctgatttcttcaaaatatattcatag

SEQ ID NO: 87864 - DNA, 189 bp, Glycine max
  Peptide Sequence Number=SeqID_204642
atgaggacgcggactaaggtattggtagttgagggatatgttgactttaatattcttgagaaggtgcaaatgcaaggtgttgttgttggtcatgcatttgacctaaccacgttgagtggctatgatgatctcatagatggacttaagaaattgcttgagaccagaggagagctgcgttcacaagactaa

SEQ ID NO: 87865 - DNA, 1137 bp, Glycine max
  Peptide Sequence Number=SeqID_204643
atggatcgcagcaacaccttttcctcctcgctccttctgttgagcttgttggggttccacctcttctttgtttcgtcgcaggtcgaagacgacgtgacatgtctcaagggcatcaaagaaaccctctccgaccctctgaaccgcctcagcaactggcgcttcgacaacacaaccgtaggtttcatctgcgattttgtcggcgtgtcttgctggaaccaaagggagaaccgcgtcataggtttggacctccaagacttcaagctctcgggtaagatccccgaggctctaaaatactgtggaaatagcattcaaaggttggatcttgcttcaaattctttctcttcggagatcccacatgagatctgtacttggatgccgtttttggtttctatagatttgtcaagtaaccagctttctggggttattccacccacaattgataactgttcatatcttaatgagttggtgttgtcgaataatcagctttctggttcgattccatttgagtttgggaatttgggtaggctcaagaagttttctgtggccaataataggcttactggaacaattcctgcgtttttcaatggatttgatagggagggttttgaagggaatagtgggttatgtgggggtcctcttggaggaaagtgtggtgggattagtaagaagaatcttgctattattattgctgctggggtgtttggtgctgctgcttcattgttgctggcttttgggttgtggtggtggtaccatttgagtgggaagaataagaagaagggttatggggttggttctggtggtgttggtggtggtggtggtggtgattgggctatgaggttaagagggtataagcttgtgcaggttagtctctttcagaagcctattgtgaagttgaagttgggggatttgatggctgctactagacgggagcaacgtataagggctgatcttccggatggggtctgcactcgcggtgaagcggttgagtgtgtgcaggatcggggagaagcagtttgggatggagatgaatcggttggggcaggtttaggattgggttgggtgcggcgagggggcttgcgtggctgcaccatggctgccaccctccgatcatacagcagaacatttgctccagtgtga

SEQ ID NO: 87866 - DNA, 1479 bp, Glycine max
  Peptide Sequence Number=SeqID_204644
atggcgagagccatagttaatttggagttgaaagatttgaacttgaaactccttggcgagcaaggagttatacttcctttgctagaaatgctatctggcagcattgaatctaaagaactgtcactgtcatccctggttaaactagcaaaattgcatgccaataaggggattattgcagcatctggaggtgtgcctcttgttttagatttgatgttcttttgcaggatgcggccattcattaccattaaatgttgtgaaatccttgagaagctagcttcagatgatgatggaattgatttcttagttgatggaaaaggaaatcaacttgagttagaaaacatcatcaccaatttgctagctctaactcagggtccaaactcagctcactaccgaaagcctgcattacgtgctcttcttggaatttgtaagtttgagactggtttagtgaagaaggcagttctggcagccaatgggatatctctaatcctccccattcttgatgattctgactcagaaatcagggaaactgccataaatattctgtttcttttctcccaacatgaaccacaaggactagttgaatacctcttcagtccaagaagactacaagctttagttgggtttcttgagaatgacgacaatgatgatgtgcaaatggctgctgctggtttactagccaaccttccaaaatcagaacgggaactcactatggagttgattgacctgggaggccttgatgcaatcctaagcattttaaaaaatggtacaatggaagcaaaagaaaatgctctcagtgccctcttcagattcacagaccccacaaatatcgagtcacagcatgatttggttaaacgaggactatatcctttgcttgtaaattttctcaacacgggttcagtaacagcaaaggcaagagcagcagcattcattggtgatctttctatgagcactccaaagctcacagctgtttccaaatcaaccggttgcactcgttggtggtgttttagaccatcgaaagtccctttatgttcagcacatgggagtgtatgcagtgtgagttccacattttgtctgttggaagcaaatgctttgcccggcttgataaggctgttacatggggaggttcatgcaactgcttatgaagctatacagactctttccacattggttttggaagactttccccaaaggggagctcgtgtgttgcatgagtcaaatgcaatgagacccttattggaaattttgaattggggaactgattctctcaaatcagaagctataggactcttggagaaggtgtttgtgtcaaaggaaatggtcgaatactatggaacaagggctaggttaagtctacttggtctgactggcatcactgtatatggggatggccacctaaggagaaaggctgccagggtactgtcattgcttgaacgctattcaaagtcgtcatcatctgcattctctggagttcaggagtga

SEQ ID NO: 87867 - DNA, 2037 bp, Glycine max
  Peptide Sequence Number=SeqID_204645
atggctgctaattgcaattatggcacagcccgagtttctagtaacaaaagtgtccagtctattgttaagtccgttggctcttatttagccaactcaagttggcaagcatttccacttggatcagagaataaatttgctcttcaaggactatatgtctctagtgtggctgaaaggtccaggctcaagacccagcaaaacaagcttgtaacaagttatgtggacagccttgatattcaatatctagaaaaagcttatgaattggttgaatgtgccattgaggaaggtaaacaagtcttgttagaaaaggaggtgctgatctacgttagctttggccttgcaaaagccagactaccagttccatcatcaactgtcttaagaaagatgatagctatcgagcatttcaccccagtcactgcttggtctgcagttttggcacacatgtcacaaacagcagagggaagttaccttgctgctgagttgattcttgaaataggttatttgttccagaataatagagtagatctgcgtaagaagagcaatgcacctttgatagccatgaaaccaaacgctgctgcttttaacattgctttggcagggtgtctcttatttgagacatctaggaaggcagaggagcttcttgatatgatgcctcgaattggtgtcaaagctgatgcaaatttactgataataatggcacgtgtatatgagagaaatgggcaaagagaagagctcaagaagctgcaaaggcacatggaggaagctccaaatctaaatgatttagagttccgacagttctataattgtttgttgacatgccatttgaaatttagggatctagattctgcatcaaacatggttttggaaatgcttaggaaagcaaaggaagcaagaaattctcttgcagctgccaaatttatgacaaatgctgctgaaattgatcatagccactctcctggactggcttctgtgcatagtttgaacaacagtaaagatttatatagtttacaaaataacaggccaattacaaatgctgtattatcttatgaggagttttctaaagatagaaatttcttaaagcttgaatcagagtcaaaagctatacttagttcattattagctaagttgcagatgcaggatttagcagtgtttcttctgaacgcagaaagagaagattctcccttttccaatgacaactcagccttggttcatgttattaatgcatgcatttcacttggatggctggatcaagcacacgatctccttgaagagatgcgtctagctggagttagaactggttcatctgtatactcctctcttttgaaagcatattgccgagcaaatagagctgcagatgtcacatcacttctgagagatgctaagatagctggcatccagcttgactcaagctcttatgaggcaatgattcaatccagggtgctccagcaagacacacagggagcactccaactatttaaagagaggaaagaggctagaattccaaaagtcactcaacaaaactctggcttgatggccaaaagtggtacagagactgatgaagctgggctggtgaccaagctgttgcaggaaatcaaggaagggcagagtgtggattgtggagttcatgactggaacaatgtaatccactttttttgcaagaagagattgatgcaagatgcagaaaaagctctaaagaagatgagaagcttaggtcacttgccaaatgcgcaaactttccattctatggtcaccgggtatgctgccattggagggaattatcaagaggtgacagaactgtcgggtgagatgaaagctcttgcttcttctatatccatgaagtttgatcaggaacttctcgattccgtgctgtatacgtttgtgaggggcggattcttcactcgagccaatgaagttgtgacgatgatggaaaaaggaaaaatgtttgttgacaagtacaaggctcagcaatacagcataaactgttttgcttttgttgcctgcacgggtatgcatctcaagaaatgggccatggaaaagtaa

SEQ ID NO: 87868 - DNA, 1200 bp, Glycine max
  Peptide Sequence Number=SeqID_204646
atgccagctatccttcaaaattcatttgcatttgattttctgggattggcattgcttaccctgtttttcttgttcaagctttcttggccaaaatcattggtcaagaagtggttcaatatcaagagcaaagctgaggattttcacgcagatgatgttctctcccaaggtgttgatgaagagtgtagcagcaactactcagaaagggaggcatgcaccatcaggaaaagcaaatcagagagatcaagcagatggtactcggacagaatgcgaagaggtaagaatgaccttgatgaagctcaggttacagatgtgtataactatagaatctttgctgccacttggaatgtagcagggaagtcacctccaagttatttgaaccttgaagattggcttcacacatctccacccgctgatatctatgttcttggatttcaagaaattgtacctcttaatgctggtaatgttttggggacagaagacaatggtcctgcaagaaaatggctagcccttattagaaggaccctgaacagccttcctggaacaagtggcggatgccacactccttcacccctccctaatcctattgtagagctagatgctgattttgaaggatcaatgaggcagaaggcaacttctttctttcaacgaagatccttccaatccttgagccgtagtatgagaatcgataatgatatgataaagccccaagcttgccttgagcgccgtctcagtgtctgtgatagagtgatgtttggtcacagaacgagcgactacgaccccaattatcggtggggttcctcagacgaagaaaacggcactggtggctctccaattacaacacaatattcaccaatgtcatatggcggttgtttcactacggaggacagtgatagacagacaggacactctagatacagcttggttgctagcaagcaaatggttggggtatttctaactgtttgggtgaagagtgatataagagatgatgtccacaacatgaaagtgtcttgtgttggcagagggttgatgggctatcttggaaacaagttgtgtatagagcagaggcaaggtcgagtctttgaaggatggaatgaagggaaaatatattttcctccgacttataagtattcaaacaattcagacagatatgcaggtgatgacagacgctcaaaacaaaagagaagaactccagcatggtag

SEQ ID NO: 87869 - DNA, 252 bp, Glycine max
  Peptide Sequence Number=SeqID_204647
atggattgtgcttgcttggttatctcagccaatgctccatttttccaacaacccattagccaagctcttgccctctccctctcacaagcatgcagcattaatggagttcctttacagtgcaaagggtacattgcagcttctggttctcctttaccagttccagatacgtttcggcctgaccctgcagttcttggaccggacagcccaactctcccttcaattgctaacatcacaattaagcccaaggtataa

SEQ ID NO: 87870 - DNA, 2421 bp, Glycine max
  Peptide Sequence Number=SeqID_204648
atgatgcttcttcttcttgtgatcctttttgttttacaaggttttccaataccaacatgctattgccagaccaatactcctcagaacattgaaacattttatccaattcaaacacccaaaccacccctcctaatccaacctcctgaggcacaaccaaagccacaagcatcaccaccatcaccaagaccagtggctgcatcaaaaacctcttcatcaagcagtaagatcggaacagcggtggctgcaacagcagcaggtactctagttgtttctggtttgattttcttcttggttcaaaggtgcttcagagcaaggaagagaaaggaggccaaaaacaacactgcttccgctgtggataggcgcgttgtgcctcaggtagacgtgttcaagagaatggaagggaacgtcaagggactaattgttgatgatgatggtttggatgtggtttactggagaaaactcgaaggtaagaaattacctgacaaggatttccaaagggaggttttggatagcaccgaagacaaaatagaagatgatcatgaggggaacaatgggaaaagatctgagtccattcaagaaactcttctgcttagagacagatcttcagcatctcacatgaatatatttcttccagaacagtcatatacaatcatgagaattccacctcctgctcctcctcccagtgttccttcatcaattggaggctcttctactcaactatcttctccaccctttaccccttcatcaccaaaaccactcaacacttttttctcatcaattccaaacacgtcaagtcctgcaccaccaattccgcctccaacaatacctgatagaaataatcaagcaccagcaccacctcctcctccaccaccaatcccgggtataaaaagctcagcactgcctctgcctcctcctccaccaatcccagttaaaaagagctcaacgcctccaccacctcctccaccaattcctcctagaaagagtccagcaccacctcctcctccaccaaaggcacatggtttgaagtcatcatcaaaaccaccacctacccctattgaaagaacaccaagtaccacaagtaaagaaggcaacacttcacctgaggtaaaactgaagccattacattgggataaggtgactaccaaccttgatcactctatggtatgggacaaaatggaccgagcattagctgatgacttcttaaacatcagggttgatgatgatcttatggaagctcttttcgggttagtggctgccaaccgaaatgacagtaccccaaaagtaaataattcaatgagtcctagcagggatgctttggctccatcagtgaataccttcattcttgaccccagaaaatcacaaaacattgctattgttttgaagtctctggcggtctcgcgcaaagaaattattgaagcactcattgatggtcaaggccttaatgcagacaccatcgaaaagcttggtagagtagccccaacagaagaagagcaaacacttatagttgcatatgaaggaaacccttcaaaacttgctgcagctgaatctttcctacatcacatcctcagagcagttccttcggcatttaagcgcttgaatgctttgttattcaggttgaattatgattctgagattgtagaaatcaaggagtttctgcagacacttgcactggggtgcaaggagcttcgaaaccaaggaatgtttgtgaagcttcttgaagcagtgcttaaggccggaaatcgcatgaatgcaggcactcaaaggggcaatgctcaagctttcaacttggtttctctcagaaagctctctgatgtcaagagtactgatggaaaaaccacattgcttcgctttgtggttgaagaagtagttcgtgcggaaggaaaacgcgctgttcttaaccgcaatcacagtttgagccgtagtagcagtaggaacagcaacagcagtgtggactctcaaaactctgctgtttcaaatgaacaaaggcaaagggaatacataacactaggattgccagttgtaggagggatcagttccgagttttccaacttaaggaaagctgcggttacagattacaaaagttttgttggttcaatctcatcactctcagctaggattgttgagattagagaacttgtttcccagtgtggaaatgacaaaggaggcaactttgtgagagaaatgaacaattttcttgaaaatgctgaggaggaacttagattagtgagggaggagcaaacaagggtaatgcagcttgtcaaaagaacaacagattattatcaaggaggatcttcaaaagagagtgcagaaaaccctctttatctatttgtcatagttaaggattttctgggaatggttgatcaagcatgcattgagattgctcgtaacatgcagaagagaaagacaaagacatctttgtaa

SEQ ID NO: 87871 - DNA, 834 bp, Glycine max
  Peptide Sequence Number=SeqID_204649
atgaacaacctaacttcatggaaagaggtttattcaggtccaactaaaattctcattaatccaagcacaagggtccgctcaaagaaatacaacgaagcacttaatgggttaattcaagaaattgggacaaacaatatggtgattgaacaagataatccaaagttattgtttctgtcatgcctgacctcctcaaggtccttgcaagatatatgtgtggggatttttgttttaggttggaagcttgcaagtattgaagttgagggattgtggatatttttgaaagagttacccttgaatttgtataaactcactattttatgccgtcttgatgtagaagcaaagcttcatgatgaatcaagattgattcaaatatgttttgatgattacaaagataatgacaaaggtgatgacaaaaagctcaaagatagaatcaagaacacttcaagattcaagaggaaagttgaagaacacttcaagactcaaaaggaaaagttgaagaacacttcaagattcaagaggaaagttgaattcaagaatcaagaatcaagattcaaggatcaagcttcaagatcaagattcaagattcaagattcaagaatcaagagaagacttaatcaagataagtatgaaaagagggtacatctacttgggttgttgactaaaaacaagagagggtacatctcttgtggatcagttctagtggagggtacatcctctaggttcaaagagaacaagggagggtacatcccttgtggatctttgcttgtaaaaggttttttacaaggttggaaaagaaatctcaaggaccgcaggtcgcttggggactggatgtag

SEQ ID NO: 87872 - DNA, 303 bp, Glycine max
  Peptide Sequence Number=SeqID_204650
atgccatataaaattggcgtcgaaaatctggaaaatatcaagttgaatctcaaaaccttaatgcatgaggtgggtacacggcccagtaaggaagaagtgggcccaagaaagcatcgaaaaagacacgcctctttggatgggcccaccttgagcctatggataatagaagtacgttacgtgggacaggaatataaagaagaatatagaacaggcactgtgcaagaaagtatggacaaaataccttccatcagcgaagagaggattgagattttcaaaaaggacaaaaatcagcctgtttattga

SEQ ID NO: 87873 - DNA, 852 bp, Glycine max
  Peptide Sequence Number=SeqID_204651
atgctgctgaggaacagatcaagggcagtgacaaagccaggtttgatggctgatcacagcacccagaattcttctcccaatcaaaactatgctaaaaccattataccctctctatttgggtcaccaaaattcagagatttcaccaacaagtgtctctcttcaggaactgaggccttaaggagcccaacttcaattcttgatgccagagcattatccccttttgcctttggaagcccattctcaacccttccaaacaaaagctcctcacaaaacagaacctgggacaaacctgattcaaaagggggcattggtcttgctcttgttggtgctctcaaagatgaagatacctcaattagtcacaattctgaacccaacaaaggaaatgttttgcttagagtgaaaatcccgtttgagtctcaatttcaaacatgtgtagatgattttggaaccaccaaaaccaataatggttcaaagaactcatcagggtcaggaatttgtgcaaaggattgttgtgattctccaagaagtggtggcgttctgtcttggagtgagatggagctttctgaagaatatacatgtgtgatatcccatggacctaacccaaaagccacacacatattcaacaattgcattgtggtggagacctattgttctctcccccaaaaacataactctcatcactctgctgctacctccgggaatttcctcagcttctgctacacttgcaagaaacatcttgaccagacaaaggacatctttatttatagaggagagaaagctttctgtagcagggaatgccgccacagagaaatgatgttagatgggatagaaaatctagagtttgaaaattga

SEQ ID NO: 87874 - DNA, 162 bp, Glycine max
  Peptide Sequence Number=SeqID_204652
atggcaacaatccggcatgtcaagtttcttacatcactcgctaaaccacaacatagaggggtaaaatgcgtcttagaaacttttgatttcgtgcaggtttcaatttttgttttctggggagatctggttgatccgatccacttggggttggtaaccgcgtaa

SEQ ID NO: 87875 - DNA, 771 bp, Glycine max
  Peptide Sequence Number=SeqID_204653
atggctcatgggatgaattcactacttacacccgtggccacaactacaaaggcttatccaacgtcaaaaactacttccaccatcttggctacatccctaaccctaatgcaccaccttttggacgacaaattcgacgacaccctcgtatccgccatcaaaacattccaaaagaactacaaccttgacatcaccggcaagctcgacaacaacactctccgacaactcacgacgccccgctgcggcgttcctgacataatcaatacaaacaccacgacacaacacactcagcttcacattcacacggtctcccactactccttcttcaacggcgcgccgcggtggccggcgggaacaagacaactcacgtacgcgttctccccggagctgaatctcaactgcgccgccaaaagcttgtttgcaagggccttcaacagtggggaccacaatgatgggcttccttttgatgggccgcttggggagtgggcccatgcattcgctcccaccaacgggtggtgccacttcgacgccgacgagtactgggtggcgtccggcgacgtcacgcaatcgccggtggcgcgtgcggttgaccttgaatccatagcagtgcacgagattggacacttgctagggttacaccactcgtcggatcagagagccatcatgtatgcttatttaccacctcgtactaggaaggtcaatctggcgcaagatgatataaatgggattcgacacctctattgtctctggatgctcctcaatgagcatgaataa

SEQ ID NO: 87876 - DNA, 1677 bp, Glycine max
  Peptide Sequence Number=SeqID_204654
atgtctccctcttccctccacgcgctcctcatcattctcttcctaggttccgcacacgcgctcaaggtccccttccgagtcaacgatgttctccccgttctcccccacggaatctcctggccgctcctcaacaacctccacagcgccgtcgacttgctcccttccttcgtcgccgccgtccctcccgataacgattccgttcagtggagagccgcatgcttttacgataatcaagcctccctcgaattcaccgcccccggccacgacgacgccgacggcttgggcggtgccgtgctccgtctcaagagactaactctcattcgaacccagtcccttgtgaaattgtcttacgtcaattatcatacggaccaagaattccggtttttggttaaaggatttagtatttctaaaatgagtaagacagaagctgctcacagttggacctgcatggatctgtatgtatttgcaacgccttataggattacatgggattactatttctctgcgcgagaacatactttgaagtttgattcatgggaagatcctgcagagttggaatatgtaaagcggcatggggtttctgtgtttctcatgccatcggggatgctgggaacgctcctttctctggttgatgttttgcctctattctcgaacactgcatggggtcagaatgccaacttagatttcctaaagaaacacatgggagctacatttgagaagcgcattcagccttggcgtgcaactgttgatcctgcagatgttcattctggagattttttagctgtgtcaaagatccgtggtaggtggggaggttttgagacactagagaagtgggtaactggtgcatttgctggtcatacagcagtttgcttgaaggatgaaatgggaaatttatgggttggtgaatctgggcatgagaatgagaagggtgaagaaataatagtggtaattccctggcatgaatggtggacattagctctcaaagataattccaacccacagatagccttgcttcccctgcatccagagttgcgtgcaagattcaactccactgccgcatgggaatatgcacggagcatgtctggcaagccatatggttatcataatatgatattcagttggattgacacagtagctgacaactatcctccacctcttgatgctcacttggtaatttctgtcatgtctatgtggacaagaatgcagccagcttatgctgcaaacatgtggaatgaagcactgaacaagcggttagggactgaggatttggatttgcatgacattctaattgagactgagaagcgtggtatagcttttgatcaattacttaccattcctgaacaagatgaatgggtatacagtgatgggaaatcaacaacatgtgttgcctttattctttcaatgtataaagcggctggaatattcggccctatttctagctccattcaagtaactgaattcacaattcgtgatgcatacatgcttaggatttttgaggataaccaaacacgtctaccaagatggtgcaacaatgagaacgatcggcatccattctgccagattcttggtgaatataggatggaattgcctggctataacaccttggatccttatgccaatatgaacgagcactgtccttcccttcctccaacttatgacaggcccttgaaatgttag

SEQ ID NO: 87877 - DNA, 564 bp, Glycine max
  Peptide Sequence Number=SeqID_204655
gggagcggaggacggtgcggcggcgccgccacaagactctgcgctcgctgcgaagccgttgcttattgctctctctctcaccagattgcacactggaatcgtcacaaacacgagtgtgatagtttgcaacagcaattgaaaagtgttgaagtcctcaacgattttcccttcactttctctcgcgaagccacgtttcagccacttacaatatatcatgctgctcgacttgttggagttaccgccttgaatcctgaaatcattggacctgagaaagagctgctacaacttgctgtgtttggagaattactggcactcttccctggtgtacgaattcatatagaacttgttggacctgcaattcctcctcaaagggatggtgagaagattcacatttctaagtatccttgttgcaatgaagacgaatgtgaatgcaaaataggaagtacagatacgttcttagaaacacaatctggtatcacttctgctttgacattgcaactttggcaaggattctatcatgaccgatatagagatattgttaaggtattgtgtaacaacatctga

SEQ ID NO: 87878 - DNA, 297 bp, Glycine max
  Peptide Sequence Number=SeqID_204656
atgtcggggacaccgcatcggagtcttgatggctgttattgtttcctcgtcaagagaaacgttgaatggcgtagaggattgaaggggaaacttttgttcgatattgtccatgtgattctcccatattccttgcttgaacgccttgcccccttttgcccttctcactttggcagtggaagaaggatggaaacggaaattcgccaaaagggattggtcgacaaggagaaggaatgcataaggtatggtttcatgttaacggctatttcttttagtctctcagagcttgagtctacttag

SEQ ID NO: 87879 - DNA, 1691 bp, Glycine max
  Peptide Sequence Number=SeqID_204657
ttggtgttgcaacgatacttgtcatgggtctcgagtttggtttatgggatcagtatggaacttttctgggttgccttaagctgggagattcaggttatgctaggaatgcagttctctgttcagttttgctttctatctgtacttgtaactgggagtctgttgctgtgttagttcctttgttcttcttcttcatccttcccgtcctcttcttcttcttcctcggacactcttctgcaggtttgaagaagaagaaagagacagattctagaagaaccatcactctgccaaaaacatacccattaattggttcttacctagccatccaagccgtcggcaaccgccgtattcagtggttgtccgatatggtcaaaatctcctccggcgctaccttcaccttccaccgccccttgggccgctcgcacgtgttcaccggcaaccctgccaccgtagaatacattctcaagacccgtttctccaattaccaaaagggcagaaccgctattaacattctctccgatttcctcggcacaggaatcttcaacgccgacggcaacacttggaagtttcagagacaagtagccagccacgaattcaacacaaagtctctacgaaaattcgtggagcacgtggtcgatgccgaactctccaaccgtctcgttcctatcctcgctttagcagcagcacaaggcaaaacgcttgattttcaagacattctccaacgttttgcgtttgacaacatctgcaaaatcgcgtttggcttcgacccagaatacctgaagccgtcagctgaacggagcaagttcgcgaaagccttcgaagaagcaacggagatcagcagcaaacggttccgcgagccgttgccgttaatatggaaagtcaagagagcacttaacataggttcggaaaagaaactaagaatagcagtgaaggaagtgctggagttcgcaaagcacatagtgagagagaagaaaaaagagctaaaggagaaggaatctcttgaatctgttgacatgctttcacggtttttaagttcgggacactccgatgaagactttgtgacagacatagttataagtttcatattggcggggaaggataccacctcagcggcgctgacgtggtttttctggttgttatcgaagaacccgcgtgtggaaaaggaggttttgaaggagataatggagaaatcagaggctccggtgtacgatgaagtaaaggatatggtttacacacatgcagccttgtgtgagagcatgaggttgtacccgccggtgcctttagacacgaaggaaacaatgaacgatgatgttttgccgagtgggacggtggtgaagaaggggatgtttgtgacgtatcacgtgtatgcgatggggagaatggagagtatttggggtgaggattgggcagagtttaagccagagaggtggttggagaagcttcaaacaggaaagtggaactttgtaggaagggattccttcacttatccggtgtttcaagctggtcccaggatttgtttggggaaagaaatggcttttatgcagatgaagaggttggtggctggtattctcaggcgcttcacggtggttcccacggtggctaaaggggtggagcctcactactttgccttcttgacctcccagatggaaggtggcttccccgttaagattctcgaaagggtgcactcagattga

SEQ ID NO: 87880 - DNA, 561 bp, Glycine max
  Peptide Sequence Number=SeqID_204658
atggcagcggacggcacgggagtcgccgtagttggagacgacgagtttgtccagcatggcgacgacgatgacgacggtggatctggcggcattgcagtggggagtctggagctcgcacctgtaggtgaaggtctggttgctctggctcctacgattaacctcgtcgtccatgcgagcgaatccattctccatcgtcagctttcactccaaattctcaatatgaacatgagagcaaccctgactgtcgaaaacgccaaagtagtggaagccttgggtgaaggaaggccgcaccaaaatggaatcttccatgtctcttctcctccgcaaactgacgtcacgccgaacttaggagaatcttcaactttcgacctttgctgcaacctccaggtgcttgtctccaacctctgccgcagcctccaagcgcacggctctgatctcgttgtgcgcgttaggaagcccgagacagtgctggcaaagctcgtcaagacgtcgtatcctaagtttgcaagagagagagaagaggaagaaactgttgcaaatgatggaggtgcaagagattaa

SEQ ID NO: 87881 - DNA, 1461 bp, Glycine max
  Peptide Sequence Number=SeqID_204659
atgatgagcaacctgaatgttgggggcactggcaatgaacgttttgaactatcacaacagttcttgcagagtgtttccaagtcaccatttccatttaatactggaaagcaagctgttaaattttctgcatggctggaggaaagaggcaaagacctcacagaagtgggcgctaatcttgctgaagatctacaatgtggggacatttttcatttgtttgctttagtctcatcgggtgaactttcaatttctccattcctaccagataatggtgttggagaggctgaagacttgagaagtgcaaagcgtaaatctgatactaccgagtcttcatatagtgataaagccaaaaagtcaaaatccttctttggagtagaaggtgaaattatttctcgtcgggaaaaaggatttcctggtatcatcatttctgcacaccgaacaacaatttcaagagctgatattttaaatttgttcaaggataatgataactatggccaaccttttgagggagatttccaattaaacattggccaaagcagtaattattcacttcctgaccatatcttggaaatcactaaatcttctgaccctgtacctctggaagaaaatcgtagtgaatcaccctgggaagctatggcaggctatgcacgacatttgttgtcagaatattccaataaaaaacatgcatatgccatttgtgctgaggtcttcagggttgtttatgctgccatccaaaaggctggtgaccaaggattaagcatgggagaaatttcccaggttataaacttgccaggagcagagatagatgtcttgattgttgatgctcttcaagcatttgggcaagccttaaaggtcaatgcttatgatactgtccgtgttgttgatgtcttataccgtcacaagtactttttgacacctatgtctgattttcatcttcatgttgtacaaccttcctcaacaaaaaccatcgagaaaagtgatcatacatgtgagctttatgaatcggaggaaagggatactacttctgttgatacttcgagagaaagaaacaccgctattgatagcgtgcacacattgacaattctcaatcttccacatggggatgtggatcctgaaaatcaagcttgtgataggaatgaaggctgtaagcaaaacagacttggtttatccagagtcaatcataagaaagaaactctcgaattttcttctggtgaatcatgtgtgccaatattgccatgggtcaatggagatgggaccatcaacaacattgtttacaggggactcagacgtcgtgttcttggaatagtgatgcaaaaccctgggatattggagatttctaacagaatcataaaagaagataagaaagatattttgagagagagagaacttgggaagcaagaagtgaaaaatgatattaagccactcaactttgtgttacagtttggtatatataggctagaatag

SEQ ID NO: 87882 - DNA, 276 bp, Glycine max
  Peptide Sequence Number=SeqID_204660
atggaggtggtggcaagcctgaatggtagggtggtgtttctggaggaggttattctctgtggcaggcctaaaatatattggagggttgggacaatggggatacatggtggcaatggagaggtggtcgaagaagacgacgatgggatggaagtacttattaggaagggagatattggagatctgagattgggatcgatggagccttttttggattttaatttgcttgtgtttgattgcttattggaagagaaggatgtgttagtgttgtctatgtag

SEQ ID NO: 87883 - DNA, 804 bp, Glycine max
  Peptide Sequence Number=SeqID_204661
atggtggtgagaatagcaatttcgggcaatgagaatagccacggccagcatcatgagagcaaggcaaagtccggcggagccgccggaggagtggcggtgacaccggcgaagagaggccgtcccttcggcagcggtaacaacagtgcctccgccgccgcttccgccgcggattcggcggctccgtcaaacctccttggtccttcccttcacgttcacaactcctttgccgatcagaacaataaaagaattgtcttggctcttcaaagtggtctgaagagtgagctgacctgggcgttgaatattcttacgctactctcctttaaagaaaaggatgacatgcgcaaggacgcaactccccttgcaaaaattcccggcttgcttgatgcgctccttcaagttatagatgattggcgtgatatagcactcccaaaggaattagccaagacaacgagggtgaggacgttaggtgcaagttctgttgtaactggatttgggtgtgaatatcaggcgctgggctcaactggtactcaccaccgccctggtgtaggatctggctctgctggtatagaatcaacgcagcagaatggcgtgacaaaatctcgtttttcggagttgtggcttgatgaagatagcctatttaatttagatgatgaagggcgaacagaaaaacagcaatgtgctgttgctacttcaaatatcatcaggaacttctctttcatgccagataatgaagttataatggtccaacatcgccattgtttggaaacagccttccaatgcatagaagatcatcttgtaggttag

SEQ ID NO: 87884 - DNA, 405 bp, Glycine max
  Peptide Sequence Number=SeqID_204662
atggctgaggaaatggatctccaacttcaacatctaacatggcacttgacgaaagtctttgaaaaagaaagagaagaattttgtaaaatgttagacagacatagaagaagtcatgagaggggaagcattaatggtacctatccaagaaggcctcataagcaaggcaccttgttaaagaatgcttcattgagaagggttaaacaccttgttgctcttgttcctagtgccctattgtattgtatcataccttggaataggaatgtcattcatcttgaagaagaaacctacaaagttgacatgctaggtattagaggcttaaattcgaggacgaatttccctaaagaaggaggggatgatgatagagatcaaggaaggcctctagacctaagaggaagaatcccttaa

SEQ ID NO: 87885 - DNA, 186 bp, Glycine max
  Peptide Sequence Number=SeqID_204663
atggctatgcaagattttgggtccgtccagcataatccgcaagctatgtgggtttggacgacgtggcttgcgaggcgggtgcggactaatgtattaagtttgtgtaagagtgcggataccattgtgggcttatgtcgggcgagacgacctgcttacccacacctaattttaaccgttgatggttaa

SEQ ID NO: 87886 - DNA, 271 bp, Glycine max
  Peptide Sequence Number=SeqID_204664
atgagatatgaaacactaatcaatttggtcattggaggggtcaaggatgagaaattcaaagggttgataaatgatggcataaagggtgatcacaaactcagatttcttatgcttgctcgtaggagatcatcatttttgaagctttggacacttcgagttgcatttgttatgctgctttggaccattgtagtgcaattcaaaggccttggtgacatggtaacaccatccatgttcaagactcgttcttctgcctcctctctaccacctcaaa

SEQ ID NO: 87887 - DNA, 777 bp, Glycine max
  Peptide Sequence Number=SeqID_204665
atggctccgatgaaggttcagccaattgcaattgacatcgattccgagaaggtgaaggcgaccacggcggcggtggtggtccggaacgagtcggtgctgaagtcgcgcctgagaaggttgttcgtctttgaccgccagttaccgaaaaacaacaacaaagatgccgcagaattcgaaccgagctcgttgtgcttggcgaaaatggtgcagaatttcatggaggagcagccaccggcgccaccgaaatgcggccgcaaccgctgcaactgcttcaacgccaatagctccgacgaggacgatttcgacctcttcggagccgcaccggcaccggaatcctccaacgccgacgccaccgaatcactcaagagcttgatcccctgcgcgagtgtcggcgagcggaacctgctagctgaggtggcgaggatcgttgagaaaaacggcaagtcgattaagcgaaaagacgatttgaggaaggtcgttgcggaagcgctttcctctctcggttacgattcttctatatgcaaatcgaagtgggagaaaacttcctcttgtcctgctggtgagtatgaattcatcgatgcgattgtggaaggagaaaggctgattgtggatgtggattttagatctgagtttgagatagcgcgatcgacgggaacgtacaaggcgatgctgcaatcgctgccgttcatcttcgtcggaaactcggagaggctgacgcagatcttggcgattgtttccgatgcggcgaagcagagtctaaagaagaaagggatgcac

SEQ ID NO: 87888 - DNA, 3316 bp, Glycine max
  Peptide Sequence Number=SeqID_204666
atgaacgaaacaactttcaacaatgtcgaaagctatctgtatcttcatcctagtgaaaacccagctactgcccttgtctccccagtactggattcaactaactatcactcatggagtcgttccatggtcactgctcttagcgccaaaaacaaattggagttcgtcgacgggactgcaccggaaccattgaagaccgataggctatacggggcctggcggcgatgcaataacatggtcgtctcctggatcgtccactccgttgcaacttccataaggcaaagtgtgctctggatggataaagcagaagatatttggagagatttaaaatcgagatattcgcaaggtgacttattgagaatttccgacctgcagcaggaagcgtcaacattaaagcaaggagccctttcaataaccgaatactttacccgattacgcgtaatctgggacgagatagaaagctttaggcctgacccaatctgcacctgcaacgttcggtgttcttgctcggtttccaccattatcggacaaagaaagctcgaagatcgagctatgcagttcctgagaggtttaaatgaacaatatacaaacattcgatctcatgtcttacttatggatcccataccacccatatcgaagatcttctcctatgtggcacaacaagaacggcaattattaggtaactgttctcctaatctcaatttcgaagctaaggaaatttccattaatactgcaaggtctgcttgtgaatactgtggacgaagtggccacacagaaagtgtgtgctacaagaagcatggtatgccctctagtcatgaaacaagatacaaaagcaatgggggaagaaagacctgtacccactgcggaaagatgggccacacggttgacgtatgttaccgaaaacacggatacccgccgggatataagccctacaatggaagaaccacagttaacaacatggtaacgatgaatgacaagtttcaggaagatcaaacccagcatcatgaagcccaagatcttgttcgattctcacctgagcaacataaggctctactcgctttaatccaacggccgtcgacgggaagcacggcgccggaacaaaccaaacaggttgcatccatatcatcttgtaccactgacaaaccttctatcccaggtatatcttcatccatcataagctcctggatactagattcgggagccaccaatcatgtgacttgttccttgaactatcttcatgcatataaacctattaacccagttgcagtaaaacttccgaatggtcaccatgacacgaacaaacgtacgaagattggtatagttgaggagagacatggcttatatcatctcattccagaccaacacaataaaactgtttgctcgaccattgtccaccctaagagcaatgttataccaattgatctctggcattttcgaatgggccatctatcaacagaaaggcttcaatgtatgaaaccccattatcctattctgaatcatgataaaaatttcgtgtgtaatacgtgccattatgcgaaacataaaaagctttccttttcctcaagcacttcacacgcattgcataattttgatttacttcacatggacatctggggtccttgttcgaaaacatccatgcatggtcataaatattttttaaccattgtagatgatcattcaaggttcacgtggatacatcttatgcattctaaggcagaaacacgagacatcattataggattcattacatttattgaaactcaacataacaagagagtgaaaacaatacggagtgataatgggcctgaatttcttatgcccggctactataaatcaaaaggaatcgtgcaccaaacatcatgcatagaaacacccgaacaaaacggtattgcggaacggaaacaccagcatttgcttaatgtaacacgagccttgttatttcaagccaacatgccacctaaattctggaactatgcattaatacacgcagcatatttgataaattgcatccccactccctttctacataacacatcaccatatgaacgtcttcatgggcatatacccgacatatctcatctgcgtgtttttggatgtttatgctatgctagcaccattaaagctaatcgtaagaaattggaacctagagctcatccttgtattttcattgggttcaagccaaacacgaaaggatacatgctttatgatttgcattcacataacatcatcacatcacgcaatgtcatattctatgaggatcactttccacagattgttgatacacaacattcatgcatagaacctagctcaactctaccagaacctttctctaacatccattatgaaccaattatagaaactacatcaacacaacattctgtacaagaacccataagccaaacacacacaatggaacccacttctccacagcctagacgctcaaaccgaagaacacaagcacccacatacctacgcgattatcaccatgctctctcctcactcgataccaacacttcaacgaaggctcgttaccctcttagctcagttctttcatactcacgactctcacccacacacaagcatttcatcatgacgatcacctccacaatagagccttcttcctatgctgaagcctcccaacacgactgctggattaaagcgatgcgtgctgaattggatgctctacaatcaaacaaaacttggagattaactcctcttcctccacataaaacggccatagggtgcagatggatatacaaaattaaacacagatcggatggttccatagaaaggtataaagctcgtctcgtggccaaaggttacacgcaaatggagggccttgactaccttgacaccttctccccagtcgcaaagctaactactgttcgttttctgcttgccgttgccgtcatgaacaaatggcacctgcggcaattggacgttaacaatgccttcttacacggcgaattagatgaagaggtctacatgcaggttccaccgggattaacaactccgaatccaaacttggtatgccgtttgcagtgctccctctacgggctaaaacaagcaagtcgtcaatggttcttaaagctttcgagtcttctaacagctcacgggttccacaagtctcaatccgatcattcactcttcctacgctttacagaattaaccaccactataatcttagtctacgtggacgatatcattctaactgggaatagcagttctgaaatacaaacgatgattaccatacttgatcacaccttcaaaatcaaggatctcggagacctgaaatactttctcggccttgaagtcgcgc

SEQ ID NO: 87889 - DNA, 637 bp, Glycine max
  Peptide Sequence Number=SeqID_204667
atttcctcttgaagaagctgggaccaaaggtgtcaagctttgttctttgtggcaggaaaatgtgaagaattcagcttggcatccatttaaagtggtcacagttgatgataaagcaagttttctaccagcaaaatggggggcagccttcgtgaatgaaaaagcagtttctttaaccttggaagacgatattgtgcagacccggaatgatgcttgcaaagattcagatcaaacatttataattttatatcttgctgcaaatagcaacttccatgagaggaaaaaaatgaatttttacatcaaagccgatagaaccaacagcaagacacaggttctagctgtaataagtgaaaagatttcgtttaatgaaagtactataggcaaaggtgccgaaaggcgtgccaaagccactgaggcatgtgtcgtgcattacagccttcagacattattttcttactttcaggttttgtctgtgacattggatgaatggtcaagtgatgaaatagatgcaatgattgaagttagaggaaattcttctgctaattcaatttatgagacttattttcccaaaggatatacaaaacctggaccagatgtcagtcatgagcagcatgcgaaattcatccgcccattgtcctag

SEQ ID NO: 87890 - DNA, 435 bp, Glycine max
  Peptide Sequence Number=SeqID_204668
atggatatcatgctctatggtatcctatgtcctatcacatatgataagaaggtgatgatcaattttctcataactgccaacctgacctatatgtacagactgattcacagttttctgttcaacatggtgatgcctagactggggtcacaagactatgttagtgatagggataaattctgcatgtacaaggtcatggtaggagagaaggccttcaaagacaagttcaaccctaagttgaaaggaatgacctttgtgaaaacgggaattgctaagaatttcctagaatacgctcagaagtatattaagaaaaaggttaagaaggaaccaaaggaagaaccacagtttgtggtaggacaggcgatggacactcaggatcaacctgttgatcttgagtctaaaattgtgtctctacagatacatggggagcaagcctaa

SEQ ID NO: 87891 - DNA, 615 bp, Glycine max
  Peptide Sequence Number=SeqID_204669
atgtctagcccaaccaatatgcaccttcaagctgcttatagggtccttcgatatcttaaaggaacccctggttctggcatttatctctccgccgtcggcaatcctcaactaagagcctttagtgactcggactgggcaggatgtcaagattccagacgctccatcaccgggttcattgtatatcttggctcctctcccgtttcatggcaatctaagaagcaaaccacggtttcccgcagctcatcggaggccgaataccgagctttagcttcaactacctgcgaactccaatggttgacttacctccttcaggattttcgaatcaaatttgtagaaccagctaccatatattgtgataatcattcagctattcagatcgccaccaaccccgtctttcatgaacgaacaaaacatatcgagatcgattgccatattgtccgtcaacgggttacttcgggtcatctcaagctgcttcctgtgcaatcttcctcacaactcgcggatatcttcacaaaggctttaccccctaccgtttttcagactctttgtaacaagctgggaatgttgaatatccattcccagcttgagggggggatcttaacagcttctagttag

SEQ ID NO: 87892 - DNA, 570 bp, Glycine max
  Peptide Sequence Number=SeqID_204670
atggctgagtccgatggctcagataacaattgcaagggatccacagacgatgaaatgaccctcatgtctaggaagttcaaacaaatgatgaaaaacaaagtaaagttccaacactcctccagaccaaaagacattaggcactttggtgacaagaaaaagaagagtctgatggtcacttgggatgactcaaacaatgggaagagcaacaactcagacaataagcaagccaaaatctgtctgatggcagacaaacaaaaagatgtatctataaggagatacaaatgtctaaggggtactaatgctcatggacccaaaaaaatttgggtgccaaaatctcatattgttcttgttgcaaatatccttggtaggaaaatgccagggtttaagctggtacctgaacagtggatgctcacgacacatgataattttaaagatatgcagattggtctgtctgttgcatccaagatagataaaataaaatcgtctaatgaaatccttcctcaatttggagaatcatcaagtcaacatcctcataccaaggattggaaatttgttaactatcacccttaa

SEQ ID NO: 87893 - DNA, 246 bp, Glycine max
  Peptide Sequence Number=SeqID_204671
atgacgaacgaagaacaccgaatgaagaatgatgtagaagttgattacggtcacaattcgatagcgcttcggcctcatggcattaagggtcatggcaactcgcccatgcgagctggttacttcacccctaagctatttgggggcccaggcgagccagaagctagcctgggcaagccagggttcagaaaaaggcttaaaatgacccttttgggtattttctgcattcttgatcaaaacattgaatga

SEQ ID NO: 87894 - DNA, 483 bp, Glycine max
  Peptide Sequence Number=SeqID_204672
atgggtttagaaaagagagaggtgaatctgaaggtgctcaaggtttcggaaatcgaatcgaaggtgctggatgctactgataatgaaccttggggtcctcatggtactgtgctggcagagatttcaaaggctaccaaaaaatttactgaatgtcaaatggtcatgaatgtcctttggacaagactgggtgaaactggaaaagattggcgttatgtatacaagatctctgtaaggaccattctcttgtatttagttaatttattcttgcaattaacaacagtgctgataagtagaataagagagtattttctcataatttactctggattggtaaaagcactttctagttttgaatatgtcgaacctagtgggaaggatgtgggactcaatgtaaggaagaaggttgaaaacattgtgtcacttttgaatgataaagataagatacatgaagtcagaaataaagctgcaaactgtgacaagtag

SEQ ID NO: 87895 - DNA, 669 bp, Glycine max
  Peptide Sequence Number=SeqID_204673
atgagagatgaggcattggagcctgctgatctctgtgaccgtaacatgagagtggtggatgttggaggaggaactagctttgccactcttggtatagtgaagcatgttgatgccaaaaatcttgccaaggctaagcagaaggaacccttgaaagaagatcttccatttccaactgattatgctgatagatatgtttctgctggaagtattgaatactggccagatccgcagcgtggcattacggaagcatacagagtgctaaggataggaggcatagcttgtgtgattggtcctgtacacccaacattttggctgtctaggttctttgcagatgtgtggatgctcttccccaaggaggaagagtacattgaatggtttaagaaggctggtttcaaagatgttaagctcaaaaggattggtccaaaatggtatcgtggggtgcgcaggcacggccttatcatgggttgctcagtcacaggtgtgaagcctttgtctggagactctcccctccagcttggtcccaaggtagaggatgtaaagaagcctgtaaatccatttgtgtttctttatcggttcattcttggtacaattgcatccacttacttcgtactagtgccaatttacatgtggatcaaagacaaaattgttccaaggggcatgcccatctaa

SEQ ID NO: 87896 - DNA, 3754 bp, Glycine max
  Peptide Sequence Number=SeqID_204674
atgcccgaccaccatacccgactcactaccacggacaagctcgaagaagctatccatcgcctctcggaaaaccacacctccctctcccagggccaccaatctctcaattccaagatagatagtattcactcatccctcacttcccaaatcgaatccctctttgatcgccttactgccatcaccctgcaacccaacaataccccttcccccaaccctacggcccacattcctccttcccctgcctctcgctaccatcacctcaagctcgatgttcccaggttcgacgaccatgacccactcggctggatatttaaaatatctcagttctttgattatcaaggtatcccggagctcgaacgcctcaccatcgcttctttctatatggacggcccggccctttcttggtatcagtggatgcatcggaatgggttcttttcctcttggccggcgatgctgcaagccttggaatcccgtttcgccccctccttctacgatgacccccaagggaacctgttcaagcttcaacagacgggctccgtcacagattacctcaccgccttcgaacgcttggctaaccgcaccatcggtatcgctccatcctctttgctgagttgctttatttcaggattggtcccggagctccgccgggaagtccaggcattgcggcccatctctctccctcaagcaatagaacttgctcggcttcaggaagacaagttgctcgaccgccgccgcggtccccggcctccgccccacccaccttccccgaaccccatctcggccttttccccgtcaccccctcccggtgccctcaccccgaaaacaccttcccctccttccctgccatccccgaagcttccgattaagcgcctctccgccgaagagctcgccgttcgccgcgaccaggggctttgttaccattgtgacgacaaatggtcccccggccatcggtgcaagtcccgtcttcacctgttcatcgcggacgaagacatactttcccctgacccttttcccgaacccgaccctgatcctaccctcatctcccagatcagcctaaacgccatggaaggctcccctaccccacaaacgttccgtctctacggctccattggccatcatcgtgtcatcatcctcgtggatggcggaagttcacacaacttcatccaaacacggcttgcccgcttcctccacctccccaccgcctccactacccctctccgcgtcatggtcggcaacggccacacccttgactgcgacaccgtctcccctcaaatcaccctcaccataaaaacccacccgttcaccttggacctccttcacctccccatctgcggcgccgatatcgtcctaggggtgcagtggcttaaactacttggcccagtcaccacagacttcgcaaccctaaccatgtcctttacctatttgggccgcccactcacattatttgctgatgtacccccctcaccctctcctgcctcggcccatcaactcaaacgccttgccaacacccatagcatctcggccctcttccacataacccccttaccagcccactcccctccccttccctcagaccaacaccctcaacccctccctgagcccataaccgctgtcctcacccgttattcctccattttttccgagcccacccaactaccaccaccacgcaccatccaacaccacatacctctccttcctactgcgtccccagtcaatgtccgcccttatcgctacccccactaccaaaaggcagaaattgaatcccagatcacggccatgctcaattccggcctcatccaacccagccaaagtcctttttcttccccaattttacttgtcaaaaagaaggatggttcctggcgctgttgtattgattaccgggcgttgaattccattacagtgaaggacaaatttcccatgcctacggtggacgagcttcttgatgatctcggcaaagcttcttggttcacgaagcttgatctccgacagggctttcatcaaatccgcatggccacctccgacataccgaaaacggcgttccgcacacaccagggccattacgaatttcgcgttatgcccttcgggctctgcaacgcgccctcaacctttcaatcggccatgaatgataccctccggccctatctgaggaaatttgtcgccgtattttttgacgacattctcgtctatagcagcgacctcccttcccatgtctctcatttggacacagtcctctcgaccctcaccacccaccacttctacctgaaggaatccaaatgtgtcttcgcccaatccaagctcaactacctcggccacattatttcttccgccggcatcgctcccgaccccgacaaaattcaagcaatggtggattggcccacccccacgtccaccaccagcctccgtgggttcctcggcctcaccggcttttatagaaaattcatcaaaggctacgcacatatcgctgctcccctcaccaccctccttcgcaaggaccagttcatttggtcccctgctgccacctctgctttcctccaattaaaggcccacatgacttgtgccccggtattggccacccctgattttacgattcccttcatcgtcgagaccgacgcttccgcggttgctatcggagctattctggttcaacaggatcacccgattgcttactatagcaaagtgctatgtccccgactgcaacgcgcctccgcttatgtcagggaattgcacgcgattacctctgcggtccgcaaatggagacattatctcctgggagcttccttcactatccttacagaccataagagtcttaaggagctcatgtcacaagtcatacagacgccggagcaacagacctacttggtgaagcttttggggtacgattatactatccgttataaacccggccacactaataccgtcgccgacgctctctctcgtatccctaccggcgaacttctctctctcacggtccctcactgtgacttcctgaacaccctccgacaggcattggcggctgatgatcattatcgtgacttactccaggctatcggaacgaaccccgaggaccatcctgctctctcagtccgtaatgggttcatcttcaaggacggtcgcatatggattcccttccctactcccctcaccgcgacattactcgaggaatttcatacctctcctctcggcggccacaccggagttgccaaaacactccatcgtctccggcagagcttcgattggccaaccattaagtctgatgtccaacaatttgtatcccactgcctcgtctgccaacaaacgaaatatgaaacgaagaaaccctccggcctgctccaacctttaccgatcccggcccgaatatgggaggatatgtctattgactttatcgctggtctcccgccgtcacaagggcatacagttatcatggtggttgttgaccgatattcaaagggggctcactttggagcattacccacccatcacacagctcaccaggttgcagtccacttcctcaacctcgtttgtaaactccacgggttccctcggagccttgtatccgacagagacgccttattcctcagccacttttggaaggaacttttccgtctcagtggtacgcaattgcgcatgaccaccgcatatcaccctcagtccgacggccagactgaggtcgtcaatcgaaccctggaacagtatctcagagcttatgtccaccacaaacccagtcaatgtatcgctatttgcacctcgcagagtg

SEQ ID NO: 87897 - DNA, 180 bp, Glycine max
  Peptide Sequence Number=SeqID_204675
atggctgttcaaaattctctccaaataactagaagtggtactggaggttatgatgatgatgggcgtgccaagatgactgtcatagtcgcgatttcgttgcaatccttgatgtcggggaagttgcagacaaatgtggctgatgtggctgcaattgtagtcacggaatctccaaaaccttga

SEQ ID NO: 87898 - DNA, 1856 bp, Glycine max
  Peptide Sequence Number=SeqID_204676
ttgaagctgaaggtggacactctgcgagcttgccaagttcttcattggaaggcactgaagaatatgagaagcaagaagagtcatgctttagagatcacctgttacaaacatatgataatcaccttaataatgagccttcaatccaacaagggaatgaaacaactgaagtcagacaacctgaaaagtctccaaatgatggattagttgaagttgaaggtggaaactccgagagcttgtcaagttcttcattggaaggcactgaagaatatgagaagcaagaagagacatatgaagaggaaacaacggttttaacagtaaatcctgtgaatgtgtcaaataatatagagattcaagaatcattaagtggacattctgatcatgaggagccagataaatttatctctgaaaaatcatttcaaggcacaaaatcgcatctagaagttaattttctagatactaattctcattctgagctgattaaggatgatggtttagaaaaagagatggaatcccataaaaaactgtgtgctgacaagtcagatggtaaggatagaaatgagtttgggagcagtgtgatagatacttgtggaacaccaccaagtattgacaacaccaatggtaattcattgaccaaggtaaattgtaccaccgaggattccctaacctcacttcttgactcttccattgtggataatccacttaagtttgaccatgaggaaaattacgaggtgctttatggagaaagtatattgagcaaaagtggatcaacaatggagaattcacatgattacaagccagatcaatgcatgaaagactcattgaaagaatacaagtctggcatggtgtatacatgtgatatggcaatagggtctaatggagataccaatggagaaagaaaaatgttacctgattctaatgcctgcaagcttgccaccagtgatcaagttgaagaacctaaagtcactgagaatggagtaccatttgatgttgatgcttatgttaacaactacaacaaggcttcagaggaaagtggcactgtttcagaccaaaaacattttgtggttcctgaagccaaaagggtttctcttattgcagggttaactgttgttgattgcaggcatgaggaaggggagagttacaagaataaaattgaagaatcagaagcttcacgtgtcatggacaacgtaaagcaagaccaaagttttactgctaccagcatgccaaactcagattggaagctagcaaatgagaccaaaaactttgccattgacaaccatgtttcttctaagttaacagttccatctgtggacttggttgatgatgaagcatttgagaaacgagaagaacatctacaacatgtaaaagcagcttcatctgcaggggcagaattaacaacttcaacagctaccatgtccattgaaccatcttcaatctattctatatttgcaaatggtggttatgaaacaagggacagtgtaacaaggctcagtactgaatcaaaccccgacaattccatctcttgtcagatgcaaaagtcaccaagcttcaatctcaacctcagaaaggaagcaagggcagaagaatcagataagattccattgcttcatcaggatatgtctgcagataaaagcttgtcaaaaaagactagtcaaaatctcatcaagaaatctaaagctccattcattggactcttgaaagaagaggaagaagctcatcttctaaacatgccacagatacaacataaccatgttggcacaaagaatgcagtgtcatctacttcacataaaagaaaagagaagcgaaagcctcggtcttccttcttcagcagctgcatatgttgtgcaactgtgccttga

SEQ ID NO: 87899 - DNA, 318 bp, Glycine max
  misc_feature (67)..(67): n is a, c, g, or t
  Peptide Sequence Number=SeqID_204677
ttggttggtaacccctacaaaacctttggagggccctcagtatcatccccagctacacctcttgtanccacaacaagtaaaaaccctcatgctatggcagaaataggaaagttggatcatctagaggaaaggctcagggccattgaagaaggtgaagattatgcctttgctaacctagaagagttgttcctagtacccaatatcatcacccctcccaagttcaaggtgctggactttgacaagtacaaggggactacttgccccaagaatcatctaaagatgtattgtcggaagatgggggcatacgttaaaagatga

SEQ ID NO: 87900 - DNA, 648 bp, Glycine max
  Peptide Sequence Number=SeqID_204678
atggctgcattccaaacctgcttgcaagtgtgggtcacatctttccttcttgctgatggattggttgttgttgtacaggcaattctagcttgttcctttgttgagaaagactatgaaagtgggttatggaagttcttatgtcccttcaagtatctcaaatggagacagatgatccaacaacaagttacatgctacattatggagactattgctcttagggacaaacgaattggaatcaaggctagtgttgtagaggaaaaagctacagcatgtagcatgctttgttgctatgttgatgagttgaaggaaggattctttccatggattgatcaggttggtggaactttagttccactccttaaattttatttccatgaggaggttagaaaaatagttctttcagcaatgccggagctattacgatatgcaaaattagctatagagaaggggcaatctcatggtcgggatgttactagcttgaaatttttgactgacagtctcatcccagctctggtggaagcattgcacaaggaacctgacatagagatttgggcaagcatgttggattcattaaatgaatgcttacagatctttgggatgctttttgatgaaagccaggtcagatccattgtggatgagataaaatag

SEQ ID NO: 87901 - DNA, 456 bp, Glycine max
  Peptide Sequence Number=SeqID_204679
atgtacaagttatttgtcctctgtcaaacctgtgccgccatcgcacctctatcaaactcgcgccacaaggcggtggtgttggaatgttgttcactttcacacggatctagaatgttgttcacactgtgcaattatcgtccaaaaaagctgcaaagcttcgttgttgttgctacacttgtgctgcgatgctttgccatctccaccatcaccaacgacgaacacttcatcatacctgacactcacaacaccaccttcaaggttgctctgtcgcgagtcctgactggggtcccttgcatagtggcgcactcactcttttgcgaagagtgcgatttcaatgatggcgaagtacatcgggatggtggcaatgtcgaggaaggagagggatttgggaaccgcaacgatgaactggtccttggttgttctctacttgtggaggaattgttcgatgaccgctag

SEQ ID NO: 87902 - DNA, 162 bp, Glycine max
  Peptide Sequence Number=SeqID_204680
atggtggggcgtgtgtgtgaagagattgctatggcgacggtatcatttaggaagagcttcttagctgtgactagagagtgtgtcccttcaccggaaagaaatcaaacagggccaacaaactatcattttcaaaccataagacaaagaaactgcagtttgtga

SEQ ID NO: 87903 - DNA, 1902 bp, Glycine max
  Peptide Sequence Number=SeqID_204681
atggaaaatcaacctgtcctcaaatgtctaaagctaggagcatgtgagcatcatcatcagcatcactatcatggatttggaaagctgagcatgggcaacgaaatgggaaataacaacacatctgctaccaaagaggaagataacataagtgaagccgagaaaaagactttccgagaagataccagtgaagttgcagatgggatgtcacaagatattcatgaagacaatgccaaggaagaaattcagaatgtaccaacatctaaagccaatgatgtaatggaaaaagcttcagaagcttccaatgatataacaaatgaacttgggaaaggtacatggcaagaagagggtcatgctgaagatcaaaaagagaaaactcaaacaatttcaacagttgaagccaaagatgaagacactcaggagaaagctatagggattgcttctaaccatacagcaagcatgcttgaaaatgattcaatggagggagatacccatgcaagtgatgtaaatatggaaaatcaaatgcctccaacagctgaagctgaaggtgttcaggaaaaagctgaaggactggtttctgaagatgcaacaacagaacttggaaaagtttcactgcaagaatatagtcatgaagattatgagaaagaaaaaatgcaaatgaatccaacagaagaagccaaagatgttcaggaggaagccacagggctaaattctagcagtacagcaagcatgcctgaaaatgatttgttgggagaagattcttgcaaaagtgacatgaatatggaaaataaaatgcatccaactgctgaagttgaagatgttcaagagaaagctacaggaatggcttctgactatgctacaagttcacttgaaaatgatttgttgaaaggagatgctcctgaagatgatgttcatgcagatcatcaaaagcatcaaataattgaaagcaaagtcgatcatcaacaaatagcagcaaggtcggatttcaatgataaaacaagtgaatttgatgataaacctcaggaagatcaacaagatgggaatgtagtaaatcctgctgcaaatggaatatatgttcaagaaaaaactatcattgtagcttctgatgctccgttgaattttacaaattcttttgaaggttcagctcaaggtggaaactctgagatcctgtcaagttcttcattggaaggaactcaagaatatgagaagcaagaagagacacgcttgagagaacacctgtcagtaacatataacaatcaccttaataatgaaccttcaatccaacaaggggatgaaacaactgaagtcagcatacctgaaaaatcttcaaatgatggatcagttgaagctgaaggtggaaactttgggagcttgtcaagttgttcattggaaggaactgaagaatatgataagcaagaagagacatgcttgagagaacaactgttagtaacatataataatcacgtaaatgatgaaccttcaatccaacaaggggatgaaacaactgaagccacacaacctgaaaagtctccaaatgatggatcagttgaagctgaaggtggacactctgagagcttgtcaagttcttcattggaaggcactaaagaatatgagaagcaagaagagccatgctttagagatcacctgttagtaacatataatattcaccttaataatgagccttcaatccaacaaggggatgaaataactgaagtcatacaacctgaaaagtctccaaatgatggatcagttgaagctgaaggtggacactctgagagcttgtcaagttcttcattggaaggcactgaagaatatgagaagcaagaagagtcatgctttcgagatcacctgttagtaacatataataatcaccttaataatgagccttcaatccaacaaggttag

SEQ ID NO: 87904 - DNA, 2958 bp, Glycine max
  Peptide Sequence Number=SeqID_204682
atgccagtgagacagatgagggagagctcagaacaacaccttgtgatcaaaccccatttgcagaaccccatgaatggagctaagaaggttcctagagctgttcaaaatggcaaaggtccaccaccaccgccactgccacaacaggaactaccccacaaccaaacttcacctcatgtaaggaacaaggggagaagaaggagcagaggtggaggaagaaaatgtgatcaaggagatgttttgatgagacctattgtggcaagtggtgttgaaaatggaagcaccatgtgtggtgaaatagagatgagttgccccacttcaagcaagtctttgagctttgctcctaggcctggctatggacaagttgggacaaagtgcattgtgaaggctaaccacttctttgcagagttaccagacaaggacttgaaccagtatgatgtcagtattacccccgaagtgtcttccaaagcagtgaacaggtccattatagcagaacttgtgaggctgtataaagagtctgaccttgggatgaggcttccagcatatgatggcagaaaaagtctgtacactgcagggccacttcccttttcctggagagagttcaagataaaggttgtggatgatgaggatagagttaatggccccaaaagggaaagagattatagagtggtgatcaagtttgttgccagggccaatttgcaccacttgggccagtttctagcgggtaaatgtgctgaagctccacaagaggcactccaaattcttgacattgtattaagagagctatcatctaagaggttttgcccaattgggaggtccttcttttcacctgatattagaacaccacaacggcttggagagggtttggaatcgtggtgtggattttaccaaagcataaggcctactcagatgggtctttcactcaatattgatatggcttctgctgcgttcattgaacctcttccagttgtggaatatgttggccagctattaggaaaagatattctgtcgaggcaattgtctgatgctgatcgcattaaaattaagaaagcccttagaggagttaaagtcgaagtaacccaccgagggagtgttagaagaaagtatcgagtttctggtttgacttgtcaaccaaccagagaacttgtgtttcctgttgatgagaattcaactatgaagtcagtagttgaatactttcaagagatgtatggtttcacaattaaatatactcaccttccttgccttcaagtaggaaatcaaaagaaggcaaattatttacctatggaggcctgcaaaattgttgagggacaacgatatacaaaaaggttgaatgagaagcaaatcactgctctcctgaaagttacttgtcaaagacctcgtgatcgagaaaatgacattttgcagaccattcagcacaatgcttatggtcaagatccttatgcaaaggaatttgggattaaaattagtgaaaagctagcttctgtagaagcgcgaattctccctgccccatgggtaatgtgcatctcaaccaagaggtgtaagatacttaaacttaaatatcatgaaagtgggaaagaaaagaattgtttaccccaagttggtcagtggaatatgatgaacaagaaaatgataaatgggatgactgtcagccagtgggcatgcataaatttttcacgaagtgtacaagacagtgttgctcgcactttttgtaccgagctagctcaaatgtgccaagtatctggcatggaatttaatccagagcctgttatccccatctacaatgccaaacctgagcatgtggagaaagctttgaagcatgtttaccatgcgtcaacaaacaaaaccaaaggaaaggaattggagcttttgttagcaatattgccggacaacaatggttctctctatggtgatctcaagcgtatttgtgaaaccgaccttggtttaatttctcaatgttgtttgacaaagcatgtctttaagatcacaaagcagtatttggctaatgtgtctctgaaaatcaatgtcaagatgggaggtagaaacaccgttcttgttgatgctgtaagctgtagaataccattggttagtgacataccaactataatatttggagcagatgttacccatcctgaaaatggagaagactccagcccttcaatagcagccgttgtagcatctcaagactggcctgaagtgacgaaatatgccggtttagtgtgtgctcaagctcatagacaggaactcatacaagatttgtacaaaatgtggcacgaccctgttcgtggcttagtcagtggtggcatgatccgagacttgttgatttcctttagaaaggcaacagggcagaagcctctaagaattatcttttatagggatggtgtaagtgaagggcagttttaccaagttctactttatgagttggatgcaattcggaaggcatgtgcttctttagaaccaaactatcaacctccagtaactttcatagttgtacaaaaaagacaccatacccggttgtttgcaaataaccacagggacaggaacagtacagataagagtggaaatatattgcctgggactgttgttgattccaaaatctgtcatccaacagaatttgatttttatctgtgcagtcatgctggcatccagggtacgagtcgtccagctcattatcatgttctgtgggatgaaaacaacttcacagcagatggaattcagtctttgacaaacaatctctgttatacatatgccaggtgtacacgctccgtatctgttgttcctccagcgtattatgcacatttggcagcttttcgagcgcggttctatatggagccagacctgcagcaggagaatggctcctcaggtggtggctccaaggcaacaagagcaggtggggtgtgtggtggggtgaagccattgccagcattgaaagaaaatgtgaagagagtcatgttttattgttag

SEQ ID NO: 87905 - DNA, 1986 bp, Glycine max
  Peptide Sequence Number=SeqID_204683
atgacgaggggaagatctgatggattgcaaaagaagcatttagttgcttccgtttgtggtgtggcaatctttcttggttttctatatgtgtaccatggatccatcattggttctcagaatagtggttcgtctgcacttgaatatggcagcaagtcattgaaaagacttggggcatcatatttgggtgcagatgatgatgctgatagcaagcaagatgaatcttcatcaagtattatgcagggagatggtgaggctgatattgtaccaaagagtttccctgtttgtgatgatcgtcattcagagttgattccctgcttagacagacatcttatctatcaaatgagactgaagctggatctttctttgatggaacactatgagagacattgtcctccttcagaaaggagatttaattgtttgattcctcctccggcaggatacaagatccctattaagtggccacagagcagagatgaggtgtggaaagtaaatattccacacactcaccttgcacacgagaagtctgaccagaactggatgattgtaaaaggtgaaaagatagtgtttcctggaggagggacacattttcactacggagctgacaagtacattgcatctattgcaaatttaataggtcttttcaagaccatgtttgacagtgttagttgtttggtgcattctgattatttaaattcactttcatctcatagacctcacagtgagtttgtattgcagatgctcaatttttcacaccataatctcaataatgaaggaagactgcggacggttcttgatgttggctgcggtgttgcgagttttggagcttatcttctttcatctgatatcatcgcaatgtccttggcgcccaatgatgtgcatcaaaatcaaattcagtttgctctagaaagaggaattcctgcatatcttggtgtcttgggaactaagagactcccttaccctagcagatcttttgaacttgcgcactgttctcgttgccggattgattggcttcaaagggatggaatactactccttgagctagaccggttgcttaggccagggggttactttgcatactcatctccagaagcatatgctcaggatgaagaggatcgaaggatttggagagaaatgagtgcccttgtgggacgtatgtgttggagaattgctgcaaagaaggaccaaactgtcatctggcaaaaacctctgacaaatgaatgctatatggagagagaacccggcactcgccctcctctttgccagtctgatgatgacccagatgcagtttttggagtgaatatggaagcctgcataacaccttactctgaccatgacaacagagccaagggtagtggattagctccatggcctgcaagattgaccactcctcctcctagattagctgactttggctattcaaatgaaatgtttgaaaaggatacggaactatggcaaggaagagttgagaattactggaatctattgggtccaaaaatctcgtcgaacacagtgaggaatgtgatggacatgaaagcaaacatgggttcatttgcagctgctcttaaaggaaaagatgtttgggtgatgaatgtagtacctcgtgatgggccaaacacacttaagcttgtatatgacagaggcctcatagggtctatccatgactggtgtgaagcatattcaacatacccccggacttacgatttactccatgcatggactgtgttttctgacattgaaacaagagggtgcagtaaagaggatctattgattgagatggaccgtttgcttaggcctacaggtttcatcatcataagagataaacagcatgtgattgattttgtcaagaagtacctaacagcaatgcactgggaagcagttgcaactgctgatgctagtgctgactctgaccaagatggcaatgaagttatttttgtcatccagaagaaattgtggctcgccactgaaagccttaggaatacagaatag

SEQ ID NO: 87906 - DNA, 222 bp, Glycine max
  Peptide Sequence Number=SeqID_204684
atggcaaatctgattctgaaaaacatcattggatcgaaatcaaatgcaaacatttccatgagcactgaaaaggccaaaccaaacgaacccagatggcaaagtgatccagatccagcaaaaaaatgcaaacctgatgcaaaatcagcagagaatgtgaagggagagaagaaaaagcttactgggatgggatcaaatctgaggaagttaagaactcagatttag

SEQ ID NO: 87907 - DNA, 558 bp, Glycine max
  Peptide Sequence Number=SeqID_204685
atgctgctgaagtacaggccggaggacaaggcggagaagaaggagaggctgttgaagagggctcaggctgaggctgatgggaaacctgttgaggccaagaagcctattgttgtcaaatatggtctcaaccacgttacctaccttattgagcagtactgccaaggttttaaattgcggttgtggctgccgttatccctcatcattaacaaggcacaactggttgtgattgctcatgacgtggacccaattgagctggtagtctggcttccagcattgtgcaggaagatggaaattccatactgcattgtcaagggcaaagcacgcttgggaacaattgtccacaagaaaactgcttcagttttgtgcttgacaactgtcaagaatgaagacaagatggagttcagtagaatcctagaagctattaaggccaacttcaatgacaagtacgatgaatacagaaagaagtggggtggtggaatcatgggttcgaagtcccaagccaagaccagggccaaggagaagctccttgccaaggaagcagcccaaagaatgaactag

SEQ ID NO: 87908 - DNA, 1440 bp, Glycine max
  Peptide Sequence Number=SeqID_204686
atgagggttgactacaacatgataatccacctccatctagcgaaaatacttctgcaagggccaccacctaaacgccaacgcattgctcaattagctacccggtttattgaaagtttcaacgacaaaatggatgcgctgatgacccattttggaaagattgctgacaaatgccagattattcacagttggatccttcaaaaagggatttggttggagagcacatatggtatacaacaagttatgcaattcctgaaacttgctcgccttcttatgccatacgtgaggaggctacatcttcattcggagccattgccatcacaaagcacctacaaatttaacagtattgatgatgctgtggctttgtttcaccacatggtcggtattcatcccctgccatcaattgtagaattcaccaaaatcttgggaaccattgggaagatgagatactatgccacagctattgatctttataccctaatggaatataagggtgttgtgccgtttatagttacttttaacatcgtgatcaactgtttctgccacgtgggtcggatggattttgctttctctgtaatgagtatgattcttaagtggggttgtcgaccaaatgttgtgacttttactacgctggtgaaggggttctgtgtgataaaatgctggatgcactatacatttacgatgaaatggttgcacgaaggattcgtgaatgaggcaagaaatttatttcatgggatgattgaaaggggtttggtgcctgatgtttggagctataacatcttgattaaaggttattgcaagtttgaaagagtgggtgaagctatgtatttacttgaagatatttttcttatgaatttagttccaaacattataacttacaattctgtagttgacggcttatgcaaatctgtcggaattttggatgcatggaagcttgttgatgaaatgcattattgtggtcaaccacctccagatgtaacctcttacaataacttgttagagtcttcatgtagaattgagcgtgttgaaaagacaattgcattttttaaacacctcatctttgaaagaagttttgcacctaatgtttggagttacaacatcttgattagtggttgttgcaagaatagaagattggatgaagccattaatctttttaatcatatgtgtttcaagattttggttccagatattgtaacatacaatatgttcttagatgctttattcaacgggcagcaacttgacaaggcaattgcattattagtccaaattgttgatcaaggtattagcccaaatttgcaaacatacaatttacttcttaatgggttgcacaaaggtgggaagtcaaagactgcacaaaagatttccttgtatctttccatgagaggttaccatccggatgtccaaacatatataatcaatgagctttgtaaaggtggattgtga

SEQ ID NO: 87909 - DNA, 198 bp, Glycine max
  Peptide Sequence Number=SeqID_204687
atggtggattttatctgcgaatatccacgggttgatagacctcatgcaactaaaatatactctgaggaagcaaggtggagtagaggcaaaatggagggtaagctagaactagaactaaatgagtcacctgagcaggaggaaacatgtccctcaaagtataaggaagctagaattggagctaagataaacccttgctag

SEQ ID NO: 87910 - DNA, 1767 bp, Glycine max
  Peptide Sequence Number=SeqID_204688
atggcgaagtcatcaaaacgtagcgtcggaaccagcaccaccgacaagaagaagaagaagagcaagaagttcggtccagaaggcgtggccatgaaagtgaaagccaacaacaacgccactgcctccaaccccttcgagtcaatttggtcgcggaggaaattcgaggtgctagggcagaagcggaagggcgaggcgcggcgcatggggctggcgcgctccctggcgatccagaagcgcaacaacacgctcctcaaggagtaccaccagagcgccaagtcctccctcttcgtcgacaagcgaatcggagagaaagacgaggcgctcgacgagttcggaaaagccatcttgcgttcccaacgcgaacgccagctgaacatgaagttgagcaagaaaagcaagtatcatttgtctgatggagaggaaaatgactttgagggaattgattctcttgggagagatgattttgaggatgagatgcttcctgatgatattgatgctgagactgatgagaaattagatttggttcaatggagcatgcagattccgggggaaaccagtgcggatgatggggaggaaaatagacataaaagcaagaaggaagtgatggaggaaattatctcaaaaagcaagttttacaaggctcaaaaggcaaaggataaagaagaaaatgaaaacttggtggaagaattggataaggatttcacttccttgattcactctgaagccttgttatctttgactgaacccaacaagatgaatgctttgaaggctctggtgaacaaaagtatttcaaatgatcaaagtaataaggaccacatgtctgctactcggacaatggataattctgtgcaggaaaaacctgatgattatgacaaacttgtcaaacaaatggggttggaaatgcgtgctcgcccttcagataggacaaagacaccagaggagattgctcaggaggaaaaagaacgtttagagcaattggaggaagagcggcagaagaggatggttgctgctgaagattcaagtgatgaagacaatgaagactcagaaaagccatctgaacagaaaccaagatctatatctggtgatgatcttggtgattccttttctgttaatgaacaaattatgaccaagaagggttgggttgatgagattcttgaaagaagagatgaggaagattcttctagtgaagatgatgatggtgaagatcctgacaatttgggaagctctgaagatgctgatgaaggatcaaatgaagatcttgatgaacacaagaaggatctttctttaaaagattgggaacaaagtgatgatgatgatattggtgcagatttagaagatgaagatgatagtgatgaaaatatagaaacagctgcagaagaccttgatgaggtaaaaggattggatgctgcagttcatataagagcaaaaagaaatgcttctgttgaaagtgtaaaaaaagataaggattcttcagatgccaagatagatgttgtaggaaaacagtcaaaagagttggacattccttatataattcaagctccgaagacctttgaagaattatgttcactggtattctatggagtattgttgcaatattttgctgttttggcaaataaggaaccacttaatgttgagttactcaatatgctggtgaaaccgttgatagagatgagtaaggaaatcccatactttgctgcaatatgtgctcgtcgcagaatagaagctaccagaaaacaattcattgagagtatcaaacaatcaggttga

SEQ ID NO: 87911 - DNA, 483 bp, Glycine max
  Peptide Sequence Number=SeqID_204689
atgaaggtcacagatatccttcttcaattagagaagaaacaaaagtggagttgttgcttaaacaatactcacaacacccaacaagaaagcgacaaaatcatgaggattaagaaggatattgagcacaaagttcttcagatatctaatgttgttggtccaagactgcattcacgagggacaatatcaaatgatgctgcaaaaaaggaagagaaacttgttgaaacctcaaaaagaaaacctcatgagggacaccaaccacatgcaaggggtttgaaactcagagggacatcagataatgatgctgcaaaaatggaagagaaacttgaaacatcaaagagaaaacttcatgagggataccaagcacatgaaagagatagaaggagcacaaggtactttgagggatatgaatgtgatcttcctaaaggcaagcatagccgcagaagctcacgcccgaagctaagcaatcgaaggaaatacagctga

SEQ ID NO: 87912 - DNA, 315 bp, Glycine max
  Peptide Sequence Number=SeqID_204690
atggcctccataaaacatatagctggaaaacaactcaaggatgtaatgttagagtgtttattggctttgtatgagggagagccttggaacaatggtaaagttactgctttgtggcctagaggtcacaggtttaaatccaggaaacagcctctccagtttccacttgtgggtgtaaagctgtgcacatctaccttccccaaacctcacttagtgggagccccatgtacttggtcgccctttatagtttgtttttggatctgtgcctatattttaacctttttggagtgtggtccctatttatacgattggatttag

SEQ ID NO: 87913 - DNA, 312 bp, Glycine max
  Peptide Sequence Number=SeqID_204691
atggtgggtggtccttttaatggatctaggataagttctaataccatcttagaatgtggttttggcctgaaccaattccaaaagttagctcatagggtgagggttgcctccacttatatactctatcttgatactatctctagccaatgtgagacttgggtttttctcaatacaccccctcacgcccaacacttttgggcttggtgcatggataacatggtggacaacccttttgatggatctaggataggctctaatactatcttagaatgtgggtttcggcctaactcaattccaaaagttagctcatag

SEQ ID NO: 87914 - DNA, 534 bp, Glycine max
  Peptide Sequence Number=SeqID_204692
atgcaggcctattctacagttggaacacctgattatattgctccagaagttcttctgaagaaaggatatggcgtggaatgtgattggtggtctcttggagctataatgtatgaaatgcttgtggggtatccacccttttattcagatgaaccaatgttgacttgtagaaagatagtaacttggagaactactttaaaatttccagaagaagctaaactttcagcagaggcaaaggatctcatttgtagactcctatgtaatgtggagcagagacttggaaccaaaggagctgatgaaataaaggctcacccatggttcaaaggtgttgaatgggacaaattgtaccaaatgcaggctgctttcatacctgaggtcaatgatgaattagatactcaaaattttgagaagtttgaggagggggacaagcaaactgtaccttcctcaaaggcagggccgtggagaaagcccatgggagacttgggtttcacccaatacaccccctcatgcccaacactttttgggctttgtgcatga

SEQ ID NO: 87915 - DNA, 444 bp, Glycine max
  Peptide Sequence Number=SeqID_204693
atgacgagcgaagggcccactggggatagtgggtccctgacactccctaatgcccaagtccctatcaaactatctcctaattcatatggtgctttcatgtcatggcttggacttttcctcagtgagattagtattttggacttttcctttattagcattttggatactaaaggtctcatgtccaatgccttgcctgctataaagaatggttgtcaagtgtatgatgaatcagctacggctgccaatcaacctgtcagagggagcttcttaaacctcttacctcctcaaatggaaatgggagttgatggatttggaagccaggtccctgaaatttctggttttggatggctgaattttttggctgactgggatattttccgtgtagaaaaatcaattaaggtgtatattcttcaatccaccttctatcaaactgcaatgtgttaa

SEQ ID NO: 87916 - DNA, 222 bp, Glycine max
  Peptide Sequence Number=SeqID_204694
atggggactagtgaaagattgatcatgaatcaggcgcttgaatcacttcagacggaattgaagactgatcctaattggggtgaaaacttatttgatgaagctacaaagacaatcattctgattgattttggagcagcacgtgattaccctaaaacatttgttgatgattatttaagaatgcttggttctcttcctttcaaatttatctctttatatcaataa

SEQ ID NO: 87917 - DNA, 1077 bp, Glycine max
  Peptide Sequence Number=SeqID_204695
atggaggcaattgctttgcgaagaacaaaagatatgacattggtggggctgccacccaaaaccattgagatttgttatgtcgagctttcttttgatgaacgtcaaatgtatgatcagttgaaacaggatacaaagatatttttgagtaggtatgcccatgatgacagtctagtgccccattattctgctgtactaagtaggattctaagacttcgccaaatctgtactgattcaaaactgtggaatgttcagtcgctactccttacaaatattgaagatgcctccaataatcctgaactgctgcaagcattacttgggcaggtgcaagatggtgaagattttgactgtccaatttgtttgtctcccccgatagagattgtgatcacacgttgtgctcacatcttctgccgaatctgtattctgagagctctacaaaataaaaacccatgttgtcctctttgccggcgccgcctcaaagaatctgacttgttctcagcccctcccgagtcttccaaggtagatagtgctggagagtgctcatcatcacaaacagtgttaccctccaaagtgtctacattgataaaacttcttacagaatcgagggaccaacatccagctgcaaagtctgttgtattttcacaatttcgaaagctgctattgttaatggaagagcctttgaatgcagctggattcaagaccctgcgtcttgatgggacaatgaatgctaaacacagggccaatgttattgagcagtttcaatcccaaggaatagatgggccaacagttctgcttgcaagcctcagggcttcaagtgcaggtataaatctgacatctgcctctagactgtacttcatggagccatggtggaaccatgcagttgaggaacaggcgatggatcgtgtccaccgcattggtcagaaagaggctgtgaagattgttcgattgattgctcaaaacagcattgaagaacaaatattggtgttacaggagaagaagaaacaactgcctagggaaccatctgggacaggattaaagggcatgggcataaatgatatacatttccttttagatcactag

SEQ ID NO: 87918 - DNA, 462 bp, Glycine max
  Peptide Sequence Number=SeqID_204696
atgaagcaagaagcaggacattcaggctctgctccatcgccatcacggttaagcaccctcaacgagaaactggaaatggttcttgcgactctgcctaaattaacaaatgaagagcacgaacaatgctgcaaaatggcgaagatcatgttgaagttcgcggttccactagatactattttaaacaccgttaacatttacggtgaagttagtaggtcatttgttgtgaggtggaaagacgtacttgaccgtttatggcatttcattgacaaggatggaaatttccataccgttgtctacaaccaagatttggacaaatcagctattatagcaaggtggacaacactaagagatttttatcacttgaccggagatcatcaagtgtcgttaactcattatggtaagagtgtattctttctcatcatattcaagagcagtagccttccaaaatcattctcaagatga

SEQ ID NO: 87919 - DNA, 585 bp, Glycine max
  Peptide Sequence Number=SeqID_204697
atggctattatagggttgtatgtagtatgtgatcaccgtacatgcccgatggccttgggaaaaggatatgatagtgcgaccatcatacacaatgtcccttatgcagatggtgtggttagggtgactgttgcaaaagcttatgacgatgatgctcaagtccctttttctgatgtcagagattcaaatttagacaatcatgtgccaaaaccggttggagttgtcggaaagtccaataaagtggttgcagttgatccgctgggtgaattgattcgaaaggtgtatgatttccttaggcctcagtctatacacaatgtaaaggaaagacatcatgaatgtcaacattacattgaaacaaggttcaaggaatcacaacgagaggtgtacttaggagcttacatgaatcatgcaatgaagacattaaacactagtttggaaggtaaattggatcaacctacacctcggtggattgaagtaaagtggttttatgatggaacaatgttagacaccaaggtcataacaacgcttcgcaagaaatgggcaacatattatttacaagttaaaagcaatgcatttagacagctttag

SEQ ID NO: 87920 - DNA, 1389 bp, Glycine max
  Peptide Sequence Number=SeqID_204698
atggattggcaagaagatgatcgtagtttcgagtcttcagaatcgtcagacaaatacctgttgggcttcatcatgtccaacatcgtgggcctgcagcaccactccggcaccctccacggcgagcgtcctctggtgggcctggcccgcgagccccacaacccgcacgaccctcacgccatcgtagtcctcaacacccacagcctctccgtcggctacatcgaacgctccgtcgccgccgccctctcccccctcatcgaccaaaacctcgtcaaagtcgaagccatcgtccccaccgcccgcaatgcccaccgcatcccctgccagattcacgtcttcgcccgcgtttccgacttcagcgccgtcgaaaacgccgtcgaggacgccgggctcaagatcatcaccgggtccgacgcctccttcaccctctccgactccgtcgccgtcaaggagacccgcgcgcagaagaagtcgtcctccgtcgacgccattttcaagaaagtcaaccgaagctacaccggcaagaaccctgctatccaaatcctggagcctccgaggaccatcatcagaacagagcttctccagcaccagaaggagggtctcgcatggctcgtccatcgcgaaaattccgatgatctccccccgttctgggaagaaaatgaaggcaaattcgtgaatatcttgacagattatcaatcggataaccggcctgaccctttacgaggtggtatcttcgccgacgaaatggggttgggaaagaccctaactttgctttctttgattgcttttgataaaaagagccaaatgggtgtctcgaagaagtggagaactgacagaaaggttgttactttggagaaaagaagaatgcgtgaaagtgagaatgaaagtgagagcagttcccctgagaagggatttagaacaaatgcaaccttggtggtgtgtcctccttctgttatgtcgacgtggatcacacaattggaggaacacactgtgcctggtgcattgaagacttacatgtattatggagaaaggaggacggatgatccttttgatctcaataggtatgatctggtgttgaccacatatggtattttggctggcgaacactgtatgcccaagatgccggctaagaatatgtattggcggagaattgtgctggatgaggcacacaccatcaagaatttcaatgctctgcagagtttggcggttagcaagttgaatgctcagtgcagatgggctgtcacagggacgccaattcagagtggttgcattgatttgttttctataatggtctttttgcggtttcaacccttttcagtgagacaacaatggagagagttggtgcaacgatctcttaataagggcaaagacaaagggcttgtacgtttgcag

SEQ ID NO: 87921 - DNA, 849 bp, Glycine max
  Peptide Sequence Number=SeqID_204699
atgaatacgataccagatttgttgaaagatgcatttgaacaagcaaagtttcttacttctggttatgaggacaagaaaatcattaacaagcttggtcttaactatatgaagatagatgtatgcccaaaagactgtaagttgtatctaggagatgaaaaacatttggaggcctacaacacatgtggtacatctaggtggaaacctaagaaaaagaaaaagatagccacaaagattttacattactttccattggaaccaagattgcaaagattgttcccgtgttttaagattacactagatataagatgccatgctttggaaaacaataaagattggtggttgagatatccaagagatggtgaggcatgtaagaagtctcttggaaataacatagatgtgtacttacgacccgttgtagaggagttgtgtgaactatggaatgatggcattgaaatatttgactcatcattgaatcaaaattttagattgcatgcaactcttatatggacaaatagtgactttcctggcttaggcatgttttttggttggaacacacatatgttattccctacatcattcttcacagttatgattcacttaactagtcaacttatagaggaagcagaacttggtggtctagtgctttatttatatatgtatcctattgagaggtacattgaagatataaagacaagtttcaatagacctaaacgtgtgtgtgatgaaccaaataataatgagacttcttttgtgtcctttatcttcccaccagttggtaaacatagcatgaatccacacacaatggatacaatgtctgttgatctaaagtttctggcacaagctccataa

SEQ ID NO: 87922 - DNA, 117 bp, Glycine max
  Peptide Sequence Number=SeqID_204700
atgaggatactaggttgccttgcagcggcgctttccgtttgtccagagctaggcaagggacgacgatctatcggtcgtgaccctagcctctacttgcgtccgtccctaagtacctga

SEQ ID NO: 87923 - DNA, 282 bp, Glycine max
  Peptide Sequence Number=SeqID_204701
atgtcaatctccccctgcggaactctagttacgagcctctatcagtcctacagggtgctcgtaccccccggcaaggtcatgccatcgcgacatagggatcacacccgtaggacacctagtggacccaaagaagtccaacagggtcctggggtttccagctctgattacgggcctctatcagcaacaggcaaaaaatgcatcgccgccacctccagagcccctcagctcatccacaaaaggcgaccaagtccaaagccaaaggacgcacctagttgctcatga

SEQ ID NO: 87924 - DNA, 687 bp, Glycine max
  Peptide Sequence Number=SeqID_204702
atggttagtgtggagaaaactaaggtttatgtgcccaaagatgtccagccagctctgatttgttcttatgtggaggaaattgaaaaatgtaatatgttgtattatcctcatagaaacaataattatatatggaaagatataggttggagtgcttgcttggaaggttgtgtgaagataaatgttgatgggtcagtgattgctggtggtcatcgggcaacttgtggaggagtgtttcaagatttcatgggaatctggttggcaggtttttctattaatcctggttctagtagtgtgctgagagctgaaatgtcagctattttagctgccttagagctagcctgggataagaagttaactaaggtctgcattgagagtgattctgcagtagctgtgcatttgattaatattcagaaggtgactaatcacccttttgcaacttatgttaggaaaatttctgtttggctcaatagagattggcaagttagtatttctcatattcatagagaggctaatgtagttgttgatagcttaacaactcatgggcataatttatctttaggttctcgttatcttgagactactcttgatgtttgtatgatcccgttatgggcagattttgtagttctttggtttttccttacagtatcaaaaaagagcatgtcatgtctgaaaccatctttgatttga

SEQ ID NO: 87925 - DNA, 384 bp, Glycine max
  Peptide Sequence Number=SeqID_204703
atgaaggccatggtcaaccaagaggggtcaattaatgagggtcatgacaaattcctaagagttgtggtcaaccaagacggccatagtcaatctgtaatggtccaaggcttcaacttcacttccgaccacagtcatggtggattcaccacgatcatatcctccaaaacaacgtcaaactccgacaatggtcgtggtcaactgatgagggtcatggtcaaccaagaggggtcaattaatgagggtcatggtaaattcctaagagttgtggtcaaccaagagggccatagtcaatctgtaatggtccaaggcttcagcttcacttccgaccacagtcttggtggattcaccatgatcatagtgcgtctttttgtgagatatctttaa

SEQ ID NO: 87926 - DNA, 363 bp, Glycine max
  Peptide Sequence Number=SeqID_204704
atgaatattgagggagagatcttacagagaaagatattatcaagggatcggaggcacctttctcaattgaatcacattgttgagcctttgacaaatgctccatatgttcatgatcaacgagttcttcaagatgatggtggcttatgcatgccctcttcatctaagcccaaggagggggatgtgcagatcctggaggggccattgtgtcaggagaaccaacatgttgatggatcaatggaggtggtcccaactacatcttgcatttatgttgtgcctaaggatgaagagcctaagtgggctcttactatagtttgtgggtctccaagagttgctactagacagagcctttgggaaggaatttag

SEQ ID NO: 87927 - DNA, 183 bp, Glycine max
  Peptide Sequence Number=SeqID_204705
atggataaaattgacatttttgtccctcatcctctcacaaacacatcttcgcttattcaacttccaccggaatatgagtgcaagccattggttgtgaaaacaaagatggataccttagagccctacactggggcaatgaggggcatcgtgcatgaacctcaagtgaacctaggggaagattag

SEQ ID NO: 87928 - DNA, 825 bp, Glycine max
  Peptide Sequence Number=SeqID_204706
ggaacaaaagctggtaccgggccccccctcgaggtcgacggtatcgataagcttgatcttgtggaagtccaccagtacgcgcgggtgttcggccagcagctgctggaactgctcaggcgtggtggcgtcgatgatctgcatcgctgttgctccagtaatgggccaggaccgcatcggtccaagcctcgatggccgcggcatggcgctcgccatgcggcatctgttcgatctccagcggcggatagtcgctgtggaagtagcggatcagccggtgcacagcaccgcagtagtactcctgcccccactgtgtctcgccggtaccgaacaccgccagctgccgcggccgctcgccgccctcggcgatgccagccacccatgccttcatctccgaaggcgtgcggccggcgttgtcggtccagcagcccagcagcaccaggtcggcctcgtcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 87929 - DNA, 228 bp, Glycine max
  Peptide Sequence Number=SeqID_204707
atggctaaccggaaaaactctgcaatgaggaaacaaaactttcacaggggtgagttcctgtgttgcacgagatatgggaaggagcgcaggttccatctcaagagcaaactagacattaagaattaccatgatgctttaaacaataaatgctgcacttgttctctttggccttatcaaaattggtacttagtcttgcaaaacacattatatgttggaaaaagatactag

SEQ ID NO: 87930 - DNA, 303 bp, Glycine max
  Peptide Sequence Number=SeqID_204708
atggcaaccattgaattgtcgagtagatatgggagcaagttagcatatgacaccggaatttggggtgaatcctacaggctttttgctgcaaaatcccttcctggttggtgttttgatttgtgctcaaggtggtgttttgcattggttgtgtggaaggtgggttttgtggttgatttagggatggcctttgtggataactgggtggtggcggaagacaaaggaaaagaggtgagaggaggcgccatccactggggaataagccatggaagaagaagcttcaccaccaagatgagccttggataa

SEQ ID NO: 87931 - DNA, 1041 bp, Glycine max
  Peptide Sequence Number=SeqID_204709
atgccgatcgtcgcgacgcacgcgggcgagtgcgagaagtgcgaggaggggatccgcgcaggtcagcggatcgagcgggtcgaccgtggcggtgtcggtgctgtctgggcgcacgtcgcctgcccgatgcctcgagcggtctgcgaggcgtggctgatggacgacgacacctatgggccggatcaggctccggtggccgagacgccgccgcatgacttggtcgcggagcagagcgctctgggcggcatgctcctgtcgaaggaggcagtcgctgacgttctcgagacgacgcgggcgaaggacttctatgtgccgaagcacgagatcatcttcagcgcgatcacgtcgctgtacgcggcgggcgagccgactgatgtcgtcgcggtcaccgatcagctgatcaagaccggtgacctgcagaaggcgggcggcgcggactacgtgcacatgctcacctcgatcgtcccgacggcggcgaacgcgggctactacgcgggcatcattcaccggaacgcactccgcaggcatctccgcgaggtcgcggcttccgcagcgcagatctccggcgatgggcggatggatccggtcgacgcgatcgaggacgtgcggcagatgctcgaccagatcggtgtcgctgggcagatctcgctccacgcgatcgggcacgccccgttcgatcagttcgtcgaggtgctcgagggcgggaagccgaaccacgtcgcgacgccgtggtgggacatcaaccggatcatcggcggcttccgcgaggggagcctgaacgtgatcgcggcgcgaccggcgcagggtaagtcggtgatcgcgttgcaggcggcgatccgtctcgcgatggagggtcctgtggcgttcatctcgctcgagatgggtcaggaggagatcgtcgctcgcatgattgctcagctgggcgaggtcgggctgaaggggctggtgaatcaagagatcgcctcggctgagtggcagaagatcgcgatggtccgtcagcagatcgcttcgcttccgctgtacgtcgcgacgtccgacgag

SEQ ID NO: 87932 - DNA, 636 bp, Glycine max
  Peptide Sequence Number=SeqID_204710
atggttcatggcccatgtggaactctgaatcttggatctccatgcatggaagaaggcaagtgtagtcgtttctatcctaaaatgttccagccacatactattttagatgctgatggttttccggtctatcgtagaagaaacaatggtcatgcaattgagaaaaatggtgttataattgataacagagtaactgttattttgattcatgaagataatgatgaaactcacaatggtggcactcataatgatgagatcaaagaatatctagattgcagatacatatgtccctgtgaatctacttggagaatctttgggtttccaatacatggcagaaaacatgttgttgaaagattacacttccatcttccaggccaacatagtgttctctacgaagaccatggtgatattgatgatgtattgtctaagctaagtatctctgattcaaagtttatttcatggatgaacaccaaccaaaattctgttgaaggaagaaatcttacttatgcagaatttgtttctaagtttgtatacaatcagaagaaaagatgttggcaccttaggaagaaaggctacaccacctggcagaatactatgggttccaccaattacaggggaattattttatttcgagaatga

SEQ ID NO: 87933 - DNA, 228 bp, Glycine max
  Peptide Sequence Number=SeqID_204711
atggatatctctgacgatactgacatacctgtaatattgggaaggccattcatgttggccactagctacatagttgatatggggaagaggaagctggagctaggttttgaagaccagaaaattgattttgatttgtttgttgaagacaagcctgttccagaacacaatgtttgcttacaggtaatggaaagaggtcaagaggttctgaagttaggaaccaatacataa

SEQ ID NO: 87934 - DNA, 747 bp, Glycine max
  Peptide Sequence Number=SeqID_204712
atggccatgcttactattctccttctaagcaaactactttctctcttctctaaatttgcagtcgcaacagataccatcacccagtctgagttccttgaagataacacgaccttggtttcaaacaatggaacctttgagttgggtttctttaccccgggtagtagtagttccccgaaccgctatgtaggaatctggtacaaaaatattccaatcagaaccgtggtttgggttgcaaaccgcgacaatccaatcaaagacaactccagcaaattgagcataaacacacagggcaacctggtacttgtcaaccaaaacaacaccgttatttggtcaacaaacacgacagcaaaagcatcccttgtcgtagcacagttgttagactcaggcaacttggttctaagagacgagaaagacacgaatcctgaaaactacttgtggcagagctttgactatccctcagacacgtttctacctggaatgaaattgggatgggacttgaagaaaggcctcaattggttcctaactgcttggaaaaactgggatgacccttcaccaggggacttcacacggtctactttacataccaataatcctgaagaggttatgtggaagggcacaacacaatactacagaagtggcccatgggatggaattggattcagcggtatcccctctgtgtcatctgactcaaatacaaactacacaattgtgtccaacaaggatgaattttacatacatatagcttga

SEQ ID NO: 87935 - DNA, 250 bp, Glycine max
  Peptide Sequence Number=SeqID_204713
caaaatcctcaggaatttaaaatccttgagataggtcctgggcatcctgagtctgggcctcctccttatctatcagatggaaaaataggggaatcagagagagcaacaacatctctagataaggaatcagaaagatcaacagcttctctagttggggattcagggggagcagtagcttctccagatggggaatcagagatgataatcaaaggtggagatgggggaactacttcaagctcaggagaagaag

SEQ ID NO: 87936 - DNA, 117 bp, Glycine max
  Peptide Sequence Number=SeqID_204714
atggtttccagggcttccgtggcttccgtagtgcttccgtacaatttccgaaaatcttggtcttcaaccggtaagtttccgaaatcgaatctttcaattcattctatgcacccttag

SEQ ID NO: 87937 - DNA, 1529 bp, Glycine max
  misc_feature (1413)..(1413): n is a, c, g, or t
  Peptide Sequence Number=SeqID_204715
gcactaccgctgccaactacaaggtcacactacaagacaccatcactgaagctgctaatgccggcaatgacaccgtgcaattgcgtttgctcggcagcaccgattacagcgctatggcaagtgccaccaccctcatccttggggctaaccttgagaacctcgatgcctcagatacagggtctaccaaactcaacctcacaggtaacgctctcgccaataccctcacaggcaatgatgcagataacatccttgatggcggtgcaggcgtagatacgcttgtcggggggagtggtaacgatacctatatgctggacctgaaactccagggcactggcgctggcgctactgtagtgattgaagattcggttactgagcttaacggtactaccgaaggtattgataccgttaaattacgtgggaccgctaacctcaccacagctacaacactgaccctggataatgactgggctaacattgaaatcctggatgcttctgctactggatcaaccaagctcaaccttaccggcaataatctcggcaataccttaatcggcaacgctgcagctaatatcctcatcggtggcactggcgacgatacgctcaacgggggcgccggggctgacatcatgacgggcggcgatggcgatgatatctatatcgtcgataacgtcggcgaccaagtcattgagaacgacggtgaaggtacggacgaagttagagccagcatcagctatacactctcagataacctagagaacctgaccctgactggcactgctgctatcaatggcactggtaacgagctggacaatacgattaccggcaatgctggaaacaatatccttaatggtggaactggtgcagacaccctcatcggtggcaaaggcaacgatacctatatcgttgatgacgtgaatgatgttgtcgttgagagcctcaacgaaggcaccgatcagatcaatgcgagtatcagttactcattagcattggctgcaaacgtcgagaatctcttactcacaggcacagatcacatcaacggtaccggaaatgcattggcaaataccatcacggggaactctggtaacaacacccttgacggcggtgatggcgtggacaaactcgcaggtggattaggcaatgatacttatatcgttgacctcgtccgcacaggcactaccactgccaactacaaggtcgcactgcaagacacaatcactgaagctgctaatgccggcaatgacaccgtgcaattgcgtttgctcggcagcaccgattacagcgctatggcaagtgccaccaccctcatccttggggctaaccttgagaacctcgatgcctcagatacagggtctaccaaactcaacctcacaggtaacgctctcgccaataccctcaccggcaatgatgcagatnacatccttgatggcggtgcaggcgtagatacgcttgtcggggggagtggtaacgatacctatatgctggacctgaaactccagggcactggcgctggcgcttactgtagtgattga

SEQ ID NO: 87938 - DNA, 840 bp, Glycine max
  Peptide Sequence Number=SeqID_204716
atggatgcgcaatcggtgatccgagtagatggtccaagttctgctggaatcaatctttacggcaatgcgctagataattatatatggggtaacaactacggcaattggataagcggtggtgctggcaacgatactctttatggtggtgatggcgaagatactttagatggtggagagggtatcaatattttagcgggaggcaaaggcagcgatacctacatcattcacagcaattcagacataatttatgaattacctaatgattatgcaatagaccaaattattacgtatgtcagtatcgacttagatttatacccaggtattgagtatgcccggattgcctatggagcgcagaatgtagtgatcagtagcagtacaggcaatatatatggtggtagtgataacaatgaccaattaattggtagtgctggcaacgatacatttctatcttctgcagggaatgacattcttacaggcggtctaggtgctgacacttttatttggagcattgcagacaaagggccaaatggaaaacctgccttagataaaatcacggactataactcagaggaagataaattagactttagagatttattgattggcgagtctagtgaaaatattcttaattacttgaacatcaccactagtatcgccgaaggtgtgacaaatactgaaattagaattagcaataccggtggttttactggcggcaattactctgcagcagtagaaaatcaacacattacattagctggggtgaacctactcgcaggtacgaatgaggctgatttagttgccaatttaattagccaaaacaagctggttattgatgcgtag

SEQ ID NO: 87939 - DNA, 773 bp, Glycine max
  Peptide Sequence Number=SeqID_204717
atggcagtttcacttcccgtgatcgggcatccacagcgcttttcttttcatagtcagggcctggatagccaagcattggccgagctggcctgtggtttaaaagcaacacaaacgcctttggtagtgctgacggccagtgcgtttgaagcgcaacgcctgatggatgaaattccgtattttggtaaagatattcaggtacatttgctgccggattgggaaactttgccttatgacgtgttttcaccccatcctgatttgacctcggagcgcctggccacgctctatcagctgagccagaatcagagcaatgtggtcattgtgcccatggccacggccttgctgaggttgccacctgtttcttacctggccgctcatacctttatgctcaaaaagggccagaagctggatgtagatgctttgcgtaaccagtgtgctcaagcaggctaccaccatgtgagccaggtcatggggccgggtgagttcagtgtgcgtggcgggctggtcgatttatatcccatggggagtgcgtttccctaccgtatcgatttatttgacgacgaaatcgagaccatacgcacctttgatattgatacccagcgcagcgtctatcctgtgccagaaatccgtatgctgcctgcgcgtgaattcccgatggatgaagcagccattacgcgcttccgcagccagttccgtgagtattttgaaggcgatccgcagcgcgcaaaaatttataaggatgtgagcaagggtacccctagcggaggtgtcgagtg

SEQ ID NO: 87940 - DNA, 126 bp, Glycine max
  Peptide Sequence Number=SeqID_204718
atgctggaggttcatgagcaacctcaagagccagttccagatgatgaacgtactgagttgaagttggcctctcatgggaggaaggtagagaaatttggaaggcctacacctgagatgaaggcatag

SEQ ID NO: 87941 - DNA, 2340 bp, Glycine max
  Peptide Sequence Number=SeqID_204719
atggggagtgagagcagaaataggtatggcaacggttgcggcggcgaaggcggcagtggagagctagttgcggcggaaaaggagatggtgcagtgcgtgaaggagatcgtgaactgcacggagtgcgagatctacgctgcgctcgaggaatgtgatatggacgttaaccgcgccgttgagatgcttctatctcaaggttttgctctaacgctattgtgtgttccttcggttgcgttcgttgttgttgcagtggaacgcaaaactggcactggcagtgatgacaaggttgtgcaaagtggattaacacgtgagacttataatgagaatggtaaagccaatgacaagggggagggtgggtcagtaggtgcttcagttatggctcccacaactcatgttgtgaggaaatgtacaaaacgtattgataatggaagacagtctttaataacaagacattctgtactagattctgcccaagcctctctaggacctgaaccctcaatgacaggaatgagcaaaggatgtctttcaatggcagacattgtaagaatgggtacaacatcgtcacaagacactgtttcacataactgtaatacctcgggaggagtttctgcatgtggaaattcagagtcaagcttaccacttcccagtcaaaaccattctgagcaacaagtttttcatgatgagtggccagcaactgaacaaccaattgctagaaatgcacaggaactaaacatgtctgcttcttctaatgccaatgggccatttgagcatcctagcttgcatgtaaatgcaattggtttacacaggaactgtgaattagacacagccccagtttcatggggggatgttgcttgtgataatgatgcttttgaaaaaaatgaatctgcttctatatctagagaacatactgttttgagcagcaacactggactacgatcccattccaactctaacttaaggaatactatttcctctgatcattgtagttcttatgggcatggtgaagacgtgtcatcagccgcttcaattttccagcggctaagtataggagaatccaaacagaaagtgccaacatttgaagatgatcctgcagtggttattccaattcatttacaagccttaggtgctgactgttcacatttgagttttggtacatataatggcagcagtactgcatcttctgtccttcttaattctaatcatctttcaaaaagtgacttggaagagaagtctgcagctagagataagcagcatggatttgatgttcttaaaggagcagcaggtgataaaaacagtgacatcctttcatctgataagcaatggtttgtgaagcatattgttcctgaggaaacttttgagaatgaacacatcatcaaggcatctgtatcagatcctagattgcaaaaatcacactgggagaatacttcactgccattgaagcagccaggggtgcagagtggaaaccatttgaattttccaagaggattgtatgctgactcaaattcaatacctggtgatgtgttggcgttgctcatgtcacaatctcaaactgcaagacacagtaacacagtttcatccataagcaatcctgccttctccatgtctaaggtcatggagccaggtgcctttcctctacctatgagatctgcacttccccgggatcctacagtgcattcctcatcacactttcatcaattgcctgacacaaaaggatatttttccctgccccagaataggtcatacaatacaaccataaattctcagttaccattttcaggcaatactgtatacaatcaatctccagcagacatgaagtacaaccttctacaaaatagaaatgaattccttacaaatagattgcctcctgccactgccagagatgcatttggctatggaaatcttggctcttccatttatagttctggaagctttctgtctaatccatctcctggtcatatgatgccttcaagtaactttaatgagattttaccttctcagtataatggtggacgtaacataaactctattcaacagcatggtagcttttctcattgggattacggagccgagccaagatctttgtttatcccgaagagaacccagtcacagtatgctactcctggatatgctgaccttcatcattctgagacacgggttttggaaaaatatcagcagccaggtgattttcaagatttgccatccaagcagttgcatccattttggcaacgcgacaaccttcatcattctgagacacgggttttggaagaacatcagcagccaggtgattttcaagatttgccgtccaagcagttgcatccattttggcagcacgataactaa

SEQ ID NO: 87942 - DNA, 579 bp, Glycine max
  Peptide Sequence Number=SeqID_204720
atggtgactcatcaaagtgaagatctaaagagaagatacactactggagatgcgcatacttatggacataaaataatcctcaaagtccaccactcaaagggacatcaccacaccaatcactacaattcccaacttagttcccatcactcaacaaatccaatcctgaatcctaattccaaccctgatacagtctctccagcctccacactcccaatcacaactcctaccatgccaaacaactctccagtgtcctcttcaggtgcaagctggtgcactgcaagcccaacatcctcacaaagagccttacaagtgggattggactatgcttgtggatatggtggcactgattgttctgcaattcaacctggtgggagctgctacttcccaaactctgtcagagaccatgcttcttatgccttcaataagtattatcagaagaatcctgttcctaatagctgcaattttggtggagctgctgtcatcactagcaccaatccaagtagggcctctactgttatgattcttaatgttatgaccttactccttagaagactattggaattgttttgtttgatttga

SEQ ID NO: 87943 - DNA, 1455 bp, Glycine max
  Peptide Sequence Number=SeqID_204721
atgtcaggaaacagttctttgcatgtgggattatcgaggaagacttcgtttttgggattgcgattatgggttttgattgggataggtgttggtgtttttatagttgtgattctttgtgtattatctgcatgggtgatgtttcggagaaagtctcggggatctctggacaagtactctttgtcgcaaataccacatatctcaaaggacatcagagtcgacaaggttggggtgcagacttctcacgatcaaccggacagtgtagctattcctgtttatgacaaaccgagtgagaacaactcggacaagttcttggctcatttgagcaagaacaaatccggcgatgctgataatatcagtcagtgcagctcggtttatcatcatgagagaggatttagttcaatgtcgggggaagaaggaagctccgggactgttaagaagcagtctgcatcgtcatttggaggaatggtaacagcatctcctctagttggcttgccagaattttctcatctcgggtggggccactggttcacacttagagatctggaaattgcaactaatcgcttctctccagagaatgtgattggtgagggtggatatggggttgtttacaggggaagcttgatcaatggatccgaggtggcagtgaagaaaattcttaacaacttgggacaagcagagaaagaattcagggtggtagtagaggctattggccatgttagacataaaaatcttgtacgattacttggttattgcgtagaaggggttcacaggttgctggtatatgaatatgtgaacaatggtaacttagaacaatggctacatggggctatgagccaacaagggacacttacctgggaagcccggatgaaagttataactggaacagccaaagcgctagcttacttacatgaagcaatagaaccgaaagtcgttcaccgggatataaagtcaagcaacatattgattgatactgatttcaatgcaaaggtttctgactttggtttggccaaacttttggattcaggagaaagtcacattactactagagtaatgggaacatttggttatgtggcaccggaatatgctaatacaggtttgttaaatgagaggagtgacatttacagctttggtgttctcctgcttgaagcagttactggaagggatcctgtggactactcacgtccttctaacgaggtgaatcttgttgaatggctcaagatgatggtggggacaaggagaactgaggaagttgtcgactcaaggcttgaagtgaaaccatcaatacgtgctttaaagtgtgctcttctagttgctcttagatgtgttgatcccgaagcagaaaagaggcccaaaatgagtcaggttgtgaggatgcttgaagccgacgaatatccattccgagagttagttatgctcaaccatgaggctaatgatagtatcactgtcatggaatag

SEQ ID NO: 87944 - DNA, 99 bp, Glycine max
  Peptide Sequence Number=SeqID_204722
atggaatacgattcgctttcaagatgccttggtggtgaaatggtagacacgcgagactcaaaatctcgtgctaaagagcgtggagatcgcaaattctag

SEQ ID NO: 87945 - DNA, 579 bp, Glycine max
  Peptide Sequence Number=SeqID_204723
atgccgatctccctctacgaaagtatcgattggtctgtgccatcccgacataggggtcgcgcccacaagacacacaatggacccggaggagcccaacagggccctggggtttccagctcgggttacgggcctctgtcagtcctacatgtcctcactttcagaggactacatgtcctcacttttagaggactacacgtcctcaccttcagaggactacatgtcctcacttttagagaactacgcgtcctcaccttcagaggactacacgtcctcactttcagaggactgcatgtcctcaccttcggaggactacacgtcctcacctttagaggactgcatgtcctcactttcagaggactacacgtcctcacctttcagaggactacacgtcctcaacttcagagggtttcacgccctcgccttcagaggactagacgtcctcgccgtcagaggactagacgtcctcgccttcagaggactacacgtcctccacttcagaggactacatgtcctcgccttcagagggctacgcgctctcgccttcagtgggctccacattcgcaccttaagagaatttaa

SEQ ID NO: 87946 - DNA, 279 bp, Glycine max
  Peptide Sequence Number=SeqID_204724
atggcacacgaaacgggaaaagctgaaaaaagtgaaattcctcatggttcatctttattgaaagctgtgaggaaaagtgcggtggaagaaggaagagaagcattgaaattaggagtttttcgaggctatggcgtaaacaagctaggcaaaagagagaaaacattgctccaccaaatattcggatcttcattgccaagattcaaatcaatattgtgcctgggatttttgaaactggaagggggagcagacgagatgaaattagttagtcaaacgggatga

SEQ ID NO: 87947 - DNA, 2496 bp, Glycine max
  Peptide Sequence Number=SeqID_204725
atgtattcagcagttgttgaatgctatgagactctcagggacatcatactgaaccttctgcttgatgaagatgatagaagggttgtgatgcgtatatgcggtagagtagaagagtgcatacatgaagaaaaatttgtcaaggaattcaatatgagtggcttaccttcactcagtgagaagttagaaaaattccttactctactgagatctgaagatggcaaactagaatcccagatagtcaatgtcctgcaagatattgtagaaattatcatacaggatgttatgtttgatggccatttgttgctgcaaacacctcagcaaacacctcacgaatatcatgtagagagagggcagaagtttgtcaacattgacacttcttttacacataatacatcggtgatggaaaaggttattaggcttcatttgcttttaacagtcaaggaatcagccataaatgtgccccaaaacatagaagcccgccgccgtattacattctttgcaaactccttatttatgaatatgccaaaggctcccaaagttcgggacatgttgtccttcagtgttctgacaccctatttcaaagaagatgttctatattctgatgaggaactcaataaggaaaatgaagatggaatatcaattttattctacctgaaaaagatatatcctgatgaatgggccaatttcaatgaacgagtaaaaagtgattatcttgaagaagataaggagttaattcgtcagtgggcatcttacagaggacagacactctatcgaacagctctctctgaaggctaccggacaatggattcctatgaaaaaaataagaagcttctcgaagaggcacaagccatggccgatttaaagttcacctatgttgtttcttgtcaagtgtacggttctcagaagaagtccaaaaatactagagacagaagctgctatactaacattctcagtctgatgttaacgcattcagcccttcgtgttgcttacatagatgaaacagaagacacgaaggatggaaaatctcagaaagtttattactctgttcttgtcaagggaggggataagtatgatgaggaaatatatcgtatcaagctaccaggtcctccaacagaaattggagaagggaaacctgaaaaccaaaatcatgctattgtatttactcgtggagaagccttgcagaccatagacatgaatcaggataactattatgaagaagctttcaaaatgagaaatgtattggaagaattccggagaggacgtagtggacaacggacgcccagcatattgggtataagggagcatatatttactggaagtgtttcttcacttgcttggtttatgtcaaaccaggagaccagtttcgtgaccattggccaacgaattttggcaaatcctttaagggttcggtttcattatggccatcctgatatatttgacagactcttccacataacaagaggtggcataagcaaagcatcaaaagttataaacttaagtgaggatatatttgcaggtaaggggcgtgacgtgggcatgaatcagatatcactctttgaggctaaggttgcaaatggaaatggagaacaaacacttagccgtgatgtttatcgacttggacgacgatttgatttctacagaatgttgtcattctacttcacaacagttggattctactttagtagcatgataactgtgttgaccgtgtatgtgttcttatatggacgtttatatatggttttgagtggagttgagagagaaattcttcaaagtccaaacatgcatcagagcaaagcccttgaagaggccttggcaactcaatctgttgttcagttgggcttactgcttgtgctgcccatggtgatggaaattggcttggagaagggatttcgcactgccttgggtgattttatcatcatgcaacttcagctagcctctgtgttctttactttccagcttggaacaaaagctcattattatggaaggacactcttacatgggggctctaaatatagaccaactggtcgtggatttgttgtcttccatgcgaagtttgctgataactacaggatgtactcacgaagtcattttgtgaagggcctagagatactcatactattgattgtttatgaagtctatgggagctcatatcgcagttcacatctttatttattcatcacaatctcaatgtggtttttagccacttcctggctgtttgctcctttcttgtttaatccttctggctttgattggcaaaaaacagtggatgattggacagattggaagcggtggatgggaaatcgtggtggtattggtatttcatctgataaaagctgggaatcttggtgggatgaagaaaatgaacacctgaaatactcaaatctcaggggaaaaataattgagataattcttgcatttcgcttctttatgtaccaatatggaattgtctaccacatggatattactcatcataacaaagatttgctggtagagtaa

SEQ ID NO: 87948 - DNA, 435 bp, Glycine max
  Peptide Sequence Number=SeqID_204726
atgtgccatgaagtctataacattttagataagaatcttgctcgtgtgactgggagcacagacctagtagaaggacgagatgatgaacattttctgagggaagttataactcctatatatcaagttttaatgaaggaagcaaagagaaacaacaaaggcaaggcaagtcattccaattggagaaattatgatgatcttaacgaatacttttgggcgtggatggcctttattgaattagagagatatgtcatgagttttgatcgaatgtggatattctttatattggctttacaggcaatgatcatcatagcatggagttccttgggacctgttggatttttttttgatggagatgtcttcagaaatgttatgactatattcattacttatgcttttctcaattttcttcaaggtactggattcgtttatgtctga

SEQ ID NO: 87949 - DNA, 240 bp, Glycine max
  Peptide Sequence Number=SeqID_204727
atgtaccctaaggctcatgagaaccctagggtcttctcttgcatctttggcctaatcttcttagagtcttctatccaatgcccttgggggttaggattgcatcagcgtcttctggccgagactaggaaaatgtctcatttgctatcccttgcagtgactaacatcgtcatctgcaccttccctggcgatgccaacatcttcaggtcgagattgcgaagaagtctcatttgctatccgtaa

SEQ ID NO: 87950 - DNA, 1388 bp, Glycine max
  Peptide Sequence Number=SeqID_204728
ccatggcaggcattaatgtctcagaatatgctcatagttctgtgcacaaggccataatattgaaggatcatgctggtcttaaggagatacttggagttctcccaaaactaggtaacccccttgagatcaaaactgaggctgcttcaatagctgaggatgagaaagctgcagccatctctgttgtggtggataggagggatgtgccacatggtgacacccctcttcacatggctgcaaaactgggtgacattgttgctactgaaatgctcatggatgccggggcaaatggtaggttgaagaacaaggaaggatggactgctgttaggcaagctatcattaacaaacaagataaaatagcaatggttatgatcaagtactcttggaatgaccctgacaacaaatattttagaaggttgcctaggtatatagggactatgagaaggatgaaggacttctacatggagatttcatttcattttgagagttctgtgatacctttcatctcgaggattgcaccttcggatacttacaagatttggaaaaagggtgggaatatgagggcagatatgactttggccggctttgatggtttgaaaatcaagaggtctaatcagagcgttcttttccttggtgatggtacttcagatgatgagagcaaatttcccggatcgctgttcaaagtcttgcacaaagagaagaaagtatatgtggtttcacctagtttagatgcccccactgatagagatgttaaggacacattagctaagaagtctaggtctgaatcagtgaggagggtagggcttgatgtgagtcaggcacttcttgttccccagttaacatggaggagaaaggagagaaaagaaatggtggggccatggaaagctaaggtgtatgacatgcaaaatgtggtttttagtgtgaaatccagaaggatccctggtgctccaccacctgaggcgaagccagctcctaagaaaactaagaagaaggacaatggaaaaattgaagacattttgacagatgaagaaaggaagcaatttgaagctgcaatgaattcatcagatgataatggccacagtcacaatcgtgcgaagaaagaaaagaaaggaaggtctggtggacatagagaccacaaggagagaaaaaccaatagtgcacaacctgctgagcattttgtaaaccagaagggtgaaagccagtttaagagagggatgatgcctgctctttggctttcccagaacttcccactaaaaattgatgaattgctacctatgcttgacattcttgctgaaaaacttaaagcggtccgtcggttaagagaactccttacaacaaaacttccaaaggaatcctttccagtcaaggtatgtcctctctctgttctttga

SEQ ID NO: 87951 - DNA, 228 bp, Glycine max
  Peptide Sequence Number=SeqID_204729
atgacatggacggaagggaagaagaatagcggcggcacaaacgaagggaagagaagaagattgacggtggcgcaaatggaagctcactgtgctggtgtacgaaggcgtaaaatggtgttgggtgcaccaaaatcttttaaattaaggccaggggggtctttatccacccaaaccatgatgatgatgaggaacgttcctcttctgggttctcttggtcaccagaagtag

SEQ ID NO: 87952 - DNA, 441 bp, Glycine max
  Peptide Sequence Number=SeqID_204730
atgaagccacttgaacgtgataagtatattgatcgacatgggctaaaggatgatttttttttacgtgatatattttggacacgttcagatgcaatgaaattaagcaatgcatataatttgtttaagaatatttttatgagatgtggtgtaatccctcaagttattgttactggcagagattcaacattgatgagtgcagtgaaaattgtgttccttgaggcaactaacttgttgtgtcggtttcgcattgatagatatgagcagttaaagatatccctatttgttgatagattatccatggtaacaatggataagtcgatgaatattaccgatatgagttatggcattgcatcaagtatttctaagagatggttgtcccatgctgccaatagctttgctatggtcaccacattgtcattatcaagcaaaaaattgacctaa

SEQ ID NO: 87953 - DNA, 981 bp, Glycine max
  Peptide Sequence Number=SeqID_204731
atggctctaattgaggaggagcttggtcagccatggcaaaacatctattctgaactatcatcttctcccattgcagctgcatctcttggacaggaacctgggtttggctcttcgaaagtttcctcaggcaagttaaattcttgtgagcagagacttaaagtctccattgatgtggttgggttggttgatgagtgggctgctcgattttttgaggagttagactatgtgaatgaaggtgaaaatggaaaccgttttgcagaaatgatgaggaaagacctaccacaggcaagtcttttaattgttgtcataccaagaacctaccataaatatacatcaaggagggttcttacgacagaatggattgatggagagaagctgtcacagagcacagaaagtgatgttggagaattggttaatgttggagtcatctgctatctaaaacagcttctagatactggattttttcatgctgatccacacccgggaaatttgatccgcactcctgatggaaaacttgccatacttgactttgggcttgttacaaaactgactgatgatcaaaagtatggaatgatcgaagcaattgctcatctcatccatcgggattatccagccatagtaaaagactttgttaaacttggttttattcccgatggagtcaatttggagcctatcttaccagttcttgccaaggtttttgatcaggccttagaaggtggaggggcaaaaaacatcaattttcaggagctggcatcagatttagctcaaattacctttgattatccttttaggatacccccatactttgcccttataattagagctattggggttctggaagggatagctttagtaggaaattctgaatttgccattgttgacgaggcttatccttatattgcacagttaaaattgtatcattcaatggaaaaaagaatgaagacaatggcatatggattggatggaaaagtttctgtttag

SEQ ID NO: 87954 - DNA, 1755 bp, Glycine max
  Peptide Sequence Number=SeqID_204732
atggggccatggggttcgtactggagattgaactctgaaagttctacggaccatgctaccatcctccctacgagcttgagggcttactctaaagtgacattgctagggccttcgaggatgattcttgccctacttcccttcacgttggacgcgccgtcaacgctttcgcaaaacctgtttgatgggagagtttgtcttgactaccacttggtgactctgaaagtatggcctgagacgtcaggccaagcttcgtcagatactcagagatataggagtaagggtactcctggcccaggtagactcaagactgatggtgtggcaatagtcttcttgaaggctaaaaaggcttcccgggaacttgccttcactgaccttgaaagtgcatttttcctggttgaggcacatgccatatttgcatatttctccgaataccttttcctagtctaccgtgtgttgggctatgctatgggatttaaggaccatgtcatcgacgccaaaaggcatgaccatgtagccgaagttggcatcttcatcgatgcacatttgccatttgtcattggcctttttgaccatgacgatgttggcgagccagataaggagcttatggcatataatgctggggtggatgcccgacatgacatcaactatgcatctatgttcatagctggtggggtcccaattgagctatgtacactgctcggttttgggtccaagctgcagtttggcaaaccctttgtccatgatcatgacttgagtaccaccacccactgtgaggtgaggcctagcaggctccctggtggaaggatagggtgccactttcaggcttttagtgaacttcttcttaagatgcaatgtggagatgatgactccgagcttgtcgacatagcctctggtctatactatttctcctacaaagccaataagtggaccaaagtgaggctggaccaaatcagaagagactttaagactttggaatgtcttccagtatacgatgttaatggagcttccctagttgatgaggaccttgaacaccatgaagttggcgattatgataaagacaaccatggggtcgacttagttgatgtcaatgtcccagatagcgtgaaggtggcgtttgtgagacatactggactgccctccataggaaaatccgctcacaatggtgttgattacacctttgatttattgggcaggctcattttcttgtgcttgcagaggttgtcgctcgcgtctttgctagtgttgtctctgtcttcctcgatcttttgctctgtctcttcttctatcggcatcgtggtttctgtggcgattgtcttggtgtcctttaggtacctccgtgttgaaggcctcctcaaggatttagtgtgcttggccattaggggtgaggaaagtgtccaaatgttcatctggatccgtggttccatcatactgttcttggttgagtggtttccaacctacgggtatgtcaacttccatgatgtagtcgacaaaggggtgtcgacgagtagtctgcccttcaggatagtgtatgagggagagattaggagaatcttgggtgttgacttatcggtatctgacattgttgttggaggaagattagagcctttgaaaggggtcttgcctctgaggccagaccgtgtgctaatcatgggtgaaagagagagaggccgcgagggtatccatggacaaggtgggctcctagatcttgcacatcggactgagagtcctaatcgaggccgtacccgaatcaaataa

SEQ ID NO: 87955 - DNA, 585 bp, Glycine max
  Peptide Sequence Number=SeqID_204733
atgagaggcaccatgcatgagcctcaagcaatcctaggggtagatcagaagttctcacccggtcttcctccagagaagcatggcgatcctggaatagaatgggcaaaggcaacaagaagcgctaagcaaggtggtgtccttagaggccaagtagcctttgctgaggctgtgaagtcgaaccatcaactatcctccaaggttggtagtgttcttgacaagttgttgtgcactagattagatggtgaggagctacttgagcactacaaagaattgcagagggcatccaaggagagggagaccaacaaggagcttgaagaggagttgctgatgtacaaaaaggaggctgtgcagcaacatgaaaagggctttcataaggctgtttggcaggtcgggttctttgccaaggaccttgacttgggtctttttgacccattcaaggacgtgaaggatggtgttctgcttgatgagaaagatattgttgctgaggagaaggaggctgcggaatggagaaggaagagagagaggagacgccacttcaaggagaagatgagtctagaagaagctcaccaccataggaggccatga

SEQ ID NO: 87956 - DNA, 819 bp, Glycine max
  Peptide Sequence Number=SeqID_204734
atgaagggatttgtggccttcacaacgggggatgctcccttgcaaccaaactggtgtatgtcagctactattagccgacactcagggaagatgccctcgacttcacaaagaggtgcagacaatgccctcggctacctatggcacaaagtcatgatactcatcaaagttggggaaccgtcgacgaggaggacaggcgcatccctggtcgcagctccaaaggctcgtcaaacccaaggtctatccttggtaagtcttacagttcctaaagctcgtcaaacccaatgtctatccttagtaagtctcgcttctccaaaggatcgtcaaacccaaggtccatccttggtgagtcttgtagctccaaaggcttgtcaaaaccaatgttcatccttggtgagtctcacagctctaaaggctcgtcaaacccaaggtccatccttggtgagtctcctagctccagaggcttgtcaaacccaaggtccgtccttggtgagtctcacttctccaaaggctcatcaaactcaaggtccttccttggtgagtctcacttctccaatggctcatcaaaccaaggctcatcaaatccatggtctttctttggtgagtctcacagctccaaaggctggtcaaacccaaggtccatccttggtgagtctttcttctccaaagacttgtcaaacccaaggtttgtccttggtgagcctcaacccatcttcacgggcttgtcaaacccaaggtccacccttggtaagcctcgccaaaacccaagatgaacgagtccctggtccaaaatttgttaaacctaaggtttgcccttggtga

SEQ ID NO: 87957 - DNA, 735 bp, Glycine max
  Peptide Sequence Number=SeqID_204735
atggttacaacgcttacctcgacggtggatggtgacgaagctccctcgacggtggacggtagcgttgctcttcacggaaacctcctcaatgcacctcgcaacctcttcacgacaaactcctcttcacgacaacaatgctttgtggctcgtgggaccatggttcttgctgagtacagtgagttttctggaaacttcaacaccattgcctctcaatgcctccaaaagcttccttcttccaacaacagattcacctacaactgtgatggccacactttcaattatctcgttgaaaatggattcacctactgtgtggtcgctattgaatctgctggtagacaacttcccattgcttttctagagcgtgtcaaggatgaatttagcaaaaaatatggtggaggcaaagctgcaactgcttcagcaaacagcctaaacagagaatttggcccaaaattgaagcagcaaatgcaatattgtgttgatcatcctgaagagatcaacaagcttgccaaagtgaaggctcaagttcttgatcgtggagaaaagattgagatgcttgtggataagactgacaaccttcgctcacaggcacaagactttagaacacagggcacaaaggtgaaaaggaagatgtgggttcaaaatatgaagatgaaattgattgtttttggtatcgccgtagcattaattttgatcatgtttatgtctatatgtcgtggcttcagctgcttacattag

SEQ ID NO: 87958 - DNA, 558 bp, Glycine max
  Peptide Sequence Number=SeqID_204736
atggcaatgaggcagggtggggacgagtattgcctccccagtccccgatcccgactccccaacatatacacatacctgtccctgatatccgacgggttaaaatttgttaccccatccccgtatccatcgggcatcgagtatccccgtctccgccccgtctccgagcttaatcgtggttgcatcggtctgcctagccattgtcaccaatatgctctagtaccttacaccgtcatgctccacctcttggctataggaaatgttgcataccctccatgcatggactcacccaccaagaagactttcgatataagggatactcatattcatggatccactgccaactccattttactcatcaaagctagccaccaagttgaaccattggctctgataccaaatattaagaatctgagggggctaaacactggggagcgtctcgagggtagctttgtcaatgtggctgctatcatcaaggtagtgcttggatggaaatgtgaatgcaaggagagaacccttgccaacgagcttatgaggaaggacagaaaggaacatcaatag

SEQ ID NO: 87959 - DNA, 183 bp, Glycine max
  Peptide Sequence Number=SeqID_204737
atggagaataggtcaaatgaatcagattgtgctccacatatgcaagatctatcttcaatccttacacctgagcgtcttaatagtacaagttatcatgaatgtcacgaaataggaaaaaaagtgaagtctccaaggaaaactccatcgctgctattggatttgttggtgcaacaagccatatga

SEQ ID NO: 87960 - DNA, 636 bp, Glycine max
  Peptide Sequence Number=SeqID_204738
atgaaacaacaaaatggaacggatgcattccttcagcatgtcataggccgcttccatgcgtttgagaaagcgcatacaatggatccaacatcaagtgggcgtggtgttcgtcaattcaagacttacctattgcacaaactggaaaaggaaggggaacttacagaaaaatctgttcagagaagtgatgctagggagctgcagacctactaccaacatttctatgaaaagaaaatccgggatggggaattttcccaaagaccggaggagatggctaagaatgttcagattgccactgtattgtatgaagtgctaaagactatggtagctcctcaaaatactgaggataagacaagaaggtatgctgaggatgttgagcataagaggggacaatatgaacactataacatccttccattatatgctgttggtgttaaaccagcaatcatggaacttccagagatcaaagcagcaattgctgctttatgtagagtggataatcttccaatgcccataattcgtgcaagacctgatgcttctcaagatgattctacaatgcctacggataggcttaaaaaagtgaatgatatacttgattggattgcctcagtttttgggtttcaggtgaaagaaaattag

SEQ ID NO: 87961 - DNA, 123 bp, Glycine max
  Peptide Sequence Number=SeqID_204739
atggtcaaacttgaaagatttgaggctaaacctcggagtgttagaaaagcacttgtttggtatccacctaaggttggacatgagaaagttaaagttggacgtgggagtgctaatatggcttaa

SEQ ID NO: 87962 - DNA, 294 bp, Glycine max
  Peptide Sequence Number=SeqID_204740
atgagacccaggtgcgacagcgagttgcagagcgcaaacctaggtcgagttgcagaccaggtgcgacggcaagctacgacatcaacaagttcgagcgtgaagaatgaagatgaagagaaggggtttttggttgcggtagtgatttttaaggttgatgtgttttatcttccacctgccggacacatacatttggataaagcaaaaggagagcgacaattgacggtcctaatagagaaggagagaattagagaaatatcccatacatgtcgaaaaaagaaaatattccttcaataa

SEQ ID NO: 87963 - DNA, 489 bp, Glycine max
  Peptide Sequence Number=SeqID_204741
atgtatgataatataatatctgaagaagttgatatgaatgaacaaaatcaagatgaagccggtgtgaataaagaatatgttgattgttgtgatgcgttcaatacttctcaggtatttgctacccgtgatgatgttctacattgggctcaatctgttgcttataaaattggttttgtggcggtgattatgaggtcagacacaaatagtgatattagaggaaggacctcgtctgttttaattgattgtgaaataagtgatcaatatagggtcaagaagaaagatttagtaagaacagttattggaagtagaaaatatgggtgtccatttaagctgtgtgcagaaacagtggtgggaggcgaaagatggatggtgaagttaatgtgtgggagtcacaatcatgaattgatcaagtcattagttggacatccatatgtttatctggtgactaaggatgagaagatcattgttgttaatatgataatgtcaatg

SEQ ID NO: 87964 - DNA, 2622 bp, Glycine max
  Peptide Sequence Number=SeqID_204742
atggagcttggtcgagattctgatactggtggacagattaaatatgtggtagaacttgctcgtgcacttgccaaaatgcctggagtatatagggtggatctgtttacacgccaaatctcatcacctgaaattgactggagctatggagagcctacagaaatgctaactccgggtgatgatgatgatgataaccttggggagagcagtggtgcatatatcataagaatacccttcggtccacgcaataaatacctccggaaagaacttctttggccttatattcaagaatttgtggatggagcattagctcacattctcaatatgtcaaaagtattgagtgaacaagttggtgggggccaacctgtctggccatatgtaattcatggacattatgctgatgctggagatagtgctgctattctttctggtgctttaaatgtaccaatggttctgacaggtcattcccttggaagaaacaagcttgaacaacttatcaagcagggacgccaatccaaagaggatatcaattcgacttataagatgatgaggaggattgaggcagaagaactttctctggatgcagcagaacttgttatcactagtacaagacaagaaattgatgagcagtggggactttatgatggatttgatgtcaagcttgagaaagtattgcgtgctcgtgctaggcgtggtgtcaactgtcatggtcggtacatgccaaggatggcggttatccctcctggtatggactttagcaatgttgttcgtcaagaagatggccctgaaattgatggagagcttgctcagcttactgctagtgttgaaggattttcaccaaaagcaatgccttcaatttggttagacgtaatgcgtttctttagaaatcctcacaagccagtgatcttggccttatcaaggccagatccaaagaagaacttaaccactctgttaaaagcctttggagaaagccgccccttaagagaacttgctaatcttactctcataatgggaaatagggatgacatagatgagatgtcttctgggaatgctagtgtgctcacaacagtgttgaaaatgattgataagtatgacctatatggccaagtggcataccctaaacatcacaagcaatccgatgttccggagatataccgatacgctgcaagaacaaagggtgttttcatcaatcctgctttagtggaaccttttggtcttactttaattgaggcagcagcacatgggcttccaatggtggcaactaaaaatgggggaccggtggacattcatcgggccctgaacaatggtttgcttgtggatcctcatgatcagaaagcaattactgatgcattgatcaagttgttgtcagaaaaaaacctgtggcatgattgcaggaaaaatggttggaagaacatacaccttttctcgtggcccgagcactgccgtacttatttgactagggtggctgcctgcaggatgaggcatccacaatggcaaaccaacactccagggaatgatatagctgatgaagagtctttcaatgactcactaaaggatgttcaggacatgtcccttaggctctcaattgatgctgacttagcaggtttaagttctggacccgacatgcaagaccaagtgaagcgtctcctaagcaggatgaagaagccagattctggtggttcaaatgacactgatggtgggaataagatgcctgacaatgtaactgggaaatatcctctactgtggagaagacgtcggttgattgttatcgcactagatttatatgacaacaatggagctcctgataagaagatgatccaaatagtgcaaaggatcattaaagcttctcaactagaccctcaaaatgcaagagtttcaggatttgctttgtcaacagctatgccaataagagaaaccatagagttcctcaaatcaggcaacattcaagtaaatgattttgatgttttgatttgcagtagtggtagtgaagtttactatcctggtacttacacggaagatggaaagcttttgcctgatccggattatgaagcgcatattgactatcgttggggttgtgaaggtcttaagaaaaccatttggaatcttatgaatactgctgaaggtgaagacaaaaaatcttccagccccattgtggaagattcgaaatctagcaatgctcattgcatctcatacaaaataaaggatctcagtaaggcaaagagagttgatgacttgagacagaagcttcggatgcgaggcctacgttgtcatcctatgtactgcaggggatcatctagtatgcaggttattccactccttgcatctagagcacaggcactcaggtatctctttgtccgttggggactgaatgttgcaaacatgtttgtctttcttggagaaactggggacactgattatgaagagttgatttctggaactcacaagaccataatattgaaggatgttgtgtctaatggttcagaaggaatacttagaggtccaggaagctaccatagagaggatgttgtacccaatgagagtcctcttgttgcaagcattagtgaaacaactgaggacaagattgccaatactttgaaggaactatcaaaatccggggcaatgtga

SEQ ID NO: 87965 - DNA, 222 bp, Glycine max
  Peptide Sequence Number=SeqID_204743
atgaagaaaaacatggaaactgcgttatgtgttatgatatgtgatgatgagtttggtttgctttgtgttattgatttggatgaaaagatagtgtgcgtgtgtagaacgaggaaaaggagtggtgttgggattgacgaagaagggttcaaaatcaaagaaaagatagcgttatttgggagaattacgagaagggatgggaacgtgtgtgagggagagagatga

SEQ ID NO: 87966 - DNA, 408 bp, Glycine max
  Peptide Sequence Number=SeqID_204744
atggctgggaatgaatggattaatgggtacctggaggctatactttcaactggggcctcaaccattgaagagcaaaagcctgcacctgtgactctaaaagatggggggcatttcaaccccacaaagtactttgtggaagaggtggtggcaagtgttgatgagtctgatctgtaccgcacatggatcaaggtggttgccaccaggaacaccagggagaggagttcaaggttggagaacatgtgctggcgcatttggcatcttacacgcaagaagaaacagttggaatgggaggaagtccagagggtaacaagccgaagattggagcgagaacaaggacgcagagaggcaacagaggacatgtctgaagacttatcagaaggagaacaaggtgatagtgttgtggagatg

SEQ ID NO: 87967 - DNA, 549 bp, Glycine max
  Peptide Sequence Number=SeqID_204745
atgggaaggaaagtaagtcaagaatcactgaaaatatctaaggttgatcatcagaaacatcaattcaacactttgatcaaggtcttgaggcctaaggtctacatcactgacagctcaagcttcaagaagttagttcaagagctaactggcaatggaagttccaataacactttgtctccacctcctttggaaccaaacatggtcgaaaatttcccccttaatattggaactgagcctcatgagagtgaccttcaaactagtcctgatgatgtgtcaatttctcctgaagcaactagcaactcacctgagttgtgctgtgatgcattgatgaatgaagaatttaacctagtttgcaaccagttatgcttagatgacctagccttccaacaagactcagtgaccaaccaatctatagaccattttttggcataccagaatcttgagtcactactgcttgatgttgaatcaaatcccttgtacaactgttatgaacagatgatgcagccagatgtcagcatatatgattatgagttgtcaggattactatga

SEQ ID NO: 87968 - DNA, 258 bp, Glycine max
  Peptide Sequence Number=SeqID_204746
atgactttaattgttaaaaagtggtccattctatcacgaagaccaagacggcttcaagtgttgcaagagactgcagagcctctaccaacctatgtccattcttccaccaccattgacaccacctatgaaaagaccgcagcagcggcagaggggaggggtcgatggtgcagtggaagcaaaaaggaaggagtgcaggaagtaaaagcccggccagttttacccaacaggctgtgggctggtgttggtctggcccagtag

SEQ ID NO: 87969 - DNA, 650 bp, Glycine max
  Peptide Sequence Number=SeqID_204747
atgaaggaaaagcatccatgctttactggcactgaatacattctttcaatgtgtattgataactattttgttgtatgcaggaaggatgcaaattacaaaagaactgtcattgcttgctttatacaggcagtttacctgcttgaactcgatagacaggagaaccgaacgcaagaaaatgctctagccccaaattggtggattcccttcaagtacaagctcacacaaacattgattgatgaaagagatggatccatttttggggcaatacttgaatgggacagatctgcagcaatggcagacttagtactacttagaccaagtggtgcccccaaagctgttttagcgctaagaggaacgttactcaaaagccctacaatgcgaagagacattgaagacgaccttcgttttcttgcctgggaaagcctgaagggctctgtcaggtttaaagtagctctggaggtactaaagtcggtttccgacacatatggaagcagcaatgtttgcattgcagggcattcgttgggagccggcttcgctcttcaagtgggaaaggcattagcaaaagaaggcatttatgtggagacacatttgttcaatccaccttctgtttccctagccatgagtctcagaaacattggagaaaaggctga

SEQ ID NO: 87970 - DNA, 234 bp, Glycine max
  Peptide Sequence Number=SeqID_204748
cttacttctacaatatatggggccacttctttaggtgtatggacaaggctgaacaacataaggaaaaattgcttcttgtgatgaatggagttgtgaacattgaaaatcaattggctgagtacgaaagggattctaaacaaacaaagacagatgatttagaaacctttgttggatcaagcattcctaaagaagtgggaattcttccacctcaattttcaaagacaaaaggaagtg

SEQ ID NO: 87971 - DNA, 318 bp, Glycine max
  Peptide Sequence Number=SeqID_204749
atggtgagcaaaggttggagctttgatggagcttcaatggtggaggagaaagggagaaaaagcaacgtgagggagaggaaaaagcttctacacttttggctgatcacaagaagagaaaaatatgatctttttgaaatgctaaaatcctacctcggtttgcgtgccgtttctctggttccagtccctcgcgtttctctgcacccgtcggggccagttttcgaaggtaagcaatatatatatcaaaacgctcagaatgaaaccccgagcgtggttcagaggttggttttgttaaattttaagttgtacgcaaaacgataa

SEQ ID NO: 87972 - DNA, 336 bp, Glycine max
  Peptide Sequence Number=SeqID_204750
atggctggtttcgataagttagctagttttgatgttgctactatgacacaacacaacagatcgggaagaaccctaaccaaacaagaaagcaatgtgtcgcaacctacccttttgcgtgcgagcgaggcgaggctcatgggtgcgtcttccaaaggaggaaaatgcgcggagtcgccaccaacgtttatttgtggaaaacgtcgaaaaaaccgaaggaaaccggtcatgaagaatattccagattcgggagttgtatttacgtttgaggaaggtcgacaaaagcggggctcttgctcttacgtaccctccatcgaagaggaaatcagacctatgtag

SEQ ID NO: 87973 - DNA, 2024 bp, Glycine max
  Peptide Sequence Number=SeqID_204751
atggcgggaattgatgctacaaagtatggtcatagtcctgtgcacaaggccttagttttgaaggatcatggtgaactcaggaggatacttgctggcctcccacggctgcgtagcacggccgagattcgcactgaagcggtttcgattttagaggaagagaaggctgatgccatcgctgctgtgattgaccggcgtgatgtgcctaaccgtgatacccctcttcacttggctgtgaaattcggggatgaagtggccaccgagttgcttatggttgctggggcagattggagtttgcagaatgagcaagggtggagtgctcttcaggaagctatttgcagtagagaagagggtattgccaagataataattaagcattaccagcctctggcttgggcaaaatggtgcagacggttgcctcgcttggtagggaccatgcggaggatgagggacttctacatggagattacattccattttgagagttctgtgattcctttcatctcaaggatcgctccttcagacacatacaaaatttggaagaggggtgcaaatctaagggcagacatgactttggctggttttgatggtttcagaattcagagatcagatcagagcattcttttccttggtgatggttcggaagatgggaaagtcccacctgggtcactctgcatgatctcacacaaggaaaaggaggtactcaatgctctagacgatgctggctttccagcaaatgatgaggaggttcagcaagaagtggttgcaatgtctaaaacaaatatatttaggcccgggattgatgttacacaggcagttctgttgcctcagttgacttggaggcgacaggagaaaacagaaatggtagggccttggaaagctaaggtctatgatatgcacaatgtagttgtgagcataaaatctagaggagttcctggagccatgacagatgatgaactcttttcttcttgcaatgaaaatgaaacagagagtgaagagctcaatgatattttgactgaggatgaaagaaggcaattggaagatgcactaaggttggattcgacagacttgaacaatgagagtgatgaggtgatcattgggcatcgtcatagctgttatgaacatagagaaattcctattgaagaaggaaattataacaaaagtggagaaaataagctggaaaagaaaggatggtttggtggatggaggaaaaaggattctaaacctgaagctccaaagaagattgctccgccaagaagttctctctgcatagaagaaaaggtgagtgatttattgggggattctccttcaagaaatcagagtaagccaggaagacattctgttgagatagctgtgaagggtgatgagtcacggaggagaaaagatgccaaagcttcttctgcaaattctgatagcagaagtcgtcacaaggatggaaatcgtgaaaatgaatataagaaagggttgagacctattctttggctttccccaaactttccactaaaaactgaagaactcttgccattgcttgacattgttgcaaacaaagttaaagcaattcgacgtttaagagaactccttacaacgaaacttccaatgggaacttttcctgttaaggccgccttagctatgacttctttgggggctgcctcaattgcagcccgccttaataagatgaggattgcccagctgtctatttttagttggttttgtgagcttgttgccatccctgtggttcccaccatcagagtattggttacttttacaaagtttgaagaactagagccagtagacgaatttgcaacaccaccatcaagcccatctgcagctgagcaagagagccctgcagtgcctcacttctcggcatcgtcttggtttcaatggataaaggctccttatcgctctagtacatctgctccaggatccagcagtaggatagaaaatattgaagacccttttgcaattccatctgactatacttgggttactgctgaagcaaagaaaaagaagatgcaagagaagaacaa

SEQ ID NO: 87974 - DNA, 354 bp, Glycine max
  Peptide Sequence Number=SeqID_204752
atgtatgctgatggtcttgccaattatgggatagatgatagattagagataagtggtgaaacttgctccctttgtttattagggataggcggaagtaagcggcaacttttattagatctagattttttctatgtcgaaaggaaaagaaaaacgatttcagaaaaaggacaaaagaaaacacacactaatatcaacaaaggtgataacaagattcagaaaagaaagggtgagtgctatgtttgtggcaaaacaggtcataaagcttatgagtgcaacctgaggaagggacaacaatctaacaactcgaaacctgctgcaccacatgctcctcaagcacatctagcagaaaaataa

SEQ ID NO: 87975 - DNA, 366 bp, Glycine max
  Peptide Sequence Number=SeqID_204753
atggtatcttatctaaccaatccgggtaaggggccttcttattgggatcccccgaagaactccgcagtacaactagccgcagcgatcactgccggctcaaggatctattgtccttgctataccacagaagagtcagatggcaataagaaggtctataagtacaagggaccgggtagaaatgttataactccagaatggtataaagaacagtacgccgacccttcccgaagtctgataaagaaggtaacttatcaatttcgacccaattggaaagaactctcggttaaaaacaaagagagtacaaccactcttagaactctcagtaactccaagagaatacctttctttaatgaaaaaggtaaatat

SEQ ID NO: 87976 - DNA, 162 bp, Glycine max
  Peptide Sequence Number=SeqID_204754
atggtaaaggactatttcttaaagaatctggacaacaaactattgaggtattcacagatgcagactaggttggatccattagtgatcgaaaatcaacatccagttactgcacatttgtttggggtaacttggttactcggaggagcaaaaagcaagatgtag

SEQ ID NO: 87977 - DNA, 393 bp, Glycine max
  Peptide Sequence Number=SeqID_204755
atggaaaaagccactgcaatcgaaggaaattcctccaccatgtctcctatgaattctggaggtattgaaactccatccccggttgtatccgattctctatctatggataccaatttacaacttttaaaccaaaagctgaatgtacaaggatgcagaatactgaaagttcaaccttggctgcaaggggacaagaaccaaaaggagaaaagaagaagtgaccttgttgtgatcattgttgaaagccatggcacacaaaggaaaattgctggagacttaatcccaactggaaaaagaaatcaactggagagggataagctttccaaacctcaaataaagaaaatgtggagcagaagggcaactccaagtcatccctgttcgctaaagaacaactag

SEQ ID NO: 87978 - DNA, 435 bp, Glycine max
  Peptide Sequence Number=SeqID_204756
atgccaccgatatcgttgttgtctatgccgctgccggaaaaagcctccaacgaggtggaggaaaaatgggtgcaatcctacgtggcatggctagggtttggatatgggatggcagagtatgtggtggaggcgaccgggttccgccgcgagatggtggccggaggtggcaagatgaaggaatgtggcatggggagggtggtggtggtgggtggtggtggtggtgggaggatacggaccctacccatgtggcacgtttgttgcattatatattgtgagaaatacaagaagggcttcatccaacggttgaatgaagctacgagggacacgtggcatgatcgtgtggtggatgaggtgttggggatgccagttatggagctttgtggtcgtttgtatggtaataataatgcttcttgggttggctccatctccatgtga

SEQ ID NO: 87979 - DNA, 1602 bp, Glycine max
  Peptide Sequence Number=SeqID_204757
atggtgtcctacttggtgcccctaaggcttgcaaattgggtcatgaaccaagtgcttgttaaatcatgttatggattttctaggaaacttaaaagccttgggtttcgttggggtgatctttcatccaaacccttgcatcaaccctcccctttccctaatattaccaagtgcgatttggagggtagagggtcacaaaccctagcttgtgactttcacaaagtcctcttaaggactcactccttctttccctatttcatgcttgttgcatttgaaggaggaagcatttttagggcattcctcttgctttgttcatgccctatattgtggatcttaaactatgaaatgaagcttagggtcatgatcttcatttccttttgtggtctcagaatgaaggacatggacaacacttcaagggcagttttgccaaagttctacttggagaacctcaaccttgaggcctatgaggtagtggcttcagtagggtccagagttttcttcaccactatgcctagagtgatggtagaagggtttctgaaggagtatttgaatgctgatgctgttatagccacagagttgcacactgctggctgttacttcacgggttttctctctaagtctggtttgcttgtgaagcatagtgccctcatggattattttggagacacaaaacctgaccttgggatcggtaacgcaagtcttcatgatcaactttttgtttctctttgcaaggaggcgtatgtggtgatcactgaagagggaaaagtgatgccaagaaacaaatatccaaagcccttaatatttcatgatggaaggctagcatttttgcctactccttcagcaaccctcttcatgttcacgtggcttccacttggatttctgatggccatttacagaatttttcttggggttttcctttgttgcaaatttacattggcattaggaatatggagtggcctaattctgaatttcaatgacaagaaccaacaaagatctgagtcaaacaaaggggtgctctatgtgtgtagccacaggactctcatggatccaatttttcttagcataatgttggggaggcgtttgactgctgtcacatacagcttaagcaaggtttctgagttgatagctccaattaggacaatgagactcacaagggatagaaaacaagatggggaaactatgaaaaggttactttgtgaaggggatttggtggtgttccctgaaggaacaacttgtagggagccatatttactaaggttcagttccttgtttgcagaacttgctgatgagattgtgcctgtggctatgaatgctcatgtgaccatgttttatgggaccacagccagtggactaaaggtcttggaccctattttcttcttcatgaacccttggccaagatatgacattcaagtccttgaaaaggttcctagagaactcacatgtgctggtggaaggtctagtcatgaagtggcaaattacattcagagagagttggctgatgctttagggtttgagtgcaccaaccttaaaaggagggataaatacatgatgctggctgggaatgaaggggttgttcaagaaaagaaggggagaagattctgctaa

SEQ ID NO: 87980 - DNA, 465 bp, Glycine max
  Peptide Sequence Number=SeqID_204758
atgcgtacttacgacttaacccctttttatagaaccgctattggttttgaccgtttggccaaattactgaatgaaagccaacgtaacgaaaacgatatcagctatcctccttataacatcgaattggttgacgagaatgcctacaaaattgtgatggcagtcgctggcttccagcaggacgagttggagattgaaaccgaacaccaggcattgcgtgtcacaggccgcaaagcgaaaaaagagcaggaaaccactttcttgcaccgtggcattgccacacgtgattttgaacacaaattccagttggctgaccatgtgaaagtcaccggtgccaatctcgagaatggcttgcttactattgcattattgcgcgaagtgccagaagcactgaagccacgaaaaatccagatcggtacccaagccggggcaaacactaccttgattgaacagaaagcggcggcttaa

SEQ ID NO: 87981 - DNA, 559 bp, Glycine max
  Peptide Sequence Number=SeqID_204759
gaccggtagaagagatcggtatgatgaagctcgctatcagtttgaggttaacgtgtatggtgcggcccgccttacgcaactgctgataccggccatgcgtgccagacgcagcggttacattattaatatcacctctatggggggtaagatttacacccttctgggagcctggtatcacgcaacgaaacatgcgcttgagggatggtctgactgtctgcgtcttgaagtggctgaatttggcattaaggttgtgattgttgaaccgggtttaatcgagacaggctttggtgatgtggtcagcggcaatatagttaaacgttcagcaaatggcccttacgctcgcctcgtggagaaggtggctaaatcggtcaaaaatgcatacgggaatggcagaggcagcgacccgaaggtgattgcggacgtggttgcccgcgccgttaaaagccctcatccgcgtacacgctatgcagccggcaagtatgcaaagatgctcatccgcatgcgtctctggctgggagaccgtctgttcgatcgcgttatccttggccagacgctatga

SEQ ID NO: 87982 - DNA, 285 bp, Glycine max
  Peptide Sequence Number=SeqID_204760
atggggagaatggagagtatttggggtgaggattgggcagagtttaagccagagagggattccttcacttatccggtgtttcaggctggtcccaggatatgtttggggaaggaaatggcctttatgcagatgcagaggttggtggctggtattctcaggaggttcacggtggttccagtgctcactccaggggctgagcctcacctcatttctttcttatcctcccttatggaaggtggttttccggtcaagatcgtcgacagggaagcttcatcttcaaactaa

SEQ ID NO: 87983 - DNA, 432 bp, Glycine max
  Peptide Sequence Number=SeqID_204761
atgtcggggtgcgttaatgtttcgagtcacacatatgttaagagttcattaatcgggacaaatggagtaaggtgtgtaggcctaattaaggagcatggaggattgggaatcaaaaaggttacatactttaatgaggcactagctagtaggcaaatggagatgacacttgacgaaaatacacatgtaattggcttacttctacatttagttggaagattggttgtgggggaagagcctgcttttggcatgcatgataattggctggaagaacaatcccttgctatggtgtacccgaaactttttattttgtctaataatcaccataggacagtgtacaagaaatgggaagttggggagatgggaggtggacatggaacttggcatggagacgaccttgctttgtatgggagaagaactttgttgatgatttga

SEQ ID NO: 87984 - DNA, 306 bp, Glycine max
  Peptide Sequence Number=SeqID_204762
atggtattgaaactagcagttgttgaaaaggtgctttttgttggtttagtttgtctatctgaaatgaccacaatctatttgatgcagaatttcatggctgaagctgcaagtgctacacaggatcctatggggggatcagtcagccaaggttacagtgcctatccaacaactgctccagtttatgctccacccactagtgctggtggtggtggtcatacaggccatgcgccttctgcagattatggccccctatatggttatcatactgttggtactcttgctttggctttcatcatttcacattaa

SEQ ID NO: 87985 - DNA, 1530 bp, Glycine max
  Peptide Sequence Number=SeqID_204763
atgattgacatacttctgaatctccagctgttagctcctttcttcctcttcttaatacttccagtgtttttcttcttctgtttcacctcctcaggtcctacaaaaggaaccatccctattccaaaaccataccctattattggtcactacttcgccctcaaaagcgtcggcaaccgccgtatccagtggctatccgatattgtcaaaatctcaccggccggcacgttcaccctccaccgccccttgggccgccgtggagtcatcaccggcaaccccgccaccgtagagtacattctcaagacacgtttctccaattaccaaaagggcagaaccactactagcattctctccgatttcctcggcacaggaatcttcaacgcagacggcaacacgtggaagtttcagaggcaagtagccagccacgaattcaacaccaagtctctacgcaaattcgttgagcacgttgtcgatgcagagctctccaaccgtctcgttcctatcctcacttcagcagcagcagcacaagacaaaacacttgatttccaagacattcttcaacgtttcgcgtttgacaacatctgcaaaatcgcgtttggcttcgaccccgaatacctgacgctgtcagctgaacggagcaagttcgcacaagccttcgaagaagcaacggagatcagcagcaaacggttccgcgagccgttgccgttagtctggaaaataaagagattacttaacataggttccgaaaggcgtctaagaagagcggtgaaggaagtgcacgagttcgccaggaacatagtgagagagaagaaaaaggagctgaaggagaaacaatcgcttgaatctgttgatatgctttcgcggttcttgagttcggggcactccgatgaagacttcgtaacggacatagtaataagcttcatactggccgggaaggataccacttcagcggcgctgacgtggtttttctggctactatcgaaaaatccgcgcatagaaaaggaggttttgaaggagataatggagaaatcagaggctccggtgtatgatgaagtgaaggatatggtttacacgcatgccgcgttgtgcgagagcatgaggttgtacccgccggtgccgttagacacgaaggaaaccgtggacgacgatgttttgccggatgggacggtggtgaagaaggggatgatggtgacgtatcacgtgtacgcgatggggaggatggaaagtatttggggtgaggattggagtgagtttaagccagagaggtggttagagaaggttgaatcgggaaagtggaagtttgtcggaagaaattcattcacttatccagtgtttcaggccggtcccagaatttgtttgggaaaggaaatggcctttatgcagatgcaaaggttggtggctggtattctcaggcgcttcacggtggttcccgcggtggcagaaggggtggagcctcactactttgccttcttgacctcccagatggaaggtggtttcccagtcaagatcatcaagagggaaacttcaacttga

SEQ ID NO: 87986 - DNA, 288 bp, Glycine max
  Peptide Sequence Number=SeqID_204764
atgccactgaaagactctactgagacaaagacgggctgtcaagaacgtagaggagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgcctttcggcatccaggggtcgcggaccgaccatagaacccctgttcaaaaagcggaacgcattagctatccgctctcaggttggacagtaa

SEQ ID NO: 87987 - DNA, 297 bp, Glycine max
  Peptide Sequence Number=SeqID_204765
atggcatctaagaaaaggaaggctccttctacaccttcccaggccatatatgacagatccaagttcacctctcaagaagcttgggagagatatactaatataactgtgccgaggaaatttcttctagagaggaatgtggtagtttattacactgagtttgatgagttcaaggaggaacccgagagaagacactgggataaggaattgactgattttgctaacaacaacatcaacgttgccattgtgaaggagttttatacgaacctctatgacaccgaggataaatcacctaagcag

SEQ ID NO: 87988 - DNA, 957 bp, Glycine max
  Peptide Sequence Number=SeqID_204766
atgttgctcgctctcgatgccgagccacttggccttggcgccggtggcgatgatcagcgtgtcggcggtccatacctggccagaatcggtcttcacgacgaacgggcgaacgctggtttcaacttcggtcaccaggtcactgacgatttccgcgccgacatgcgtcgcctgcttcagcatctggtccatcagccacgggccctggatagggtctgcaaagcccgggtaattctcgacatcggtggtgatcatcagctgaccgccctgttccatgccggcgatcagcaccggcttcagcattgcgcgtgccgcgtagatcgccgccgtgtagcctgcgggaccggagccgatgatcaataccttgccttgcgttaccaacaaggcagttgtggatgcacgcgcaattttgtgaccggttggcggcatattgttgcgaatcccgcgccgaatagtacaaggaagttctccagcttaacgaggtactcctccgtgaccagcgtcgaactcgatgccatcgatctgaaaatcctgcgcgaattgcagcgcgacgggcgcatgaccaatgtggaactggccgaaagggtcggtatctcggctcctccgtgcctgaggcgtgtccgcaagctcgaggaggcgggcgtgatcgagggttatcacgccatgttgaacgccccgaagctcggtttcgacctcgtcgccttctgcatgatcggtctcaagcgccagtcggacagcaatctgaaggcttttgcggcggcaaccgccggctggtcgctggtgcggcaggcctggatggtgtcgggcgaaagcgacttcctgctgcattgcgtcgccaagaacctgacggaatttcaggatttcgtcatcgaggttctgacggcggacgaaaatgtcgatacggtgcgcaccatgctcaccatctttcaggtcaagcgcgtcggtctggtggaaatctga

SEQ ID NO: 87989 - DNA, 339 bp, Glycine max
  Peptide Sequence Number=SeqID_204767
atgcatgagaacgaatggcacggagcgtgtttgctctttgcccctatttgggaacctataggacaatatctaggggtctctaataactactccccaacaattcttaactcacacggctgttctctagaggtatcatcactcaagataatgatattgtggcggcctaactcacaaaaatactccccagtggagtcgccaactgtcgcaacgtgcccttcgcgggcgagcgaaggcgaggctgacgggtggactttccaaaggaggaaagatgcgcggagtcaccaccaacgtttatttgtggaaaacgtcggaaaaaccgaaggaaaccggtcaaaatga

SEQ ID NO: 87990 - DNA, 506 bp, Glycine max
  Peptide Sequence Number=SeqID_204768
aacaccctggtcttgtgcgtgctgctagagctggtgtcacgatcaagcaatactttagaccgactccaaggacctctcacacgtcttccttcattgctcccgaagagctggagcagctgacgcaaaaaatcagagaccaactagaggagtcgatcacagaaaaaatgcaatcacagggacttgcattgcctcctgagcctgaggttggtccttcatctgctcgtgtcagtacaaaggagagttatgttgatccctcagggaacgatccagagacgggtgactcagaaaaatatgggttgttatatgagggatccacaatcgttcacaaaattcatttgttgcatgatcaagtcaaggttggtgttgaggaggttagagatgcagattttcccattcctgtacccactgaagaggttaagttagtggggcaggcacttaacaccttccttgcttggccgacacatcttatcaagcgtttatcagaacatgtatttcagtgtcattaa

SEQ ID NO: 87991 - DNA, 303 bp, Glycine max
  Peptide Sequence Number=SeqID_204769
atgctcttcttcttcctccaacggttctgcttcttgagttttctgcttcttcagttttcttcttcctcccgcgcagcttcttcattcttcttcttcttcgccgccatcgccgccattgtttccgtgtttaggaggaaggtgtgggtcttcgcgcttgtggtgtgggtcttcacgtttgtgcttcttcttcgcgtttcttcttcttcgaggaaagtttgtcgttcgggttttggtttttgccggcaatggcagaaaacgctgtcgggaagttgttgggttgtttacggatcaagtgatccgtaa

SEQ ID NO: 87992 - DNA, 144 bp, Glycine max
  Peptide Sequence Number=SeqID_204770
atgtcatatgacgcagcgattgaggtgaggaaccatgtttccccagagccagaggtggaggacgccggagttgcttcgttggcgaatccaaagaggcttgtgacaaattcggaatgcgaaatgattttaaaggttcaaaggtag

SEQ ID NO: 87993 - DNA, 198 bp, Glycine max
  Peptide Sequence Number=SeqID_204771
atgaagaacgatgaagaacggataaaagagggaggtggttgccgcccagctcgcccaggcgagctaggttgcttccaccagaaggcaccgccttctgttggaaccccctggaaggcccaaaactttaccgattacctaacgatgagtgttaagtacctcgaggcagtcaagcgaaggttgcatgccaccaaacaatga

SEQ ID NO: 87994 - DNA, 273 bp, Glycine max
  Peptide Sequence Number=SeqID_204772
atgacacaatcgaacaaccgagtaaaaagttattgtcgattgattttgctcagagcttctgttctgaatttcgagcgtctcgatatacaacgggacacaatcggacatccgagtaaaagagcttctattctgaatttcgagggtctcgatatactacgggacacaatcggacatccgagtaaaaagttattgtcgtttgattttgctcagagcctctattctgaatttcaagcgtctcgatatactacgggacacaatcggacaaccgagtaa

SEQ ID NO: 87995 - DNA, 297 bp, Glycine max
  Peptide Sequence Number=SeqID_204773
atgtctcttgctcactttgtgttcaactttagcacagattcagaaatgctttcatctgggtctcaagatggaaagattaaagattttaggattagaatcccttcatccatacagataacccagccaccccaccctgtatttgtacctccttattcttccctcatcttttctggctaccaagtaccacccagcaacccgagtgttttctggccattggccaaacctgtccttttttttggcagccagaacttctgtactctggtctttgccctatcacctctattttgcatagcttag

SEQ ID NO: 87996 - DNA, 183 bp, Glycine max
  Peptide Sequence Number=SeqID_204774
atggataagaacttgaaggtaggagaagatgagaggagggagagggagacaaggagcacgaaattttgtgcctcaaaagagtccactaatccaagatcaaatccaagattctccactaaatgtgctttaggtgtcatgagatatgtaaagcatgaaagacatgcacaaagtgtgactatatga

SEQ ID NO: 87997 - DNA, 1638 bp, Glycine max
  Peptide Sequence Number=SeqID_204775
atggcttattatggaatatcatcaaatttgatactatatctgacaaggaagcttcaccaaggcactgtgacctcttccaacaacgtcaccaattgggttggcaccatttggataactcctatcttaggagcctacgttgccgatgctcatcttggtcgctattggacttttgtcatcgcctcagtcatctatttaatgggtatgtctctacttacactatcagtgtcccttccaagcctaaagccaccagagtgccatgaattggatgtgacaaaatgtgaaaaagcctccatactacatctagctgtgttctatggtgcactctacactttagcactaggaaccggtggaaccaagcccaacatttccaccattggtgctgaccaatttgatgactttgactccaaggagaagaagctcaagctctccttcttcaattggtggatgttcagcatcttcattgggaccctctttgcaaattctgttctggtctatatacaagacaatgtggggtggactcttgggtatgctcttccaactcttggacttgcaatatcaatcatcatatttttggctggtacacccttttatagacacaaattacccacggggagtccatttactaagatggccaaggtcatagtggctgctataaggaaatggaaagtgcatattcctagtgacactaaagaactttatgagcttgatttggaagagtatgccaagaaagggagagtcagaattgattccactccaaccttgaggctcctcaacaaggcatgtgtcaacaccgattcaactactagtggatggatgctaagccctgttacccatgtagaggagaccaaacaaatgctaagaatgatccccatcttggctgctacattgattcctagtgcaatggttgcacagataggcaccctttttgtgaagcaagggattacacttgatagaggcattggcagcttcaatatccccccagcaagtttagccacatttgtgactctatccatgcttgtatgtgtggtgctctatgaccgtttctttgtcaagatcatgcaaaggtttaccaagaaccctagagggataacccttctccaaaggattggaattggcctcataatccacatagtgattatggtagttgcatctcttactgaaaggtatagacttagagtggccaaagaacatgggttagtagaaaatggagggcaagttcctttgagcattttcatcttgcttcctcaatatgttcttatgggagcagctgatgcatttgtcgaggttgccaaaatcgagtttttttatgaccaagccccagaaagcatgaagagccttggcacttcctattcaatgacaaccttaggcattgggaatttcctaagcacttttcttctcacaactatttcacatgtcaccaagaaacatggccaccgaggatgggttttgaacaacttgaatgcttctcatcttgactactactatgcccttttggccatactaaactttttgaacttcatatttttcatggttgtgacaaagttctatgtgtatagagctgaaatttcagattccataaaagtgcttgaggaagagctgaaggaaaagacctcaaaccaagtgattccaagagattag

SEQ ID NO: 87998 - DNA, 613 bp, Glycine max
  Peptide Sequence Number=SeqID_204776
atgagaaatttcatgggatttactaggcagactgggagaggtcagggtcttttgaatacgttgaagagagtaaagaaaggggataaagggggagttagcttgagtcagttgaaaactgagaaggaagttgggaggaaagtgcttgtttccctgaggcctattagaagtagagtatcaactaatggttcaagtggtcaccatcatcgacatggaggctctacaagtggacttggtgggtattctccgaggaagaggaaaagtgaagctgctgttaaaactccttccccatctaagcattctgttgagaagaaacgtgctggattggatcttccccctgcagggacaaataatccttctgctgttgtttcttcaagttttctagtatcaaattgtgctgtgttgtccaacaatcatgatgtgattttgactagttctcttgatctagcccttgcgaagcctctgcctaatttacctgcttctgcttctgagaaagctgtcatggattgtttcaataaactcttgctctctgcccgtttacaaaaagataaggggcaagcacttgtagagttccttacagtttatgatgcatcagctgctctttctttggaaggca

SEQ ID NO: 87999 - DNA, 154 bp, Glycine max
  Peptide Sequence Number=SeqID_204777
atggcggctaagcatgtggtcataataatgggcccagctagagcattgagaagggttgtgaatgagtacacacaagatggaactgtggatcttaaagggaaacccattctcaaatccaaaagtggtggttggaatgcttgctcctttgttgttg

SEQ ID NO: 88000 - DNA, 669 bp, Glycine max
  Peptide Sequence Number=SeqID_204778
atgaagctgggaggggaagtactaacagttcttcaggctatgcctgatgcatcaccctcggaaaatgctggtgagccaccgtcatatgggattccagagcatgcagaaccactgctcagaaagccaacgcaagtactagagattaataatgtgtttgcagactctatttggtctttatctgatgtgacaattgaagaaattttggatgatgtccgattggaatgtgcaagatttgggactattaaatcaattaatgtagtcaagcatagcagtgacgagaatttagcaaccaaattagaagaatgtgaagtcataaacaaagtggatgctaaagatgtttctcaagacacaaactgtattactaataatacagaatatagtttttctgacaaggctaattactccaaatttaaaggaacaaatgggatggaaatccatgataacaaagaaatggaagaagataaagttgatgagggtagcagtgttaatgttgataaaagtgctgaagtttttgatgataaatcatgtagagaacaccttgtagatgatacagcagttgaagatgcagaggataagaacataccttgtagtatcattcaagaatgtctgggtcaacaggatactctcgatgatgggccagaatttcttgatatgatggttgctaactga

SEQ ID NO: 88001 - DNA, 237 bp, Glycine max
  Peptide Sequence Number=SeqID_204779
atgactaatccggaaggaacacattttaggcctatcttcgggacaaatttcagaatattgattagagatgtcgtctgtgtttcagactcacttcatgtcatttctcttattcaagctcctatggttgttagtcagagatatgcatccatcatcatgaggatcaaagatctgcttaactttaattggaaggtagtgcttcgtcattctcttcggatgctgcaagagttcactttctga

SEQ ID NO: 88002 - DNA, 831 bp, Glycine max
  Peptide Sequence Number=SeqID_204780
atgtcattttctgtgttgaaggtaaaccatgggaatctagtgaagttggagggattttgcatagacccagaagaagcaaattgctatctagtctatgaatatgtagagaatggatctctatactcatggctgcatgagggcaaaaaagaaaagttgagctggaaaataaggctaagaatagccattgacattgccaatggtctccaatacatccacgagcacacaaggccacgggttgtgcacaaagacatcaagagcagcaacattctcttggactccaacatgagagccaaaattgccaattttgggcttgcaaagtctggaatgaatgccattaccatgcacattgtgggaacacagggctatattgcccctgaatatcttgctgatggtgtggtctctacaaagatggatgtgttcgcatttggggttgtgttgcttgaattaatttctgggaaggaagtcattaacgaggagggaaatctcttgtgggcaagtgccatcaaaacctttgaagtggacaatgagcaagagaagacaaggaggctgaaggaatggttggacaaggatattttaagggagacattctcaatggaaagtttgatgggtgctctcaccgttgcaattgcttgcttgcatagagacccgtctaagaggcccagcataatggatatcgtctatgcactgagtaaaagtgaagatatgggctttgatatttccgatgatgggattggttccccacgggtgatagctaggttttcttgttgctatggatatgccgaccacgaaaaagggtatagaagaccacccccaataagtagtacttcgtga

SEQ ID NO: 88003 - DNA, 579 bp, Glycine max
  Peptide Sequence Number=SeqID_204781
atggaaagcagagtggtatttgagaatgatttgaatctcaaggcaacagagctaagattggggttgccagggacggaggacaaaaccgtgcatgctattagtattagaaacaacaaaaggcaagtgcctgaaacttctcaagagtctgtttccatttccaaggcctcacctgaccagcatgtggagagtgatccagcccctccagccaaggcaaagatagtggggtggccaccaatcagatcttacaggaaacaaagcctgcaggagggtgatcagggggatgggatctatgtgaaagtgatcatggatggagcaccttacctcagaaagattgacttgaaagtctataggggctatcctgaactactcaaagctttagaaaccatgttcaagttgaccataggtgagtactctgaaagagagggttacaagggttctgaatatgcacctacatatgaagacaaagatggtgactggatgctagttggagatgttccatgggacatgtttatgacttcctgcaaaaggctaagagtcatgaaaggctcagaagctagagggttgggttgtggtgtgtga

SEQ ID NO: 88004 - DNA, 390 bp, Glycine max
  Peptide Sequence Number=SeqID_204782
atggaagatctttttaagaggtggacccagtatcttgacagcacacaatcaagggtcaatcatccaccaccggacattcatgttggcacaagctattccatggaaaattatcagtgggagcaagagttgcaaccctacaatcaatatgaagaagaaagaagttctaatatggataattttttgatgcaattcaaggaaacaattgaatctactcaacgagcatttaaaagtctagaaattgaagttggtaagctagtagaagaagtggctaaatttgtggccacaagggaagaaaactttgtagaggttgaagctcatgaggaaagccttgcagaagagcatgattcaagagaaaacgatgaagaaaaaagtgaggagaaaacacaataa

SEQ ID NO: 88005 - DNA, 330 bp, Glycine max
  Peptide Sequence Number=SeqID_204783
atggagggaaagagcgaggtatttcatgcccctcttcgtgcattttctgtaatcaagcattattatttgataacctgtccgggaagcattgctacatgggagatgccgggtatgtggaactggattgagccactgatcactgaggttgattcctttcgtggtctggtgtttaaactgagtgacactttgaatgctgacaatacgaacaagtttgcaatgttgctatggagtttggggaagagaaggaatgaaaagttgtggaattcaatggatgaaactaaagctacagtttgctatagagccaattcgatgctgcaggactggacttaa

SEQ ID NO: 88006 - DNA, 684 bp, Glycine max
  Peptide Sequence Number=SeqID_204784
atgccctcaccttgggtactagttaccctcaccgttgagaggactacacgtcctcgccttgagaggactacacgtcctcaccatcagagggctgcacgccctcacctccagaggactacatgtcctcgccttgagagggctgcacgccctcaccttggaggactgcacgccctcacctccagaggactacacgtcctcgccttcagaggactgcacgtcctcaccaggctgcacgccctcaccttcagaggactacacgtcctcgccttgagaggactacacgtcctcaccatcagagggctacacatcctcaccttcagagggctacacgccctcgccatcagaggactgcatgtcctcaccttcagaggactgcatgtccttaccttcagagggctacacgccctcgtcatcagagaactgcatgtcctcaccttcgtagggctacacgccctcacctttagaggaccacacgtcctcactttcggagggctacacaccctcgccttgagaggattacacgtcctcaccatcagagggctgcacgccctcacctccagagggctacacgtcctcaccttcagaggactgcacgtcctcaccttcagaaggctacacgccctcgcctttagagggctacgcgtcctcactttcggtgggctccatatccacaccttaagataa

SEQ ID NO: 88007 - DNA, 536 bp, Glycine max
  Peptide Sequence Number=SeqID_204785
cgatcgacgtttttctcgcctatcataaccacaaggaaagcccggtcgtcgccattttggccatgtatgacacgttcgaccggggatgtgaaggagcggcgcaagaattgtttgttgtgcaccaactcttggctagcatggagggacgtctgttaattggttccctcgctagaaggaaggaagaatcaggattgtatcttcatgcgaaggatgtccaaatgttccctggatgggaacatggggacagagagcttaggggaagcagtaatgggatcatcggtggctatcataagtggctgagagtccggacacaaggattggattggctcccaaatctaaagactgtgggagacaatgaggttaaagcttcggaagaaagtgatgaggtgcaagcgctaaaggcaaagcttgaaagagcccgggtagtcaaagagaagttcaaggcagcaatagtgagctcaaactctgaagaggtgaaaggaatcatcatgggtcaaaggcatgatctagaaggacgagttaaaggcttgccttag

SEQ ID NO: 88008 - DNA, 741 bp, Glycine max
  Peptide Sequence Number=SeqID_204786
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgattctatcttcatgcgaaggatgtcccatgagaggagtgccatcagacgaaagcatcacgcctttcatcgcacgaggtttcagtgaccacaacgcgagggacagagagcttaggggaagcagtaatgggatcatcgacggctatcataagtggctgagagtccgaacacaaggactggattggctcccaaatctaaagactgtgagagacgatgaggttaaagctttggaagaaattgatgaggtacaagccctaaaggcagagcttgaaagagcctgggtagtcgaagagaagttcaagtccatagccatcaaa

SEQ ID NO: 88009 - DNA, 309 bp, Glycine max
  Peptide Sequence Number=SeqID_204787
gtattgtcagcagccaaagttgccaaaaagatgaagctaaaatttactaaagaatggattgcatatcttagattgcctcttccaattgatgtttacaaagaggtaatccacaaatgtctcaaggtagtcatgagatccaatgtaggattggaaggggggaagaaacacaaatggtggaattgtaagattttgaaaccagctttcacaataatagctgatcatgagatgaaatgccttttgttattgattcgtggcacacatagtaccaaggatactttaacagctgttacaggaaatcttttacaataa

SEQ ID NO: 88010 - DNA, 123 bp, Glycine max
  Peptide Sequence Number=SeqID_204788
atgaagaacgatgtagaagtcgattatgatcgcaattcagtagcgcctcggccttcttgcccaggtgagctattgcttcaacctgaagtaaccttgcttgcccgggcaagctcagtcgactag

SEQ ID NO: 88011 - DNA, 825 bp, Glycine max
  Peptide Sequence Number=SeqID_204789
atggcactgaatattctcggcgtgaagctggccgcgatgttcgaactggtggtgacggtgctggcagtgctggagctgctggtgttcatgggcgtggtatcgccgggtttcagcgtcgctaacttcgccgctaacggctgggccggcagcgaccattttggcatgccagcgctgtccggcatctttgccgccatcccattcgctatctggtttttcctcgccattgaaggcgcggccatggcggccgaagaagccaaagatccgaagcgcaccatcccgaaagcctacatcagcggcattcttaccctggtggtgctggcgattggcgtaatgctgctggccggcggcgcgggcgactggcgcaagctgtcggacatcaacgctccgctgccgcaggcgatgaagatgatcgtcggcgagcactctaactggatgcacatgctggtgtggatcggcctgtttggcctggtcgccagcttccacggcatcatccttggctactcgcgtcagttctttgccctggcgcgcgcgggctatctgccgcacagcctggcgaagctgtcgcgcttccagacgccgcaccgcgccatcatcgcaggcggtgtcatcggtatcgccgccatttacagcgacggactgatcaacctgcagggcatgacgctgacggccgcgatgatcaccatggcggtgttcggcgcgattgtgatgtacctgatgagtatgctgagcctgtttaagctgcgccgcagcgcaccggacctggagcgcagcttccgtgcgccgggctatccgctggtaccgggcatcgcactggtgctgtcgctg

SEQ ID NO: 88012 - DNA, 228 bp, Glycine max
  Peptide Sequence Number=SeqID_204790
atgatcactagaatattaggaagggaattcctaattgaattagcaaagatatctgaggccacttgtctaacacgttggtggcgactccgtgcattttcctttcttggaagacatacccgtgagccctgcgtcgccttcccgccgaaggatttggatgcaaggagaactgtgacaaggtgcgcattcatgactggcaactctcttgatagttggaaggaaactctttag

SEQ ID NO: 88013 - DNA, 108 bp, Glycine max
  Peptide Sequence Number=SeqID_204791
gaatgggtagaggaagaatatcccatctatgctaacggtccaggttacatagtctcagctgacattgctcagttcattgtatctgaatttgagaagcgcaaattaaaa

SEQ ID NO: 88014 - DNA, 204 bp, Glycine max
  Peptide Sequence Number=SeqID_204792
tgggctaagcgtgcatccaccgctaagcgcagctttagcgcgcttagcgagaaagaagaatctggcaaggcattagcatcaaggccacacgctaagtgcgagatcagtgcactaagtgcagcagacttgaagcagatgattggcacagattccagagcataccacagtgcctatttcgggaaaagagctctggaggcagcatga

SEQ ID NO: 88015 - DNA, 222 bp, Glycine max
  Peptide Sequence Number=SeqID_204793
atgaagaagatcctaggcctacaagctccaatggagcttacatcacccctgacccctcaactttttgcgttaatatgggtgatctcttacagaagagacaatataaggaaaggtttcacagaatcaacagtgaacaccagacaattgagagacgaggttcaacacaaagaaaaagatgacataataggacaaaaaaaaattaagagtagtaccatgatgtga

SEQ ID NO: 88016 - DNA, 1011 bp, Glycine max
  Peptide Sequence Number=SeqID_204794
atggaggatgtagtccctatggatggagtgaaggatagtggtgttctagatgaagtagacatccccttggctaaacacattagtggtcaatgtcttgaacaagagggtccttggatggtggcagaccattacctcattcttcagagatggagaccattctttcttatgaatgggaaaataacaaagaaggtagcattgtggatcaggatccaacgtctctccattgagctttatagtaatatcttcctcgacatgataggcatcagtctcggaaaattcctcaaggtggataagttgacatcaattcaatctaaaggaaaattcgtgagaatatgtgtgaagttggaccttgagaaaccacttgaaactcatatttatgttcatgggttgagtatgaaggaggagaatattccagggagtattgggagagagattttctttgatactatttgtaatattcttgattttcgacttctcgatggctctcacactatgacacttcaggaggtggtagtttactcaacatccttgttggtcaaaaccctagtaaagtgccaccacatgaagtgtcatagtgtgagagctgttgaaaagtcaaaaatcagagttgtgacaaatggtataagagcaaacctctctcctagtacggtgtggtttgaggaaaaaccagactatacaattgacgatgacctaaaagaattaattggttccacctataccaacaagatgcatctacttttaagtagctcatcacttaagaactccacagttggatgttctaacaaacaaggatgtggagtgaagtgcgaatgtgtgaagtgtcgtagtgtaagagtcaccaagaagttgaaaatcggtgatgttacaagaatagaggaagagatgaagtggagcactatgtttggaactattgttgatcatatttggtcaagaaggaatgaattcatctccacaccaaatgatgataacggcaaccatgatgcttctagaaggtggaagaagcctctatag

SEQ ID NO: 88017 - DNA, 621 bp, Glycine max
  Peptide Sequence Number=SeqID_204795
atggcacaatacctgtcagagtttgaagacctcgccaaccgcgtgatcgtccttcctgctccgttcttgctgagctgcttcgtgtctggcctcgctcccgacattcaccgcgaagtgcaagcccaccaacctttgacgattgtccaagctgcagggttagcgcgcttgcaagaggagaagttgcaggatcctcgaccgccaccgcgattccgccctatcccaccactaaccccgccttctctgactttgccctctccgtgcattcctccatctcctcctttgctgccgtccccctcgcggccaccgccatcgcccaccgtgcgtcgccttactcctaaggaactggcctctcaccgcgagaagaggctatgcttcttgtgtgacgagaagtttcaccgcgggcacaggtgcacccctagggttcaccttctcattactgaagaggacgacccaggcgacccttcccttatagactcgggcgacccagccccgtacccagctgatgggcctgacctgcttgcggcccaaattagcttacactcgctaacgagccttatggcccctgagacgttgagactcattgggtaccatcgtcggctatgcgattcttgtcctgattga

SEQ ID NO: 88018 - DNA, 188 bp, Glycine max
  Peptide Sequence Number=SeqID_204796
tcttacggatagcaaatgatactttttcgcaatctcggtcggaagacgccgacatctccaaggaaggtgcagatgacgatatgatgatgttagtcactgaatgctctcgggctttgagtcttacggatagcaaatgtgtgtgttcgggttaccgtatagggcgtctccgcgtgccaatggactcacag

SEQ ID NO: 88019 - DNA, 1041 bp, Glycine max
  Peptide Sequence Number=SeqID_204797
atgtctagcagccgagcggcaatacgttgtggttcagcgctcaataggaatcaatccgtccgttcatcgaagcaacacaattcaaaggagtggtgcatgtccagctggtctatttataaacgccgggcgttgctgggttgcctggcgacgccgttcggcgctcaggcgctggaatgccacctgaataccgagaacggcattaccgaagagagcgaggatatcggccggttgaccataccggccaccttaccggtcggcagccggctttggacctctaaaccgatgagccgcgacgttatgtgctgggcgcacgccagcaaacccaagggggaatgggtttatttctatcccaatccggacaaccggcagttcgccgccggcatcgccatgggggtgatttataatggccgggatctcggcttgatcaactcccgagtacaaaccgatatgtttcgcacccctaagcaacgggagctcggtcatgtcaactatcaggtttatttgcaaaaaaccggagaaatcaccgaagggggcgccagtcagatcgccgtttttcagctcgatggcgtaggcggcatcaacgtccacccgggaaaaaattaccgtttcaccctaaccgggctggataaaatcaaggtgatccagtgcgccgcttcggtggagctttcaaccccggaaggcgttgatttcggtgagatcccgacctggaaacccaatgcgggcaccgtagcgagcaaggatttcagcatcttgatccgcaaaaacggctgcagcgacagcttcgcgctggaggccaatttcatggtgaaaaatggcacgctgaccgacgctaccggcttgaatatggacaatggttcaaccttgcgcatccacgataattccaaccccaaatggattaaatacaatcagttcgacagctttgccgacatgagtggccgcgatcaggtgcaaaaatcctacagcgcctcattgcaggccagcggggaaggacaggaaggcaatttccgcaagaccgtaatcttgctgattaattatatttaa

SEQ ID NO: 88020 - DNA, 187 bp, Glycine max
  Peptide Sequence Number=SeqID_204798
atggagggtgcattgaccttgttggatgtccctggtttcatacgttgcatgttgtgtatgtacatggaagggtgtagtgaccttgtcggatgcccctggggtgcagtgaccttgtcggatgcccctggtgggggaaatatagtggttaaaaagtttaagcatctcaggagggggatggctgatcgag

SEQ ID NO: 88021 - DNA, 182 bp, Glycine max
  Peptide Sequence Number=SeqID_204799
gaacttaccggttaaagactgaagaacgaagaagaacggtgaagaacgatgaagaatttccgcagaatcgcttacgaaagtgttacggaagcatttcgactcgatttttcatcacgaaaacggaggttcttgccgcccagaggcttcttgaggaagatttcgaagcgtaccccaattactaa

SEQ ID NO: 88022 - DNA, 1473 bp, Glycine max
  Peptide Sequence Number=SeqID_204800
atgcttgttccgaattcatggattgatttgacaaatgtcttcaactacaagatactcaccccaacatacgtagagagccaggtgatcattgatgatccaaatttcaacaccaactctttttctctcgtgtttcctaattttggaaaccttctggctggttgcaaagcaaaattccaaggcataacaaaggttgaaacttggaatggattcattcaatcagagtgttcagaattccagcttcaggatgtgtatgctaagttctctctcacttacaaccctgatgagactctctctacaagaattatcaatggaggtggcaaaaacccaacattcaatgaaaaattgaggatgaagatcacccaaatagatgctgttctgaaatgtgaagtttggatgtttagtaggtcaaggattcacatggaagaccagcttttggggtttgctttagtcccaattgcacaagttgttggcaaaggaaaggtgactgaagattacagcctttcctccactgatcttttccactctcctgcaggaactgtccaactaacattgtctttggacccctctttggcaatcaactcatcagtgaatttgatacctgaatcagcaaagaactcatcaatatcatcagaagttattttgcttgatagaaagatctcagaagttatgttggacccagttgagtatgctagaattgagtttcctgacatcagtgtggtgaaggagaatcagcaaatggtatctgagtacttcaatttggcttctcaaggtactacttctgctccttcaaggtccaacattggagggtcactaccatttcttcatcttggtgcatctcctcaacttgatgattatgagatgactatcagttcacaagatgagaatcatgtagggtccatttctccaaatgagagcattcagaactcttgcttcctaggctccaccatcacaaccttgagtgatgatagaaactcagccgattcagttgagaaaaagaaccatttgagcactggcgactcatcaaattctgtcactgtgtcaatcactgtggaaggtactcaaaactgttgtgctggtccagataccccaacttccaagaaagaagaaggtgaggccagaaatgacaaagatgcaaacttctcaagcaaggaaaaggaaagcaaaaaaaccaataacaacaacacagaagctgcaaagtttggtcaagttttttcaggtccactagggaacatcaatttagaagctgagcaagctgctatgcaaaaacaaatagtggacatgtatatgaggagcatgcagcagttcactgagtccttggcaaaaatgaagctcccaatggaccttgacaaacctgaaaaagtggatcatggtgatggtgatgtgattcagaatcatgacagcagcaaattagaaatggataagaagaaaaaggatggctcacgtgtgttttatggtagtagagcctttttctga

SEQ ID NO: 88023 - DNA, 660 bp, Glycine max
  Peptide Sequence Number=SeqID_204801
atgaatgtgcatggctgctcagtgatggtggcgaagtggcgtggaggagatgggatagggtggtggcacaacgcagaggttgtcaatgatgatgatggggaaggaaaaagagggagggtcaaaaatggacttttccggggggaggttgaggccaataacaaagatattgcatttatgagacgtagtcaaagtgagatagtttctagtgggattctaaaagggccctatattcaagctatgagaggaaggaaccaaatgaacaaatgcaaccacaaatatggtgtggttgcatttgctgagagctccaaggggaaggctacctggcttagagatcctgatcaagatgtggacatcatctcggtgcatcatgcttcaggtctcatctgcgaaataaacctaagcaaccctctctccacttctgatgatttgcgcttcttgggaacctttcacgtgttttctgtcacaggcttttacaacaacaacctttcagcttcttcatcccccaacaacaacagcattccctattcatcctctgcaattcaattcacgagaggaagccctcccaaactctttgaaggtcttattggaggcaagcttataggtgtagaacctgtgcaggtcatggcttctatcgttaagaagcgaacatgttctacttga

SEQ ID NO: 88024 - DNA, 554 bp, Glycine max
  Peptide Sequence Number=SeqID_204802
aggactacacgtcctcaccttcagaaagctacacgccctcgccttcgaaggactacacgtcctccccttcagaggactacacgttctccccttcagagggctacacatcctcaccttcagagagctacacgccctcaccttcagaggactacacgtcctcaccatcagagaaccacacgtcctcaccttaagagtgttgcacgcccttgccttcagaggtctacacgccctcaccttcagaggactacacgtcctcgccttcagaggaccacacgtcttcaccatcatagggttgcacgcccttggcttcagaggactacacgtcctcaccttcaaaggactacacgtcctccccttaagaggtctacacatcctcgccatcagaggactggacgttctcactttcagagggttacccgccctcatcttaagagtactacacgtcctcatcatcagagggttgcacgccctcgccttcagagggctacatgccacacctttagaggactacacgtcctcgccttcagaggaccacacgtcctcaccatcagagg

SEQ ID NO: 88025 - DNA, 267 bp, Glycine max
  Peptide Sequence Number=SeqID_204803
atgtcgcagaactttgcggattacctaacgatggatgttaagtacctcgaggcggtcgagcgaaggttgcatgccatcaaacaatggtccccggacaaaattagggcgcggatgaccataaggtatctccgcctacaacctaactcgctgtccctggatgacaaaaggtgcagaagacgatgtcggtctcttcgcatcaacaggctcgcttgtccctggttaacgaaaggtgcgggtaaccataaggtaaccctgcatgtcacctga

SEQ ID NO: 88026 - DNA, 177 bp, Glycine max
  Peptide Sequence Number=SeqID_204804
atgtcctcctttcgcgatttggagcagaaatgggcaccaaaggttgaagctttgttgggcaacaatggtggatgggagaaaagaagaagaaggttgcgtgagagagaaagagcttctgaaatttttttggggctgagtgaggagagagagagagctatgccacatgtctccatttga

SEQ ID NO: 88027 - DNA, 480 bp, Glycine max
  Peptide Sequence Number=SeqID_204805
atgtcgatctctccctgcataagtattagttgggatcgcccccacaagacacacagtggacccggaggagccctacagggccctggggtttccagctctggttacgggcctctatcagtcctacagggtgcctgtcccccccagcaagggatcgcacccgcaagacacccagtggacccggataagtccaacagggtcttggggtttccagttctgattacaagcctctgtcagttttacggagtgcctttcacccccagcaaggtcattaggcccccaactaaccgagctttcaacaagaagtattgcacccccaggcaggcgcagggcgagacaccacagcagcctggggatggccgacagcgagcaataaacgcaccgtcgccacctccaaagcgcttcagctcatctacaaaggctggagcgttacctatgacccgtggccgcccaacaggcgaccaagtccaaagccaaaggtaa

SEQ ID NO: 88028 - DNA, 366 bp, Glycine max
  Peptide Sequence Number=SeqID_204806
atgaccaagagcaatggcaaggatccacttgaaggacatggaggacctatgacaagggctagagcaaggaaagccaaggaagctcttcaacaagtgttgtccatactatttgaatacaagcccaagtttcaaggagaaaagtccaaggttgttagtgggtcattactaaaatctgctgtaaagcttctatataagctggaccattttatcaataaacacaagttgagttttattcagaaaattagagtttatctcttttatcttattgagagtgattctcctaaattcttgagtgattcaagaacaccctggctgtatcaaaggactttcacaacctttgtgtgttgccctcactggaaagagtga

SEQ ID NO: 88029 - DNA, 1266 bp, Glycine max
  Peptide Sequence Number=SeqID_204807
atggatgacaccttagattatagactacataatcaaggattttcagttgtggctactacaaggaggttaccttcagattctggtgcctttgcggactgggcagcgacagcttcctccggtgctggtggtggtggcggccgcgctgtccccgtcgacgacctctccctcggcttcaatgcgggtcctgctgccgccgccaccggacccaccgccggtatgtggtccacccaagctaggtcaatcaattaccccgaaatggggatgttcgtcgtggcgccagcttcttccttccaccaccaccaccaccaccagccgccgcaacacgatccctctgtcatggcggattcccttaaccccgccactgcactcggcgtcggcgtcggcgtcattcctctcctcgcagccacgccgtgcctcgaatccgacaacaacatcctcggaagtaggacacgtggcggcgggggaattcagctatggcaagaccaacaacaacaccatcaaagccactacatgaagaagcagctgcagcagggtcttctcgaccataatagtaacaccagttcggggaatttgattcagaacagtggcgaggtaactgcttctggaactagtagcggcggaacaacgtgccaagattgtggaaaccaggcaaagaaagattgtaccaacagaaggtgtagaacctgttgcaaaagccgaggctttgattgtcctacccacgttaagagcacttgggtccccgccgcacgccggagagagcgccagctaatgacgtcggccaccgcagctgtcgccggttctagtggctccacttcgggcactaaaaaacctaggctcattgcttcacaaaccacaacaacttcccacacttccacttccaacaccacccctcctagaagctttgacactagctctagccatcaagatgcggggttcaaagagtcattacctgggcaagtacgtgcaccagcggttttcaagtgtgtaagagtgacggcggtggaggatgggcaagatgagtatgcatatcaagctgtggtgaagattggtggccacgtgttcaaagggtttctctatgatcaaggggtggagaatagggatgtgtatcctaacctatctgagttgcatttgggtggtggaagtggtggtgcaggaagaaatggggtttcatcttcatctccaatgatggatcctaatgatgtttatgcagcttctggtggagggttattagggggttcttcagcatatggtaatccaatgaattga

SEQ ID NO: 88030 - DNA, 828 bp, Glycine max
  Peptide Sequence Number=SeqID_204808
atgaaattgtgtggtcccttttatttacggtggatgtacccgattgagcgatacatgaagatctttaaaggatatacaaagaatctacatcgtcctgaaacatccattgttgaaaggtacattgtagaagaagctattgagttgtgttcaaagtatattgaaaaggcaaaacctattgagcttcctgagtcttggcatgacgagagagttaatgaagttgtgacatacatagttcgtcacaaagcattagtcaaagaaagtaatccaaaaatgaccaagaataagatccttgtggtgaaaggtggtcaatggttctacacgaaaaattcattggtgttaatattgaagatgatgattcaaccctatcacactcctttctccacacatgtgcctaacgtcaatggagaagaagaagttgatgacgtcaatgcaaatcgtaatgatcatgatgaaggagaattaattaacattgcatatggttacaccactgagctcccccctcttgagtcagtaccttcattgactacatcgaagagggctagaaaagtcacacaacttatatcattgtctgtcaaactcgtgggggtagagaggtcactagttcatgtggatcttaccgctacgaaagttgatgaaggcaaggaggacgacgatgacaaagtctatgagaagtacaaatttagcaaagagaagtggaaccaattttttcaaagtcgtagcgaccttttatgggaggatgttggaaagaaggcgcaatccatgcagaaacaaaatgttgcccctctcgtacttgaacaaaagttaatggaggaaaatcaaaagaaatga

SEQ ID NO: 88031 - DNA, 576 bp, Glycine max
  Peptide Sequence Number=SeqID_204809
atgacgacattccttaaaatcatgagtccagccggggagaccttgcgtggtgccaagttaacaaaatcaatatacatgggatgcagcctagatgatgaagatgactggcatcacttcagaaatgctgttcgagctacgatacgagaaacgccaacatctacagagagcaaagggcgttccccatcaccttctttgcaacctcagagagcaggagcattttcattcacttcaaccatgccaaaaaaagatttagagaagcgaacagtttcaccatatagatttccacttttacgcactggatccatgtcaggtaggcctacaacacccaagaatagtagaccaactactccaaactcaagcagaagacccaccacatcaagtccttctgatgcaagattaatgtacccttcagagccacgcaaatcagcctcaatgcgattacctgccgagagagacagcaacaaagatgtagaacaccaacaccacagtaaaagtaaacgtctcctgaagtccttgcttagcaggcgcaagtctaagaaggatgacttgctatacacttacttagatgaatactaa

SEQ ID NO: 88032 - DNA, 453 bp, Glycine max
  Peptide Sequence Number=SeqID_204810
gaatcaagaattccagcagatcttaaatacttttcaagctttgcactgtcatggatattctcatggcaatatcgttacagcaagactgaaaagacaaaccaatatccatcactacaaagacacgcatttgtaaaatggtggacacaatttgactcatccaaagcggatgcagaacaagtaaaactatggttccaatcccatccagaattcctcaaagcagctgatccagagacttctgtgtttttgaaccaaaagtctcatctggcagcatttttagcaggatcgacatcaaaggaggtcttagctaaaaatctgaaggaagttctacaaatgttacaacaggaagaagaagcttcatcctcaaagaaggaagaaacaagttctgctgaagaagacgaagaagatcccttttaccaaaacgaagatgattgttttggtatctgtttagattaa

SEQ ID NO: 88033 - DNA, 624 bp, Glycine max
  Peptide Sequence Number=SeqID_204811
atgacatccagtgaaacaccatcatcccaagaagcctctactcaaaattcaaggcctaatattagagcgaaaactgatatagcttccagacattgtaagatgattaaggagggggaggtggaattaattggttcaagggtcacttggctggtgctagcagaagttcgctatcaaatgaaacaaaatcttgatgaaaataagagtaagatgagaaaaattgaagaagaatgtgatgatagttattcacctagtgaagagggtggtgaagtgccaatagaagtggaacaaccaacaccaagagcttttgcaactaaaaagcatgagtctaggatacaaggctccaagtatgcacaacctttggggttattagaaaaagagtttcccaaattggtttggtctccttgtgcgtcacactacattaatttgatgttgcaagacatgggaaaactagaggaattgactgagccacttgtatgtgtgttgcgtattgttgatagtgaagataaatatgctatgggttttcttaaccaagctatgtataaagctagagaagagatggtgagaaggtttcagcgaaataaaacagaagtaaagccttacttgaaaatcttagatcatcgttga

SEQ ID NO: 88034 - DNA, 297 bp, Glycine max
  Peptide Sequence Number=SeqID_204812
atggtgggcatcttgtactacaagaagctcgttgaggccatcaattgcaatgagaagccctctaacgattattacaactttacaagggttgatttcatcaagggaagaaaatgcatgataatggttcgtgtgccagctttgtcagggtgtcttatcaaacctggagttaattatatcagtggggaggaacataacaagctctaccagcggttgctacggagcacttttggcagcatagtaggaagttttgaggatacaatcaaaagaaatcattgcagtggatatggttggttgtag

SEQ ID NO: 88035 - DNA, 441 bp, Glycine max
  Peptide Sequence Number=SeqID_204813
atggtgacaacgaaggaacttgagaccctcctggaatcatttgaacagacatttacagaggcacaagaatcaaccaagaaaacattagattcgttgcacaaaatgttggagagtctcgtttcatccttagcatccttgaatggtgaaaagaaaatcttgaccgatgaagacgagaatatagatactcttgattcaggtcgatcaatagtagaacacgcgcaaattcaattccttgcgtttgatggaacaaacttttgggattggagaggaaaagctgagcaattttttgaattagaggttacaccgatagcacaacatgggcgtgaggttaatttagttaatagaagggtgtgggtagataaggatatagcttctcaaagaagcttcttgagaaagcttctcaaagaagccacggggaagcttcttgaggaagcctcttaa

SEQ ID NO: 88036 - DNA, 624 bp, Glycine max
  Peptide Sequence Number=SeqID_204814
atgagatataactggttgtacgctggagatgttggggttatgcatgaggatgggtatttggagataaaagataggtcaaaggtgagtcgtgtggagggtgaagtcggtgttgtacgtgcacccgacgatggtgggagtggtggtgtagtatccatttgtgaggctgaaagaaggactagtggtgtcgctgttggagaagaaggtggtggagttttgcaaggagaagttgccgcactttggtgcctaaaatggtggttgaaggaagggctagtggaaccaccattgaagaaggaagtggtggagtttctacagggagaggttgtcgcacttcatggtgcccaaattgggagatgctcgatgatcttcatggttgtcaagttggaggagatggctacaatcggagaatccatagggatgacggagctttatgaagggaaagtagccggaaaacatattgatgcggtttcaagtcctgagatatcagctaaaagcaattttcaaatttatagtgcagtgaggcatgaaaatgacaacacgaaaattatgaaggaactaggaaacatggtctcaaaagatggtgaatattgtgatcttggttctcattggtggctgaagcttttatag

SEQ ID NO: 88037 - DNA, 294 bp, Glycine max
  Peptide Sequence Number=SeqID_204815
atggctgaacttaaccaagatgacacattcatgcccctattcggtcatggcatatggataaagggacaaaccgacaaaggtttcacaatggatacggttatagcaaggctaaaattggatcattggttttctcattggttggcttcatgtagagcctttaggccttggatcttcttcatcaatggagtcctttgcttcttgaagatcaatggcagcggaatgaagaagaaggaaaggttattggagaggccacttcaaggagaagatgagtcaagaacaagctcaccaccatag

SEQ ID NO: 88038 - DNA, 589 bp, Glycine max
  Peptide Sequence Number=SeqID_204816
atgactggacagtttcgtcccaggaagctgattgctgatgttaaaaatgagatctctaatgctgaagaattcgatctctccacagtcaaggatgttgtgaagcatttcattaacaagtcactttattcttttgggttaacctcacagttcgcttttcctccttcaacatccttgctgcttgctatagaaggccatggtgagaaagaaagattgcgccgcaaaatgatgcttcatgatcatgatcttacgttggaagcagcatggcctcaattatttgttgaccacaaaggaaaatattgggatgtccctgagtctttatctgttgatttgtcatcccttgtgtctgaatctggattgcgatatcactttgggatacataaaaatggtggtaatccccaggcaatgaatgcaaccgatggtaacccgccactgtctctactgccagggttatgtgcgaaggttgctgttagttatgagaagatcaaatacttctggagagataaaggtgctgcagaacaagagaatgaagaggcgcttccatatgatgtgcgtcttaaggaacctcacgcagcagtatctggaattattg

SEQ ID NO: 88039 - DNA, 144 bp, Glycine max
  Peptide Sequence Number=SeqID_204817
atgaccaaacttggtctctgcgtgccattggacacgactgtgtctgaatggcaaaggggtgcggataaccgtaagaatgaccagacttggtctctgcttgccatcggacacaactgtgtctgcctagcaaaggggtgcggataa

SEQ ID NO: 88040 - DNA, 468 bp, Glycine max
  Peptide Sequence Number=SeqID_204818
atgggtggaagaaccaaaggtttaagaaggagggggggtccaccaatgaggttatatgaagtgcagtttagacatttgaataagcaggacaacactatggttatttcttctttttcaaaggaagaagtgaaaggcacaatatgggagtgtgttggaagtaaatgcctaggtccagattggttcaatttccacttcataaagaagtgttgggggatgattaaggatgatatcatgaaggttatgcatgatttttactctcgcgaggttcctccaaaagattttgaaaaggcatatgatttcgtgagatgcaactttctataccgcatgcttcaaaggttaggcttcttcgagtgttggattcattggatcaaagcttgcttggaaacttcctcaatgtcgattttgattaatggtagtcccacacaggagttaaaaaatcagagggggttgagaagggggaccccttag

SEQ ID NO: 88041 - DNA, 557 bp, Glycine max
  Peptide Sequence Number=SeqID_204819
gaaatggccccgaggaagcttgcctcaaagaggtccagggaaagacaaggcggccgaaggaactagtttccgcccccggagtacgacagtcaccgctttaggagcgttgtacaccagcagcgcttcgaaagccatcaagggatgggcgccggcggtgggcaccactggttactcctatggccaatggatcccgttcgatgccgacgctatcagccagctcctgggatatccgatggtgttggaagagggccaggaatgcgagtatggccagaggaggaaccggtctgatgggttcgatgaggaggccatcgcccagctgctatgtataccggggcaggattttgcccggactgctgcagggaggcgagtgcgaatcatgcgcaccaatatgaccaccctgacccagatatggatgacgttgctcctcagcaacatcctgcccaccgatcataattccgacctccccatgcctaagtgccagctggtgtacgccatcctgacacggatgagcatccatgtggctcagttgatcgctgatgccatctatatttttgcag

SEQ ID NO: 88042 - DNA, 333 bp, Glycine max
  Peptide Sequence Number=SeqID_204820
atgaaagactttagacttatctccctctacaatggcatcaacaaaattatttccaaagtccttgccaatagacttaaacccatccttcccaaatgcatctcccaaaaacaatcaggttttatagaaaaccagactatcctggataatgtccgcttatcctcaaaagtcatccaccatatgagatgtaagaataagggtgtttcaccttttctaaagaataatgaggtgaaaggagatattcatggagtgaagttaagtgacaatgagattaccattataaaggagatccttgacaagtatggtgaggtttcaggccaaaccatcaattactag

SEQ ID NO: 88043 - DNA, 282 bp, Glycine max
  Peptide Sequence Number=SeqID_204821
atgtcttttattagtcttatactcagtggacaccctatgatgagatcatggattctgacaaagaagtgctcgcgaagctcaattctcgaattggcctataaggcgtgcaagagtacaaaaaagagtggagtctttagcttctatgatggagcaaacaataatgagttgggttacattgctaagcaattaaggaacttaaagaaaaagttcttagaaaaattctcaacaccaaggccttacatagaagaaaggatacatgaagagtatcatggttcagaatga

SEQ ID NO: 88044 - DNA, 459 bp, Glycine max
  Peptide Sequence Number=SeqID_204822
atgggaaacacagtgaaattggggactttactgtttgagttgttatcagaagctcttggtctgaattcaaactatctaaaagacatggaatgtgcggagggactttttgcagtttgccattactacccttcatgtcctgaaccagaattgactataggaacagccatgcacactgacaatgatttcttcacacttataacaagtgatagatgcaagagtgttgaacacagagtgcttgcaaatcatgttggtccaagaatatcgattgcaagcttttttcgccctcgtggaaaagcagccttaaaggtttatgaacctataaaggaactattatctgaagacaatcctcccaaatacagggaaactacatttgctgactatgaagcatactatgttgcaaaaggacgactggatggtactagtgctcacattacaagattttggaaaaagaaggattag

SEQ ID NO: 88045 - DNA, 216 bp, Glycine max
  Peptide Sequence Number=SeqID_204823
atgaaaggttattggaaccgtcctgacgaaactgaaaaagtgatgaccaaagatggtttcttccgtactggtgacgtcggtatcatggatacacgtggctttaacgtttatccaagtgaaatcgaagaagtgattgcaaaacatcctaaagtgttggaagttgctgcgattggtgtacctgatgatcgaattcctgcagcccgggggatccactag

SEQ ID NO: 88046 - DNA, 369 bp, Glycine max
  Peptide Sequence Number=SeqID_204824
atggctataacagagtttctgttattcatattaacagctactctaggaggaattttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcggttcgttcgataa

SEQ ID NO: 88047 - DNA, 1490 bp, Glycine max
  Peptide Sequence Number=SeqID_204825
ggcgtttcacggcgcgaaaagcggtggtcaccgccggcacctgggtgaaagcgctgttgccgcagctgccggttgcgccattgcgcaaggtattctcctggcatcaggcggatggccgctacagcgtgaacaatcgcttcccggcctttaccgttgaagcgcaagacggcacgcactattacggcttcccggcggataacgacggcctgaaagtgggcaaacacgacggtggccagccgatggatgcccccgagcagcgcaagcccttcggcagctacgccagcgacggcaccgaagtcttcaccttcctgcggcagtttttgccgggtgtaggcgtatgtttacacggcgaagcctgcagttatgacatgagccccgacgaagactttattatcgataccctgccggagtgcgatcgcctgatggtcatcagcggattgagcggccacggcttcaagttcgccagcgcactgggcgagattgccgcgctgttcgcgcaggacaaagcgccgccggctgtcgctgtcctggttcccgtcgagccctgggcagcgaaatctgacgtcctattttacagaagatatgctccatcggctttcaacaaggacgtcaccatgaaactacttgtcgtggacgaatgctgcttcacccgggtcggtatagccagctactttgctgatagtgggattacgacgatcaagtgctgccacagcattgagtacgctacgccgctgttggccagctttcagccgagccacattctggtgaacctcagcaaccagtgccgctataacgaagcggacgcacagctgctggcgtttatggaagccagccagtctgccttgctgtttatctatctcgatacgccttacccttacagcgaaacgccaatgcgcatcgccgataacgcgtttctgttcaataaaagcattctgccgctcaccttacgcacgctgcgcgaaaatccgctggcgctggccgatgacggcgaagagcgttccctgttcagcccgcaggaactgacggtgatgaaatattggatggcggagatgcccaactaccgcatcgcgaaaaaactgcaaattagctcgcatacggtgtacgtgcacaagcgccacatcacggagaagatcaacgcgcgcaaccggttggagttctactcgttatataacgtgctgcgttatttctacccgccgaacacgccaacgaactcgacgccgttggcgctgctggcgcgctcatatgcgcggcgcgctataaaagacgccgagaaaaggactataatcaaaggtctctttcttctggcggctgaaatgttaaaccgaatactggcggctatcgtcaacaacgtgcgtgagcacctggccgccgctgcgccccggccggctgctgctgcagatgcgctatgccccgatcaatccttccgacctgatctcgattcatggccaatacgcgcaccgtatcgccctgccgcaggtgccgggctatga

SEQ ID NO: 88048 - DNA, 1068 bp, Glycine max
  Peptide Sequence Number=SeqID_204826
atgctggaacgccgccgggtgccgcgcatccttggggtgacgctgctggtgacagcggtgatcgtggtcgtgatgctgtttatcggcatgctgggcgcttcgctgaacgagttcgcccgctcgctgccgcagtaccgcggcatgatgatcgagaaactgcgcgagctgcagcattacgccgatcgcttcaatatcagcctctccagcgaagcgatgctgcagtatgtcgatcccagcgcggcgatgaatctggttacccgcatgctggggcacctgtctggcgccatgaccaacgtcttcctgctgctgatgaccgtggtgtttatgctgtttgaagtgcagctgttgccttataagctgcagcaggcgttggataagccgaacgaaggcctcgccgcgatgcggcgggcgctggacggcgtgacgcgctatctggcgctgctgttcaacggattgggcgatgcgctggtggtggcgggcggctttatcgctgtcaacatggtgatcggcaatatcctcgaaccgcgggtgatggggcgcgggctggggttgtcgacgctggtggtgttcctgtcgctgatcttttggggttggctgctcggcccggtgggcatgttgctgtcggtgccgctgacgatcgtggcgcgcattgcgctggagaccaccgagggcggctatcggctggcggttatcctgggggacggccgcccgccgcgccagcctccggcggcgccggagtggaacagcgaagcgcgcagctttaactcgtccactacgcgccgccagtccacctggcacccgcctaaaaggcccagcgccacgaaatcgccgccggagcgaaccgctcgcgccagctgcaatccgtcttctccgccgatgcagtcgatggcggcgcgggcgccaaaatgggtcattttcgccagctgcggcgcttcgataacgcgccaggcgccggcggccagcagcgcctggcgatgggcggcgttgcgcaccaccaccgccagacgaataccacgcagcgccgtcagctgcgccaacagcaggctaacggcggagccgccgccgtga

SEQ ID NO: 88049 - DNA, 952 bp, Glycine max
  Peptide Sequence Number=SeqID_204827
ggctgcacgccctcgtcttcaaaggactcatgcctcgccttccgaggactacacatcctccccttcagaggactgcacgtgctcaccttctgaggactacacgtcctcaccttcagaggactacccgtcctcaccttcagagggctacacactctcaccttcagaggactacacgtcctcacctttagagggctgcacgcactcaccttcagaggattgcacgtcctcaccttcagagggctacgcgccctcaccttcagaggactacacttcctcgccttcagagggctacacgccctcgcccgtcctcaccttcataggactacatgtcctcaccttccgaggactacacgtcctcaccttcagagggctacacgcgctcacctttagaggactacgcgttctagccttcagagggttgcacgccctcaccatcagagggatacacgccctcgccatcagagggctatacgtcctcgccttcaaagggcaacacgctctcgccttaagaagactacacattctcgccttcagagggttgcacgccctcgccttcaccggactacacgtcctcgccttcagagggatgcacgccctcggcttcggaggactacacgtcctcaccttcagaggactacacgttctcaccttcagaggactacacgtcctcgtcttcagagggctacacgtcctcgcctttaaagggttgcacgtcctagcattcagagggctacacgtcctcaccttcaaaggactacacgtcctcacctttagagggctacacgccctcgcctttagaggactggacgtcctctcctttagagggctacacgccctcgccttaagaggacaactcatcctcgccttcagcgggttgcacaccctcgccttcagaggactactagtcctcgccttcagagtgctgcacgccctcgcctttggaggactacac

SEQ ID NO: 88050 - DNA, 321 bp, Glycine max
  Peptide Sequence Number=SeqID_204828
atggcggaaagtaagaactcccccaaattaatagtaaaagctccaaaggctcttggggacatggtggaaagcattgcaggggtcatgctcgttgataccgagcttgatattgagaatgtgtggagaatctttgaaccattgttgtctccaattgtgacccctgttaatcttgaacttccctccctctgtaaactgaataaattgtgtgattgtcttgtctgctttataaaagagacatccacaaaagagggggaaattcatcatgttgaacttcaattgcagctggaagatttttttttttttggtaggaagagggactga

SEQ ID NO: 88051 - DNA, 234 bp, Glycine max
  Peptide Sequence Number=SeqID_204829
atgaggggaggagattgcacagtagctcgcccagggtatgacaccctgcatcaacagcgccaggatcccagtccttactcgtggccaactctcgagcagttcaaggccacaattgcatggcctggagacaggcccaattttcagaaaggggcaggacccacaggggccccaggagatgaagatggagctcaggaagatgatgacatggctgatgtgatggacttcttcctttga

SEQ ID NO: 88052 - DNA, 477 bp, Glycine max
  Peptide Sequence Number=SeqID_204830
atgttggctcccaggaaactggaagacagtgaagctgctgagcaatattgtgctgagataggaagagctgatgcatatatgcagttgcttgaaatgtatttggatccacaagatgataaggatcccatgtttactgctgctgttcgccttctgcataatcatggagaatcattagatccattgcaagttttagagaaactgtctccagatatgccacttcaacttgcttctgacactttactaagaatgttcagggccagagttcatcatcatcgtcaaggacagattgtgcataatttatctcgtgccgtagacattgatgcaagattgtcaagattggaggagaggtcaaggaatgtacaaattaatgatgagagcctctgtgactcctgtgatgcacgtcttggtacgaagctatttgcaatgtatcctgatgacactgttgtatgttacaagttccatgttttcggtcattaa

SEQ ID NO: 88053 - DNA, 411 bp, Glycine max
  Peptide Sequence Number=SeqID_204831
atgtttttaacttcagacaaacgagagatcgagctttctcctgatgaagttgttacaactattgatccgcagaaggcagaaattttacagaggtatctccagtggttgattgaagaccaggactgtaatgatacacagttgcatactttgtacgccctctcacttgccaaatcagcaattgaagcctttgaatctgaaaatatttctgagaatcttgatagtggaaatatagagacaagaagtttggctatgttgaagaactcaatctttcagattcctgtcagggaaagtttacagatatttttgcaatcctcagacttgtatgatccagaagaagttcttgacttgattgaaggatcagaactatggttagaaaaggttactttaagacttttgaccgtgctatcttaa

SEQ ID NO: 88054 - DNA, 1134 bp, Glycine max
  misc_feature (185)..(185): n is a, c, g, or t
  Peptide Sequence Number=SeqID_204832
atggttcaggttgaaagcaacagcagcatgagccgcgtggtgctggagccccacgcgcagttcgacctcaccgcccactcacgcgccagctccattcgatccctctcaatctcccactcgaaacgacaccgtacgactcttctctacgtcggaactcactccggaaccctattttccctctccgncgaggactccaacgacagcgacgacgccgttttgcgcaagctctcgttcctgagaagcgtttcggtcagcgacgccgccgtcgagtccatctcggtaatcgaagagttccggaagcttctgttgctgtccgatgggactctgttcttggtcgactccgaactctcgaatcgcgccacgaaattgagtttcccgaagggggtttcgttggtcacgaggagaaggctcaggaacaacggtggagaatccgagggtttcggttcgggtttaggttcaggttcaggttcgggttcgggtctaggattgtttcagaaattgagaatgaactcaatgaaggagggtgaagtgcagagtgagacaggtggtggttgtgtttttgcaattgttgttgggaacaggctgattctcgcggagcttgttttggggaataggaatgggaaaagtgagagggatgatggtggtgcgcttgtggttttgaaggagattcagtgtgttgatggggttgttagtgccatggtgtggctgaatgattctattgttgttggtactgtgaatgggtacagtttgatttcatgtgttactgggcagagtagcgtgatcttctcattgccggacgtgtcgtggccgccgaggttgaagctcttgcacaaggagtggagggtgctgttgctggtggacaatgtgggggttattgttgatccccatgggcaacccgtgggggggagtctggtcttccggcacgggttggattccatgggggagattgattcctatgtggtggttgtgagtgatgggaagattgggttgtatcataagaggcatggtggttgtgttcaggtgttgcccttcggcggggaaggggttgggcgatgcgttgttgccagcgaggaagataagggtgggaggcttgttgctgttgcaactgctaccaagaatatagctgttgattga

SEQ ID NO: 88055 - DNA, 813 bp, Glycine max
  Peptide Sequence Number=SeqID_204833
atggcccagccacaaggaccgcaagtgaaagggaatcccttatgtcacatcaacgaaaattttgtgagcgcggactggatgtttgatgggcgggtagccatgattcatgatgaagtccctcgagagcaatcaaactgggggcttcctccagagctacaaagaatggtcgaacaggaagatcgagaaatgaagtcgcaccaggaagagatggaaatcgtaaacttgggtgttggtgaggaaaagaaagaggtaaaggttggcacaagcatgaccatgcctatccaagatgcattggtggctctgctacgagactatcaagacatcttcacttggtcctaccaagacatgccaatcgctcgatacccaaaatgggtcgctaacattgtgtcggttcccaagaacgatggaaaagtgcgaatgtgcatggactatcaggatctgaaccaagccagctacaaccaaatcaagatggcattggaggacatgggaaaaatgacgttcgtcaccctgtggggaatgttctactacaaggtgatgtcctttgggctcaagcacgctagggcaacctaccaacgggctatggtagcatttttccatgatatgatgcacaaagaaattgaagtctatgtggacgatatgattgccaagtttaaaaccgaggaggaacatcttgtcaacttgcagaagttgttcgagagattgcgtaagtatcaattaagattgaatcatgccaagtgtacttttggggtcaagtcaggaaaattgtttgactttatcataagccagaaagggatagagctggacctcgacaag

SEQ ID NO: 88056 - DNA, 516 bp, Glycine max
  Peptide Sequence Number=SeqID_204834
atgggggccgcgctgctccgctccgccgcgatagcggccgtgacgcccacgattgacaacatagggggtaatctgcctgaaatagaacttttgaaatgtgaagaaatggttcctaggaataggtattggggtttgcatcctccaccggcccctcttgaagatgtaatagatgatggcttgatgacaatccaaagagcttctttcctgaggaaagcaggtgtagaaacaatagtagataatgatctttttctcaatccagcaaatagagctgatttgttggagtcagcaatcaagaacattagcaggtatttggaggcctgtcgtgaaaaagacctaacggaatcagtcagggagggagttgacacactactaatgtatttgtatagagctctaaattctgttgaggacatggagaagctggcttcttctataaactggtgtgttgtggctcctagtagactaagtggagactattttcctaggcaaatagtggatgctaattcctatgagaactaa

SEQ ID NO: 88057 - DNA, 678 bp, Glycine max
  Peptide Sequence Number=SeqID_204835
atgtggattgcccaagtctctattagctctactttggttatatctatagtcgacatgggatctcaacaaggtatggtgaactatggtgttggtatctgcccaggaatacaagtaggaaaccctgccaatgacatagttgacattataaacaagaatcgaacggatgaaaagcttcctcgcttgaatgacagccctggtctagggtgcatggccttacaatacgtcgaattatgcaaagggaactgcactgaaaacaatgttgtaaactgcagacctcctgaagatgacttcactgaagtatttgctcccaactgcggtgtagagctaccgacttttggcaccataaccggacacattgtgggctgtcaaagaaagtatatcgagccattgctagtgttttctgaagttctcattaaagataagaaatcgttgtctcttctgagaaacaaatcacatactgaggtgggagttggcctggttggactccacaaagggcctttcttttgttttgttgcaatctttgacaatgtgagaaattgtgacttgtgtggttacaattgcggtcgcagacagttattgaaagccatgggaggaagagagttgcattgtggccgcttcgatcgagatgaaagtgttacggaggtacgttggcaagtgatgattgttaacgaagattaa

SEQ ID NO: 88058 - DNA, 369 bp, Glycine max
  Peptide Sequence Number=SeqID_204836
atggcgaaggaagcggatgaccataatttgtctctgcatgccaacggacttgattgtctctggatggcaaaggaagtggatgaccataatttgtctctgcgtgcgattggacttgattgtctctggatggcaaaggaagaagcgaatgaccataatttgtctccgcataccatcggacttgattgtctttggatggcaaaggaagcggatgaccataatttgtctccaaatgccatcggacttgattgtctctggatggcaaaggaagcagatgaccataatttgtctctgcataccatcggactcgattgtctctggatggcaaaggaagcggatgaccataatttgtctccgtgtgcctttcactaa

SEQ ID NO: 88059 - DNA, 490 bp, Glycine max
  Peptide Sequence Number=SeqID_204837
agatatactgctgaaatacaggaagcacataatgaaacttgggattttactgcttgagttgttttcagaagctttgggtctgagtccaaactatctgaaagatataggatgtgctgaggggctatttgctctttgccattattatccttcatgtcctgaaccagatttgactacgggaaccaccatgcattcagacaatgatttcttcacagtgcttctccaggatcatattgatggcctccaatttataacaaacgatagattgaagagtgctgaacacagagtgattgtaaatcatgttggtcccagaatatctgtcgcatgctttttcagtccaagtgccaaggcatccttaaagttctgtggacctgtaaaggaactattatcagaagaaaatcctcccaaattcaggaacactggtgactatgaagcctactattttgcaaaaggactggatggtactagtgcccttacacattacaggatttga

SEQ ID NO: 88060 - DNA, 282 bp, Glycine max
  Peptide Sequence Number=SeqID_204838
atggctgaagagcaaccaagaagacttatacagggcaatttgtttcatggattgtcaaatgaagatccttacgcgcatctagcaacatacattgaaatatgcaacacagtgagaattgttggtgtgctagaagatgctattaggctccacttattttcattttcactatctggagaagccaataggtggttgcattcattcaaaggcaatagcttaaggacttgggatgaagttgtggaaaaatttctgaaaaagtattttcctaagtcaaaaattgcatag

SEQ ID NO: 88061 - DNA, 227 bp, Glycine max
  Peptide Sequence Number=SeqID_204839
ggaaagcagcattcaaggagagaatgaaaaggtggttggttgtggcattggagacaaaagaagaagaagaagaacaagaaggatcgaaaaagggtcttcgttcaacacaacttaccaaacacgacggtgagcgtggcggcgaacacaaccagagcgcgacgacgaacatggggtcatatatgatgccagtgacggcacttgcagcggacacagggtctgagtcgtga

SEQ ID NO: 88062 - DNA, 467 bp, Glycine max
  Peptide Sequence Number=SeqID_204840
atgtgggatcaatacaatcttaaaggagcactcagaccgggtgttaaggatgttcctagcttattccatcaccaacctgagaagtttgagaaggcttcaaatataggcaacacaagccatattattccaatcatagaccttgcaattattaacaaagatccaagtaaccgcctagggcttgttgatattgtgaagaaaacatctgaaacatggggtttctttccggtggtcaatcatgacatccctttgagtgttctagtggagatgaaaaatggtgtcaaatggtttcatgagatggatactgaagccaagaaacaattctattcaagagatagatccaaatcctttctgtataaaagcaattttgatctatatggctcacagccatcaatcaattggagggattctttttggtatttgtattatcctgatgcccccaaaccagaagaaattcctgtagtttgcag

SEQ ID NO: 88063 - DNA, 2669 bp, Glycine max
  Peptide Sequence Number=SeqID_204841
acctggcgcacgccgccgcccaccgtcagggggatgaagacctgcgaggcgacctgctcgatgatgggcaggatcaggtcgcggccatcgctggtggcggtgatgtccaggaaggtgagttcgtcggcgccctgctcgttgtagcggcgggcgatctcgacgggatcgccggcatcggcgaggttgacgaagttgacgcccttgacgacccggccggcggtgacgtcaaggcaggggatgatgcggcgggtcagcgcgctctgggcgggcgcgccggcctcgggggacctgctggagttgagcgtgccttcgtagatgctgcggcccaggatggcgccttcgacgccctcttcctcgacggcgcacagggcctcgatgtcctggatgccggcgatgccgcccgaggcgaacacgggaatgcgcacgtgttgcgccaggcgcacggtggcctcgacgttcacgcccgacagcatgccatcgcggccgatgtcggtgtagatgatggcttcgcagccgtagtcctcgaacttcttggccaggtcgagcacgtcgtggcgggtcagcttgctccagccgtcggtggcgatcttgccgtcgcgggcgtccaggccgacgatgatctggccggggaaggcgccgcaggcgtcctgcaggaagcccgggttcttgaccgcggcggtgccgatgatgacgtaggagatgccagcgtcgagatagcgttcgatggtgtcgagatcgcggatgccgccgccgatctggaccgggatatcgtcgccgacggcgtccaggatggccttgatgggtgcttcgttcttcggtttgccggcgacggcgccgttcaggtcgaccagatgcaggcggcgggcgccctggtcgagccattgcgaggccatggaggcggggtcttcggagaacaccgttgcatcgtccaggtcgccctggcgcagacgcacgcagcgtccgtctttgagatcgatggcggggatcagcagcatgggcggtgtgcccgtggcttacggctgccagtctacaaaattgcgatacaggcgcaaaccgtgctcggcgctcttctcggggtggaactgcaccgcgaaaatgttagctgccgccaccgcgcaggtaaaggcaacgccataatcggtttcaccaacggtcaggctcgtatcggccgggtcggcgtaataactatggacgaaatagaaatgcgtgtcgcccggaatgccgtcccagatagggtgagagcgcgtctggcgcactttgttccatcccatgtgcgggactttcaaccgctccgggcggacatcgaccgggccggccgtgccggtgtcggcctcgcaggccgcgtcgtcggccgcgaccgggtcggcgaagcgcgggccggcaaagcgccgcaccacgccggggaacagccccaggcacgggacgcccagcagcggcttggcgcgggcggccttgacgaccgcttcgcgcaggccggattcattcagggtgcgcatgcagtccgccatggcgccctggccgggaaacaccacgcggtcggccgcgtcgatttcatggggctggttgcagatgcggatgtccgcgtcgggggcggcgtacttgagcgcgcgcgcgacggaatggaagttgcccattccgtagtcgacgatggcgatagtggtcacttcggtttacctgggcacgacgtcgcccatgcgcgggtcgacttcgatggccatgcgcagcgcgcggccacaggccttgaagaccgtctcgcattggtggtgggcgttggtgccgcgcaggttgtcgatgtgcagggtgatcagcgcgtggttgaccaggccctggaagaattcgcgtgtcaggtcgacgtcgaaggcgccgatgtgcgagcgggtgaaggggatgtggtattccaggccgggacggcccgagaaatcgaccaccacgcgcgacagcgcctcgtccagcggcacgtaggcgtgaccgtagcggcgcagcccggccttggtgccgaccgccttggcgatggccatgcccagcgtgatgcccacgtcttccaccgtgtgatgcgcatcgatgtgcaggtcgccctcggccttgatgtcgaggtcgatcaggccgtggcgcgcgatctggtccagcatgtggtccaggaagggcacgcccgtgtcgatcgtctgcttgccggtgccatccaggttgatggccacgcggatgcgggtttcgttggtgttgcgggtgatctctgcggtacgcatcaaagcggcgttctcggacggcgcgcccaccgagatgcggaggcagccggccaggagcggatgggcgttggagaagttacgaaccaatattttgcgctgtttcagggcaagatgcacggcgttgccatccagcttgccggaaaagcgcgcgagtacgaagttggccgcggaagggaataccctgacgccgggcagcgccgccagcgccgcggccagcggttcgcggtcggcgcgcaggcgggcggcctgttggtccagcaccggcttgtggcgcagcaccgtcagcagcgctgcctgggtcagcacgtccaggttgtagggcgggcgcaccttgtcgaactcggcgatccagtcggggtggccggccagatagccaaaacgcaggcctgccaggccgatcttggacacggtgcgcatcaccaccac

SEQ ID NO: 88064 - DNA, 138 bp, Glycine max
  Peptide Sequence Number=SeqID_204842
atgaagaacgaacgaagaacgatgaagaaaggtggaaaaccttcgcgaaatcgcccacgaaaacgtctcagaagcattatggaagcgcctcggcttagattttcttcatgggtaaagagggaggtggttgccgcctag

SEQ ID NO: 88065 - DNA, 2508 bp, Glycine max
  Peptide Sequence Number=SeqID_204843
atgtatcagtggaggaagttcgagttcttcgaggagaagtacggcgcgaagtgcgcggttcccgagaacgacgaagacgacggcgtcgtcgcggcggagaggaagatcgagtgctgctcgagtggtaggggcaaacttgtcaccggcttcgacgacggcgtcgtttgcttcttcgatcggggcctcaagttcaactactctttccagcctcactcttcttccgttctttttcttcagcaactcaagcaacgcaactttctggtaacaattggggaggatgaacagcttactccccagcaatcagctttgtgcctcaaggtttttgacctagacaagatgcaaccagagagttcgagcacaacgagtcctgattgcgttgggatattgcggatattcactaatcagtttcctgaggcaaagattacatcgtttttggttttagaagaagtgccacctatactactcatagctattggcttggacagtggttctatttactgtatcaaaggagacattgcacgggagcgtatcacccgttccaagcttcaggtggaaaacaaccatttggacaaaactctttcggctgtaactggacttggttttaaggtggatggtcaatctctacagttatttgcggtgactccatgttcagttagcttgttttcattgcatgatcaaccgccgagaaggcagacccttgatcagattggatctggtgtgaacagtgttgcaatgagtgatcgctctgagttggtaattggtcgaccagaggcagtatatttttatgaagttgatgggcgtggtccttgttgggcttttgagggagagaagaaattgcttggatggttccgtggataccttttgtgtgttattgcagatcaaagaacaggaaagcatactttcaacatctatgacctgaagaatcgattaatagcccacagtgcattggttaaagaagtttcttatatgctttatgaatggggtaacatcatactcgtaatgaatgataaatcagctttatgtattggagaaaaggatatggaaagtaagttagacatgttattcaagaaaaacctatatactgtagcaattaatcttgtccagactcagcaagcagatgcagcagctacagctgaagtgctaaggaaatatggggatcatctgtatagcaagcaagactatgatgaagcaatggctcagtacatacatactattggtcaccttgaaccttcttatgttatacagaagtttttggatgctcaaaggatctacaacctcacaaattacttagagaagctacatgaaaagggtcttgcttctaaagatcacaccacacttctattaaactgttacactaaattgaaagatgttaaaaagttaaatctatttattaaaagcgatgacagcattggggaacttaaatttgatgtggaaacagcaatcagggtttgccgtgctgccaattaccatgagcatgcaatgtatgttgcaaggaaagcagggaggcatgaatggtacttgaagatcctgcttgaagatcttggtagctatgaagaagccttggaatatatttcaagccttgaatcaagtcaggcagggatgacaataaaggagtatgggaagattctgatagagcacaagccagtggagacaattcagattctcataaggctttgcacggaagatggtaacaaaagagggcgctcaaatggagtgtatatgtctatgttgccatctcctgttgattttcttagcatcttcattcatcatcctcagtcccttatggattttcttgaaaaatataccaataaggtcaaggactcacctgctcaagttgagattcataataccctcttagagttgtatatatccaatgaattaaactttccttcaatgtcgcaagttaatgatggtggaaattaccttaatggagcatcagcaaaaaccatgattttaagtgctcagtctaatggaaacattggtgatcacaaaagttcagagcagggaaaggaccatctcgaaaggcgtgaaaagggtttacgcttgcttaagagtgcatggcctcaagagacagaacatccacaatatgatgttgatttatctattatactatgtgaaatgaatgcattcaaagatgggcttttgtatttgtatgaaaagatgaaactctataaagaagtgattgcttgctatatgcaggcacatgatcatgaggggttaattgcatgctgcaagaggctgggggattctgttaaaggaggggactcatctctttgggcagatgtacttaaatattttggtgagcttggagaagattgttctaaagaagtaaaagaagttctgacttatattgagagggatgatattttgccccctatgattgtgcttcaaactctttcccgaaatccatgcctcacactttctgtgctcaaagattacattgctcgaaagcttgagcgggaatcaaagatgattgaggaggaccgacaagctattgagaaatatcag

SEQ ID NO: 88066 - DNA, 243 bp, Glycine max
  Peptide Sequence Number=SeqID_204844
atgtcctttctcaacaatatcttgagaaaatactcttattcctccacaacttgcttccactacctcatagtcaattcaattacacttatcacgaagaccataatttttcccacccctaaatcccaggctaaaggaacacttcttagacgcgacatcacaagtggagtgcacaacatccctcgtcagtcgaagggtagggctagggttgaagggatagggttgtttcctattgttaagggatag

SEQ ID NO: 88067 - DNA, 537 bp, Glycine max
  Peptide Sequence Number=SeqID_204845
atggaaaaagctgccgcaacgaaaccagaatgtttaaacgaaagtgcttcataccacaagatattcaaaatgcttaagctacgaaaacgaaacctctgcaactgcaacaaggacctagggtctgcacagcagtcgccactgctgctggcgcttccaaaggacctagggcctagtcgccactactgctggcgcttccatagacagctcagcaaaagtgaaaacgctgctgacaatggcgtttccgtggccacgtgcctcgtccagcttgaaggcgccatcagaactggcgccatgcatggccagttacgtgaaaaaggacaccccttaggaaataatttcagaagagccctagtttgggaatttgtttctaaaagcaccctaaacagggaaaattgcctgcacgtgaaaatgggaggtgttccgccaatgaggatggcaacatgcatgtgcatgtgttttgcaaatgatgatggcgaaatttatggtggactcgctagcaggaatgacgacatgtatgggcatgtgtttcgtaattag

SEQ ID NO: 88068 - DNA, 264 bp, Glycine max
  Peptide Sequence Number=SeqID_204846
atgacatcaggttcgagagtggaaggagcgaagacaactccatgcatgtctagcaaggctttggagcttgataaagaagcttgtgagtttgttctaaaggaaaaacattttttcaaattctcacatttggaacaactagaggttttaggaaaagtgtttaataaagttgcagaagatgacatgcatattaagaaccctaatagagcaactggaggaggagctctagagagcaccagaaacgccaccattgctaatggagaatga

SEQ ID NO: 88069 - DNA, 122 bp, Glycine max
  Peptide Sequence Number=SeqID_204847
aattagagaggcaaaacacgggcaaatccaaaggctatgactttgtgactttcaaggaggctgaggctgccaagaaggcttatgaggattcaacaacgctcattatcaatggccgtcgttga

SEQ ID NO: 88070 - DNA, 243 bp, Glycine max
  Peptide Sequence Number=SeqID_204848
atgaatatcaatgtgaaaggggagtggatcctaatgcacataatgtcatgtccaaattttgtatctctctcttcgtactattctatcacatcatcaaactatgggaccagtcatgttcttgttttggctgacttttcaccaagtaccaggacaacagagctagagaagctttttgagaacttcaaggatcatggatttgtgattcgttgggtcaatgatacagttgctcttgcagtattctga

SEQ ID NO: 88071 - DNA, 312 bp, Glycine max
  Peptide Sequence Number=SeqID_204849
atggcgcgtatcatggtatcggagcggaaagccacgtgctttcagcaggaacttatttccactaaggaagaggcgcttcgtaagcttctcagactcaaacaaatgttcgattctaagagtttattaccctacttgtgctttcagatggcccctatgcatgttaatcatgcgcgcgaagtcccagagtatgaaatcaatcctaaagagcttgatttaaccaacagtgtggagataatgaagattatggctgccatcattgccattgaaaaagcagttgaggaacattggaactggttatgcgactcgaaatag

SEQ ID NO: 88072 - DNA, 216 bp, Glycine max
  Peptide Sequence Number=SeqID_204850
atgtcagccctggcacaggagcacagacatccaacccttagcagtcgggctccccaaccaacaggtcttccctcttgtcctcctaacaaaggtcactctcaatcgacgtgcgatgtccaagagtccaccttgatgtgtgtcagcttcgaattttggttaaagatagatatcatcaaacttacaacaatttgtattctactcgataagcttcattaa

SEQ ID NO: 88073 - DNA, 1563 bp, Glycine max
  Peptide Sequence Number=SeqID_204851
gtacctatggactatggttaaacctgtacttaccaaaattcgaagctgacacacatcaaggtggactcttggacatcgcacgtcgattgagagtgacctttgttaggaggacaagagggaagacctgcaaaacaaaggactttgatgctcaaggttcgatggaacttggtatttatatgagtggagtggagttacgagtccttgtttggttggatgtctgtgctcctgtgccagggctgacatggagggttaacatgcaaaagaggtcgtccagtgttgaagattgtctaatgtccggggcgatagccttgacaagtagaggtctatcaagcttgtcaagctcccgagcctggacaagtggtattcgggctgcttctgtcaagttgtctggggtggacatgcttttgattttgtcggctaggtttgatccagcaacctcggaggatacttttcgtggtgccttcgatagtgaatcctcttccccagagagagtgagggcttcacattgtactagtggagtctctcccattaattgtgatcctcccccattttgcttctacggaagtgaggaaaattacgttgggtcatcgtcgtccccacctaccgtcgctggctatgagtgggttagggatgatgttttaaagtataaatctgctctcacctctgcattgagtgtcgttgctctgcaatgccaggtgaagctagcaagccatgaggactcgtgcaagatagtcgttcaggcttgtgggagtgatgacttccctttcttaaaggcggatcatttcttcaaggtcctgaacatggatgttgtggttgatggttggccattgatgcttaataaggatggggatccccttcctattctactgggtggacaaggccatcttggagtagctgccagcctcgttggacacacgagtattatgggtgacttttcctggaggccactcataaagcaggtcgaacctgctagtggtgttgtgtcatcgtctgttgttgctcctattgttggagaagagagtcaacctgttgttgaggctaactttgtagctgttgagattgctcccagtgccccttcctttgtattggctaagaggaagcaagatgatagtgctgggccattaggccacaagaagttgaaggccccttcgagccttcgtgccttgaggcaggctgcaggtatgcaagatgtgcctccagctccatcggtcgtcgaggctcttgatgttgatgttgttattgttgttactccagctcctccacctcctcctgttgtgtttgttcaggaggtcgctcatgttgctgctaaagtgattgcaccagctgctttggctagttctgctgtggaaccctcatccaccgtcgtagcatacatctacttgggttgtaatactgagaacaagagaggatacatctcttgtggatcagttcaagtggagggtacattcacttggttgttcaaagagaacacaggagggtacgtcccttgtggatctttgcttgtaaaggattttacaaggttaaaggaaatctcaagaactggtggttgcttagggattggat

SEQ ID NO: 88074 - DNA, 567 bp, Glycine max
  Peptide Sequence Number=SeqID_204852
atgaagaacctggcctgtctaacagccttgttgaagccctttttatgctactctacgacctctttcttgaaaatgagcaattcctccccaagctccttgttggcctccctctccctagcagcccacaacttagactccttcagcatggaatctgactcatttagtcaggcctcgagatctgccaccttcttagcaagctcgtccttctccgccataatgtccttcaccttgccggccaagttatttttctcttcctgcaaggccttgcagcagttgaacaattcatcatcatccaatctagtgcgcatcaacttggccaacactgccaattttagaagacagttggtggttcgacctcacagcctcaacaagagcaaaaatagaactagctaccttagggcgcttcactctccaaatagtgtggaagtcaaagccaatgcggtggagggagggaccattagagccgaagaggaaggaggaagtgccacaggggcattggtggtcgccacatcgacacttagtaaaggtgcaatgacgtgttggatcaagtggtctcagaataattaa

SEQ ID NO: 88075 - DNA, 297 bp, Glycine max
  Peptide Sequence Number=SeqID_204853
atggtaacactggctgagcaagttgtacacctatggcatatggcttcgaggcacttcactgctttccctatttctcatagcccctctcgtggtactttgcgagtccccatagcccctctgtcaccgcttccatccaaacatggttctgcttccatccaaatgcgtagctctttctccatggagtggaacgtggggcaaaggaacaaacggggtgacatggagaagaggaaaaggcgcgaggagaaagaggaaagaggaacagacgcgaggagaaatgaatgtgagggaaaggaatga

SEQ ID NO: 88076 - DNA, 262 bp, Glycine max
  Peptide Sequence Number=SeqID_204854
atggtgatgggaaaatgttgtttggtggtggttggagtttggtcacggtggatgaagggtgggaggagatggttttggttggagatgatgaagcgtgacgatggtggtgcgacagtgctatttggtggtgatcagaggccacgtaggagaggagagaggagagtgtcgccttttgcattggcgacacacctccacgttggatccgccatcaggactggcgatacagcctcatccaagcccgccattcgtgctggcgagatag

SEQ ID NO: 88077 - DNA, 1233 bp, Glycine max
  Peptide Sequence Number=SeqID_204855
atggtgggcctggtcagcagccttggtggcaagggtgcaaacatgaagaaaggggtgttccagcctttaaacggtgtgaaaggaggagtacctccacaaagggtggcatgcctccttggtgccatcggtccaccctcttgtcctcctaacaaaggtcactttcagccgacgtgcaaagtccagaagcccatcttagccacgtccaccctgaccatggacgaattatgcaaacgaaccaagggctacatccaaatggaagaagtgttcgagttcaagaatgaagtcagacaagctggacagaatcgcgacaagcatgaaggaggcaccaagactgactcatatagcgaagcgagtaactacctccacaactataggaagctgcacaacaaattagaggacatcaacgcaccatcacaacaaagtctccctcctataactttcatggatagggacttcaagggtatcaaccccatcaaccaagacgaccccatggttgtcttcatcatcatcacaaacttcatggtctcccctgacactgtccaccttcacgatggtccactccttggctttgcaggcgaaagagtagagaccaaaggctacatggacctaatgaccactttcgatcaaggccaactctctaggagcttcacaggtctcagagccctaaccgtctaccaaccaagcttggatgatgaatttgatatagatccatgtgacgacacttttgacaaaagcccatctaagagctcatcaagctacagctcagacccaaactcgagcagtccatctgacatgccgggaatccatcccagcatcatctgccacaagctcgccatatacccccaggccaaatcggtatcacagaagaaaaggaagataagagaagaacgatgcaaagttgtcaaagaagaagtggaaaaactcctgaatgctaacttcattaaagaagtcaggtatcccacctggctcgccaacatcatcatggtaaaaaaagacaatggcaaatggagaacgtgcaccgactatacagatcagaacaaggcgttccccaaagatgcataccctctgcccaacgtcaataggctagtcaatgaagcgtctgggttccaggttatgcctttcatcctaaaaaatgcaggcgctaaataccagagattgatggaccaaatcttcaaacaacagattggacacaacatcaagctctacgttgacgacatggtcatcaagtcttaa

SEQ ID NO: 88078 - DNA, 534 bp, Glycine max
  Peptide Sequence Number=SeqID_204856
atgaagacgtggagcagggcgctgctgccggcgatgttcggcatgctggccgccgtcaccgcacaggccgccgattaccgtacccagtacgccaaacagtggccgctgacgttgtccagcgcacaatcgggtgcctaccgtgttgtgctggaaccggcgatctaccgtcgcgccggctgtgcggacctgggcgatgtgcaggtgttcaatgccgccggccaatcgttgccgtcggccttgctggcgccggatcagccgctggcgcagccgccggtgcagcgtgagctgccgtggttcgcgttgccaccattggccgaagcacaccgcaacgacttgcagttgctgaccgagcgcgataccgatggccgtgtgcgtcgcgtggaagcccgctggacagccgttgcaggctcacgtgcagctggacgtcagctacgacctgcagcactggcgtgcgattggccgcgactttccgctggtggatctgcagcgcgccggcaagcgcctgctgcagcgccgcctgcaggtggatggtga

SEQ ID NO: 88079 - DNA, 243 bp, Glycine max
  Peptide Sequence Number=SeqID_204857
ggattccccgtctactgtatctctcaaagaaatgaacgtggattcgaggctttagtcctcacgttggggatggatcatcttgagctaccttctggggtggggacaaaacatgaacagcagaaaccagtcaaggaacggatgcaactggggatggagtcacgaccgactgatcgttgccccttctctgcgctaagcaggcagagaacgtcgctgcaaggcagccccatatcctttgtattcgca

SEQ ID NO: 88080 - DNA, 393 bp, Glycine max
  Peptide Sequence Number=SeqID_204858
atggtagcatcccacataacctggagaggcttcaaaaacagttgtgggatggtcaatgtcatcagtcttcctagggcaaccaagcgggaaggattttcttcaatgtatagcccgcatttgtctgagtcacccatccctggatcgttccctgagggagcaacacaactctcctttgtgctgacacaaggacctaagggaccaaactctggctctggaggtagtgcaagtccctttgattgcatctgttctaggtcttcaggaggcatggaggaagaactgcgggacgttcgtgaagccgatccaaagtattgctttatggtgacaccggctccaacagcacaaacacggccagggtgttctggtcgcccaatggcagcagtcaggatatcctga

SEQ ID NO: 88081 - DNA, 261 bp, Glycine max
  Peptide Sequence Number=SeqID_204859
atggatttcaaactttatcaaatggatgttaaaagtgcatttttaaatggatttattcaagaagaagtgaggtttggaatggaaaatgctaaacaaatggccacccctatgagtactgcttgctacttggataaagatgaagttggtcaatcagtacatataaagaaatatagaggtattgatgtgaacctgactaggagcagatcgcttgatacaggctacggagatttggatgatgccactttcagtgaaggaagataa

SEQ ID NO: 88082 - DNA, 198 bp, Glycine max
  Peptide Sequence Number=SeqID_204860
atggtatgtccatcacgatgccatgaagagatgcatgatgtgatcaaggaacaaaccagaaggaaaactctagaagaggcttcactgtcatcaagcgagtcggagacccagcatgaccacagatcgacctccactccttatggctcacatagacctaggtatagtgatgcaatcctaccccccaagggcattggatag

SEQ ID NO: 88083 - DNA, 426 bp, Glycine max
  Peptide Sequence Number=SeqID_204861
atggccggaacccagagcagcaacggcgtcggaacggtggacgcagagcagctagggtttttgcgcaacaatggagccccaaatcgtgaaacaacaggttttagaagacaagccaaaaaccgaaaataccctcacttaccctcattaagtgaggcggcacgaaaaaccgctctgcaccctgcgccgctccgccgcgatagcggccattccagccgtgaccttaatccgcgccgctacacccgtgttcgtcgcggatggctgccgctccgacgctatatcggccgctacgaccactatcgacaactatgcttccttgcctatatatggctaatagatggagaagcagtttgtggggtaggtagagaaggggaaagagaggttgatgaaacagtgttactatgtacaggagtcttggaattggcttga

SEQ ID NO: 88084 - DNA, 426 bp, Glycine max
  Peptide Sequence Number=SeqID_204862
atggctagattttgtagtgtggttctctcaaggttcttatcatcaaagatcaatccctctagtttacttcaaatccctgtcatcctccccaacccccaatcgccaaatagaaaatcaataatacagagatatttaagcatcgaagatgaaagcgagtgtagacagaaaagagatatgaagagaaaaagaacgcaccccagccttgccaggaatagtgcaatgccagaccatcaaattaacggtggcatcagggagagtctcgggcacaaaaatatataccagaccacaaaaagcataaaagcaaacattttaagaagaaaaagctttagatggaaaacctgtggtgatgtggttgggcaactacacaaagcacagcgccgtgttcaactctcaggggaaatcctcctatatccaagagaccactaa

SEQ ID NO: 88085 - DNA, 249 bp, Glycine max
  Peptide Sequence Number=SeqID_204863
atggcacatcaaaaccccccatacttagccttttgcactcctgggcaaaatgaaacaaagaacaaaatccacgaatatcaaagagagacaaacgaaaacatccacatatttctcaatgaacatcaaggaatgaaattaatcagctcaagaatgaaaagtgataaagcctcacaagatatacactctatctctcaagtgtctaggctactatttaccctcaaagcacccatgaaaacaaacaccacataa

SEQ ID NO: 88086 - DNA, 342 bp, Glycine max
  Peptide Sequence Number=SeqID_204864
atgggtacatccaagttgaaagtttcctccagaatcatagtgcgattggccattagagatactagccaaggcggtcaaggtcaagcggtgagacctgctggtggcatactatgcactgaatcgttcgatgaaggtgtcaaagctatctatggacctaggtgggagtccaccacaccaggtcaagaaggcatccagatgcttgtctggatctattgccccaatgtaccactagaggagagactgaagtcatctatagtgttgattgtgcgtcgcggtatggttctccttgggtgcactcaggcaaaatatgagcggagtgttcgtcgccctggggacatctga

SEQ ID NO: 88087 - DNA, 1419 bp, Glycine max
  Peptide Sequence Number=SeqID_204865
atggagaaaacaaggtacatagcagttattcctggtgtaggattcagccatttagcccccattcttcagttctcaaagcaacttgttgagctgcatccacattttcatgtcacatgcatcgttccctcacttggttctctcccaagtgcctcaaaagccatcctagaaactcttccaccaaattacatcaacaccattttgcttccaccggtgaaccctaatgaccaattatcacaagaagacattcccgtactagtcaaaattcatctcacaatgagtcactccatgccatctatacacaaagccttgaagtccttaacttctaaggctacccttgtggccatggtagttgattctttcgcctttgaagcactagactttgctcaagagttcaacatgttgtcctatgtttattttccagcagcagctacaacactgtcaacactcttgcatttgcccaagttggacgaggaaatatcctgtgagtatagagatttctcagatcctatcaaagtaccaggttgtgtaccatttcgtggtggagatttctatggtccagctcaagatagaactagtccagtttacaaattcttgcttcaacgtgttaaccgaatccgtcatgttgatgggatcttcattaatagcttcttggaaatggaaacaagtcctataagagcattgaaagatgaggataaagggtaccctcctgtgtaccctgttggaccaattgtccaaagtggtgatgatgatgcaaaagggttggacttggagtgtttaacatggttggacaaacaacaagttggttcagttttgtatgtttcttttgggagtggtggaacactttcgcaagagcaaataactgagcttgcttttggtttggaattgagtaatcacaagttcttatgggttttgagagcaccgaataatgcaacatctgatgctgcttatcttggtgcacaaaatgatgttgaccctttgaaattcttgcctagtgggtttttggagagaaccaaagagaaaggtatggttgttccttcatgggcaccccaaattcaagtccttagtcacagttcggttggtggattcttgacccactgtggttggaattcaatccttgagagtgtgctaaagggtgtgccgttcatcacatggccactatttgcggagcagaaaatgaatgcggttttgctaagtgagggtctcaaagtgggagtgaggccaagagttagtgaaaatggcttggtggaaagggtggaaattgttgacgtgataaagtgtctaatggaaggggaagaaggtgcgaaaatgcgtgaaagaatgaatgaattaaaagaagatgctactaatgcactcaaagaagatggatcttctacaaaggccctttctcagttgccattatattggaaaattttggcatga

SEQ ID NO: 88088 - DNA, 549 bp, Glycine max
  Peptide Sequence Number=SeqID_204866
atgacacaaattttgtttttgacctctctaccctcaatccagcagataacaatcaacaacacaaagaaaaagccaacggataacaacacaaatatagagaaagagaaagaatgtgtaaaaagtttaaaggcatttgaacaaagtggaaccacactaaacacggacaaatcagaggcgagggacccaaggcacatcaacccttcaaaggcagcgagaaaaaccagagaagaaatagggagcaagggcctacctgcgcagggaaggaaacggacgcggcactttgcagcaatggagacgcttgcgggaacagcaaggagaagacgtagaagagttgttcatttggcttgttgggccgtgtcgcgtgtgtctacttggtgggccgcgtccaatcacgcgtgtcctattgttcaaccatgtccagtgacggcagaggcaacggacaccatgtctcaccggagtcatacccgcatgtgtgtctggtgcgagtccggcgcgggacacgccggggatacaaactccaagttcaacctggaaacacctacttactaa

SEQ ID NO: 88089 - DNA, 1413 bp, Glycine max
  Peptide Sequence Number=SeqID_204867
atggagaaaacaacaacgcacattgtagtaattcccagtgcaggattcagccacttcgttcccattatccacttctcaaaacaactcgttgagcttcacccagaaattcacgtagcatgcatcattcccatactagggtctctcccaagtgccgcaaaacccattctccaaacccttccacaaaacataaacaccattttccttccaccggtgaaccctaatgagctaccacaaggtattcccgtagttctccaaattctgctcgcaatggctcactccatgccctccatccaccacaccctcaagtccataacttcaaagactccccacgtggcaatggtggttgatactttcgcctatgaagcactagattttgctcaagagttcaacatgttatcctacgtttacttcccttccgcggctacgacactctccacacacttctattttcgcacgttggacgaggaaacatcgtgtgagtatcgagatctgccacaccctatcaaagtaccaggttgtgtgccgtttcatggccgcgatctctatgctcaggcccaagatcgaaccagtgaactttataaaatatcactcaaacgatatgaacggtaccgtttcgttgatgggatcttcattaacagcttcttggaattggaaactggtcctataacagcattgcaagatgaggaaagggagtacccacctttatatcctgttggaccacttgtccaaactgggacagcatcttctgcaaatgggttggacttggagtgtctagcatggttggacaaacaacaagttgcttctgttttgtatgtttcttttgggagtggtggaacactctcacaagagcaaataactgagcttgcttttggtttggaattgagtaaccataagttcttatgggctgtgagagcaccaagtaatgtagccaatgctacatatattggtgaacaaaaacacgttgacccgttagagttcatgccatgtgggtttttggagagaaccaaagagaaaggcatggtttttccttcatgggcaccccaaattcaaatccttagccacagttcagttggagggttcttgactcactgtggttggaattcgatccttgagagtgtgctaaagggtgtgccattcatcacatggccactgtttgcggagcagaaaatgaatgcgattttgctatgtgagtgtctcaaagtgggagtgaggccaagagttggtgaaaatggtttggtggaaagggctgaaattgtgacggtgataaagtgtctaatggaagaggaagaaggtaagaaaatgcgtgaaagaatgaatgagttaaaagaagctgctactaatggtctcaaacaagatggggcttctaccaagaacttttctcgggtagcattcaagtggaaaaatttggcatag

SEQ ID NO: 88090 - DNA, 1416 bp, Glycine max
  Peptide Sequence Number=SeqID_204868
atgctaaatcctcctactatagttagactaccaaatggccatcatgtcactgctactcactctggtgacatatgcatttcagattccatcatcctgtcagcagtgttatatgtcccttccttttcctttaatctgatttccatatctaaacttgtctatactaatagctgtaaacttattttctcttctaattcatgcttgatgcaggatgagattactcaagcgaagattggtacagttgaagtgagaaatggattgtactacctcaccccaaactatacggccatatctaacattgaaaccaacattgttcatccatattgtaccattacacctatagatctttggcactttagaatgggacatctttcctctgaacgtttacgaaatatgcaatcaacctatcctttcttaaagcttgataagaattttgtttgtaatacatgtcattatgctaaacataaaagacttccatttcccaccagtaactcacatgcatcgaatagctttgaacttttgcatatagatatatggggaccttgttcaaaggtttcaatgctaggacatcgatactttctaaccatagtggatgattattcacgttttacttggatatttctgatacatgtcaaagctgaaacacgagaacatatcaaagcctttatagctcttgttgaaactcaatttgacaataaggttaagaaaattagaactgataatggcctagaatttcttatgagtgatttttgtagtttgaagggaattatacatcaaacaacatgtgttgaaatgcttgggaaaaatggaattgttgaacggaagcaccaacatcttttgaatgtaacaagagcattactttttcaagcaaacttgcccaacaatttctggtgttttgctttaagtcatgcagcatatttgataaactgtatacttactccatttttgaaaaatgcatccccttatgaaaaattgtttggaagtccatgtgatatatcaaatctcaaagtttttggatgtctttgttacatttccacactctcagcacatagacaaaagttagacccaagagcacatccatgcatttttctgggttttaagccaaatacaaaagcttcagtgagccatcctctcggttattcagcttcagtgtgtcatcctttcaattttgtactatcttattcgcgtctatcatcatcccacagacattttgttctttccatttctacatctactgagcctaagacatatgccgaagcatctcaacatggttgttggcttaaagcgatgcaagccgagtcacaagctttacaaacgaataacacttggacccttacagacttaccagctaataagaaagctattgggtgccgttgggtttataagattaagtatcatgctgatggctccgttgaatga

SEQ ID NO: 88091 - DNA, 624 bp, Glycine max
  Peptide Sequence Number=SeqID_204869
atgagtgagagagattcacaaacacctggtgtggatagctttctttacttgcatccaagcgaaaatccagcggtatcacttgtttcaccagttcttgattcttcgaacaatcattcatggagcatatcaatgatgactgctctgagtgcaaagaataagcttgaattcatcgatggaggtgcgctagaaccgctaaaggctgatcgaacttatggaggatggaggcgctgcaacaacatggtggtttcatggatcattcattcagtatccatgactattaggcaaatgaaattggcctgtaattattgtgggaagactggacatactgagaatgtttgctataagaaacatggagttccttcaaataacagtgaaaggaacaagtctagtagccataggagtgggaaagtatgtacttattgtggaaaaatgggtcacactattgatgtatgctacaaaaagcatggattcccaccaggttacaggttttctaacccaaggagcagtgctaacagcttggtggcaggagataatgcagtcaccaatgatcaaacacagcttttagagtccaaggagattcgtttttcacctgagcaatacaaagcattgcttgctttaatctaa

SEQ ID NO: 88092 - DNA, 1600 bp, Glycine max
  Peptide Sequence Number=SeqID_204870
gctggtactgccacgttcctcactatggcctacatccttgccgtcaacgccaccatcatcgctgattcgggcgggacatgcagcgtctccgattgcatccctctatgctccgaccccaaaacgccaactctccgaatgcccgacccatctcctgacccgacccggattgtcttgcaagtaccctcccgtcaacccgggctatgcggcgtgcgtggaacgcacgcgccgcgacctcatcgttgccaccgtggcctcctccctcatcggctccggcataatgggcctctttgcgaacctccccttagccctagcgcccggcatgggcgccaacgcgtacttcgcctactccgtggtcgggttccacgggtcgggtcccgtaccctaccgaaccgcattaaccgctattttcttagaaggcctaatcttcctcataatctcagccgttggatttcgcgcgaaactcgccaaactcgttccaaaacccgtccgagtctcctccgccgccggaatcggtctcttcttagccttcattgggcttcagagcaacgaaggcattgggctcatcggattcagcccatcaacacttatcactcttggaggctgcccgaggaacaaactgacggcgttagctccggtcatcacaattaacggcacagttagtttaattcctggcgccaccgtctccgacaagatactatgttctgggaaccgcatggagagcccaaccttatggcttggtttggttgggtttcttatcattgcttactgcttaatgaagaacataaagggggctatgatatacggcatcgtttttgtaaccgtgatctcctggttcaggaacacgccggttacggtgttccctaatacccaactcggtgacgccgggtatgactattttaaaaaggtggttgacgtgcacgtgataaaaaccaccgccggtgcgttgagttttgatagcatgtggaagggtgcattctgggaagcacttttcacgttcttgtacgttgatatattggacactacagggaccttatattcgatggccagatttgcagggtttgttgatgataacggtgatttcgaggggcagaattttgcgttcatggcggacgcatcgtcgactgtggtggggtccctgctggggacgtcgccggtgacggcgttcatcgattcgtcgacggggatacgggagggggggaggacggggctgacggcggtgacggtggcggggtattttttgatggcgttttttttcacgccgttgttggcgtcgattccggcgtgggcggtggggccgccgctgataatggtgggggtgatgatggtgaggtgtgtggtggagattgactgggaggatatgagagaagcgataccggcgtttgtgacgattgtgttgatgccgttgacgtattctattgcctatgggttgatagggggcattgggacgtaccttgtgttgcatgcatgggagtggggggaggaggtggtgaggaatttttttactaacaacaactttaaggataataataatatatctaatgtaaatgctaatagtcgtgttgttgatgatcatgaacaaggagatgataacaaggtgtag

SEQ ID NO: 88093 - DNA, 330 bp, Glycine max
  Peptide Sequence Number=SeqID_204871
atggctttgctagtggggttaggctcttcatttttcaagcatgtggggtatgttattgatggagttgtggcgataggggctatatttttggaagcctttgtggtgaggaaaggaggtggtttgttggttgtggtgagtttgtggcgtgtcattagagttgtggagagtgtctttgagttgagtgatgaggccattgaagctcaaattgcagggatagtttgccaatttgaggcactcaaagaagaaaatatgaggctcgtaggagtaatatatgagaaggacaagatgattgaaatgctcaaggaagatttagataagtgtagggaatga

SEQ ID NO: 88094 - DNA, 771 bp, Glycine max
  Peptide Sequence Number=SeqID_204872
atgtcaccaaatctattgctgcgaagtgcaaagggccctaaaatttcgactaagaaacaatgcatggaaaccggaataagaaggcaaggtcgaacgcatcgacgaagaacaggaggttgtgtcgatcaacgtgccgaacaagcaacgagactcgaggatctcaacgccagtgacatcattgatgtcaaggcgacagagtgtgatgacctcgtggccaacatcgacagagatgcagaggacgcaggagtggttgaaggcggtgacacagagagagaggtgatcatggaagaggagggagaagaagaggaccttggcggcccaaaggcgcatggattggaccatagggtgcgcttttcaacgaggaggtgggggccggaacaaaccatcgcaaccactgtcgcctctctatttttttatgacaacccttttcaaagaaaacctactccatttttcgaatcaacaaaccacactcaaaaccctaatgacggtgaccatcccatgaacatcgattttggcaaggaaaagaagtggaagaggaataaggacaaaacgaacaaaaccccaaccccaaccattaatacccttgtttttgtaactgaagctattgagaaatcagagaagaagaggaaacgtgattccgacgaaggaaaaaaccttaatgtggatacaaaagcgattgggaaaaggaaaaggaaaagggacgaagttgagaaagattgggaagaggaatgtttttcagaattgaaatctgttttggaagatgaaggttga

SEQ ID NO: 88095 - DNA, 723 bp, Glycine max
  Peptide Sequence Number=SeqID_204873
atgaaagtcagactagtactggatgcagctcctttggctgtttttccagtaattgatgacttagagattgaactcagttctggaacatatttgaagcagagccaggtgaggataatgggtgtcactgctgacagtcaaaatcaaggaagaaccacaattgatattcacttggtttcacatgggaaaaaatttgacaataccactgcagttctgttgtctaaaaggttttggcacaacgaagttcctcttaataggagcctttttggtgattattatctaggtagttgtttcatttctcctaatgacattttagtttattcttgtcatatgttactgcctgagactaaagcagttggtatcagatttttttcccatcaatatatactaacagggggatacacctattgtccagaggcaatcctttggtgggcctttgcctgctcctctgagtacttttgggaattagaacaaaaccagagatcatgggaaggctatgtgaactggaggaacaagtctgctcccagagactgccatggtggcatgcttgcagcctcctttgctttagtcgtcgagatattggagagtctggcatttctagctaatgcatgcaatttgtcacaaagaagcaaagagtgtccactctgttggcaatcacttgctttgaaagatcctgccagccaagagcttctagctgcagtggaagatgagaaatgcatgagataa

SEQ ID NO: 88096 - DNA, 555 bp, Glycine max
  Peptide Sequence Number=SeqID_204874
atgtcgtatgatctgaggttcctcttatcacgcctcttggacacgaatcccagtacgaggataaccgtcgatgaaatctataagaacacgtggttcaacgcgggtggtggtgagtatcggttcaaccgggtttcggtcacggagagtgagtgtgagaagcaattgggtcgaaccgggttcgagtcgttgaatgcttttgacttgatttctttctcaaccgggcttgatatgtcgggtctttttgaggatccgaatggttcagattcggctgaacggattgtttcgtcagtggcgccggaggaaatcatggagagggtggaggcagtggcggaggaggggagggtggtggtgagaagggagaagaatggcggtggagcaaagctagaagggcaggatggtaatttgattggtattgttgtggtttaccgattaacagatgagctggtagtggttgaaatgaagaggggtgaaaaaggagggaaatgtggtgtgcagttttggaaagataaattgtgtcctttgcttcttgaattgacaagtgatttggaagagccg

SEQ ID NO: 88097 - DNA, 219 bp, Glycine max
  Peptide Sequence Number=SeqID_204875
atgcgaaagccccgctggcagtccttgattcggaagttccagctagctgggaagggttcaagaagaagcaagaggtcctgcgtgcgtgcgactagggttcaagaagaagcaagaggtcctgcgtgcgcgagactagggttagaaaaaggaaggttcagtgcgaaaggagagaagttgggacgagcgagggtcgctgctgtgtttagtttgttttcctga

SEQ ID NO: 88098 - DNA, 262 bp, Glycine max
  Peptide Sequence Number=SeqID_204876
atgggtgaagacaacaattccaatggtcaatctcacactaactcactggatcgggataagctcctcactgggattgacctagagccaccagatttctcatttcatcaaagtgaccaccaccaccaccacacttataccatgtcatataatcatcatcatagtaataacaatgattttcccactacaagcaccatgggaagtagtagcttatcctatgatgaagatgcaagctttgatgagaggcatggcaaaatgctcaagt

SEQ ID NO: 88099 - DNA, 447 bp, Glycine max
  Peptide Sequence Number=SeqID_204877
atgtcgatgaagaagctcgggtcgatgaagaacgaagacatttcacaaagttacatcaaatacgtacagacagacaaggcctatatacttcaagaagctatcacatatatgaaacaacttcaggagagagtgaaagtgctagagaatgagaacaagaggaaaacaacatattcaaaaatattcatcaagaaatcacaagtgtgctcaagagaagaagccacatcatcatgtgaaacaaactctaattatagatccacgccaccaccactacctcaagttgaagcaagaatgttggaaaaggaagttctcattggaatccactgccagaaacaaaaggatattgtgctcaaaatcatggccttgcttcaaaatctccatctctctcttgctagtagtagtgtattgccatttgggacttctacagtaaaagttacaatcattgcccag

SEQ ID NO: 88100 - DNA, 216 bp, Glycine max
  Peptide Sequence Number=SeqID_204878
atgaatgcaaagagaatagaagatatgattggtgtgcttccaaagagaaaaatactaatgtggcatggggagtcacaggggaaccaaaacacaatggtgagcaccatcacacccgaccacaacatgttgtcaacaacacaaggcatgatccaggccctccatgtcggcgagcacatccgcagcgtgatgggtagcgacagttgctcccctgattga

SEQ ID NO: 88101 - DNA, 1338 bp, Glycine max
  Peptide Sequence Number=SeqID_204879
atgggtggtggtacagcatttttggagcaccccatatcagacgatatacttcagttactctttgaagtctccaactcttctaacttggaaaagtccttagagattctcattcagaatgccaaatccgattctgggcgtttggaactagcttctaaaaagattcttcctgcagtacttaatatagttcactcactcactcatgcttcacaccaccatcagcgtaatcatattctttctttgtctttcaagctcctcagaaacttgtgtgctggagaagctgcaaaccaggactcatttcttgagcttaatggcgtggctgttgtttgtagtgttctgaggtcagaggctgcttcttcaggccctgatcatgggttggttcggtggggtctgcaggttctggcaaatgtttctttggcggggaaacagcatcaatgtgctgtttgggaagagctctgtctggatgggtttgtatcacttgctagacttggcaccaaggagacttgtgacccgttgtgtatggtgatttatacatgttgtgatggaaaccctgaatggtttaaacggttgtccagtgaggatggaaggctcgtaatggcagaaattgtgagaaccgcctcttctgcatttcttctgcgaatcctatcagaaatcttgaatgagcggcttaaagatgttactgtttcaaaggatgttgcactgtttgtttttgggatattcaagaagtctattggggttcttgaacatgcaacgagagggaagtctggtcttcctagtggctttgttggggttgatgttcttggctactctcttaccatactgagggacgtttgtgctcaagatggtgtgagaggtaatacagaggattcaaatgatgttgttgatgtgctattgtcatatggcctcatagtgttgcttttgtgtttgcttggggcccttgaacctccagcaataatcaggaaaggactcaaacgatgtgagaaagaagatggtgctagttgttccataaaaccatgcccttataagggcttcaggcgagacatagttgcacttattggcaattgtgtttatagaaggaagcatgcacaagatgaaatccgacataggaatggaattctactgctattgcagcagtgtgttactgatgaagataatcctttcctgagagaatggggcatatggtctgtgaggaatatgttagagggaaataatgagaaccaaaaggtagttgctgaattggagattcaaggatctgctgatgtgcctgaaattacttcacttggtctccgagtggaagttgatcagagaacaagacgtgcaaagcttgtaaacatcccgtga

SEQ ID NO: 88102 - DNA, 249 bp, Glycine max
  Peptide Sequence Number=SeqID_204880
atgggtgagtttggggaacttaggctcactgcaattatttttcaatatttctgctgcaagggtttagtttatgaaactcgtggtcactgcaaggtccgtttggggtgctcactttacagttcgtttagacagctctctgggtctcacagcaaggtattgtgcgtggttgacaggtctgggactaggagagttccaatgggtttgcacagtgttgacaatggtgatgttaaacactatgtgtctctttag

SEQ ID NO: 88103 - DNA, 396 bp, Glycine max
  Peptide Sequence Number=SeqID_204881
atgaaatatttgatcgccacaaattgcccaggcccttttctcttgtcatattccccaaacctcaaaacccctaaagccgaaccgcacagattcattgcgttttcaatcctcaatccttcttgtcaaggacaaataagtaacaaggatgaaaacaaaacgtatttcagatctagggacgagaacctgcagaaggaggatcttcgattctctgcgtcgacggaggatcttcgatactgggaagcgatggagaacacggtgttggtgaattgtgatggtggcagttcgattgagctcacgacgatagagaactgctcgaatgctgttgaagatgttttgaatttttttaattttcgattagaattcaaagtgtttctagaagaagatgaagatgggtaa

SEQ ID NO: 88104 - DNA, 1308 bp, Glycine max
  Peptide Sequence Number=SeqID_204882
atggcaacatttatccgaagaatggcaatcagctatattcttctgacattgtttttctctgcagatattggattttttggacgtgttgcatcatttggaatcaactatggccaagtagctaacaatttgccgccgccagacaaagtccttgaactcttgaccaacttaaaggtgacaagaacaagaatttatgacaccaatcctcagattttgactgcttttgctaactcaaacattgaggtaattgtgacggttgaaaacaacatgctaggccagttaaacgatccccaacaagcccttcaatgggtgagtggccatatcaaaccatacctcccagacacaaagatcacagggattcaagtagggaatgaattattcaccaatggtgacaccactctcattcagtatcttgtgccagcagtggtgaacattcacaatgctctagttcagctaggcctagactccaacatccacgtttcgacgccgagttccttagaggtgcttcaggaatcttaccctccttcagctggtagtttcaagagtgagatctcagggatcatgtcccaatttttgaacttcttggccaccactaaggcacccttttggatcaatgcctatccttactttgcatacaaggatgaccctaataggattccattggactacgttttattcaatcctaatgaaggaatggttgactccaacaccaacctacactatgataatatgctctatgctcaggtggatgcagtctcatttgccattgctaaattgggttttagtgggattgaggttagggtctctgagactggttggccatccaaaggagaccctaatgaggttggtgccacagtgcagaatgctcaaacttacaacaggaatttgctgagaaggcaaatggcaaatgaagggacacctctgagtcctagaatgaggttggaagcatacttttttgcattgttcaatgaggacatgaagactggagcaacctcggaaaggaactatggtttctttcaacctgatgcaactatggcttacaatgtaggattggctgcttttgcagactcatccacttcatccacttcaatttctcttacctcctctgccactaaaacaaagaaatcaggaccaacacactttctgaatgatgggggcaacaacaaaatctgcaatacggcgaagaggcaaggcaattcaattggaaaatcaactttctcagagtggctacactttcattcacttaccctaccattagtcacattccagcatcaagcatgtggcggtgacgttagattgagcttattttag

SEQ ID NO: 88105 - DNA, 303 bp, Glycine max
  Peptide Sequence Number=SeqID_204883
atgggtggatgtggacgccctcgacggcgtcgaagaggaggagggcagtggagaccctttagtggtgccttctcgatggcgaagggtgggaacggcgtcgtaggcggtgcgaagggtgggaacggtgtctcgtccgatggcgatcggcttcaccttcgacgtctcggagtaactgaactggaactcgaatggcgctgtggaagaggaagaagcgtcgcagccatgctcaaggcccttttgcatggacattcatactctgcacatggtaagggttgcgttgctactgttaaatcaatccaatga

SEQ ID NO: 88106 - DNA, 219 bp, Glycine max
  Peptide Sequence Number=SeqID_204884
atggttgtcattttgcctaaggaaaatgttgtcatctggttgtgttcgttgcataatagaccagacaactacctcaaaggaataattaatagtgctttgaaagaacttgatgatactccacaaagtaaatccaaggctgctgctagatggattgttgttaaatatttcaatgatgctagaccattggaaccagagagattgaaggcgcttcgcatctag

SEQ ID NO: 88107 - DNA, 834 bp, Glycine max
  Peptide Sequence Number=SeqID_204885
atggctacaccgcccaactcttcttctcctcctcctcttcctcctactgatgcaacatcgcattcgttgtctaacttgaagcggacaagaaaggcgacatgcctaagatcattggtgactacaccagttggggcagagagacccttggtccatgtggaccctgctagtgggaaagcggatggtccccacagaaagaagttaagaacatatttggggatcgtcgctcgtgataaggtggatgtgacatacgagaattggaagcaagtccatgctgctcagaaggatttgatatgggaggatattcagtttaagtctgatttgacatctaaatggacacttgcagccgacaaggatagtgtcgatgacactgatgtacgaaagaaggcacaggccatccagagacaaaacactacttctcacgtgttgtctcgtgggggttatgaatatttaaaaaataagtttatggatgagaagagaaagagaaaaatggaggaagctactcaatctagaagcattgacatcgtgattgattctctatctcccatcagacgacacgtgaagtggaagatggctcgcacaaagaaaactggccaaatgacgtctgagacagcaaagaaaattgctaagaagattgattcattggaggagcaggcctcacagggttcgtttgtcgtccatggacgtcaagatgtactgactgctaccattaggcaactagaacaccctggtagtgtacatgctactggagccggtgtcacgatcaagcaatactttggagcgactccaaggacctcccgcacgtcttcctccatggctcccgaagacctggagtag

SEQ ID NO: 88108 - DNA, 675 bp, Glycine max
  Peptide Sequence Number=SeqID_204886
atgactagtgcatataacaggttaagtgaatcaaaaattctaggtcattctcctctccccctccctccaatccttccagcccgtcgaagccatccactcctccgtcgtgcctcttcttccgctccaccgtgttgcttcttcattgtgagatcgggaagcctcaagcccgcggaggccctcttgccactgaaagaaggacccgatggaaccgacggcggcaaccatgactccacgtgcggagatggtaggtggggtcagtggatgaaaggaccactcgtgagagcattctctatttcttcttcttcttccttgtcctcttgcaagaacaaaaagtctgatctgaggttgcttcttggcgtgttgggtgctccactcgcccccgtccacgtgtgcaccacggaccccttcccttacctcagcatcaaagacatccctgttggagtaagaaaaatgttgagaaccacaaatgatagtgttctaggagactatgagttcagttgcgcctttgctcttgtattagggtttcaggagactttttctgctcagtacatattagagaaatacattgctgctagtggagggcaaaggcttcagaattcgattaacaatgcgtatgccatgggaaaggtgaggatgatagcctctgagtttgagaccgcaaacaaggtcctgtga

SEQ ID NO: 88109 - DNA, 264 bp, Glycine max
  Peptide Sequence Number=SeqID_204887
atggttgtgactacaaacaattttagtgactatgcacaaattgagcaagcgcgttatgggaggttttttaaaggttttcttccagatggtactgttgctgccataaaacgtgcacaagagggttcactgcaaggtgagagggagtttctcactgaaatacagttgctatcaaggttacatcaccgcaatcttgtgtctcttgttggatcttgtgatgaaaagggtgaacagctcgcacctcatttacaagcttatccacgatag

SEQ ID NO: 88110 - DNA, 552 bp, Glycine max
  Peptide Sequence Number=SeqID_204888
atggaaggtgatgtatcttttgaaaaccaatgtgtcttaaaagctataaagatcaatttccacaaaagaaaagttttatgtgtaacgttggcatgcttcccttcaaattcttgggtctacccaagaagagttgcaacttgtggtcctgttattgagaactttcaaacgaggttggtggtatggaaaggcttcgaaaaaggtgatacaaaaactaataagcatccagagaggaggtttctgtggggtggaaaatcagcagatcaaaaaatctcgtgggttaattgggaccaggtttgcctcccaaaatcagaaggtggtctatgggtgaaaaatattatagtggtgacgggtgcttacggggaagaatgttatatggttgaacctaatatattccctcaactaaaaatatgggtgcctcctctgcccattcattatggtggagggatatttttgaatctgaatcatcgtgacatgtgtccggcaccatggttatcatataacattgttagaaagcttaggactggatctagcattaaattctggaaagaatga

SEQ ID NO: 88111 - DNA, 528 bp, Glycine max
  Peptide Sequence Number=SeqID_204889
atggaatcaatgaagatcagcaaagtctggactttagttgaagcttcaaaggatataaaactaaatggttgtaaatgggtttacaagaaaaagattgaagaagatggaaaggtagagacctacaaagcttgccttgtttccaagggatatcatcaaaaggaaggttgtgttttcaccttaaatggtggcacagtaagttggaaatatttcaagcaagctacggtggcagattcagtaactgaggcaaagtatataatggtaagtgaggctgataaggacattgtttggatgaaaaagttcatctatgaacttggtgtggttccttcaataggaggactggttccactattgtgtaacaatactggaactatcactcaagcaaaagaaccaaaatcacatcaaaagtccaaacattttttacaaagatatcactcgattagagagatcattggacatggggacgttaagattgaaaaggtagttggaaggagaatgcagcaaatccattcaccaaggcacttggcataa

SEQ ID NO: 88112 - DNA, 357 bp, Glycine max
  Peptide Sequence Number=SeqID_204890
atgtacaaagataattggacccaaccttggcccatgggctcagaaatctatcctaaggttcatgagaaccctagggccttcttcagcagctctagcctaatcctcttggagcctcttgctcatggctctagtgactggtcccttcctagggaggattgcatcactcatcagtgggctaagcgcgcatccaccgctaagcgcaggttcagcatgcttagcgtgacaaaagaatctagccgggcatcatcatcaaggtcgcgcgctaagcgcgatatcaatgcgctaagcgcagcagttatctttagccaggctcagtgcacgactgacgctaagctcaaatccacttactcgcgctaa

SEQ ID NO: 88113 - DNA, 360 bp, Glycine max
  Peptide Sequence Number=SeqID_204891
atgcaggaaatgaatggaaagtgtaaaaggaaggaattgatgatgatgggaatggagaaagggaatgtgcgagagaggtgtgtgcagcaatttcaccaaaacgcttatctcccaaaagtcatggcttcttcatttattgcactcataccaaaaaagatcaacccacaggagctatctaagtatagaccaatatccatgataggaagcctccataaaatcctatccaaattgcttgctcgcagaatgaagatggttctttggagtttgaggcttagaggagcttgcccaagtcctcttcttaatagtggtgaagggattttcggggcttttcaagaatgcaatgcagatagagctttatag

SEQ ID NO: 88114 - DNA, 276 bp, Glycine max
  Peptide Sequence Number=SeqID_204892
atgctaaacctttttcctcagcccctcatgccattttatagcaaaaatgagggaggtggttgccgcccagctcacccaggcaagctaggaagtctcaccccttacattttgttcaagatcaaatggtggcagaggagccaatgcttcacctcaaagttgagtgtgcatgggagcttgggtacccaatgtgatctacggcatagatcactttttgaggtatctatgatatacaacaatgtttataggcaaccccaaggagctaccttacctttttga

SEQ ID NO: 88115 - DNA, 1173 bp, Glycine max
  Peptide Sequence Number=SeqID_204893
atggcatcatcagatgaagaaggtgaaattatcccagatcttgttgatagttattggtttgaaaatgaaaaggaagagtttgtgtcactttctagtttgacattactgtggagcattagtgagaccgtatgtggcttgaaagcacaagtatttttgcgtggcaccactgatgacgacggtctccagacaattcacaaacaaataatcggatggagatttgaacttccctctgggaagcctgagatttcagtgctttcaaaggacaaaagctggataactctccaaagaccaagaaagtgttttgagagtacaattaaggcaatcttggtcacagtatattgtttacattttgtgaaatggaatccagaggaatctcaaatatgtatttgggtcaaaatgctgaaggcctttagctcatttgatattgtgccatccgagaatgatcttcttagtaatgtgacattgattagagaagctgttgaaagggataaagatttaacaaaatccaagaatgttcttcctacaaagaaatcaaagtttattgtggactccgaggatgaggagaatgaccaatctgatgttctaactacaaagaaatcaaagtttattgtggactttgaggatggggagaatgaccaatctgatgttcttcctacaaagaaatctaagtttattgtggactccaaggatgaggagaacgaccaatctgatgttcatcctacgaagaaatctaagtttattgtggactccgaggatgaggagaatgaccaatctgatgttcttcctacaaagaaatcaaagtttattggggactttgaggatgagaagaatggccaatctgatgtttttcctacaaaggaatcaaagtttattgtggactcagaggatgaggagaatgaccaatctgatggtgaactcgatcccgatggagagcaaaatattggatatgatactgtttgtgcaatatgtgataatggtggtgaaatacttccttgtgaaggaagatgtctgagatcctttcatgcaaccaaagaggctggtatagatgcagtttgtgaatctcttggctacactagtgctcaagttaaggtaagcactgtgtttcccgtcttctgttactatgtttggactatatgggaaaagaaaggaaagaaaacagtaggatggaagtaa

SEQ ID NO: 88116 - DNA, 2148 bp, Glycine max
  Peptide Sequence Number=SeqID_204894
atggaggaatcccaacatggtacatctctgttccccatgttagaaaagtggaactcgacgatgaggccgggacatagattggtatgggcccaatgttggggtgtacctttagaaaagtgggatatagcgaatatccgaaaaatcgtggcgacagtcagagacctcatcgaagtagacgacgatgttgacgagcggagaaggttagacagggctagaatcctaatcagaactccaaggaaacctctggtccaccacacagttgcagtacatatcggcggggaggtacacaacgtgcacattgttgaggaagggtgcaccgctgttggaatgagatccacgctttgccgcagcaccacgaactcatcggaacagatcgactccgatggtagtgacatcggaacactgttcgcagcgccggagacaacccctgatttccagacccagacaagcagcctcgacgggatgcaaaatgatgttgcagaaaaccaccagatctcgttattacccggcggtcatcaggccacggagaactcgctgggtattgcacaaagtagtcagactcacccacctagtaccgacaaacgcacacaaacagacaccggaaaaggaaagcagcagaactcagtggtgcaaactacggtaaacacaatgccctatatcggtgaagatcgcacatgcgaagcagcaaagaagaaaggtttgggcagcagagtgatgtcgtcagtcacagaggagcgcacaggatacacaggaaaggaaatagttgttgtgcctacccaaggtcagcgggatattgaccatcaaattaccaacgggccaattatgttttcaaaaatgacatgcatctccaaccccagagataacgggccagtttcagagttgggcctcactacccacaccacatctttcacttcacacaacccttatgtcagcccacctcatctcgaaacccttagtgtgcatccatcgacttcaacagcggcttgcgataaactcattactgaagctgggtcaaagactgatgtgagcctcactaaacataacacagtcactaacccagaacataacaaggctagttcatcataccaaacagaagagaatggaagtgagttgaaggtatatgctagatccagggggcgcagacagaagacagcccaccaaagtggaaagcaacacactttgggcgacatcaccccacttactcatctggaacccatatcaggcacggctacaccaacagcagcaactaaacacaacatagtcactaacccaaaacttaacaaggctagctcatcatatcaaacagctgagattggaagtgagttggaggtctatgatagatccggggggtgcagagaaaaggaagcccacctaagtggaaaccaatacaacgtgggcgacattactccacttacacatctggaatccatatcgggcatggctacaccaatagcaactactaagggatccaacaggggccagtatgaagaggcagcatcactatgggaactagcaaaaatttggggacagccacaccttaccatgaatattgtatcctacaacattagagggcttgggagaggggtcaaatgggctgcaattagaaggatgatcaggaaacacaaagactactttgcgtttggaatgaacgagccttcaaagtggaatgaaggtcaaaataagtgggaactatgggactcactcaagcaattgaggcaacagaatactcaaggattgtggtgcttcctgggtgatttcaacagcattaggcaccattctgaaagagtaggcgtgtcccaaaggggtgcggaagccagcaacatcattgattttaatgaatggatagcagacctaaactttgtagaaacacctaatgtagggagaagcttcacgtggttcaaaccaaacggggttgctaaaagtaaactagacaggatcttggtatcccaagaatggctgcataaatggccagatagcaccagtttcaccttggacaggaatttttcaggccattgccctattttgctaagggctaaaatcattgattgggggccaaaaccgtttagggtgtttgattgttggctgaaggataaatcttttgaacagattgttaaagagtgttggtcaaacacgcaaccaacaggctag

SEQ ID NO: 88117 - DNA, 525 bp, Glycine max
  Peptide Sequence Number=SeqID_204895
atgaagatcatagggctgaatcctccttttggggttaagggttctcttgctaacaaatttattaacaaggcgttgacatttaagccaaaactccttatacttattgtgccaaaagtaactaaacgacttgacagaaagaaagaaggatatgatttaatttgggaggatgatgagatgctttcaggaaagtcattttatctacctggttccgttgatacacgcgacaagcaattggaagactggaacttgaagccaccacctctctacctttggagtcgccctgattggaccactaagcacagggaaattgctcaaaagcattgtcatatcaaggaagaatatgatgtgcatgtgaatggaaaagaagtgaagaattatcttatggaggagaatcatgagtgttatcagaattgccgtggcttacatgtccctgggaatgttttgagcatatttgatggtattccaaatgataatggtgccaatgcacctgaggaaggtgcaactagcaatgcctcggtctggtga

SEQ ID NO: 88118 - DNA, 840 bp, Glycine max
  Peptide Sequence Number=SeqID_204896
atggatcctcaggagcttacctccaagctttgtattctagggcatagatttgttcttaatgctgaaggagcaccctggaagctcctgaggaaggatctgacgacgctggcccagacttggagcatgctgtcatattctaacctcgcccccacttctcatacctctgatctgaacatggatcgggcgagctttccagctctcatctttgcactctacgtggcccaaggagtagtctcagattctctaaccttcgagtccctcagccgtgccataaatttggcatacataaagaagaactgttggaacctggacgatcccatgatcgaatttccaaggacccgcaaggcacagtctcgaggatctcagggtccatcttcagcggctccttcggctcctgcttcctctgcacctgctccttctccgactccagccccttctacttcagcaccaccacttcctcctgctcattctcattcaccagctccctctgcttcatcatcatcatgccagtgccgatgctccaaggtcaccatccctatgttgcaaagtatccaccgtggcttatgcctggtgatgcagagtatgcatgactcggctcagcatcgaccttttatcagcatggatgagttcatggcacagatggcctggccaggagtccagccttctcctttgaggggaggtgaggcttctacagcccaggagcctcagccagagctagaggttgctcatgaggccactccagaggcgactccacaggtttcacatgctatttcacctgttgtggaggtctctgagggtgaagaaggcgccgatgacatcgactatgcagtagatctatag

SEQ ID NO: 88119 - DNA, 135 bp, Glycine max
  Peptide Sequence Number=SeqID_204897
atgtggaattttaatttccgtaaagggggacacgtagaactgcacccacaagtcaggggagcagtcgtcgttacccatcacgcgacagaggtgctcgccggtgcggagggcctgggccatgccttgcgtcgttga

SEQ ID NO: 88120 - DNA, 165 bp, Glycine max
  Peptide Sequence Number=SeqID_204898
atggaggtggagttggagcctcgcgtgaaggctcttcctttcaaggtgaaagcgatgtcgagagaatcgccgtcgcagaaagcgcttcacgttctcgacaccgacctccgcactcactggtccaccgccaccaacaccaaggagtggattcttctagaactcgat

SEQ ID NO: 88121 - DNA, 408 bp, Glycine max
  Peptide Sequence Number=SeqID_204899
atgaagaagatccaaggcctacaagctccacatggagctatatcagctgctgaagacctaaaacagctgacacaaaagatcagaggccaactagaggattcgatcacacaaaaatcgcaaatgcaattacaaggactcgcactgcctcctgaggttgaggttggtccttctgccactcgtgttagcacaaaggaaagatgtgtcaatccctcggggcaggacccagaaatgggagactcggacaaatgtgacttggatgtcgatgacaatcctccccgactagttgttgttggaagagtttatgaaggatccacgactgtgcacaacattcctttgggaaataatcaagtgaaggtcggtgttaagcaagtccgagatgctgatgcttgtgttcctgtacccacttaa

SEQ ID NO: 88122 - DNA, 141 bp, Glycine max
  Peptide Sequence Number=SeqID_204900
atggatacttcagagccctacactggggcaatgaggggcatcatgcctgaacctcaagttccctgttacaaggtcatgatgaaagacaacgattggtacctcaaagccttacactggggcaatgaggggcaccgtgcatga

SEQ ID NO: 88123 - DNA, 171 bp, Glycine max
  Peptide Sequence Number=SeqID_204901
atgaaaataaaagacatgagagcccggaaaatcatctcttcttacttgcattcgggcgcgcagtgccccatgtgtgcagttaagaatgtgatatggacctcccggcttcccgtgacaaaagacgagaccaacatacaatgcatgcgtgacgacatgatgcatgacatttag

SEQ ID NO: 88124 - DNA, 351 bp, Glycine max
  Peptide Sequence Number=SeqID_204902
atggcgaaacctaggcgaggtcgtcgctctccctccggttccatttctggctcctcctctcgctcctcttcccctccgactctcgttcctcctcttgcccgcgctccctttcttggccccgttctcactcgtgctccaaatcctcttccccttcatcctcctcttcctcccgaagccgcagccttcccctgtagaggcgccgaaggtaccgctaatttatttgatcagagcgccgaagatgctacgcttgaaggttttgagtgcggtgtgattgggagacatgtggaaattgaatcttatcatgcctgcaacattgattgttcattttgtgtcgtttctgaagatgattaa

SEQ ID NO: 88125 - DNA, 1857 bp, Glycine max
  Peptide Sequence Number=SeqID_204903
atggatgtatgtgaatcagggaagaacaaagctccagagaccccaagagtaagaccaccctcggttctggcagaaaagaacaatgcagaaaagaccaccagacgctcaagaacaagggaaattagttctagatacaaatcccctactcctgctagcccttctgctcctcgtagatgcccttcaccaaaccttacaagaacaacgcctgcgtcatcctctcacttgtttccaaagaggtctctctccacagaaaggaagaggccctcaactccgacttccccaacgccacaaagaccttctacgcctgtatctgttgatgggaaattgtcatccagaagactatcgggtacccgtttgccggacagtctatggccttccactatgcgaagtctgagtgtttctttccagtcagataccatttccatacctgttagcaagaaagagaagcccgttgttagtgcttcagaccgcactctgcgcccggcttcaaatgtggcacacaagcagcctgaaactccaaccataagaaagcctacgccagagagaaagaaaagtccccttaaagggaagaatgcttctgatcagtctgagaattcaaaaccacttgatagcttgtcttctcggttaatagatcagcatcggtggccaaatagaataggtgggaaggtatcttctaatgcattaaacagaagtgttgattgtgctgatatcagaacgttgaacacttcagttccgggaactggtgtttcttcactgagaagattgtcattgtctatatcaggtgaatccagtaaacccttccaaagggcttctaatgacgctgtaaggctattgtcgcttgttggaagtggcagaataggaagtgaggtgaaatcagttgatgactgtttgccacaagaactaagacctcacaaatcttttgctgcaactccaaccgataaagcaggacttgcatttgctggagtcagatctcagtccttgtttgctcctggatcacgactgccctcacctagtaggacctcagtgctatcctcttctagttcaagaggtgtcagtccatctaggtcaagaccatcaactcctccttctaggggggttagtccatctcgaattagaccaaccaattcatccattcaatcaaacaattcaatttcagtgctcagctttattgctgattttaaaaaagggaaaaagggtgcagcctacatagaagatgctcaccaattacgtcttctctacaacagatacttgcaatggaggtttgtcaatgcaagagctgaggctgtactttatatccaaaatgcaattgtggagaaaactctatataatgtatggattactactttgtccctgtgggagtctgttattaggaagaggatcaatcttcagcagctgaagctcgaacttaagctgaactctgttatgaatgatcaacctctttgcatatgcaagggtaaggctgcgtacaacatcccttccccataccttcgcatagcgaagagcctctgggcaatggggtacgaaatgacttaccttgatgattgggctgtacttgaaagagatcatattgatgctgtatctaaggctgtggaagacttggaggccagcactcttcgtcttcctgtaactggaggagcaatgtcagatattgagcatttgaaggttgctatctgtcaagctgttgatgttatgcaagcaatggcatctgcaatctgctctttgctctcgcaggttgagggcatgaacaatttaatttctgaagttgctgccatagcagtgcaagaaaagaccatgcttgatgaatgtgaaatgctactggcttcagtagcagctatgcagttatacagtgtgcattaa

SEQ ID NO: 88126 - DNA, 882 bp, Glycine max
  Peptide Sequence Number=SeqID_204904
atgttggtggcgactccgcgcattttcctcctttggaagacgcacccttggggtggtccctttgacgtttcaccaaaggttgaagtttgtggtggaagggcagttgatcatcgtctctggggaagaatacattctgggcacgggtacgagcccagaatgggcttaggtcggaacggcgatggcatggccagcttggtggaattcaaggagaaccgtggaagggcgagtcgccatgatcctctatgtcacatcagtgaaagcttcataattgcgggttggagatccaacgatgagtcctatgaaggtactaataccgaggaccctgatgttgattttgagcgaattgcaaaccaagctgaggatgaagaaaatgaagattcggggtttcccctagagctagaaaggatggtcgcacaggaagaccgagaaacgacgccacaccaagaagagacagaaatcgtgaacttgggtgttggtgaggaaaagaaagaggtaaaggttggcatgggcatgactacacctgtccgagatgaattgggagttttgttgcaaaactaccaagacatcttccctgggtcgtaccaagatatgcccggcttgaaccccgacattgtacaacatcagttaccgctgaataccggttgttccttggtaaaacaaaaactaagaaggataaagccagaaatgtccttaaagatcaaggaaaaagtgaaaaagttgttcgacgttggctatttggccgtggctcgataccccgaatgggtagccaaaattgtgttagtccctaagaaagatgggaaggcacgaatgtgcatggactatcgagacctaaaccgagccagtccaaaggataacttttctttaccgcacatcgatgtcctt

SEQ ID NO: 88127 - DNA, 1092 bp, Glycine max
  Peptide Sequence Number=SeqID_204905
tcatctgctatacgctctactagcggaattgttttaacagtagcttcaagtgggattgcctctatactattgcctggtggtagaacaacacattctaaatttgctattcctgtccctgcaacaaaaaattcaacatgcaatatccatcaagggagtgatttggctgaattgtttcatatcacaaaactcatcatatgggatgaagctccaatgtgtcacagatacagtattgaggcccttgacaaaagtttacaggacatcatgcacaacaacaatccttttggaggaaaggtcaatgttttttgtggtgatttccgtcaaattctacctgttgtgccaagaggtaatcgttctgacattgtctatgcaactttaaattcatcttacatttggaaccattgtcaaattctaaagctgactaaaaatatgcggttgcaatcaaatcctactgaccattccaacttggatgaactaaaacaattttttgagtggttgctagacataggtgatggtaaacttgcagagcctaatgatggttatggtgaaatcaccatcccagatgagtttcttatcaaggactttcaagatcctatccaggaaattgttgaagcaacatattcagacttattacacaactacaacaatggcgatttcttgcaaaaaagagttgtccttgcctctacaaaagatgttgttgataaaataaatgactatgtcctgtctttgattcctggtgaggagaaagagtattgtagtgttgattctgttgacaaatcagatgaactactcagtcctgcatttggagtactaacagctgaatttctaaactcattgaagacatcagggataccaaatcacaagctcataatcaaggttggtacgccaatcatcctactacgaaatctggaccaagctgatgggttatgcaacggaactaggcttattgttacaagacttggttcaagtgttgttgaagcagagattattgctggacctaacataggtcatagaacttacataccaagaatgaatctttctccttctgattcaccatggccattcaagctaattagaagacaatttccattcatg

SEQ ID NO: 88128 - DNA, 264 bp, Glycine max
  Peptide Sequence Number=SeqID_204906
atgaattgcgttttcgttcatgcgtcctccacccacgagtttggagccatgcgtagtgattgcttagtgcaattctccattctctaccccttttttcggtgtcccatgaattgcgttttcgttcatgcatcctccacctacgagtttggagccatgcgtagtgattgcttagggcaattctccattctctaccctttttcggagccccatgaatttcgttttcgttcatgcgtcctccacccacgagtttggagtcatgcgtag

SEQ ID NO: 88129 - DNA, 678 bp, Glycine max
  Peptide Sequence Number=SeqID_204907
atgaagatgaaatcactcgcgctgctggtcaccttagccgccgcgccggcttttgccgccccgttgcagttagacgtgtataacccacaggaacagggaatttttccggtctcgtcgacgctggtctccggtccgcatgaagcgattctgtttgatgcgcagttcagccccaaagatggcgagaagctggtggaactgattaaagcgcgcggcaagcagctgacccacatcgtgatcacctcgggcgatccggatttctacttcggtcttgagccgctggtgcaggcgtttccgcaggccaaaattgtcgcctcgccgctggtagtggaacatatcgaagcgaccaaagatgccaagctgcagtactggggaccgcagatgaacggcgctgcgccacaccagctgtatgcaccgcagattacccaccagacgcggtttagcgtcgatggtgagcgcatcgagctgcgccatgcggcagaaaaatcagcctacgtgtggattccctccagtaaggcaatactcggtggcacagtggtggattccggcattcacgtctggaccgcggacacgcagaccgcacccatttggtcgggggtatatataagcttgatgtttaaagacctaataacgttattgggaacagtgactctgcataatccttataacatagtagcctaa

SEQ ID NO: 88130 - DNA, 486 bp, Glycine max
  Peptide Sequence Number=SeqID_204908
atggacagagtgacggcagcgcgagtgtttaaccggatttgtgagttgggaagcctgagcgcggcggcgcgcgcgctggatatttcgcgcccgatggtcagtcgctatcttgatgaaatggagaagtgggcaggcgcacgcctgctgcaccgttcttcacggcggctgaccattacccctgcgggtgagcagattttgcataagacacgcgcgctggcccggctggccgacgagattgaacagcagggcgatgagggcaaaccgcagggcacgttgcgcgtagcctgtgcacattcaaccgccacacacattcttggaccgatgattccggcgttccttgcgcgttacccggcagtacgtattgagctggagatcaataatcagcctgtcagcctggtgggtgagcgcatcgatgtggctattcgcattaccgacgacccggagcccggcgcgattgcccgcagctgggtgaatgtgcctcggtag

SEQ ID NO: 88131 - DNA, 679 bp, Glycine max
  Peptide Sequence Number=SeqID_204909
tgacggtgtaccatttgagggtacagttgatgatgagtggaagttcgatttttctgtttttgatgcccgccggatggtttgcaccaaccaagcggatatgaccggaaggcttcttgccagttcattggcattcgaatgccacatcatgcactacttgattgtgcgcatcctacttcctagatcatccaaccttgcacaggtttatgaggaagatttgataattatgtgggttttcttaaccggtcgtcaaattgactgggcccatcttctgagatatcacatgcataagacattgcgatcaaatgctccactcccatatccccacctgatcacattgtttctacaacattttaatgtccctcttgactctgagccctttgtcaaaggcaagagatccttctctattggtgcgaatgtagtctcctctttcagataccgcaaagagagggatggctcttggatgaagaaggatgctccagtacaggccgctgaagaccgctctccatcaccacattctcagagagatgactcttcatctcttatgtacaacattcttgacaggttggatggactccacaccttcgtcgatgaacactttgactcgttggatagtcgtattgatgccatggatgcacgatttgcaaggatggacacatgtatcaccaaacttgaggaggat

SEQ ID NO: 88132 - DNA, 372 bp, Glycine max
  Peptide Sequence Number=SeqID_204910
atgatagttaaccaacaagtgaagaaaaagacggatagtaaggccttgtcttcaaaggccaaggggaaggaaaaagaggaaaaggattcctccaagaagattgttaagaaggaaaatcattttgcaacaaaatgtgatatcaaaagagcactccttcttaaacaatctttctaccttctcctatcaagggaaacatcccttagcaccgccatacctcttgagcttgaggttattcctcaagtaaaggagttgttggatgacggtttggtttgtaagagcttaaatccttgtgcttttgttggtgcccaaaataggtattatgaggcaccaaatccctatgataggtggtatgatgaatgtgttgagtggtga

SEQ ID NO: 88133 - DNA, 333 bp, Glycine max
  Peptide Sequence Number=SeqID_204911
atggcagtgcaatggagaaggaagagagagaggagacgccacttcaaggagaagatgagtctagaagaagctcagcaccataggacgccatggataagagcttggaggaagaaggagatgaatgaagggaaaggaagagaagagcacgaaattttaagaaggcaaaaatactggcaaatgagtgtgagagagaagatgcaggccgttcagcagtttccaacaaataggagcatgcgcttagctgataaggactcgcttagcgctcacatttccgcagggaattcagcttggcagcaacgactcgtgcttggccaaagtgtattatgggcttag

SEQ ID NO: 88134 - DNA, 204 bp, Glycine max
  Peptide Sequence Number=SeqID_204912
atggcactaagcgtgacgtctaggtttagaacgcagagagcagagcaaggagccaagttttcaacttttagagcgattagtgaattttttagtgattgcgaggttcttagaggtggaggagacaacctaactccttttgtaaaaggtgtctccttgccatggaaggctaaaaccctcagttggggattcttaatgagcagttga

SEQ ID NO: 88135 - DNA, 504 bp, Glycine max
  Peptide Sequence Number=SeqID_204913
atgagagtcttgaccccattgaagctcaaagatccagcctccatagaagctccacaagcaagcttccatcagtacattctttgtggcacaagtagagggtacatctacttgggttgttatactgagaacaagagatggtacatctcttgtggatcagttcaagtggagggtacatccacttggttgttcaaagagaacaagggagagtacatcccttgtggatctttggcttgtaaaggattttacaaggttgaaagaaatctcaagaaccgttggttgcttggggactggatgaggagtcctcctctgtcttcgacagttcccactacggccttgagggcgaggcaaaggtgtgtgggacaagaagtatcgtgcccaggaagagcgggtggtgttcagagaaaggccctcatgaaggcccttttggaagtcacgatggacgaggatggagacgaagaggaggaagggaaaggagtgggctttgtgaaggaacaggaccagtag

SEQ ID NO: 88136 - DNA, 231 bp, Glycine max
  Peptide Sequence Number=SeqID_204914
atgtcctctatctttatttttcataggactcaacatcctctatctttatgccttcataggactcaacatcctcacctttatgttttcataggactcaacctcctctatattttgatgacgccagagaatcaagagttaagcaagttccaaagaatcaggagtcaaaaagcttcaagattcaagactcgagattcaagaatcaagagaagactcaatcaagataagttctaa

SEQ ID NO: 88137 - DNA, 319 bp, Glycine max
  Peptide Sequence Number=SeqID_204915
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagtctggagaagcgtcctcagtggcggaccgggcccaagtccccctggaagggggcgccagagagggtgagagcctccgtcgtgcccggactcctgtcgcaccacgaggcgctgtcggcgagtcgg

SEQ ID NO: 88138 - DNA, 177 bp, Glycine max
  Peptide Sequence Number=SeqID_204916
atggcgattctggtaaaggctcgtagagctttcgcttcttcagaggctgttccgctgaagtcatggagggagtggcctcggtttaagttctcaaagaaggtggaatgcactatttgtagtagtgataaaaaaggacctggtttgattggttctaggtctcgctcagtattcagttaa

SEQ ID NO: 88139 - DNA, 123 bp, Glycine max
  Peptide Sequence Number=SeqID_204917
atggctcaactgataattccatacattgttgaggtgaatgttgattaccttacaaagcctcttgatgttttcaaggagatgtgcaggatacttaaaccaggtgtactggccataatgaggtga

SEQ ID NO: 88140 - DNA, 267 bp, Glycine max
  Peptide Sequence Number=SeqID_204918
atggcacaaattctgctccatgggactcttcacgccactgtctatgaagtcgataagctcaaaattggtggaggcaactttttaaccaagacaaccgatgtagaaatcggttatcctgaaaatcgatgtagaatgtcagatttcaacatcggtcccttaaccgtcgttgtgtttcaacaacaccgggttacaatgacgcgtgataaccgatgtaaaaaggcatcgataaccgatgtagaaaacctattttctagtagtgtatcttaa

SEQ ID NO: 88141 - DNA, 177 bp, Glycine max
  Peptide Sequence Number=SeqID_204919
atgaaggcaaatcctaaggaactgaatccatatttgaaggataatggaagtgaatccatatttgcctctcctcctctagttgttccttatgctcttgctggcacggatatagaacagggtataggcgtatgtgtagaagcaacgcttcatggtgaatgtgattcaaaggtgttttga

SEQ ID NO: 88142 - DNA, 1377 bp, Glycine max
  Peptide Sequence Number=SeqID_204920
atggattcattcaatcagagtcatcaaactaccagcttcaggtacaacccaaactcgaacacagtgaatcatacagatgataatgacgatgatgcagagttctcagggattcttgatatctatgttcatcatgctaggaacattcataacatatgcatctatgataatcaggatgtgtatgctaagttctctcttacatacaaccctgatgagactctctccaccagaatcataaatggaggtggaaaacacccaatattcaatgaaaacttgaagatgaagataacccagatggatgctgttctcaagtgtgagatttggatgttcagtaggtcaagaaatcacttggaagaccagcttttgggatttgctttggtccaaatttcacaagttgttggcaaaggaaaggtgacagaagattatagcctttcctccactgatcttttccattgtcctgctggaactgtccaattaacactttctttggacacatcattctcaatcagttccactgtgaatcccatatcacaatcagttactaattcatccatatcttcagaagttgttttgcttgatccaaaagtttcacaagatatgtcagacccagttgagtattctagaattgaatttcctgatgttagtgtgatgaaggagaaccagaaaatggtttctgagtacttcaatttggaatcttatggttcttatgcttcaaggcctaattactcagtgggattgctaccatttcttcacctcggtgcttctcctcaaggtgatgattatgaaatgactgtgactgcaccagatgagaatcatgagtccacttctccaaatgagaccattcggaatcctgtgttccctacctctactactacaagcttaagtgatgaaagaaactcaggtgattcagttgaggaaaagaataatttgaggggtgactcatcaaattctttcaatgtttcaatcacagttgaaggttgtcagaattctggtggcagtccagaaaccccaacttccaagaaagaaagtggagctagagatgacaaggagtcaaagttctcgtcaagcaaggaaaaggagatcaatagtgataggaatacagaagctacaagatttggtcaagttttttctgcttcactagggaacatcaacatggaggctgagcaatcagctatgcagcagcaaatagttaccatgtacatgagaagcatgcaacaattcactgagtctttggcaaaaatgaagcttccaatggaccttgacaaacctgaaagtgaaggtcaacttggtgtgattcaaaatcctaatagcagtaagttagaaactgataagaaaaaggatggatcacgtgtgttttacggtagccgagcattcttctag

SEQ ID NO: 88143 - DNA, 279 bp, Glycine max
  Peptide Sequence Number=SeqID_204921
atggaatcggggattaaggagcttgttgtggcagtaggtggaaaaatgaaggatgaaagcatgaaaatgaataggggagattatgatgacgtaatgggttggttggatgccactcttttcttagattgctttgctctttcttttactgtttccaatttcagtgactcactttctccactcagagtattgggattgaaaagtgttatgggggagtttacagaacctagctacaacacaaagaaccgttgtagcaactctaaaaagcctcaatcatcataa

SEQ ID NO: 88144 - DNA, 126 bp, Glycine max
  Peptide Sequence Number=SeqID_204922
atggtcagaagtcgagacgagttgacggcagaagtcaaccaaggtaagacgatggccagtcacgattggccgtgtattgtttgtctcctacttgcagattcaagtaggcaaaacactaacccataa

SEQ ID NO: 88145 - DNA, 963 bp, Glycine max
  Peptide Sequence Number=SeqID_204923
atggcgccgatgacccgtgcgcgttcccttcagccgggtaatattccctctgcgctgatggcggaatattaccggcagcgggccagcgcggggttaatcatcaccgaagccacgcagatctcgcctcagggtcagggatactcctggacgcccggcatgcattcgccggagcaggtttcaggatggcaactcatcacaggcgccgtgcatcaggcgggcggactcattttttctcagctctggcacgtcggacggatgtcccacgccagttttcaccaggatggtcagcccgtcgccccgtcagcgctggcgccggacgcgcaggtatgggtggtgaatgaaaagggcgaaggccaaatggtggactgcccgcagccgcgagcgctttcgcgcaaggacatccacagcatcgtcgcggactatcgccaggctgctctgaatgccgttcaggccggatttgatggcgtggaggttcacggcggtaacggttatttaatcgaccagttcctgcgccagacatccaacatacgcacggatgagtacggcggcacgctggcgaaccggatccgctttgctcaggaggtgttaagcgccattgctgaggccattggtcacgagcgaacgggcattcgtctttcgccgtttatcacccagcgcgggatgaacgatccgcaggtctctgaagccatactcgcgcttgcggcctggtgcgaacaacaagggattgcgttcatccacctggcggaagccgactgggacgatgcgccgcagatccccgaacaattccgtcagtcacttcgcgagacgtttagcggaacccttatcgttgcgggtaactatgaccttgaaaaagcggaaaagatccttgctgccggctatgccgatttaattgccttcggacgaccatttattgccaacccggatttaccccaccggctggcgcaccggttgccgctggcagag

SEQ ID NO: 88146 - DNA, 303 bp, Glycine max
  Peptide Sequence Number=SeqID_204924
atggagaaacttatgaagaacaatagcaaagcaatggaagcaaaggaaggaagcgcagctatgcactctcggagctcctgcttttataatggaagaaccaaaattttcaagcaaaggcaactcgccagccatgctggtgatccgtgggcaaggcaaaccgccaatggtaatggtgatttggccttgactgatgcgtctccgctgctgcactgccatggcaggactagccctgcaccctcagctattggaactcgccagtttgactggcggttccctatgcgttctgcatatcgccagttctaa

SEQ ID NO: 88147 - DNA, 252 bp, Glycine max
  Peptide Sequence Number=SeqID_204925
atgtctttacggacactattcctacttccccatcaggctctgatactagagatcagcgaaaaaggatacaacggacagataagaattatcaagggcacaccggagactggcttacaaatcccagattttcataaacagagaaaccaaagcgggggcagagtcgcacaggatcggcagagacgaagaaaggagatgaatgaaaaattggaatttattaaacttggaagaagtgcttacaaaagttgttcttaa

SEQ ID NO: 88148 - DNA, 312 bp, Glycine max
  Peptide Sequence Number=SeqID_204926
atggaagaagaaatctctcttcaagagaagaatattacaatgaagatcataagttttgttgctggtaatcgattacagacatatggtaatcgattacatgttgaaaattcaaattcaaaatccttttcaacagctatttctcaaccttgtcttctggtaatcgattacacttcctgcaaatgcttatcatttgaagcagccttgttagattcttctttgacatcatcaaaatcatgtatacatacattcacaagtacacgagtgaagattgaatgggagagaagagatcaagagcaagcttcacagacttga

SEQ ID NO: 88149 - DNA, 273 bp, Glycine max
  Peptide Sequence Number=SeqID_204927
atgagaaagaatggattatttgtgaaaagtggagaggatgtgttcccaaaggagataccacaaggactcctaccattaagaggcattgagcaccaaattaatttggttccaggaattgtgttgcctaacaggctaacatacaagagtaatcctcaggaaacccacgagatcgaaaagcaggtcactgatttgatgactaaaggttgggtagagaaaagcttgagcccatgtgttgttcctgtcatattggtgccaaagaaggatgaaagctag

SEQ ID NO: 88150 - DNA, 336 bp, Glycine max
  Peptide Sequence Number=SeqID_204928
atgccttccaaggttattttgatgatgccaaagaatcaagagttaagcaaagtttcaagcaaagattcaagaatcaagtttcaagtttcaagattcaagattcaggaatcaagtttcaagaatcaagaatcaagaatcaagagtaatcaagatcaagattcaagaatcaagagaagactcaatcaagataatttttctgtttcatcttctcttcgtctttctaaaagtttttgttcaaaactttctcgtccaagaaaagttctttgttcaaaaacttgtgctattcatcatttcattcgcttctccctttgccaaaaagaattcgccaaggactaa

SEQ ID NO: 88151 - DNA, 648 bp, Glycine max
  Peptide Sequence Number=SeqID_204929
atgtcttgcctagcgatcataactctgatctccctttgccaaagtgtcagttggtatgccatcgtgatacggatgagcgtccacgtgccccaggtgattgctgatgccatctatttgtttgcaggtatgccaccctccaggcaccctctagacccggataagtctaacagggccctggggtttccggcattgatcacgggcctctgccagtcattcggagttcccgtcacccctagtaaggtgatccgaccgccgatcacccgagccttcatcgataagtattgcaggcctaggcaggcacagggtgatgcacctcaggccgcagacgcaccgccaccacctcatcaggccgatcccgctggatcactaggcatggagcgttatctacagcacttggttcgccaccttagtcagcaggggcagggtttcgctccttttgcgtgccctactccagagcattttggggctaaggtcgcatggcctggagactggcccgaggcccaggcaggggaggcgcttgcaggatcccccagcaatgcagaggaggcccgtatggatgaggagatgacggatttgctcggtttcttgggaggagcggagccacgtgaccgaggtagtgtgcgcccccgtccgcacgatcttttttga

SEQ ID NO: 88152 - DNA, 414 bp, Glycine max
  Peptide Sequence Number=SeqID_204930
atggcgacaatcaaggtggtgtcggttacccaccatgacactgagaggagttgtggtttacgttgggttaactcctcaggggataatcttttaatggacaccgagggtattggtttcgaagggttgaccagtaggggtgagggcaatgaaggggtggaagaaatttctcttcctggagtcgggctaacccaggttcttgcaccaatgttagtggtttcagagcctgtacctcttggcggatttccggaaccctggccaggatgtgagttgcctattgctagtcatccactagaaccaagcaagggcatgaccatccatgtaaaaggaagcaatggtgatacgctcatgttcaggggtagggaaggaatggtagaggaagaagaaggtgagtggttgggtgtgtctggtttatga

SEQ ID NO: 88153 - DNA, 270 bp, Glycine max
  Peptide Sequence Number=SeqID_204931
atgtcgagtgacaatgatgaagacgagctcctccagagtggcaacaagatgtcaactacgtcggcaaatcctcctccaattcttgaaagccggtggagaactacatccagccaccgaagaaaccctttcctctgtcaaaatagtcgcagggcaaaggcagagtctccaccgccaccaatgattccaaaatcgagatgctccacatctctagcggcgatgaggataatgtccaagatctggttgccaccttcgggaccaaagccaccgtag

SEQ ID NO: 88154 - DNA, 312 bp, Glycine max
  Peptide Sequence Number=SeqID_204932
atgggcagaagagggaattcattgtcgcctgaaatgacgaaggaggtcgagctttgtaaaccattgcgatccaccaagttcatcgagaagttcgtcaatggttgggatctaaaaatgatcttttatcatgattgcattcaaggcctgataatcgacacaaaatctccaggtgccattgtgtttttaacaagtaatactggcgaggagaacaggctagacgtgaaggaggaagctctgtgggaagtatgcaaatgtgaaataatgcactggttccgctcttatgcaccagacaacagagttggggtgatgtaa

SEQ ID NO: 88155 - DNA, 444 bp, Glycine max
  Peptide Sequence Number=SeqID_204933
atggagcgcaaagaaaagagggtcagggtagcgcgggtccctggactagaggttgtaacacatgccacaggtgcccatggagatggcgtcgctgacgccaacgatgttgaagcggaagggaaccacgtcagcagcggcaatgtcgtcacgcacgacctcgaagaggtgggggaggtccatgctagcgatggcaacgccgtcacgctgtcacacaacggtttccctcgtaccaaaccgaggagacgccgacctgtggcttggtcatgtcgtccttggagagaccaatgccgtagactcggccacaagtccgacagtgagaccgtccgatggctcctggagcacgccgagtcggctatcgttaaggccaccggcaccggtacagttccggccatcgcggtcttcgttggtggcatgctcaaaatcccaaccacctcatccaactag

SEQ ID NO: 88156 - DNA, 309 bp, Glycine max
  Peptide Sequence Number=SeqID_204934
atggcagcgcagtggtacgatggtactatcatttccatggtgaggctcaacagacctagcattatggtttatggcgggactataaaactgaatgtgcgagtgctactcatgaaccagttttgtactagggtggagatgactggcgttgtgttcaagtttgagaaggaggcgtcgtcggaggatgcatcgaaagaaaagaaaaggttgccagttgtggagattagaaggcattcattgagcatatcaagtcatcaggttccactatttctttggtccatccatagtttctttgttcttgcttcttgttaa

SEQ ID NO: 88157 - DNA, 186 bp, Glycine max
  Peptide Sequence Number=SeqID_204935
atggcaaataattctgaaattgtcgccgcacgggaggagggcattgaagtggagcttgaagtgttcactggcgaggacgacgatggaggcaacaacttagattgtgccctaggagacgcagaagttgttgttcttgaggagatccatacgcgtgtcaataagcgaggtgaccttggaagaggatag

SEQ ID NO: 88158 - DNA, 240 bp, Glycine max
  Peptide Sequence Number=SeqID_204936
atgatggtcagatggagaacatacagcttcaaggtagatggagaacaaagagagcaagaaagcttagatggagaagaagacagagagaaggacaagacaacgcgaaggagacgaaacatacctaggtatggtggcgaaggagaagaagcagagacttgtgacgatgctcgagtgcgacgaagacgatgctcgagtgcgacgaacacgatgctcagatgcacacagagacggtttcgctag

SEQ ID NO: 88159 - DNA, 816 bp, Glycine max
  Peptide Sequence Number=SeqID_204937
atggacatgaatgtgggagctctcatctctggtcagattacatctatggcccagtgtaactcttctagacttgggttccctgctcttatcatcgctttatgtaagtccaaaggggttgcttctggcagcttggtctttgaacgcctgagcctggtcattaacttggcctatatcaagaaaaactgttggaaccctgatgatatgacaattactatcagagaggccaggagagcgaggacaaggccagctgaggccccttccacatctacagctcctcctctagaacgtaccctagcagctccttccgcctcatctcctgcagattttcagcattttgaagccatgcttcaaagcatccatcaggggcagattatcttattacaaagtttacagatggtggcacctccagactctattcctttagtagagcagtttaatgagtgcgtagcctggcccggaactcagtcttctcttcatagggaagatgaaggtcccatagcccaggtaccacaacaaatggaggatgagtcatacgagactaccactccaaagcccttggtcataaggaagaaggcagatcaaacacaagaagttgtagccacttctgagaaatctcttgaggccacttctgagccttcaaaaccggtggtagatacagctttaattcagcaggcagcagacccttccactcctgaggatcagactacaccagtcctatctccgaacacctctcctacagctacccctgtgcttcacttaatagacgaggaggatgttcggacacaggatactcaggaccgatcacaggatttttaa

SEQ ID NO: 88160 - DNA, 237 bp, Glycine max
  Peptide Sequence Number=SeqID_204938
atggaagcaaaagcgcaaaaatggtggcctaggggcaaaaatctgcaaaacccgtgggtgttgcgttttcgaatgagggagaggagttttgagtggagagaaactccccctcccctcgtttttatgtttccaggctgcctcccagctgcgcttccctcttgtccggagctaggcatgggacgacgatccatcgatcatggtcctagcctctactcgcgtccgtccctaagtacctga

SEQ ID NO: 88161 - DNA, 354 bp, Glycine max
  Peptide Sequence Number=SeqID_204939
atgggtgaagcagaggaggtgcaagagaagatgaaggccgacatggaggccatgaaagagaaaatggccacaatgatggaggccatgatgagcgtgaagaagataatggaagccaatgcggttgcaattgccgctaccagcgttgttgctaaggtgaacctgatgtccccatccagcatcaaccaaatgaatcatccaacctcagatatggtaggcaaagatttgggaagtacggatgaccccttggaaaattcttttttgcaagaatcaactacttctttcattctcccttgctacaaggttgtgaaaacaagacgacgatggttacctcatagccctacactggggcaatga

SEQ ID NO: 88162 - DNA, 333 bp, Glycine max
  Peptide Sequence Number=SeqID_204940
atgatggtctccgcatgccatcagacttgcttgtctctggatagcaaaaagggtgcagatgaccataatgataaccataatttgtctctgcgtgctatcggactcgcttgtctctggatagcaaaggagggtgcaaatgatcataatggtctatgtgtgccatcggactcacttgtctctggatggcaaaggtgttcggatgaccataatttgtctccgcgtgccatcagactcgcttgtctctggatagcaaaggagggtgcggttgaccataatggtctttgcatgccatcagactcgcttgtctttggatggcaaaagagactacaatag

SEQ ID NO: 88163 - DNA, 414 bp, Glycine max
  Peptide Sequence Number=SeqID_204941
atgaccactctagctcagacatggagcgttctttccttctcgaacctcattcccacctcccatacatcttatgtgaccttggacagagccaagttgatttatgtgacatttagaaggccaaggaagggtaggggtaagagatcagaggcccctactacttcagcaccaccagagacactagctccttcttcttccacagctccattacctcccactcagactccagttattcctcctacatctacatctgtacttccaactcctatatctataggaccatcagattttatatttacaccacagatactgcactccatgctccagagcatccacagggggaagtccattatcatgcaaagccttcagggcttgggctttccatccatcatgagcatggatgagtatgaggcgtag

SEQ ID NO: 88164 - DNA, 546 bp, Glycine max
  Peptide Sequence Number=SeqID_204942
atggccgccagacttgcgcataaagaccatcactctgcgttcgcctgccgtgaggtactcctgcagggcaggtgcgagcgatcggtgcatcaacgcaatagcaggatggtcacgctccccgtcgtgtacccaaaccacgggtgctgtaccgcgaagccggaacagccgctcgacaagacaggacggaataaagggcgtatcgcaggggcagaagataaaccactcgccctgagactgttgcataacggaaagcataccggccagcggtcccggataatctttcaggttatccgggtaaacggcatacccgctgcgctgccagcctggcaaaaagagccagagcttaatctgatgcaattcttgcagaaactggcaaaagagtcaggttttgacggcgaactggcagacctttctgacgacatcctgatctaccacctcaaaatgcgcgattctgccaaagatgctgttattcctggtattcagaaggattatgaggaagattttaaaacggcgctgctgcgcgcccgtggcgtaattaaagagtaa

SEQ ID NO: 88165 - DNA, 121 bp, Glycine max
  Peptide Sequence Number=SeqID_204943
atgaggcttcactgttatcaagcgagtcagagacccaacatgaccacagatcgacctccactccttatggctcacatagacccgggtataggacctaatatctcaatatgcatgcaaagag

SEQ ID NO: 88166 - DNA, 464 bp, Glycine max
  Peptide Sequence Number=SeqID_204944
agggctgcaggcccctcgccttcagagggccacatgtcctcgccttcagagggcttcacgtcctcaccttcaacgggctacatgccttcgccatcagtgggctacacgccatcaccttcagaggactatatgcactcacctttagaggacgacatgtcctcaccttcagaggactatacgccctagccttgagaggattacacgtccttcactttagaggactacacctcctccccttcagaggactatgcgtcctcgccatcagaggactacaagtccttgccttcacagggctacatgtcctcacattcagaggactgcacgccttcccctttagagggccacatgtcctggccttcagagggctgcacgtcctcgccttcaacgggctacatgccctcgccttcagagggctacacgccctcaccttcagaggactatacgcactcgcctttagaggatga

SEQ ID NO: 88167 - DNA, 378 bp, Glycine max
  Peptide Sequence Number=SeqID_204945
atgtcctccacttcagaggactacagctcctccccttcagaggactacgagtcctcgccatttgaggactacaagtcctcgccttcagagggctacatgtcctcacattcagaggactacacgtcctcaacttcagagggctacacatcctcaccttcagaggactacacgtcctccccatcagagggttacacgccttcgccttcagagaactacacgtcctcctctccagagggttacacgtcctccccttcagaggactacactcctttgcctttagagggatacacgttatcgcctttggaggactacacatcctcaccttcagaggactacatgtcctcgcctttggaggactacacgtccttgccttcatag

SEQ ID NO: 88168 - DNA, 783 bp, Glycine max
  Peptide Sequence Number=SeqID_204946
atggctaagcgcattttggttgtggaagacgaagctcccatccgtgaaatgttatgtttcgtgctggaacaaaacgattaccagccgattgaggctgaggactatgacagcgcgattggcaagctgatcgaaccctggcccgatctgattctgctggactggatgttacccggcggcagcggcattcagttcatcaaacatttaaagcgtgaagccatgacgcgtgatattccggtgatgatgctgacggcgcgcggtgaagaggaagatcgcgtgcgcgggctggaagtgggcgccgatgattacatcaccaagccgttctcgcccaaagagctgatggcgcgcattaaagccgtgatgcgccgcatctcaccgatggcggtggaagaggtgattgagatgcaggggctgagcctcgatccctcctcgcatcgcgtgatgtccgaaaccacgccgctggaaatgggaccgaccgaatacaaactgctgcacttctttatgacgcatccggagcgcgtatacagccgcgaacagctgctgaatcacgtgtggggcactaacgtggtatcgtttctctgcccgctactaaacggagtcttttaccgtgctggaacgactctcctggaagagattactgaccgagctggcgctggtgtgtctgcctgcgctggtgctgggtctgctggttggctatctgccgtggtggctgttactggccgtgtgcggcgtgctgttctggcacttcaaaaatctgatgcggctgtcgcactggctgtggattga

SEQ ID NO: 88169 - DNA, 166 bp, Glycine max
  Peptide Sequence Number=SeqID_204947
gtgtatgcatgtgaaaacagaagagaatgtccatgaccttgaatggaggaaagagatacaaaagcagaaaaattgcataaaactggatgatgttgggctttcacataatagaggaagagagaatatatatatgtgtagggaacaaaacagctataaaggagcctaa

SEQ ID NO: 88170 - DNA, 204 bp, Glycine max
  Peptide Sequence Number=SeqID_204948
atgctaccatggcccgctggtatgttgccccagcattcttcagcccaaacgacatcaccttatagcggaagtgatatgaatgacaacataatggagaaggaagagagagaggagatgccacttcaaggagaagatgagtctagaagaagctcaccaccgtatgaggccatgaataagagcttggaggaagaaggagatgaatga

SEQ ID NO: 88171 - DNA, 339 bp, Glycine max
  Peptide Sequence Number=SeqID_204949
atgactctgaccttcggggtgcaacgatttagaatctcctttaagctcatgttgatcagatgtgttagagtatccgggcaaggccagaacaccctaaggagctgctggcagtgccatctcggtgagagtgatagtgtcgggttgcccattgtgtggcaattcatcgactacatggcctcccgggctacattcatagttgtcgcaacctacccttcgatgggagggcgacgcgagactcacaggtgcatcttccaaggaaggaaaatgcgcggagtcgccaccagcatttattcgaggaaaacatcgaaaaaatcagaacgtgcggtctacgaactttaa

SEQ ID NO: 88172 - DNA, 687 bp, Glycine max
  Peptide Sequence Number=SeqID_204950
atgaaagataagagggatgaagaagaaaaactagaaaaacaaaagaaaaagaaagatagtaagacattgtcttcaaaggccaaggggaaggaaaaagaggaaaatgattcctccaagaagattgttaagaaggaaaaccattttgcaacaaaaggtgatatcaaaagagcactccttcttaaacaaaccttctaccttctcctattaagggaaacatcccttagcactaccatacctcttgagcttgaggttattcctcaagtaaaggagttgttggataagggtttggttcgtaagagcttaaatccttgtgctttgttggtgcccaaaatagttattatgaggcaccaaatccctatgataggtgtttcaatacaaacttcggtgctcgtatgtgattgtcgcaacttacccttcgacgggaaggcgaggcgagactcgaaggtgagtcttccaagaaaggaaaatgtgcagaagtcgccaccaatgtttattcaaggaaaacgtcagaaaaaccaaaaagacgaaggtttgtggattttaaaaatgagggttcgggagttgtttacgcatagggaagagcgtggctcttgctcctatgtatcctcaagtgcgatgaggaactcagacctacgtagttctttcaaagtaagaaagttgcgggttgagttgcttttaaacttttga

SEQ ID NO: 88173 - DNA, 255 bp, Glycine max
  Peptide Sequence Number=SeqID_204951
atggagggtgttcctttaagaaagttgcaaagaaagagagtcatttttcaacaaaaagagatattaagagagctcttcttcttaagcaatatttctaccttctcctctcaagggagacttcacttagcactgtcacaattcccacacttgaggccattcccccaaagggaagaagaagacaaacacaagaattttatactggttcagcaacaactcgtgcctacatctaatctccaagcaacctgcggttcttga

SEQ ID NO: 88174 - DNA, 204 bp, Glycine max
  Peptide Sequence Number=SeqID_204952
atggctactaaatgcattcttgatgctcatctcttccattcatttgatacaccatctagagagagagagagagagagagagagagagagagagagtgagagtgagagcttggaagaatcaaaacaaagcgactctttcatggcaatggctggtgcccaaatgagtgagaaggggtctgcatatgggtcgggtttgacccgctag

SEQ ID NO: 88175 - DNA, 510 bp, Glycine max
  Peptide Sequence Number=SeqID_204953
atggagcagaatattattaaagctgtaagtgttttgaatcacagatttctttgcattgctttaaatacactcagaggtgtctcatgcaacattccatatataggtcctacacatgcagccaaaggagttgctttgaacatccaaacatcaaccaaggaggaaaacgattccaaggcttcccacaaaacaattgccaaggcaatttcacctaggcctgctgacagtaagccggagaatccggctaaaaaacataaacttgggaactactgcagtcttaaaggcgatgtaatggagatcctgagacagatgccgagtgtgactactactggagatggccccaatgggaagagaatagaagggtttctgtacaagtataggtctggtcaagtgtgtattgtttgtgtctgccatggtaactttctcaccccagctgagtttgtcatgcatgctgggggcaaggaagtggccaatccaatgaagcatatcactgttttatctaactcattttag

SEQ ID NO: 88176 - DNA, 498 bp, Glycine max
  Peptide Sequence Number=SeqID_204954
atgtttattggcccttgtggaaactctggacatggagttgagcaacttgatatcaaaattgtctttctccatggaatggagaaagacattttgatgaaacaatctgaaggttttgagatggaaggaaagaaaaactttgtttgtaggttgaaaaagtccctctattggttgaagcaatctccaaggcagtggtacaagagatttgttgagttcattgtctctcatgggtacatcaaaagtccctatgattcatgtgtttatcatagtaaggtggagggtggttctcaaatttatctattactctatatggacgatatgctcttagcatcccaaaacaagtatgaaattcaaaatctgaagtcactactcaatagtgaatttgagatgaaggatataagagttgctgaaaagattttgcgatcgagccctaaaaaagttcttcttatgttagaaggaatgaatgtgaaccaaacaagcaaccttggatgcattaaataa

SEQ ID NO: 88177 - DNA, 591 bp, Glycine max
  Peptide Sequence Number=SeqID_204955
atgccggaaaaaggacagcaacaaaataggcaactggaaaataagcggcaagttgaagacagtggccggaaaacatgccgaaaaaggcaggagcagaataggcgaccgaactccgatggagctgaaactgcagggattggtgtgcgagggaggtacgacaccggaggtggaggtgtgtcatcaacggcggcgacatgctctctcttacatgccagaaaacagatttgcgatagtgctgtttggttcgcaaagaatgggcgtgtgagggagtgtcaccagtctgatcaagatgccataaccatgtcttgtagatcggtggacgatgatgctggtggtggggtcacatgccagaaatgttgccggagctccggcgacggactgtggagaacagcagtggctgatggaaaagaggggaatcgccgaaaaaggggcagcaagcagaaaggtcaactgggaatgtggaaaacggtcaccagaagaaaagcgactagtggagagctccaccgaaatgcggaaaaaggccgtcagaaaagtgacagcagctggagtcactggagagggagaaagggtagtcagaaagtgccggaataa

SEQ ID NO: 88178 - DNA, 915 bp, Glycine max
  Peptide Sequence Number=SeqID_204956
atgcggggccgccataggctacaacagagtttgaatggtgatgcatttccaaataggccgcaatcacaggaagaggaaatctacaaggagatcccacctggacatggtaccactaatggaggaaataaggtttgcagattaatgaaggccttgtacggtctcaagaaaattccatgtgatgatgaggtcgaaaaacaaattttaagggagaagttcactactcagtttgagatgaaggacctcgagaaaaaggcatctttatttctcaaagaaaccgtgtgctggatctccttaaagaaacgggtaaggagggttgcaagacttctagagtactcagagaaaaaatacaagattgagaatgatgaagaaagccctaaggtagagaagacccaatatcaaaaacttgggggaaaatacatttatctatcacataccacgactgatttagcttatgcagttagtatggttagtaagttcatacatgacccatggcagcactttcaagttgtaaatagaattattcaaaaggtcacgccaagtggagaggcaaaatttagagtcgtgtctcaaggagtgcgtgagttgttatggatcaagattgttctcaatgacctaaagtatgtagctcttatgaaactattttgtgatactgataataagtttgacatcatcattgcacataacctagttcaacatgaaaggacaaagcatatagaagtagatcgacacttctttaaagaaaaattagacagtggttttacagatacaggtgtacgttccttcaagactccacctccagttagcagacgtattcaccaaaagacttcctatagagtggtttcaagatcctatttgcaagctaagaatgattggtattcattctccaacttgaggggagtgtgctgtacagtataa

SEQ ID NO: 88179 - DNA, 252 bp, Glycine max
  Peptide Sequence Number=SeqID_204957
atgccaagatggctgccaaacagcagtgtgtgcggtactacatgcatgtttgcaaagagaaggaatgtaactttggaaggacagaaaaagcttcaagataccgagacaacctctggtgagtcagaagtaaagtttcaggtgtccagggatacattgggtgctatgctgcgatcaatggcctatatccgtgagcagctttctcatgctgatgatgcacaatcagaacctctgtcgaaaaaacacaggaagtaa

SEQ ID NO: 88180 - DNA, 2535 bp, Glycine max
  Peptide Sequence Number=SeqID_204958
atggatgttcaagtgataaatgtggaagtaagtggtcatcaaactaaggcagatgatggcgatgcagaaccaagtgacggtgaagttaataatgctgaaaactatggatctcatgttgaggatgagatttctgagccacacatgggtatggaatttggctctgaagatgttgctaagaatttttataatgaatatgctagacacatgggttttagctctaaggttggcccatatggtcgctctaaagctgatggcgaaaatatgtatagggagtttgtgtgtggtggggaaggtttgaaaaaaagcccaaatgaaagttgcaatgcaatgattaggattgagctaaagggtcaaaataaatgggttgtaacaaaatttgtgaaggagcatagtcattacatggtgagttccagtaaggcacacagtcgtcggccaagtaagcatttttccagtgttggaaggacaatgcctgaaacatatcaaggagtgggtcttgttcccagtggtgtcatgtatgtatctatggatgggaatcgtgtttcaaatcagaatactcgtggggtgaagaatattcatactgctgctgctgaacgcagtcacttagttaaaaattccacattgatgaattattctgttaggccttgttctcaaaacaagacattggggagggatgctcataatctgctggagtattttaagaagatgcaggctgagaatcctggtttcttctatgcgatacaacttgatgaagagaatcgtatgtctaatgtcttttgggcagatgcaagatcaaggacagcatacagttattacggagacacagttcatctggacacaacatacaaggtaaatcaatatagagtgccatttgctccttttactggggtaaatcatcatggtcaaatggttttgtttggttgtgcactcattttggatgattctgaggcatcttttctgtggctcttgaagacatttctcacagcaatgaatgatcgccagcctatctctataactactgatcaagacagagccatgcagacagcagtttctcaagttttcccacaagctcgccattgtattagcaagtggcaaatcttgagagaaggccaagaaaagttggcccatgtctgtcttgcacatccaaattttcaggttgaactttataattgtattaacttgacagaaaccattgaggagtttgagtcatcttggaattttatcctcaataaatatgaactcaggggaaatgattggcttcagtcattgtataatgctcgtgctcaatgggttccggcatactttcgtgattcattttttgcagcaatatctcctactcaaggatttgatggttctttttttgatggttatgtcaaccaacagacgacgttgccattgttcttcaggcagtatgaaagagctttagagagctggatcgaaaaggaaatagaagctgattttgagacagttagcacaacaccagttttgaagacgccttcgccaatggagaaacaggctgctaatctttatacaagaaaaatattttcaaagtttcaagatgagcttgttgaaacttttgtttatactgcaaatagaattgaaggagatgggccaaatagcacatttagagttgcaaaatttgaggatgaccaaaaggcatacatggttacattaaaccattctgagttgaaagctaactgtagttgccaaatgtttgagtatgcaggcattctttgcaagcatattttaacagttttcactgtgacaaatgtacttacattaccaccccattacatcttaaaacggtggacacggaatgccaaaaacagtgctggattggatgaacatactggtgaatcacatgcacaggagtctttgacagcaaggtatggcaatctttgtaaggaagccatcagatatgctgaggaagggtcagtaactgtggaaacttataatgctgcaataagtggtcttagagaaggtgtaaaaaaggttgctaatgtgaaaaaaagtgttgccaaagttacgcctcctaataatcaggccagtgggactgcatatgatgacaggaaaactactccaactttggatacaactcctcttttatggccttggcaagatgaaataacaagaaggtttaatcttaatgatgctggtggtcctgttcaatcagttgctgatctaaacttgccacggatggccccagtctctcttcatcgagatgatggtccatctgaaaacgtggtagttcttccatgcctaaaatcaatgacatgggtaatggagaacaggaactcaactccagggaataaagtagctgttatcaatctgaagttgcaagattatagcagggctccatctgcagaatctgaggttaagtttcatctctccagagttactttagaaccaatgttgaagtctatggcttacatcagcgaacagctgtcaacaccagctaataaggttgctgtaataaatctcaagggaattaagcttgttaatcgtatttcaggaggctttggtggtattggacaatga

SEQ ID NO: 88181 - DNA, 1494 bp, Glycine max
  Peptide Sequence Number=SeqID_204959
atgacactccttttactcagctatttggtcacccacccacttattctaatcttcgtacctttggttgtgtatgctatgtgcatctttccccacaagaacggacaaagttcattgctcaatcagttgaatgtgcatttcttggttattctactcaccaaaaaaggatcaccatcatctaaaccattcttggtgtaccaacgtcataatcatgcgacttcaaatcctccatctgctcctagggcccctcagaatcactctctgactgttgatctagcaccactacgacgcaattcccgtgtttgtaaacccccagatatgcatggtttcatctctcctttatcattgacagccatgttatcctctattgctattccatcttcttataaacaggcaatggagcatgaccattggcataaagctattgaaacaaaacttctagcacttgaagaaaatcagacatggaatgttgttccatatcctccatcaattaaacctcttagcagtaagtttgtgttatctataaagcttcgttcggatggattcatagacagttataagactcgcttggttgttcttggaaataagcaagaatatggtcttaattatggtgagacctttgcacctgttgcaaaaatgactactgtacgcattgttcttgctcttgctgcctctcaatcttggctactataccaattagatgtcaaaaatgcatttctctatggtgacctcgaggaggaagtttacattaaacttcccaaggctatctatgcaactcaacagctgttgcattccaccttccacatgaaagaccttggccaactcacttacttccagggattagaagttcgctatcaaccagcaagccttttcttaaatcagcacaagtatattcaagatttggtctcaccaattcaagcactattgatacccccatggaagttagtgtcaaatacagtcgtgatgaaggttctcttcttgaggacccgactttatatcgcaggttcttcactccaacttcgagcctatggtgacgctaactgggctggatgtccggacacaagaaaatccactactagttggtgtatgtttctaggtgatgctctaatttcttggaaatccaagaaacaagactctgtctctaagtcgtccactgaatcggagtatcgtgacatgtttgttgcttgctctaagataatttggttgcatggcattcttatagaacttggttttacgcaagctcaaccaactccattacatgttgacaacaccattgccattaaaattgcatcaaatccagtttatcatgaacgcacaaagcacatagaagttgattgtcactcaatccacgaggcccacaaccgcaaagttatcattctacctcatgtctccacttctgtccagcttgcaaacatcttcaccaaatcattaactcgtcaacgccacgatttcctagttgacaaattgatgcttttagattcaccagcatcaatttga

SEQ ID NO: 88182 - DNA, 375 bp, Glycine max
  Peptide Sequence Number=SeqID_204960
atgattatgaggggccaagacatttatagtagccaagatgaggctactacttcaccttcctctagtgaaagtgaagaagcaaatggggaagaatctagtgaagaaatctacccccaagaagaaggacaaccattaatggttaaggaggagtgtaaggagacacttgttagcactgccacacctcttgggcttgaggttattcctcaagtaaaggagttgttggatgagggtttggtccgtaagagcttaaatccttgtgctttgttggtgcccaaaataggtattattggggctaaggttcagctcatccaggcgagtttcaaccgccccaaggggttagaaggttcagcattgagaggatttgagagaatttag

SEQ ID NO: 88183 - DNA, 258 bp, Glycine max
  Peptide Sequence Number=SeqID_204961
atggcacaatatccatgcttcatgggcattggtgaaggaaggcttgcgattgaggattgtgatggtaattctatacatgtttggtatcaaccatggctaaaaactatcgataatgattatgtgatatcaacttgcagcaatggcaataactttgatctcaaagtgggagaccttattgaccatgttacgtgtacttggaagcttaatgagatgaatgatgctcaacctattcaatccattccgcttctcaacattgag

SEQ ID NO: 88184 - DNA, 309 bp, Glycine max
  Peptide Sequence Number=SeqID_204962
atgcccggaagaaagaataagcgtgatgcaaagcgtgttaaggatgccactgacttaggtaatgcacttggcaaatccaaccacaaacagcacaagttgaactcagatcccactttgataaaagtgaaaggacttcggtctaagccaaccatgaccgtgcgatctaaatccaacggtacacatcacgcgtgtgtacttatgtctcatcgaatctgtgtgacacgcactcactctctctcacctctctctctctctccctcctctcgtctctgcaactcccggtggttgagaaaccctaaccaccgttga

SEQ ID NO: 88185 - DNA, 216 bp, Glycine max
  Peptide Sequence Number=SeqID_204963
atggataagagcttgaacgtaggagaagatgagtggagggagagggagtgggagaagataagagcttcaaggtgcaaagggaaagtaggggaagtggctctcaagattgacatcaacaaggcctttgatcgagttgagtggcaataccttttcagtgttttgacactcacgaaattccatgaaaaatggatatcctggatcaaaatgtgtctctaa

SEQ ID NO: 88186 - DNA, 369 bp, Glycine max
  Peptide Sequence Number=SeqID_204964
atgctgggaaaatcaacttttgggttgtccatgtggttgctcaagtggctgcccattcggtttgtggatcggttccttctcatagtgtcatggctcatgcttggtgacacggctcggttcggattggaccggccgaaattgggtccccttcagctcaaaaacctgtccggaaagacaccagtgctagatgtgggtacccttgccaagatcaaaagtggacatataaaggtacggcctggcatcaagcgcttaaaacgttatactgttgaatttgttgatggaaggacagagaattttgatgccctcatattggcaactggttacaaaagtaatgtgccctattggctaaagttgattgttgaaaattaa

SEQ ID NO: 88187 - DNA, 222 bp, Glycine max
  Peptide Sequence Number=SeqID_204965
atggcatatgtgcaggaagaggatatgttctctaaggaagatgggttccctacgaagccatttccaaatggatggaagggtgagaatgggctctatgcagttggtttcaccaagcgtggactacttggtgcatcaatggatgccaagagaatagctgaggatattgaaaggtttgactttctagagaacaagggaagcaaagtgactaagaaaagaagatga

SEQ ID NO: 88188 - DNA, 1953 bp, Glycine max
  Peptide Sequence Number=SeqID_204966
atggaatccataagtaacagtggatctagtgttgatatgagaactggtcctactacaaagtcaggtgaaggagaacaatttaacaaagaaaagaaacaagtaccctcctcttcacccttttcatcagagttgaaatcacaagatcactttgaccttatgccaaatgcaacaaccactacaactcatcctagacctctaggtgcaacctctcctacacatgacaaaacttactcacagtctgaattgcataacacacatttagtggcagaaaatggtgatggaaggccagttaacagccatgtggaagcacattcttctaacccttttggcgaagctaatccttctcccttagaaaacaacacagccccctctacatcgtcacaaaaccccttcatagagatgagtgatgccaccaccaacactaaacatgttggtgcatctgaatctgaaaaggagcatgaccatctacattcattgccttccatgcaacaagaaaaaggtggcatgcctaacaatagtgtaagtgcatttcccactgatggtatgctaggcccccattcatcattggcaccatccacaaatgaatcatcacaagggaatcccttcaaagcgccaccaacaagtgaaaccaataagaacacttttgttggttcagctgactcggtgaaagttgatgaacatcatgatcatggcaatgaatcacatcatagactaccatcaccggagcaaggtcattggagcgtgcctagtagcgaagcaaggacacatcctgctaacacacatggtgaaactcatgttccctcttcgagccaacaattagaccccttgttggaatcagcacaaaacaaacaccaagctgatgcaacttctaaggaccatgcaggttctactactatcccaacaagtgttgaaccccatcataccttttcagttacagagcaaggacatcacaacaaggacagtagcaattcagaaatagataacaagtcagactcatcagtttcatcattttccccagcttctgaatcttcaactcaagaccacatgcataattctgcaaatgcagtcactaaagcacctcaaaaaaggggaaaggatgttaggtttgcttcagaatcttgtaatgatgatatcccaattagctctttccaaaaacatggacaacaaactagtgatggtgaaggacaaaactcatcaacaggtgttgctcttggcacaagcaatggctcagaaaagcaaaatcctccactacagataatggagcgaccagaaaatcctacaacttcttcgaactataggtttccatcacatgtgtttgatagacacaaatcaaaatcaaacacccaatggagcactgcctctaatgaatcattgttcagcattcaaatgggaaatacaagtttctcgaatgacatgggttggagttggatgagcaaatctggtgaaatggatagacctggtgacgcgatctcgcctggcgtatttcctccaagcaatcagcccccactcccacctcaatccccaccccaacctcaacctcaacctccagctacaaaattcagtgatatcagccaaagcactgcaaaacaacataaaggttcaagagtgactgaactaaaagctgctgagacaatgagagaggttataatggaaaacagtataagtaaaggggatttgatacctgctggaggggcaacaccttccaatatgcgttctacttctaatgcccattctcacaaatcagatgggagcaccaaatcctttgcgtttaatgtattggcagatggagaaaaacctctttcggcaaagcatggtgaagagaagagaaagcagcagaaacagccagagcagcaggatattagaccagcaccagatgcagcacctcagaaccccaagccaatcccaaatgctcctcagaacaaatcatggttttcttgcttctcatgttgttaa

SEQ ID NO: 88189 - DNA, 262 bp, Glycine max
  Peptide Sequence Number=SeqID_204967
gccagacaactaccttaagggaataattaacagtgctttgaaaggacttaatgatactccacaacctaaatccaaggctgctactaggtggattgtcattaagtgtaatagacaaaaaggaaacattgagtgcgactattacatcatgcactggatgtccaccatcatcttaggaactttcaggaactgggaagcgatcattggagccagagagatgaaaggtgcttcacatccagtgggcacaatattatctccgacttag

SEQ ID NO: 88190 - DNA, 240 bp, Glycine max
  Peptide Sequence Number=SeqID_204968
atgaccactactacaaaagtgatgttttacgaccctgattctaaggcgcccaaccgcgtcaaccccaaaacctggcgggcatgtgccggcgccgctgtccacatggagcatgcctctccctcgcatcacctcagccctctcatccgcggcacgacggggaaagtgactgcggaggccgtggctagagcttctatagtacagactagcttgagctcagtgactggagttctctttcgctag

SEQ ID NO: 88191 - DNA, 2731 bp, Glycine max
  Peptide Sequence Number=SeqID_204969
atggtttttaaggatgacaagaaagtggagttaatgaaggagaatttgagaggagattgtcttcgtggtgatggtgacaagatgggaagtgtaaggaagaacactgtcgcgtcgggtaatagggaggacatggttaacacatatgaagagcctccagacccgggtgatcacaagtatgcgttggtacctagggctatccgagatatggaaactaatgtaaatgtgggaggccaacctgagatggtggaagaaacaatggaggtttgcacaatcattttggatgaccagtataagagggtggatctttggaacaatttaagggatatctgcagtttttcgaacaagccttggatgttgattggcgatttcaatgacaccatgctcccctcagagcaacgtgggagtgagtttgatcagaaccgtgctaccatatttgcgcagaatattgatgattgtcgactcttgaaagttggtggtctaaacgcgattcataagaagctagacagggttatgtgtgataataattggaggatgaattttccagaagctgttattgaagttcttcaaagggctcactcaaaccaccattcgctattgttgagatgtaggggagatagactgttcaagttcattgatgcctggtgcacacatgaggactacaagcatgtggttagtaatgcatggaataggtatgttgttgatatcctgacctcgttagatagcatgaagaaggactccattatctttaataaggaagtatttggaagtattttccgtcgcaaaaaggagctgcagtttagaattacaggtctggagaagtatctgaagactgtagattcgcagttctgtgtggatttcttcttgctctttacattctttgctgagatggaagaaaataaatctgtgatttccacctgtgagcaagatcaacatgtggttgctgctgctcagcacattttgaaggcactagcagcaagtaagactgtatctgaagacttgagaaaaaccctattggatcttgagacacaattgtcttcaatttccatagtcaatgagagaaaacgaacaggaatcaagcaatttgagaggcagcttaagtgtgttgaagacaaggtaatgaaatgggagacaaacccttcttccaatgagtcttgtgagtatttgaaagttgttggtgaaatccaaacactgatccagagtttggaaaacttttctgtgaatgaaaaggggaagcctaaggaacttctaaggagggccaatgaaattctgcaggttgctatgccaagccttgagaaagaactagtccacattcttgtccaacataagcaatactttgagcctgaatacatgtctttccattctaatagaatggatattgtttatgatgaatcgtttcgtttggtcgaggaagaacaaatcaacgaggcctcccgaagtagtagcggtgctagccgccaatctgaggccagcactattgatttggtgaatccaacagtgcttcaacatctcaagagcattgctagtttcatgtttggttcaaaataccatcaggagttctgtcaggtctttgttacatcgaggagggatgctttagctgagtatcttgtcattcttgagatggaaaagttaagaattgaggatgtgataaaactggagtggcattgcttgaacaacgagataaagaaatggattcgagccatgaagatcattgttcgggtgtacctcgtcagtgagaaacgattgtgtgagcaaatccttggtgattttggatccttttatcaatgctgcttttctgaaatttctcagagtttcatgctgcatctcttgaattttggtgaggccgtggcaatgggaacacacacaccagaaaaaatttttcggttacttgacatgtatgaggttttggagcatcttgctgtggatgtagatattttgttctttgaagaagttggttcttttgttaggggagagtttcacaagcttcgaaggagctttggtgaatctgttaagtctacatttgtagcattcagaaatgctattgcatccaaccactcaaagacaccttttcctcaagggggtgttcaccatgttaccaaatatgtcatgaattacatcatgacactaggtgaatatggtgacacccttaatctccttcttgttgatgaaagttcaattgatcctgcaggcaacaacaacaacaaacctgacttaccatgtctctcattgtgtccaacggcttgtcaatttcgctcaatcaccgcaactctagaatccaacttgagcaacaagtccaagttatacaaagacaaggccttgcaacatgttttcatgatgaacaacattcattacatggtgcaaaaagttaagtgttctggcctaagtcatttctttggcgatcgctggcttcgccagcacactgcgatgtaccagcgcgatgcacggtgttatgagatggtctcttggggatcattgctatccatgctcaaggaagatagtgtgtcaaattgtgtctcacggagaactcttgagaaaaagtgcaaagagttctgcactgcttttggtgaagtttacagggttcagacagagtggttcatctcagatcttctacttcgcgaggatctacaaatttcagtgtctcagaaagttgttcctgcataccgcacatacactgggaaaaactcatataacattgctgagaagtatatcaagtacagtgtagatgatctacaaa

SEQ ID NO: 88192 - DNA, 156 bp, Glycine max
  Peptide Sequence Number=SeqID_204970
atgtatgaaacagattggtctgcaacagtatctatagatgatttctatttgacagctgaaggtcagaataaactaagagaagctaatccgggaaatgctcttcttgaggattggatgcacggttcagagcgaaaagaagtagaggaaattgtttga

SEQ ID NO: 88193 - DNA, 216 bp, Glycine max
  Peptide Sequence Number=SeqID_204971
atgccaagaagggagaaaaacgatatgatcagccagaagttgttcacgattgagttcgaggaaggcaacaaactaggaccatgttgcttcttagatgaccgtgttatgcaaacccttagggcaccatgggtggaatttgttattgtgaagctcttggttagccatgaaggagcaactgaaatgggtgtggaactatcaggaggatacaatgtgtga

SEQ ID NO: 88194 - DNA, 345 bp, Glycine max
  Peptide Sequence Number=SeqID_204972
atggcccaaattaaaaatcacaaggaaagaaagatgaagaatgcaaaggcgaggtcatgtttgtttgctggtgtgtcacaaatgatattcaccagaatcatgactctcaaaacacccaaagcaatttgggattatctaaaggaggaatatgttggagatgacagaatacaaagcattgaagtgcttaatttaaggagggaatttgagctccaagggacaacaacctttaatcgaggtgttgcccttgctcctacatatcctcagataacttgtggagctaatgatcaattaaaactcactttacaagaagaaaatgagattgctgatgataggagaaggagatga

SEQ ID NO: 88195 - DNA, 2037 bp, Glycine max
  Peptide Sequence Number=SeqID_204973
atggatttatgggttgttgcagctgctgctggagctggttatttggctaaatattggaacaggatttcaaaaaatggcgatggctcgtgtcacatagctttggaggattcgtgttttgagaatcctgggccccctagctgctcctctccattcaccaaacaagcgcgaagagatgagttttgccatgatttttgttttgatggaagagctttaaaagggaagtcctcaactccgaacccaatggatggtcttttgacaggagaagtggcttctaccagagggattgatggcgaaaaattgcgacattttcggaattataacaagcatgatgtgctatctttatcaaatttagcaatgccattatcaccatatgatgatgttgatgatgttgatgatggaaatgagcaaagctctggctttgttggtgaccatggtttcctttttccagattcttctgctgaagtggttcctatcaacaactcttctggacataaaacctttctcaagatgaagcatttgtctgggcgtgctaatagacctttaagttcattggaaagttgctttatggctcagctgtacaaggagcatgccgaaacagaagaatatgtttttagttctctttcatcaccgtccactgccacgaggtcatttcttgtaagcaatggaagccaaataatcaacagagcaaataataatctgttcagcgtgccgattggaagcaaggaatataagttgcaaaaagaagctggtcaagtaaaggatgaaaatgtatttggggtttcttccttgccaaaaatcatatcagtaaatgatactaaggagacatttaatgcagtcattgggagaagtcgaagattgagctcttccgacaatgtatcaagtggaaaaatcatccgtactcaacaatttgataaaacatttctcttcagtcttgggatttctttcgggatgataacttccatcatggcaaataaaagagaaatagacaagttaagagagttgttgaagcagaatgaaaacttggttcaagatctacaagaggaactggaaatgaaagattcaatgactgtaaaggagttacagaatgaaaattatggttcactggatacattggatcattcttcatatgacaaggagctaaatgaattttcccctgaaaagcatgtggataactctccaagaattgactccaaagaatcatatcatcaaaaggtagaacaaagttcagagtccatgagcaaaattgaagctgagcttgaagctgaacttgagagattggggttggatatgaatgcatcaagcctagaaggaaaactatccgagcttgttgagcttgacccagagtttgtagcagatttttctcaaggtgagttgcgagctgacatggtcagtgggaaagattctctccatccaaaatcaaatgaggatgctggtgatgcaacacctctccctgccaactatgcagttttgcctcatgaactgagtttgcgtttgcatgaagttatacaatcccaacttgagcaacgcgtgaaagaacttgagattgcccttgaaaatagccagaggaaagtacagcttttcgaatcaaagcaagagagttatcttcaaaaggcatcttcctttagtaaagaaaatgatgattgtgaccttatgtcccagcccttaatcctcaatttatcaggtgaagctctagatgcatacaatgaagcctacgaagaactaataaagataaatgactctgaagaaaattcaccattaggcatccatgatagtagtgaccaccaggaagattcacatgcaaatgattggcatgcattaggggttcaacatggtggagcaaatggttctagtaaggtaacaatgatggaagggagcatttatgaattagatggtactgcagatgaaacttgtggttttgatgatactgaggtggaacagcaattgattaggcaaattgttgaaaggaccaagaaaggttctcctgtttttaaaaatgcacaaaggatattatattctgtgtatgaagatgaacaatga

SEQ ID NO: 88196 - DNA, 1971 bp, Glycine max
  Peptide Sequence Number=SeqID_204974
atggctttctttggtagagtcgggaatatactgagacaagcaacgaatcagaagatcggtttggagatacgttctttgtcatctgttttccaggctacacggtgcatgtcaaatgctccaaattcaaggctgtttataggaggtgtttcgtattctattgacgcgcaaagtttgggggaaatttgttcacaatatggccaagttgttgatgcaaggataattatggatcgtgaaactggtaggcacagaggatttggttttatcacttacagtaatgttgatgaggcatcgcgtgcccttcaagccttggatggacaggatcttgacggtcgtcgggttgaggtaaaatttgcaattgaaagatcccatggatttggtggtggcggctttggtggatcttatggcaatactccctatgatgctggagctggcactgggcatccaggtagttatggcaacactccatatggtgctgcaagtggtgggtatgacaatactggtggtggcaatgctgctggagtttatggcaggggtgaagatggtggaggtggcaattggccgagtggtaattttggggtaagcagctttggtaataactatggcgatgctggtgtctatgctggcaattctgctggaggttatgacaacaatggatatggtggaggatctggcggtgacgcgggtccctatggtagcaatgctgctagagattatgacaacggcgttggaggatcaggtagcagttttggggacagaagctctggcaagaactatggtgatgccggtgccttcagagccaatgctgccagtgaatatggtggaggatcaggtggcagttttggggacagcagctctgtcaacaactatggtgctggtggtggttataatggaaccggaacgagttacaggaatgctggtagctttgcaaccagtaacccttacaacgatggaccaggtgctgccggatttggcaagaataataattatgacagttctgcaggatttggtagtggcagtaggtatggtagtgctgctgctgctggaggaaggcagagttttgccggtagtcagcaccctggaagtgccatggcgaatgccagtgacggtacagatactggaaatggctttgctggtggaagttatgggaatgctggtagctttgcaaccagtaaaacatacaatgatggaacaggtgctgctggatttggcaagaataataagtatgacagttctgcaggatttggtagcagcagtaggtatgatagtgctgcctctgttggcagccagagttttgccggtaaacagcaccctggaatggtgaatggcagtgatggtacaggtactggaaatggctttgctggtggaagttatgggaatgctggtagctatgcaaccagtaacactgacaaggatggaacaggtgctgccggatttggcaagaataataattatgacagttctgctggatttggtagtggcagtaggtatggtagtgctgctgctggtggaaggcagtgttttgccggtagtcagcaccctggaattgccatggcgaatgccagtgatggtacagatactggaaatggctttgctggtggaagttatgggaatgctggtagctttgcaacatgtaacagttacaacgatggaacaggtactgctggatttggcaagagtaataagtatgacagttctgcaggatttggtagcagcagtaggtatggtagtgctgctgctgttggcagccagagttttgccagtagtcagcaccctggaagtgccatggcgaatgccagtaatggtacaggtaccggaaatgactttgctgatagatatcatggcagcggtggccaattcggtagcaatcaaagcagcaatgtgggtcaacatggtcgagattttggaggctcgttcgacgaagatttcaggatcggcaattatgaaaatgatgcctttgctggacgggcatga

SEQ ID NO: 88197 - DNA, 264 bp, Glycine max
  Peptide Sequence Number=SeqID_204975
atgtacactctcattttttgctcactcacacaaccagtactccgaagccaatcgctgaatctgcccaatcacatgttgctcgttcggcatgttcagtatgggtaccggaaaatgaatgaagggtcattttgggagatggttaatgccacaccaacttgggtgccaataggtgctaggtccatgatcagatttgctcataatcaaggaaaagagttaggaaggatgagatggcgaagcctcaactacaaccacgcattcggctaa

SEQ ID NO: 88198 - DNA, 560 bp, Glycine max
  Peptide Sequence Number=SeqID_204976
atggctccgaagaagcttttcgctaagagagctaggaaggccactgcagggaaagaatctagtgtagccccgcaagcgaaaattgagtttgatgggcaccgcttccaaagcgaggagcatcagcaccgctttgaggtgattaaggattggtctttccttaaagaaagacgggtccaactagcagagggagagaatgcgaaatttcgagccgaagttgctaggaggcgtcatacacagttgacagagcccatggcaaaatatgatctggaagtagtcatggagttttacgcaaatgccaggcccactgaagaaggagtcatggacaagcactcctgggtgtggggccaatggatcccatatgacacagatgccatcaaccaattcttggggcaaccccaattctcaggtgtcgcaacctacccttcggcgggagggcgacgcgtgactcgtgggatgcgtgttccacgaaaggaatacgcgcggagtcgccaccaacgtttatttgaggaaaacgtcggaaaaaccggaaaagacgcgatctacgaacttttaagtgaaag

SEQ ID NO: 88199 - DNA, 279 bp, Glycine max
  Peptide Sequence Number=SeqID_204977
atgaatggggcagttgaggctgccaataagaacatcaagaagatcgttcagaagatgatcacttctgtacgcacatctgttggggcgaccccattctctttggtgtacgggatggaagttgcgctcctatttgaggtggagattccttctttaagaatcctagcaaagtcgggattggatgaagctttctcaggaggagcgttgttgctcatgaacatggatgatgaagagctgcctttgcctatgaattccgacattgtcaagcgatattacacgtaa

SEQ ID NO: 88200 - DNA, 141 bp, Glycine max
  Peptide Sequence Number=SeqID_204978
atggagatacccaagcggttatccatacaaacgatttctgttaaccttgacccgggaagtcaggtggcaggccaggagacggcaagtccggtgaaatacggtgatacccaagcggttatccgtacaaatgatttctgttaa

SEQ ID NO: 88201 - DNA, 195 bp, Glycine max
  Peptide Sequence Number=SeqID_204979
atgccagaaatcccaatgccctgttggacttctctaggtccactgggtgtctcggaggttagagttatggtcactatgaaggatgttactgagcaggagtgtcgtccagatttgagtcagagtggtcatgctagtgcgcatgatctgcactcgcctcccatctacgcttcgtgcaaaatatgtcccagggaataa

SEQ ID NO: 88202 - DNA, 306 bp, Glycine max
  Peptide Sequence Number=SeqID_204980
atggagcttaaggcatgtttggataatcgtgttactgggtcggtgttgttgttgttgtctatggctaaaatcaaagaacctagagccaatggttggatttatgatgcatgtcccaaatttaacaagaaggttgatggagaggttttgcctattttttgtgttggctatggaaatgaaaatgcaagtacaataccaaaccattttgtttctcagatatctcaagatgaggcattaatcagttctattgttgctaagcttcctacctttgaccttcagataaggttgactgagttattggctatttaa

SEQ ID NO: 88203 - DNA, 984 bp, Glycine max
  Peptide Sequence Number=SeqID_204981
atgacagtgattttcctttttgttttccagtttgattttgttctgttgttcggcttggctatgagaagaaaagtttcttttggagtttacttttgctccgttgctgggtttgactatgagaagaaaagaatgtcgttggctgttgttgtgtcattttcgtttgtttcattttcaagtttcagagcaaaattgtttctttgtttgcttctggatttcaaggttgttaactttggtttccagtggttgaggtggctttgcgattataaagttatggcatgtgttgctgataaaattaagttgatagatggatcaagggaagcttttaagctttctgtaaggatcactgatctttggttcattaggattcccgaaaagtctgaacaagtcgaaatggtggttgttgattctgatggagatgaaatccatgttgtttgcaaacaggatcagttgaagtctcgcaaggctaatttgaaagaaaatttaacttatgtgatgcataattttaaagttatgaagaatgatgggaaattcagagtttgtgatcatgaatataaattatgttttactggagttactgttgttaggcaatctgatatggaacacttactttttaggaaattcagatttgttgatttttccagtgtcattgctgatgttattggcgtggttgatgaagtggtatttcgatatgtgtcatcgaaaaatacgagggttgttttgaaattaaaggatttgagtggacaggtgctatcctgcacactctgggaaaattactgcttacagtttttgtcttatttgaatgacattgaagatgaaagactggtcgttattcttttgacatatgccaggattaaggaagcacagggatcatatctgctgtcggtcagtaattctttcaaggcgtttaaactcatgatcaacaaccttgtgttggaaattcaagaatttagagagaggtattttggcaatgtgttacttatgtga

SEQ ID NO: 88204 - DNA, 1158 bp, Glycine max
  Peptide Sequence Number=SeqID_204982
atgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggggtggcttgttttggttttggcgcatttcatgtaacaggattgtatggtcctggaatatgggtgtccgatccttatggactaactggaaggatacaatccgtaaatcccgcgtggggcgtggaaggtcttttccatcttagtgtgcgtccaccccaacgtctatataaaggattacggatgggaaatattgaaactgtcctttccagcagtattgctgctgtcttttttgcagcttttgtcgttgctggaactatgtgggatacttttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacag

SEQ ID NO: 88205 - DNA, 168 bp, Glycine max
  Peptide Sequence Number=SeqID_204983
caatctatgtctgttaccgctgatcatgactgttcaatgcttaactcaagtgagcctacagagcttgaatctcaatctgtgtctgttacaggagattatgaccctcttctcaggattccattgacaccaactaagcgcgtatcttctgatgagttggatgatgagtga

SEQ ID NO: 88206 - DNA, 408 bp, Glycine max
  Peptide Sequence Number=SeqID_204984
atggggaatgaagatttggctatgctggagaatttgtcgtgggatgctacacaaaagactcaaaaggaccatgatgggatcgtgattcctattagtgatgaaaacccatggaaaaacaggttgctagtcaaggtgctaggtgcatgggtgaatttccgcataattgaggcaaaacttcaacgaagctggacaaagaatgacaccattcagattattgatgtgcaagatggggccatggatggtagcaaacattactcgatagtccaaagatggaggccgttcttcttaatgcaagcggaggagacaaagaaggtagctgtatggattcgtatacccaggctaccaattgaactatacaatgataccttgagggtttggcatgtcacttggagattttttgaagattga

SEQ ID NO: 88207 - DNA, 150 bp, Glycine max
  Peptide Sequence Number=SeqID_204985
atgactctattttgcacacgacttcctatcgaatcaaagatcaaacgtggggtgggatatcgccagtcgagaacgaccttgaatggcaatctgaaggggagagacaccaaaaatgggttttcctttgccggcagtcccttaccttgctga

SEQ ID NO: 88208 - DNA, 366 bp, Glycine max
  Peptide Sequence Number=SeqID_204986
tctaatcttggatgagtgtgcttatgaagctctagggctagagtaccaaggagtcaattgtggcgtatcacacaagagggttcttgagagaggtggagtcagagaggggtgccaaacaagttcttttatcaccgaaccacaagtctatggaagagaagaagataatgatgaaattatggactttttggttggggatgcttctcattctgagcatttattagtttatgcgattgtggaagattttagggtgaagaaaatgacaaaagctatcattgaagcagtgtctgggtgtgcttatgatgtgtgggatgatgagcaagataattggcaaaaggttgaaaattgtattgacttgtggagcaaaag

SEQ ID NO: 88209 - DNA, 619 bp, Glycine max
  Peptide Sequence Number=SeqID_204987
atggccagggacagattggtagatagtcaactagataatgtaaaattgaaattgatagctgcacgtgaaaaagatggtcgtacatacaatctcccaaatgtttctgaagttgctgccctgattgttggtgattttgatccagactcaagaagggatattattgttgaaactcaaaatggagaattacaaagaattcatgaattaaactctagctatctaggactccagtaccctttactcttcccttatggtgaagatggatatagacctgatatacttcactattctacatctagcagcagaaaaaggaagagaaatcgtctaacgatgagagagtggtttgcttatagactgcagtccaggtcaaatgaagcacaaactttgttgcattctagaaaactattccaacaattcatcgttgaagcatacaccatggttgagtctgaaagacttagctacatcaggaacaaccaaaaaaaacttagagttgacaagtattgtagtttacaaacatcattggatgttggaagcagtaaaggcttatctaaagggaaaagagtgattttgccttcaaactttgttggcagtccacgctatatggaccaactttactttgatg

SEQ ID NO: 88210 - DNA, 255 bp, Glycine max
  Peptide Sequence Number=SeqID_204988
atggggggtgcagatagcaaatttcaaattttgatttgggccttccagactgtttttcgaagcaggattgcatctggagaaagcagcccagctcgcctgggcgagctgggcggcaacctcctccctctttttcctataaaaaggcaaaagggggctgttctaagggtccctgatcccgctggctatgcatttcagttgttttgggtgaaaataattgtttccgtgaagaaaatccaagccgaggtgcttccgtaa

SEQ ID NO: 88211 - DNA, 1899 bp, Glycine max
  Peptide Sequence Number=SeqID_204989
atggagaaggagaatgtcaaagttctgatagaatatatgactatgatgtacccattgtctgagaaaaagagttcagggttttatgttcctcgtgacgaggcatttgctagtataaagcagacacagttcacaagttctgcggtgtccttagggctgaatgcgatttttgaatcggtggacacaattctcacagacccaaatcttggatttttcagcttcgaagacatagacacactcttcaaggaggggttgcatttaccaccacttaaggccaacggattatcgttgctccaaagagtcattcccaagttgatcaaggctgctaatgatactcagaatattttacgctttgatgccccagaaacatttaaaagggataagttcttttggttttcagatgtggaatttgctagggagactttggcaggtgtcaacccatatagcatccaattggttaaggaatggcctttaacaagtaaactagacccgcaaatctatggtccacaggaatcaacaataactagggaagtcattgagccacaaattatcacttatggaacaattgaagaggcccttaaagaaaagaagttgttcatgctggattaccatgatttattcttaccatatgtaagcaaagtgagaaaaattaagggcaccacattatatggatcacgaacattattcttcctcactgatcaagggatattaaagccattagctattgagctcactagaccacctatggatggaaatccacaatggaaacaagtcttccaaccttcttgtgattcaaccaatctctggctttggaggcttgctaaagctcatgttctggcccatgattctggttatcatgaacttataagtcattggttgaggactcactgtgtcgtggaaccttttgtaattgcaacacataggcaacttagttccatgcatccaatttatagattattacatcctcatttgagatataccatgcagattaattcccttgcacgtgaggcacttattagtgcaaatggggtcattgaaatttcattccttactaataaatattcaatggaattaagctctgtggcatacgatcaactttggcaatttgattcgcaagcacttcccaatgatcttatttccaggggaatggctgtggcagatcctaatgcaccacatggcctaaagctaacaattgaagattatccttttgccaatgatggtcttctcatatgggatgccatcaaacaatgggtcaccgactatgtcaaccattactatccaaccccaagcatcatagaatctgaccaagagctccaagcatggtggaaagaaatcaaaacagtgggtcatggagacaaatctgaagaaccatggtggccaaatcttaacacatcaaaagatcttattgacatcataaccacaatagcttgggtagcatctggtcatcatgcagctgtgaacttttctcaatatgcttatggaggctatttccctaaccgacccacaattgcaagaaacaaaatgccaacagaagacccttctgaagaagaatggggaaattttctaaacaaacctgagcaaactcttttggagtgtttcccatcacaaattcaagcaacattagtgatggtagtcttgaacttattgtcagatcattcacttgatgaacagtacattgggaaatacatggagccatcatgggctgagaatccaactataaaggtagcctttgaaaggtttaataggagattgaaggagattgaaggtattatagactcaaggaatggaaatagtaatttgaagaacagacatggagctggaataatgccttatgagttattgaagccattttcagggcctggagtcactggaaaaggggttccatatagcatatctatttaa

SEQ ID NO: 88212 - DNA, 708 bp, Glycine max
  Peptide Sequence Number=SeqID_204990
atgaaccgcacatctttaacagcatcaagtgaaatgaaaaatcccatgatcggaccgccattgatcattcagtttatcgctgccttcaacaacgacaaaaataccatacagcttccagcgttctaccatacacaatgggcaccacagtatcccgagtttgttcatatgagatacaatggagccatctacgaaatacgggtcagacaacacaaagaaaaagtgtatttagcagatggactcgaaaacttcaggaaagatttgaaaatctacgagtcaaccaccatcaacttttttgcctgtgaccatcactttgtatttgacatacatttcataccaccactggagcggcaaacttgtggcaggcagaggcattcatccagaaagcatatctggactcttcgacttactcagcaaatgctggattctcctgaacccctgaaacgcccccgttgtacagaagttcctcttaaagcttgcggtaatcacatgacactcttaaggcgacatggccccccattgcaatggaaagttgaaaccctgaatcctgctattggtggaaaaggcgttctccaaccatggtacgattttcttgaagaaatgaactttgataatggagatgaaatctctatttactatagatattatgaaaaaaattgggatattataattaggaagcaggaggattgggaggatagtgacaacaactag

SEQ ID NO: 88213 - DNA, 891 bp, Glycine max
  Peptide Sequence Number=SeqID_204991
atggcaaacttggcaacctcactctcattcatcatcttggcactgttggcactagcaaggggttcaaatgctggcagcattgcaatctactggggccagaatggcaatgaaggcacactagcagagacatgtgccacagggaactatgaatatgctattttggcctttttgccaacatttggcaatggccaaactccaatgataaaccttgctggccattgtgatccctatagtaatggttgcaccaagttgagctctgacatcaaatcttgccaagccaaagggataaaagttttgttgtctttgggaggaggtgctggtagctactcccttgcatcccctcaggatgcaaggcaagtggctacttacctttggaacaatttcttggggggaagctctccttctcgccctcttggacccgctgttcttgacggcattgactttgacatcgaaggaggatcaaacttgtattgggatgatcttgcaaggtacctcaaagggtacatcaacaagggaagaaaagtgtacttgactgcagcccctcaatgcccttttcctgattcttggataggcaatgccctcaagacaggtctttttgacaatgtttgggtccaattctacaacaaccctccttgccaatactctagtgaagttaccaaccttgaagatgcatggaagcagtggacttcagatattccagccaacaagatcttcttggggctaccagcttcccctgaggctgcaggcagtggattcattgatgtgaatgatcttacttccaaagtgcttccagcaattaagggctcttccaaatatgggggtgttatgctgtggtctaggtactatgatgaccagagtggatacagttcctccatcaagaaccatgtctaa

SEQ ID NO: 88214 - DNA, 1576 bp, Glycine max
  Peptide Sequence Number=SeqID_204992
tccctgaaatgtatgggcctgtggccacttcagattcagccacatcccgggctggattgccaaatgatagtgtggactctgttgttactttggatcaagttccgaggtggattgatgctgatcattccttagtgtatgacaatggagacacatcattttccagtccatacttccctgatcccttgacgttcaagtcggggttggagagtggtggcggtgtgtcaaggtttcctgttgaccatgaagtgaattcgaagatatacttgtggagggggaacccctggaaccttgaggtggatgctgtggtaaattcaacaaatgaggtcttggatgaagcacacagcagccctggattgcatgctgcagctggacctggtcttgcagaagaatgtgcaactttgggtggatgtcgaacaggcatggctaaaattaccaatgcctacgaccttcctgcaaggaaagttatccatactgttggcccaaagtatgcttcgaagtaccaaactgctgcagagaatgccttaagccattgctatcgttcttgcctagaacttttaattgatcatgggcttaaaagcattgctatgggatgtatttatactgaggtaaagaactatccccgtgagccagctgcgcatgtagctataagaactgtgcggcggtttcttgagaagcagaaagacaatataacagctgttgtcttttgcactaccagcacaactgatactgagatatataaaaggttgcttccactctacttccctcgggataaacaagaggaggagatggctttgtcaaagcttcctgcagatgtcggagatgagaatggtgagactgtcatagatgagcgtaaaatcagaataaagcctttgcctaaaaaaaaggtttcaaaagaatcaaaacctgctgaagctcctgttgatcttcctgttagtgatgttggttcagttcgcagggttcgaatccggaaacagcctctttgcatatgcaagggtaaggctgcgtacaatatccctcccccataccttcgcatagcgaagagcctctgggcaatgggggcgagccctggtgcagcggtaaagttgtgtcttggtgacttgttggtcatgggttcgaatccggaaacagcctctttgcatatgcaagggacttcatcatatttagatacatatctggatcctgccttcatgtctttgattaaagaccctgatgaaagacgtctagagcagtgggagaaaactgttcaagcacaaagaggctggaattttgctaacttgcttggatttggtgacttaggtggacctccattgtctgccgctgaagaatattctgtgcactctagatatctttcaaaagcaaaatccttaaatttgtctgaaattgcagagatgaaagttgtctatcgtggaggggtagacattgagggtcgtcctgtcatggttgttgtgggggctcactttttgcttagatgtcttgatctggagcgatttgtgctttatgtggtgaaggagtttgagcctataatgcagaagccttatactattgtatactttcactctgcttcatctttgcagat

SEQ ID NO: 88215 - DNA, 351 bp, Glycine max
  Peptide Sequence Number=SeqID_204993
atgccgatctccccctatggaagtatcagttggtctgtgtcgttcagacatagggatcgtgcctacaagacacccagtggacctggagaagtccaacagggccctggggtttccagctctagttacgggcctatggatcacgcccgcaagacaccctgtggacccggagaagtccaacagggtcctggggtttccagctctggttacgggcctctggatcgcgcccgcaagacacccagtggacccgaagaagtccaacagggtcctaaggtttccagctccgattacgggcctctgtcagttctacggagtgcccgtcgcccccaacaagttcatcaggccccctattaa

SEQ ID NO: 88216 - DNA, 144 bp, Glycine max
  Peptide Sequence Number=SeqID_204994
atgaggatgcgtagccctctaaaggcgagggcgtgcagccctctgaagttgaggacgtgtcgccctttgaagatgagggcgtgcaaccctctgaaggtgaggacgtgcagtcctctaaaggtgaggacgtatagtcctctgaag

SEQ ID NO: 88217 - DNA, 971 bp, Glycine max
  Peptide Sequence Number=SeqID_204995
gactacacgtcctcaccatcagagggctgcacgccctcacctccagaggactacatgtcctcgccttgagagggctacacgccctcaccttgggactacacgtcctcaccatcagagggctgcacgccctcacctccagaggacagcatgtcctcaccttcgtagggctacacgccctcgccatcagaggactgcatgtcctcaccttcgtagggctacacgccctaacctttggagggctacacgctctcgccatcagaggactgcatgtcctcgccttcagagggctacaagccctcaccttgagaggactacacgtcctcgccaacagagggctgcacgccctcaccttgagaggattacacgtcctcgccatcagagggctgcacgccctcacctccaaaggactacacatcctcgccttgaaagggctgcacgccctcacctttagagggctacgtgtcctcattttcagtgtgctccacatccacaccttaagagaatttaaggtcctctgcccttatatgcttaaccgagacttgcactcccgggccaactgtgcgagcacaaccagagagggaggctattacactgctactatgcataccgggctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 88218 - DNA, 501 bp, Glycine max
  Peptide Sequence Number=SeqID_204996
atggaaatcgaagaagatgctgagatcccattgatcttgggacgtctgttcatgctggccgcaagctgtgtggagtttaaggaaaaggttctgaagatggcttctaggaaaaggaaagcctcaacttccaggccccagcctcactatgatactcacagattcacctctgtggacgcctggaaccgctacgctgacaacattcttggccagaacatccttctgaaaaggaaagtgaagctttttgtcacagagtttgatgagttcaggacagagctagtaagaagaaactggcacaggacgctgattaacctcatggaggggagcatagatgtggctctcgtgaaggaattttatgctaatctttatgacccggaggataagtctccaaagcaaccaggggagacccttcctgcttactccaggttctacaaactgagaccagaccctcaggagctggctgcccgactttgtatccctagtgggatttattctgaatgctga

SEQ ID NO: 88219 - DNA, 258 bp, Glycine max
  Peptide Sequence Number=SeqID_204997
atggcggaaaatcttcacggaatcacccatggaaatgttttggacgcgttacggaagtgcctcggtgtggattttcttcacggaaacgattttttttcactaatttcaagtgatcctcagatactaggagggttgaatgaaaatgagggaggagcttgccacccagctcgcccaggcgtgcgaggttgcttccttcagaaggcacatcctggaaggcccaagtgggcctggttgctatttgcaccccctatttactaa

SEQ ID NO: 88220 - DNA, 769 bp, Glycine max
  Peptide Sequence Number=SeqID_204998
cttgtcgaagaagatttcgcccttctgcttggggctggccaggttgaagggctggcccgcgatgtcgtaggcctcctgctccagctgcacgatgcgctggcccaggtcgttgctctgcttggccagcgtggcggcatcgatgagcacgccgttgcgctctatgcggaacagggcctcgctggtggcgatctccagctcgtagacgccgcgcaggccgtcgttggcctgcagctgcggccacagtacgcggtgcacgtccagggtctggtcggcatcctcgcaggcataggcggcagccttgtccacgggcacctgggcgaacgggatctggtgggcgcccttgccgcacaggtcttcatagctgatgcccgtgcggttggtgtggcgcagcgccaggctggccaggccgtgcgggcggtgcacttccagcacatagctttgcagcatggtgtcgtgcacatagccgtgcacctcgatgccggcattggcgaagacatggcggtcgtacttgacgtgctggcccagcttgggccgggccgcatcctccagccagggcttgaggcgctgcagcacttcgtcggcaggcagttgctctggcgcgtcggggccggcatggcgcagggggatgtaggcagcggcgccgggctccacgctcagcgagatgcccacgatctcggcacgcatctcgtccagcgaggtggtttcggtatccagggccgtgagttcggcggcgttgatcttgggcagccactggtcgaacgcttcccag

SEQ ID NO: 88221 - DNA, 366 bp, Glycine max
  Peptide Sequence Number=SeqID_204999
atggttaaaccaagcagccccgcaaacttggcatcagccatcatttgtttctttgcctcaaagaagttcccccatagactaaaagcatcaccgggaagggttggaagggaaacccttcaccacacccttccgtcatgggccatggtccatgggatttttcaaagcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgcatga

SEQ ID NO: 88222 - DNA, 207 bp, Glycine max
  Peptide Sequence Number=SeqID_205000
atgagcctctgtcaattttacggagtgcctgtcacccccaacaaggtcattaggccccgcattaaccgggctttcatcaagaagtactgcgcccccaagcaggcacagggcgagacaccacaacagcattgggatggctggcagcaggcaacaggcgcaccaccaccacctctagagttcacctcagctcatccacaaaaaaggtag

SEQ ID NO: 88223 - DNA, 189 bp, Glycine max
  Peptide Sequence Number=SeqID_205001
atggtgggtgtttgtcatcataaagcgaggattagcggaagcgtgatggttgaagcgcaaccacgtgtgggaggatcccgatcaatctatgatgcatttgtttctttctttatgaaaggaggtatagccagagtactctcacagatgcagaggcagaagaaagagatctttccaccaatcaaaaagtga

SEQ ID NO: 88224 - DNA, 3027 bp, Glycine max
  Peptide Sequence Number=SeqID_205002
atgtgtttcaagcaggtctatgaacttcaccgtttgtacagaatacaaagggatttgatgaatgaggttaaaaggaaagaattacacagaaaccagatacctgttgaggcgtcattttctgtaggtcacatgacatctcagttaacgacagaagacggacaaaaatggcatatttctggctttcctgtaggaaattctacttgtgctaaaacatctgtgtcgggagttgagggcattcattctcctttggattctatgaaagcgatcggccaacaaactagtccatttccatccccaaatgggtgtagtagttcaaaagatgttgaggtgcttgagtctagacccttgaaggtgaggagaaaaatgtttgacctacatctccctgctgatgagtacattgatactgaggaaagtgaaaaactcagcgatgaaaagacaagtgatccatcattctttcttcctgatagaaactgtaaaactggaaaggagggtgatgcaaaacttttttgcggcaatggtgagaagactggttgccaggaggacacttcaagatctgagcagtctttaaggagaagaaatggtttggctgacttaaatgaacctgttccggtggaagaaacatataattctccatatgttcacctactgaatcgtaatccctgtcaaggggcaactgaatgctctgatatctctgctgatgctgccaaacaaaagtcagacttttttgctctgtctagggagcaattgctcaactctcatcatggaactgaaagttggactcgaagtaatgaatatttggagagcaatgggggtggaaaagggtggtatcaatcagtggctgagtcagggcaagctaaaagcaacacgcaccctgttccacaactcctcaaatcagtatcttcccagacaatacaagatgcacttagcaaagttcgtgaacctgcatctgattatctaaatggtcgaaacaaggctgacatgtggagggaaaagacagttagtgatttacatatcagtgaaagaaatcatgaatactccatcaataagcaacctgagtctgtgataccattacatagacctggtctttttgcagcttctccttcctctgatttatctaagtcttggtctcattcggcttcttcttgggaaatggccaatagcagcctaagccagaagttgatgtcaattcagacacctccatgtctaaatgcatctggtgctttgagtaggagatcccagtcacatcaaagtaatggggtattggaagaatgctggcctctaaatatcaattccaagcctaacccaggttttcgaagtgacgcacctatacagaatggattttaccctgggtcttcatctgggcccaaggaaccatcgatgaacatctcttcaattagctatgactatctcaatcataaaaatgattgtaagataattcctgatcacttcatcaacaatgtttcgtcaaaatcctgtaagggttcagattcaaattgcaatgacatgaagtctggaaaagatattgacttgaatgtgctgcttccgaatggtttatccaataacttagttccccggtcaggtgctgggataatggatggacaacagaacaatgaggagcgtcatgcagtgttgccttggcttagagagaagacaacttgtaagaatggagtacaaaacactgcaggagagtcgagtttattccatgctgcctcattgtccaacaaagatgaaactgtaaagggacctagtggaaaatttatgcacaatgtaacttcagttttgtgttctaatgacactgaggcaaggaggacggaggcaaatgaaagctctggtaataagaaaattcttggtattcccatatttgatatggctcatatttctcctaagaaggaattttcttcaatcacttctctgtctgtgttgaatcctactccatccgatctagaagcagtgggaaataagaaaaaatggatatttgatattaacttgccttgtgatgctgctgttgttgagttggacaaagaagcattcactgaaactgctgttagtaagacaaggtctcctacaacagcagactctagaaatcaaattgatctgaacttgagtatgagtgaggatgaaggatctttcacaactataccaagtgataatataaaaatgaaggcacaaatagatttggaagcccctgctcctcccgagatagaggaggatgctgttcctgaagaaaagaagcttgaaactgctctagcatcaccgcaagtcccacaaggcacagttgaacagccaaaggatgatgaacttattacaaatgcagcagaggcaattgttgtcttgtcatctcttacctgggaagtggatgatggtgtgatcagtccatcagaaagtccaaaggtggacctgctaagttggtttgcagatgttgtttcctcctcatgcaaagatgagggaaagtgtgatgtttcaagggaaaaagatggcgaggacaacgaggggcgttcctctgaaggaatggattactttgaggcaatgacattgaacttgccggagaccaaggaagaagactacatgcccaagcctcttgtccctgaaaacttcaaagtggaagaaacaactactttgttgccaactcggacacgaaaagggccagcaaggagagggaggcagcgcagggacttccaaagggacatccttccaggcctggcatcattgtcgaggcatgaagtgacagaagatcttcagacatttggagggcttatgagagcaacaggttattcttggaattcaggattaactaggagaagctcatctaggaatggtggtggcagggggaggcgacgggggcaggttgccccctctcccccgacaccagtggcaaccaatgaaactagcaccccactgatgcagcagcttaataatattgaagttggattggaggatagaagcctaacaggttggggcaagacaaccagaaggccccgccgacagaggtgcccggccggtaaccctccgttgatccagttaacctaa

SEQ ID NO: 88225 - DNA, 878 bp, Glycine max
  Peptide Sequence Number=SeqID_205003
tacttgtacctatcaccattagaggactacatgtcctcgccttgagaggactacacgtcctcaccttcgtagggctacacgccctcacctttagaggactacacgtcctcgccaacagagggctgcacaccctcgccttgagaggactacatgtcctcgccatcagaggactgcatgtcctcaccttcagagggctacacgccctcgccatcagaggactacacgtcctcgccttgagagggctacacgccctcaccttgggctacacgccttcaccttgggtactagttaccctcaccgttgagaggactacacgtcctcgccttgagaggactacacgtcctcaccatcagagggctgcacgccctcacctccagaggactacttgtcctcgccttgagagggctacacgccctcaccttggagaactacacgtcctcaccttcagagggctacacgccctcgccatcagaggactgcatatcctcaccttcagagggctacacgccctcgccatcagaggactacatgtcctcaccttcgtagggctacacgccctcacctttggaggactacacgtcctcgccaacagagggctgcacgccctcaccttcagaggactacacgtcctcgccttcaaagggtcatgtaccttcacctttgtaggacatgccctcacctttagaggactacacgtcctcgccaacagagggctgcacgccctcaccttgagaggactacacgtcctcgccaacagagggctgcaggccctcaccctgaagaggactacacgtcctcgccaacagagggttgcacgccctcacctccagaggactacacatcctcgccttgagagggctccacgccctcacctttag

SEQ ID NO: 88226 - DNA, 516 bp, Glycine max
  Peptide Sequence Number=SeqID_205004
atgtcaaaaaatgtgattgctgccagagatgtgtcaacattcatattgctccccccaaaagctttaaagaaccaaagttcgcctttgccattcatttggtggggaatagacatattgggaccatttcctaaggcggcgggacaagtcaagttcttggtagtagcaattgattactttacaaaagggatagaggcacaggccttagccacaatcactgccaagaacatggaaattttgtcttcagacaaattctctacagaacaccctcaaacaaatggccaagtagaagttacagacttggtaattctaaagagaatacaaagacatttggaagaagctaaagtttgttgggtagaacaaggcagaaagaatgcaacacaaggaaaactaacagataactatgaagacccttatagagtgagggttaagatagatgcttatatgttggaaacatttttcgggttaacaataccccaaacatggaatgcagccaatttgaggagatattatagttag

SEQ ID NO: 88227 - DNA, 999 bp, Glycine max
  Peptide Sequence Number=SeqID_205005
atggcaccctttgagccattcaagagatcccaaattacctcttccactggcagaaacttggtttggaacaattctgttcagagcttgttcttaacaaggcacagtggtttcagggctgaagcagcatggatgtttagagggggagaacaagggttggatgtgagttcggagcacagcgagagtgctaatgaggatatcttgatgttcttcttctttcagttggacttggccacaagagtacagggtttatttcaaatttatgaagagttcttaatgcttcgtttgtttggaacttctgaatgccagtatgctttaaatatggagcagtatgacattgcaaagcagctgaggaacaaacttgctgaggttgaagaagaggtaatcaagcaacaacagtcaaaaaggggattgtcttcaaaaagtgaagcacaagataaagctataagtattatacgtcttcattcagacctccagaatgctattgagaatgagcattatgccttggctgctgaattacgtgatgaaatttccaaacttgaagcagagtctctagctgcatcggctaaagctttggctcatgaaaatgcacaatatgcattccgcttggggcagaaagtgagacataaaaaatttggctataaagctgtcatctgtggaatggatccagtatgcagtgaatcaagttcatggatggaaaatgcacaagttaaaaaattgtctcgtggttccgctcaaccattttatcaggttcttgttgatgtacatgctgaaccaaatctattggtggcatatgttccagaggagaatcttttaacacctgataaaccagacatgttgaatagattagatctatacttgaaagacatacactatgctattatttctatcattgaatttgcgcttttactggtgcccagggaagattcgatcatccctacatctcttttctattctatggaatggattcagcaggagatttcatcccaattaagcaactaa

SEQ ID NO: 88228 - DNA, 183 bp, Glycine max
  Peptide Sequence Number=SeqID_205006
atgactccactggggactattctggattcatcttccgcgcattttcctttcttggaagatgcaccaatgagccccgcatcaccctcccgccgaagggtaggttgcgataacgaggaatccgggtgcgataacttagttgtatccaacaagaggaatctgaggatgatgattgatcaggattag

SEQ ID NO: 88229 - DNA, 370 bp, Glycine max
  Peptide Sequence Number=SeqID_205007
tgctgtgattcaaaagatccttccacccaagcataaagaccctgagagtgtaaccattccttgttcaattggagaagtcactgtggtaaaggctcttattgatctgggagccaatatcaacttaatgccactctctatgtgtagaaggttgggagagttagagatcatgcctactaggatgactttacaacttgttgaccactccattaccagaccatatgaagtaattgaagatgtgttggtcagagtaaaacattttatcttcccaacagactttgtgaagctggagctgggctttgaagatcagaaaattgattttgatttatttgttgaagacaaccctgctccaaaacaaaatgtttgcttacag

SEQ ID NO: 88230 - DNA, 138 bp, Glycine max
  Peptide Sequence Number=SeqID_205008
atgcatctacgtgatcaaggtggccttgttcgtgctcgtgcgcttagcgcacttatggactgcttagcgcacattagtgaattatggcttagcgcgtgcctttctcgcttagcagatgaactgaagcagtgcgcttag

SEQ ID NO: 88231 - DNA, 228 bp, Glycine max
  Peptide Sequence Number=SeqID_205009
atggctgaacaaaataggactttgagggaattggctacactagatgttgctcatcaacctttgtgcatccaatatcctgaaatagatgaggattgtgaagatcctcaaagacaccttaaggagtttcatgtcttctattcaatcgtgcgtcctcacattgtttcgaaagattacatcaagatgaagcatctcctttcatgtcttctcttcagtcttcaaccgtgttaa

SEQ ID NO: 88232 - DNA, 153 bp, Glycine max
  Peptide Sequence Number=SeqID_205010
atggagttcctagagctcaagcaggggaacatgattgtgcctgaatatgcaaccaagtttgaggagctggtgaagcaagctgtgaactatcaaggtgtctatcagtttccactattggtgaacatgtgtcggatttgggatgaggactcctaa

SEQ ID NO: 88233 - DNA, 350 bp, Glycine max
  Peptide Sequence Number=SeqID_205011
aacgacacgtcctcaccttcgaagggctgcatgccgtcaccttcatagggccacatgccctcacctttagagaactacaggtccacgcctttagaggactagacgtcttcgccttgaggagtaaaggcgctcaccttaagagggcgacacgccctcaccttcagaggactacacgtcctcaccttgggtactcatacccttaccttcagaggactacacgtcctcaccttcatagggctacacgccctcgccatcagagggcaacacgtcctcaccttgggtactcgtaccctcaccttcagaggactacacgtcctcgcgttcagaggactacatgccctcgcatttag

SEQ ID NO: 88234 - DNA, 450 bp, Glycine max
  Peptide Sequence Number=SeqID_205012
atggaggccatgaaagaccaaatgaccatcgtgatggaggccaacatgactgtagttgccactaaaagtgccgccactgaggtagatctgactcacccatctggtgtgaatcaaataagtcgtccagtctcggatatggtagatcagggtagggaagcattgggaagtacgggcggtccccattttgtgcaagtccagagtaagcatcctttcccaccgtatggtctgcctcccaattatgcaccacctaatgttgtacatgtgcttgaggagaacgtcgaccattccactcccataccccttgaaggccaacaacctcaatctgggcatgcacatgtctctaaacctatggcggagacacatgaggtaccccatgaccacactctagtcggcttcgagccttaccccagatatgccactgaggggcaagcatttggtggtataccctag

SEQ ID NO: 88235 - DNA, 285 bp, Glycine max
  Peptide Sequence Number=SeqID_205013
atggaaagggaaaaatttgatcacctagaagaaaggctaagggccattgaaggaggtggggactacccttttgtcgacatggcgaaactatgcctagtacccaatgtcatcattcctcccaagttcaaggtgccaaactttgacaaatgcaacgagactacttgccccaagaacgacttgaagatgtactgtcggaagatgggggcgtacgcaaaagataagaagctcttgatgcatttttttcaaagagagtttgaccggggcagtaatcacttggtacactaa

SEQ ID NO: 88236 - DNA, 303 bp, Glycine max
  Peptide Sequence Number=SeqID_205014
atggagcattttcttgagcaagtagcccggcctgaagttcaacttctattagtgagacccaataaggctgctctacctgagcccacacctgtgcaagttgatctagagccaactgacccacaatctcgagtggtgaatccaccgtcttttcctgagcgtgaagtagttcccccatctccacctctaattgtcatctccgatgcatcatcagatgaagcggctgcccctcctgattcaccagctggagaaacagctgaccctcttgcttccccagttggaggaattgccaatctttctgattaa

SEQ ID NO: 88237 - DNA, 273 bp, Glycine max
  Peptide Sequence Number=SeqID_205015
atggtacccaagtcacaagcgagcaaagataggctcaaactaactaggagaaggcttagaaatcacggttaccttgaagaaatcgtgaagggatggttcagtgacatgcaatggaggctcgtgacggtcactggtggttgtgggtggtggaggaggaggtttggagtgttgggtgagggtttggggagaagaggggagacaaatgcatgttttacgctgctagatgtatttgtagcctacaagactcgctcgggcgaaattttactcgcttag

SEQ ID NO: 88238 - DNA, 360 bp, Glycine max
  Peptide Sequence Number=SeqID_205016
atggtttctatgccatcaaggacaccaagtaaaggaatttcaactgggtgtaatggacttgacctgacattaataaaggatgaaagccctccaatcattacaaagacaagtattgatgctgacaagtctctccatgaggcttgggagcagtctaacaaattgacattgaacttgatgagaatgactatggctgcgaatgtgaagccatctatgcccaaaacagataatgcaagggagttcatgaaaatggtcaaggattgctcacaatttaacactactaacaagtcaattgtagggaacctatcaagtgggttaaccaacaagaaatttattagtctgaaccactttatgatcacgtga

SEQ ID NO: 88239 - DNA, 369 bp, Glycine max
  Peptide Sequence Number=SeqID_205017
atgagctctccgtcagttcctctttacgtcgctcaaagggtttttcaaaggaagtgtaaaaacaccctattacagtacccaacacgagagatactaagagaaactcaaagttcggcagcaagcaacgacgactcgtggtggccaccagtggttgtgggtggtggagaagaaggtgttagggtttgggtgggcatttggaaaggaggagagggagaaaattgtgttttccatgctgaagaacgtatttataatctgcagatctcgcttagcgagctcgtctcgctaagcgggagtccacttttcgcgcttagtgcgacaattcgcgcagagtgcaactccttctgcactaattctcgctcagcgtactaa

SEQ ID NO: 88240 - DNA, 666 bp, Glycine max
  Peptide Sequence Number=SeqID_205018
atggcgagcaacccttccaaagctcagaagaaagcaaagtcttccaagaggaagcaagggtttaacttccctaatttgctagaagctcaaggtctatctaagcttgtgcaaatgaaaggaacattttatctaaagctggtgaatgtcttctacacatgtacacacgcctatttagaaggtaatctcttttctacagtcaatggagtagaaatggttatcgatgttggtgtatggaaggcagtagctagacaggacatgggtggagttcgcaaattcaaagaaattactgatgggtacagcaagatgaagacctataggggaattcttcttgacccagcaaggaatttgaggaatcgcctaggtgtaggtggtctgacagcaaaagacagaatgcctgtgtacctcattacctacattctcactccgaggtcaagtaatcatgctcagataactaacaatgatatgcaaattgtgtatggtcttaaatttgatatcaagatgaattggatagtggatttttccaaagcatctagtaagatcaccgaaaggcatcttaagaaacttgggatgaggtttgttgaacatgagtggattatggctagagagccaccagcagtaggaaacatggacaagatggaagaagatgtcaaagctgaagctccataa

SEQ ID NO: 88241 - DNA, 1872 bp, Glycine max
  Peptide Sequence Number=SeqID_205019
atggccaagatgctgggcctcttgttcatgattggagcaatgttgtttggtgttggagctgaaccagttgaagataaacaagcattgcttgatttccttcaaagcattaaccactctcattatctcaactggaataagagcacttctgtttgcaaaaggtggataggagtgatctgcaacaatgaccaatcacaagtaatagctcttcatttgaccagaactggattgagtggtccaattcctcccaacactcttagccgtctcttggcactggaaactgtgagtcttgcatcaaatagcataactggttctttccctactggtttttctcagctaaagaatttgacctatctctatctccaatccaacaatttttctggtccattgccatcagacttttcagtttggaagaatcttagtattgccaatttatccaacaattctttcaatgggagcatcccattctcactctcaaatttgactcatctcacttctttagtcctagtcaacaactctctttcaggtgaagttcctgatctcaatatccctaccctgcaagagctaaatttagccagcaataaccttagtggggttgtgcctaaatcccttgagagatttccaagtggggcattttctggtaacaatcttgtttcttcacatgcacttcctccttcttttgctgttcaaaccccaaatcctcatccaacaaggaaaaaatccaaagggcttagggaaccagcattgttgggaatcatcattggtggttgtgtgctgggagttgcagtgatagcaacttttgcgattgtgtgctgctatgaaaaaggtggtgcagatggacaacaagtgaagtctcagaaaatagaagtatctaggaaaaaagaaggttccgaaagccgagagaagaacaaaattgttttctttgagggttgcaatcttgcatttgacttggaggacttgttgagagcatctgctgaggtgcttggaaagggcacgtttgggacagtttataaggctgctctagaagatgcaacaacggtggcagtgaagaggttgaaggatgtcacggtcggaaaacgtgagtttgaacagcagatggagatggtggggtgcattaggcacgacaatgtggcttcactgagggcatattactattcaaaggaggagaaacttatggtatatgattactacgaacagggcagtgtctcttcaatgttgcatggcaaaagagggggaggcagaatttcattagactgggacagccgtttgaaaataacaattggtgtagcaagaggcattgctcacatccatgctcaacatggagggaaactagtccatggaaacataaaggcatcaaacatcttcctcaactcccaaggatacggttgtctatccgacattggtcttgcaacattgatgaatccagcattgagggcaacaggataccgtgcaccggaagcaactgacacacgaaaaacattgccagcatccgatgtctacagcttcggggtgcttctgcttgaacttctaacagggaggtctcccttacatgccaagggaggtgatgaagttgtccaattggttaggtgggtgaattctgtagttagagaggagtggactgcagaggtgtttgatgtggatttacaaaggtacccaaatattgaggaggaaatggttgagatgctacaaattggaatggcatgtgttgtgagaacaccagatcagaggccaaaaattggtgaggtggtgagaatggttgaagaaattcgtagactaataaacactgaaaatagatcatccactgagtctagatcagaaggttccactccaatccctcatgcaattgagacaccttctacatcttttgcacattga

SEQ ID NO: 88242 - DNA, 1359 bp, Glycine max
  Peptide Sequence Number=SeqID_205020
atgaaggacaactcaattcatctcatgattcgtgatggagccaaaaccagtaagagcaagttgggtaaaaaggacaagggcaaatcccaattaaaggttaaagatggaggggtccataaagagaataagtgttacttctgcaagcaaagtggccacctcaagaaggattgtctaaaagaaatattaatcttggacactgggtgtcatgtagatttggaaggatgtctctatgtacctggattgatcattgatgaggtagaaaggcagttggacataaaagtgaaagttgtaaggtctgataaaggtggtgaattttatggaaaatacgatgaaagtggacaatgtctaggtccatttgcaaagtttcttgaaaatataggcatatgtgcacaatatactattcctggcacaccacaacataaaggtgtggctaaaaggcagaatcatactctaatggatatggataggattcttagtaaggaagttcctaagacttcttatgaattatggacgaaaaggaaacccagtttgaggaatctccatgtttggggttgtctagcaaaagtaaagatgtataatccacatgaaaagaaacttgatgaaaaaaccattagtggttttttcattgggtatcctaaaaagtccaaaggttacagattctactgccttaaccattgtatgagaatagttgaggatggtaatgttcggttcattgaaaatgagcttcaccaaatggatgtaaagaccacctttctgaatggtgacttagaggaagaagtttatatagatcaacctaaagcttctaatgatgttgctatgttacatgatgtaaaaaagtgtccctctaataaatttgaaatgaaagatatggttgaggcatcctatgtgataggaatagaaatattccatgataggtcacaaggattgttgggattgtctcaaaaaggatataccaataaagtactaaagagattcaaattggaaaagtgctctacaaggattgttccaattcagaaaggggacaagtttagtcaaatgcaatgtcctagaaatgatttggaacgaaagaaaatggagtctatcccctatccatcagtggttgggagtttgatgtttgcccaaacgtgtacacgaccgaatattagttttgttgtaggaatgttgggtcgatatcaaagcaatcctggaatagaacattggaaagctgcaaagaaagttattaggtcaaaccaccttgaagtggttggctacttggattcagactatgttggatgtgtggactcaaggaagtctacacttgggtacatctttcttctggctggaggagtggcatcatcgaaaagtgcaaaacggctttga

SEQ ID NO: 88243 - DNA, 914 bp, Glycine max
  Peptide Sequence Number=SeqID_205021
atgactaaagcacgtcaaaaggggttcgatttcgggaacttaccggttgaagaccgaagaacgacgaagaacggtggaaaatcttcgcgaaatcactcatggaaacatctcggaagcgttacggaagaaaatgagggaggagcttgccacccaactcgcccaggcgaactaggttgcttcctccagaaggcggtgccttctggagaacttcctggaaggcccaaaatgttacggaacttcacggattatgcaacaatgctttcttttgacttccggcatgttacggaacttcacggattgcacagcaatggatgccaagtacctcgaagtggtcaaacgaggatcgcatcccaacaagcagatggtccccagatgaaattagggtatgacaataactcttcaaaggaatattacaaagaaagttatagttgtaaagaagaggcagagaatttcaacttaatgggaaagaagtttggaaaatttctcaaaaagttcaaagacataaaattctctaaatcttcaaagaagattgaaagcaaaaacaccttcacttgcttcaaatgtggtaagcaaggccatatcaaatttgaatgtcctatctaccttagaaaacatatcggtgaaaagaaaggaaataaggacagaaaacataaaaaggcctacatagcttgggaagataatgcatctacaacctccgactcttttactgatgaagaagctgcaaatgtatgcttgatggcaaagtcaatggatgaatcatcaaccattgaagaaactaaggtaaattctgaatttgaagaagttttggaagcatttaatgaaatgcatggagaagctcaaaggcttgctattttaaacaaaaagctaaaaagcgatctagaactgcatatcactaaattggccttcagcacaaa

SEQ ID NO: 88244 - DNA, 492 bp, Glycine max
  Peptide Sequence Number=SeqID_205022
atggctttaggaactgatgatgctcttaagaatggtggtctagtatttgcagccttgagtgggaaactttatattatcaaaggtggttgtggtgttggaaggatgtttgaaaatcatggccaacacatgatagacaatgattacacaccttgttcaacactagatatctttgtgaaggacttgatgtggctagaacttattcagaaatccaaagatggaggattggatgtgattgagacttatgttttttggaacttacatgaaccagttcgaggccaagaaggacttggtgaaatttgtgaagacagtggctgcaacaagtctatatgtgcatctccacattggtccatactggtttccctctttggctacacttcattccgggaaataagttcagaaactgacaatgaacccttcaaggtaaccttcttcctttcactccgagatgtcctagaatccaagtccactcatcaaaactgtcttcacgcataa

SEQ ID NO: 88245 - DNA, 207 bp, Glycine max
  Peptide Sequence Number=SeqID_205023
atggagttggatccacttcttgagctggattgctaccttcgaggactcaaaaataagttcaaaatagagaaaaagattatcggagaagaagaagaagaagagagtaacacacaatgtctcgcactctacggtacctcacatggtgatgcttcactcaacatccttgttgatccgaaccctcgatcggtcagaattcttcgtaggtag

SEQ ID NO: 88246 - DNA, 219 bp, Glycine max
  Peptide Sequence Number=SeqID_205024
atgggaaaggggagaagtccattaagagggtggggtgggagaaaggtcttaggttctaaatatgaagggttgttaattgaaagagtaggtaagtttgagaaaggtgtggagtggaggctaggtggtggtgattgtcttagtgttggtatgtcgtggggaagtgggttgatggagcctggtgttgggttcttaggtggcggcatgagtggtttatgtggg

SEQ ID NO: 88247 - DNA, 502 bp, Glycine max
  Peptide Sequence Number=SeqID_205025
atgcgtttacaaggaaatgcccaattaattgatgatcaagaaactactaaatttgcaaagtggattctagatattggagatggagttattgggaatcaaaatgatggatatgctaccattgaaattcctgagtacctactgattactgaatataatgaccccattgatgctatagtcaaatcaacatttccagatttatatcaacatcacagtaatcctaaattcttcaaatctagagcaatattagcttccaccaatgaaacagttgaagaggtcaatgattatatactttccttgattctaggtgaacaaatggaatacttaagctctgattatatagagaagttagaaaccattgatagttggcatttccaatcaatcacaactaaatttctcaattcactaaacacatctagtctgccaaatcctcgtatcaagctaaaaatcggtagtcctataatgttgctaagaaacttagaccaaacgcaaggactctgtaatg

SEQ ID NO: 88248 - DNA, 908 bp, Glycine max
  Peptide Sequence Number=SeqID_205026
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctccagcgtctgcccgtcgcccggcaggcagacatgcaggccgacgctgatggtgatgggccaggcactggtgtcgtggtgggccgagactgcgctgcgcacctgggcgcacaggcgctcggccagcacctgggcctcggcgctggcgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 88249 - DNA, 736 bp, Glycine max
  Peptide Sequence Number=SeqID_205027
gaaagaacacactttatggtgtccttaccgatcacgtgccaaagctagagtggtgagtgaaatagagaaggtacaggaacaaatgaaggtcgacatggaggccatgaaagagcaaatgaccacaatgatggaagccatgatgactatgagaaaaatgacggaggtcaacacagctatattcgttgtcacaagtactgccactgaagtggacctgactcacccatcaggcctcaatcaagtaaatcacccaatgtcagatatggtaggtcaaggaggtagaacattgggaagtacaagcggcccccattttgtgcagtccagagcaagcattccttcccaccatatggcttgcctcccaactatacaccacccaatgttgcacactctcccgataagaatgtcgataactccgctcccatacccattgagagccaacaaccccaatctggcattttgtggcgtacccctgctaaacactttgaggaggcctcagtatcacccacaaccacaacccttgcattttgcggtaggaagagtccctcctgccatggtggaaagggaaaaattcaatcatatagaagaaaggttgatggccattgaacgaggcgaagattatgattttgctaacatggtagagttgtgcctagtgctcgacatggtcattcctctgaagttcaaggtgttagattttgataagtacaaggggactacttgcccccaagaatcacctgaagat

SEQ ID NO: 88250 - DNA, 333 bp, Glycine max
  Peptide Sequence Number=SeqID_205028
atggaactgttgagattaaatcaacatgaagaaaatgataagaagaagaagggaattgctcttaaagccccatcttcaatccaagaagaaaatgaagatcttagtttttttgtccaaagattcaacaaattccttaggatgagaggaactcaaagaagacaaaacttcaaacctaaaagaagaattgaagaaccatcccaaactccaagatgctttgagtgcaatcaacccagacatctgaggcctgattgtccaatctttaagaaaagaatggagaagtctgaaaagaagattattggagaaaagaaggcaaagatggcctacatcacatag

SEQ ID NO: 88251 - DNA, 312 bp, Glycine max
  Peptide Sequence Number=SeqID_205029
atggttacgcgatccatgaaattctgtaatgtggcggaaaccaaaaggaagtattgttacgcaatccgggtgcaaatagcaatcaggcccacttgggccttccagaatcttcctccagaaggaggttgcttctggaggaagcaactggctcacctgggcgagctgggtggcaagctcctcccctattttgctataaatagggggaggaatgaagaaggaaggggttcagccttcttggtacttcgtattctccttaaattgctgaggaaaattgtttccgtgaagaaaatccaagctgaggcacttccgtaa

SEQ ID NO: 88252 - DNA, 537 bp, Glycine max
  Peptide Sequence Number=SeqID_205030
atgcccgggttgggtcgggattggtcaagcttggttgtgggcaatagcaccccacctaacgtccccaaggtggcggtcgggcgatggtgcaaaacgattctccacatccacaaatcacgtatacccaccatcccttgttgcccacctccaactgagctcacgtactcccacgtagcccttatcctcgttcctctcaacgtcgggtccccatcaatcctcccaagcttccacaacatccagcacataaacatcacaagcatcatcataaaaaccctagaactgaatggaaacctagcaaaactacccatcatatctcccaaaacccaatacccacgaaaatcaagtgagaaagaagtctaccaaaacctgaaatttcgaagtcccacacgtagagatgtgtttcacgactccgaaaatgccttcctttcgcgatttggagcagaaatggctaccaaaggttggagctttgttggagcttcaatggtggaggaagaagaagagaatggaaacgtgaaagagggagaaaaaggcttctga

SEQ ID NO: 88253 - DNA, 1116 bp, Glycine max
  Peptide Sequence Number=SeqID_205031
atggctggtatactctgccttttgaaacaacaaaatagtttagagattacgagcgtcattattttggggacaccacacgcagcattgcaccggatgaagctcgacgtgccgagattcgacggctccgatgccacgggttggattttcaagataacgcagttctttgaataccacacaacaccagaccacgagagtctcacgatcacatcattctatatggaaggtcaagcattagcttggttccaatggatgcatcgtaacggccagctatcgtcctggccggcgttccttcacgctctccactcgcgattcgcagccactacgtatgaggatccaacaggcctattatgcaagttgcaacagcgtacaacggttagtaactacctctccgaattcgaagcattagcaaatcgtattatggggctactgtcgtccatgaccatgagttgcttcatctctgggctcacaccggcaattcgtcaggaggtccaagtacttcaaccagtttcaatgagtcaagcggtggcatacgccaggttacatgaagaaaaacaaaatgacgcgcgcaaatcgtttcgaccctcggttggagcttcctctagttcccgacaagcaccattaccagcttcttccacatctccattatttcctacaccaacccatcccactccctccaatgttccgtttaagcgtctcactccggaggaacttgccataagacgagaaaaaggattatgttttcaatgcgacgagaagtattcgcggggccacaaatgctcttcttctctcttcctactcattatggaagttgatgatacagtttctgaacctcatgagcaacaccctcctttaccagaacccgtgccagaacctccgctagcacagcttagtttcaatgcgctttcaggacaagtggtaccggaaaccttacgtatgcagggatacatccgtggccaacctgtgagcatactcatagatggaggcagcatgcataattttgtgcatcacagggtcgtcatgactgtgggccttaccaccaacatgacctctcccttacgagtcacagttagcaatggtgaggaacttcagtgccaacaaacatgctctgatgtggag

SEQ ID NO: 88254 - DNA, 942 bp, Glycine max
  Peptide Sequence Number=SeqID_205032
atggttatcttatcttccttcttccgctgtgcacaatcagtgattgcctttgtggctttcataattattgtgctattccaacaaacttgctttgccaagcatcacccatcctgtcctctttcttcatgcggcaaagttcagaacataacatatccatttcgactgaaaggtcacccagatggttgtggcctctcaaggtacgaattagattgtgtgaacaacgcgacagtgctaactctgttttcggggaaataccatgtgcaggatatcgattacaagaggtatcagatccgattgacagatgcgggtatcgcggaggatactgcttgctccattcctcgctatgttttacagagatttaatttcagtgatgatgatccgctattttttacggatgtgaaggagtatcaggatgaggattactatcctcgaaatgtagtgtttctgaactgtactaagaaagtgaatgatgatcctcgatatgttgaagtgaatgccgttcgtcgttgtgattccggaggaggaggccatatctatgcccttctgaatggctttggcgaacttagtatgatggacatcaaggttgggtgccgtttaacggctactacctttgcaagctggaaacgttacaggaacgtttcctatgctgatatccgcaagtggctgcaccaaggatttcggttatcttggttctcaacagttatttgtagagatcaatgcggaaagggttacagaggttgcaacatcaatcaaaccacgggagaaattggatgtgaagaaaagagatactgctatatgttgggctacaaatattacaaaacgaccaagtattgcggtattctgggaattacatatctgattctgggatatatacggtactattctccttctccccatatagttggtaagctcgctctcccatatctttgtcatttctcttaa

SEQ ID NO: 88255 - DNA, 1872 bp, Glycine max
  Peptide Sequence Number=SeqID_205033
atgaattttggggcctgcttgcaacagacaatgctcaattttcagaaattgtctcttctaattctattgactttggtgtttcagcctgtgaatgtgataggcaagaaccactactgcatgcagaaatgtggtcgcgttcatattcaatttccattttatctcagaaacagcaataagttcaatcacaccacagactatcccactgggttcggtctgttatgcactgaaaaagatgatactttgctggagctaccttctgttccaataaaattgtttgtcagaaacattgattacaaatctcagcaaattgaaatctacgaccctcaaaattgccttccaagtcagctcttgaaactcggcaatgcatccatttctcctttccaattttcgaagccaaaaggtttttatgattacgagaaagatttatacgattccaggactaacgtttccttcttccgttgtgattcaaggtcactgtgccctatttttctacttgacccatcggacgacgttaatctatttatccccgatatactatactgcactaagctgaaagatattttgtccgtgaagtggtacttcaatatggaagattgggattcagcagtgcttatggaatggtcaaaacctaactgtagttactgtgaagcacaaggccagaaatgtagatggaagaatggtaccaacggtgaaactgaatgtttcgtttgcccaacaaacaagattccgacacggactgttctaatcattgctgcaggaggaatagttggtttgatgcttttgctgctattggccaaggcattgtttcatgtgtattgctatcataagatgaaaggagaagaccaggctcggatagagaaattcttggaggattatagggcaatgaagcctactcgattcacttatgctgacattaagagaatgacaaatgggcttagtgagagtttaggggaaggggctcatggagcagtgttcaaaggaatgctctcccgagaaattcttgttgctgtgaagatactcaacaacgcagtgggtgacggaaaggatttcatgaatgaagtggggactattgggaaaattcatcatgttaacgttgttcgtttgctcggattctgcgcagaagggttccaccatgctcttgtttatgatttcttcccaaatggatcgctgcagagattcttggctccgcctgacaacaaggatgttttccttggttgggacaagttgcaaagaattgctatgggtgttgccagagggattgagtatctccaccttggctgtgaccaaagaatacttcactttgatatcaatcctcacaatgttttgctagatgaggacctcattccaaaaatcactgattttggacttgctaagttgtgtcccaaaaatcaaaacacggtgtccatgagtgcagccaagggaaccttgggctacattgcccctgaagttttctcaagaagctacggtaatgtgtcatataagtctgacatttacagctatgggatgttgctgctggagatggttggaggaagaaagaatacaaatgtgtcattagaggaaagtttccaagttctataccctgaatggatctataacttgctagaaggcagagacacacatgttaccattgagaatgagggagatgtgaaaactgcaaagaaacttgccattataggactttggtgcattcagtggaatccagtggaccgtccatccataaaaacggttgtgcaaatgcttgaagaggatggagacaaattaattgcaccccccaatccttttggcaccaccaattcttctggaacaaatgtcgttgttccaacaaggcgtcagaatttcgagttggaaattattcatgaaacaaatgagtaa

SEQ ID NO: 88256 - DNA, 324 bp, Glycine max
  Peptide Sequence Number=SeqID_205034
atgagggcttctggtaatcgattaccaagggggtgtaatcgattaccaggcttagaaagggggctggaacattgtggaggcctctgggatgggtcactggtaatcgattaccagatcgtgatggcggcgcagctaatccgtgatcgagtagagatggagtgcctagagggagcttgggagaccctcgaaggcaacacgaggtgccgatttcagggcaccattcgattcacggctacttctttggtgcatccagatgaacctgcacggacgcttcagtgcacggtggagtggacagctccttggattagttttgtgtatttttga

SEQ ID NO: 88257 - DNA, 648 bp, Glycine max
  Peptide Sequence Number=SeqID_205035
atgaagcaggaaatggagaagagaaagcaagggaaaagtgaaggaaatgaaaaacaaaaatgggtgcatgatgcatctctggattataagggcagagttcccatccgtgcttccaccgcaattgaatttagtgagaggataacccactttgggatatccagtaatcttataatgtatccgactagagtgatgcatgaagacctaaaaacaacaaccaataatgtaaactgctggaaaggagcgacaaccttgttgcctctaattgggggatttgttggtgatgcctacacagcgacaacagtggttgtttatgctgaggacttcgttagctggggagttgcttgtcttatcctcactatttttatggctctaaatatcattgctttctatctgggtaagcctttttacaggtacaggagactacaaggaaacccttttatgccaattctacaagtcctaattgcagccataagaaaaaggaatttgctttgtccttcaaatcctgcttcaatgtcagagaatttccaaggaaggcttctaagccatactagtaggctcaggtttctagacaatgctgcaatagttgaagaaaataatattgagcagaaagatagtcaatggcgatcagcaacagtgacagaaagatag

SEQ ID NO: 88258 - DNA, 807 bp, Glycine max
  Peptide Sequence Number=SeqID_205036
atgaatcagggcgcacaggaagcggccaaagccagcggtaaacagctggtgatttataacgccaacgataatcccgtagcgcaaaacgatgcgattgaaaactatattcagcagggagtgaaaggcattctggtggatgcgattgatgtcaacggtattatgccagcgataaaagaagccgcagcggcgaatattccggtgattgcgattgatgccgtattgcctgccggtccgcaggcagcgcaggtgggcgtagataacctcgaaggcggaaaaatcctcggtaaatactttgtcgattatgttgcgaaagagatgggcggcaaagcgcgactgggaattgtcggcgcgctcaattcggccatccagaaccagcgtcagaaaggctttgaagagacgattaaaagcaacagccagataacggtcgccgatgtggtcgatggccagaatattcaggataacgccatgaccgctgccgaaaacctgattaccggcaacccggatctcaccgcgatctatgccaccggcgagccggcgctgctgggtgccattgccgcagtagaaaaccaggggcggcagaaggacatcaaggtattcggctgggatctgacggcaaaagccatcagcggcattgacggtggctacgttaccgccgtgctgcagcaggatccgaagaaaatgggtgaagaagcgctgaaagcgctgaatagcctgacggccggcaaaactgtgagcaaaaccattctggttccggccacggtggtgaccaaagccaacgtggacagctaccgttcgctgtttaagtaa

SEQ ID NO: 88259 - DNA, 735 bp, Glycine max
  Peptide Sequence Number=SeqID_205037
atgactaggagtaggaccaaacagtcagaggatactctccaacaaatggtatcaaccatacttgacaaggcccaagtggagaaggatgaaggcccagaggcactaccaagaatcatcctgcttctctctgggttccttgttgaaccaatctcggacttatcgaggctgaacccttgtggcatctatcctgacttatcttccatctctggaagtggcgttatccaaatttcgttacctataccaagtgatccactcctaataaggatcacatcaatacccattgaagaagcaaagcaacaagcgagtctagtgggatgcatctctacttataaccctaaaggtggtgaagtatcaatttcagctttcaaacccactctccttattcctggttttcgacccgacccggatctgacaccaagcttgggtttcagttccgacgttgctggcagggacaactcggcaattggcacaaagagcaatgggaatgcaagcttcagagaagaagggtgcgtgatgatggtgtcgtggggccacactacaagcgaaaggggaaagcggaatagagagacagaaaaaggagaagtggcagaaagcgcttctgatccacggttgaggagctctgttcgcagctcctccatcctcattttactagatgcgtcttctcgagagcctagggaagaggagagaaggcactgggaagaagagagagggcattggaaagaggagagcgagtga

SEQ ID NO: 88260 - DNA, 956 bp, Glycine max
  Peptide Sequence Number=SeqID_205038
tgggccaatgcctatatcgccaatgaaggttttatcgaaggggcagccgctaaagcgctgcgctatcgcaatcagctgcgggccgatcacatccgcgtatttgccgatagccatgttaaacacggcagccacgcgattgtcgccgaccgctcgattcaggagctgacgcgtgacgtcgacttcttcgaagccgatgcggtgatcgccaccggccagcgcaccggcgacagcgccacgctgagtgagatcgacgaaatccgcgccgcaactgccttgccgctgctggtgggctcaggcgtgacgccggacaacgtctgtcagatccttggccgcacgcagggggtgattgtcgccagcacgctgaaagttgatggcgtgtggtggaacccggcgctgtggcaggcgatgcagcagcaccgctttgtcgtcgacattgagcacgatcggctgccggacagcgtgtttaatcgctatctggtgtttgagggcaacttcgtcgccaccgccatcgctatttttgcgctggcggtgagcaaggcgcccggcattcgtcagcagcgctggctgattggcgtgctcaatgcgttggtggatacgcaaatcgcctggtttgaggcggtgctggcgcggcgcggcattcggccagcggattatccggacgatctgcccggcgtcagcgcattccgcgatggcatgctgaaagtcgcgcagcagggcagctatgcggaaatcatcaccctgatgttcggtgccgagtggatgtattaccactggtgcctgcgcgtcagcgcgcaatcgcagcaggacgctgacgtacgccgctgggtagagatgcatgccgaagacgagttccatcagcaggcgcagtggctgaaaaccgagctggaccagtgtgcactgacgctcagcgcggcgcaacaggctcagctgtcgcagctttacgcccgcgtgctgca

SEQ ID NO: 88261 - DNA, 1425 bp, Glycine max
  Peptide Sequence Number=SeqID_205039
atggcggctaagaaagacgggtttgccaaagtagttgttgatttagaggcccgacttaaggagttggagtctaggctagaggagtcagagttgcggattgttatggtgatggaagccagcagggagcttgaggaagagctgcttctgtacaagaaggaggaccttgacttaggtctcctcgatcccttcaaggatgtgaaggatgttgtggaggaggaggctactgatgaaggcagggtgctgcggagcaaggcgatgatgcctgtcttgcctaaccagtgtgggcataggtcgcttgacctgctgagttcctcttctgatggttatgaggattgtccacatggcggcctcgcgttgcggcaccatgcaccagtagcgttagggagtcgtgccacccttggtggtggctctcctactccgatgccatttgggaagctcgatcatctaggggtggcaatttgcttggtggaacatggacccttgatagtggttgtcgtagttgctgcaagtcaacggaccaagggagtaccttgggttttggagaagtatgtaccaagggcgaacattaggttttggtaccaagtgcgaaccttggattttgccagagtttgtaccaagggtggaccttgggttttggagatggtagaccttgcgtatcttgagttcctgaggggatggaacttagtaatggagagggctcaccatgggtggaccttggcaagcgcgaagcttgggtttgacgagtcttgtgtccttgcatacatggcacttgccgtggacttaccaaggctggaccttgggttttgtgagccctttggagaattgaccagggaattgtctaacctgggttttgggcaccgtgctcttgtatacatgccactcgctataggcttgaatagggaaaaaagtgcaacattgggtttggagtgtaggtcagctaaagtagaacttcaggttggctgtgaccctaaagggaccttcctagttggggcaaagctttcccgctcagggatcttttctggcttcacctcagactcgccaaacgagaacaaaagtctccttgtcgacggttccccaacttcaacggggatcatggcatttatgccatatgtccttagacttgtcgagtctagtacgcagggtcttggggatgactttgaagtctttgtaagtctgagctttgaattaagtgtcgttgtcggtgacaatggcatatgggaggccatacctacagatgaggtgcttctagatgtctattccccatatggtgaaaggccaaggggagcccagactatgaaggttgtcaggaggagtgcgtggcacgtctgcaaactcttggcatcatctgcatctcttggtaaagtcgaggttgtcttccctgagcattggccagtagtagccagctcacactgctttggcggctaa

SEQ ID NO: 88262 - DNA, 1212 bp, Glycine max
  Peptide Sequence Number=SeqID_205040
atggattgggaggtcatctcgataggtgagtcctcctcttccaagagggcgagggcctcccgtcgaactggtgggggtgcttcttgcccttgtagaggagtgcggctttccgctgctgccgaggagcatgtcccaattactgtgatcctcccccgtctgcttccgggggtggatgacgtgctaaagtataagtcatgtctgacctcggtggcgattgtcgctgcgcttcaccgcaaggtgaagctggccattcaggcttgcgggagtgatgacctcccattttttagggtggcacatggtcgtccacccttctttttcatgtatagatgtctgtttgaggtcctgggtgtcattccacccttgactgtttttcagtgtgttctgcttgagcacttgaattctaatcccaacaggttcaactcatatgacgaggatctattgacccttgtggagagggtcaacaaagcaattttggagcagctgccggccttgctggatgggcgagccattttgtctcttttttcagcgagtgatcatctcgctgccttggatggcattataggtgggatcgtgccaccatatgttgcagctccgtctattggagaagggggccaacctgtgggtgaggttggtcttgttgttgctgcaaaggtcactcccagtgctccttcctttgttttggcaacgaggaagagggatgacgctactgggccatttggccgcaagaagtcaaaggcccttgtgagtctttgtgccctgaggcaagttgcagggttgatacccactgggggtcactttcgagttgattctgttgtggtgccatattccaccatcgcggcacgtttgttaagtgttggtgtagcggccactaatgcttccacggtggtacctccttcctctatggcttcgatggcttctccctctgttgttttagcagagtcagagcagaagaccctggctggctttgtgtcagccttcgacaaaaatctcattaggtcggttggggtgcagaatgctactgactctgccaaagtcgccaagtggagggataatgctcgtactctttggcgagtggagcaccgtaaggtggccaatgccactgttgcttttactgaggtcataatgtcgaaccgaccgttgtctactaaagttggtgatgtattggccaagttgttgcgcacccgattagatggtgatgagttgtttagatga

SEQ ID NO: 88263 - DNA, 324 bp, Glycine max
  Peptide Sequence Number=SeqID_205041
atggttcaagcaggtgaggtgtgcgccgtgccaggtcagtgtgccagcgactacatggactggttcttccgcatttcgcatcctgtcaagacaccaggccacacatcagatcctctgccagatgatatccttcacgtgtcgaagccaggagcaccgtcgacatttgcgaggcccactgtggaagagcctaaacatgcagtggaagtttgccatgggattgctgagaggttggagtgccatctgagcctaggggtggtcacaccaggctcatcgacacatgaggtgattgaagaatgcctcaggatggccaggagtgtcacatag

SEQ ID NO: 88264 - DNA, 789 bp, Glycine max
  Peptide Sequence Number=SeqID_205042
atggcggaagtaaagcaaaccatgaaaaaattagcaaccagtcaaggaattgatgtgagccaatctattagaccaccaaacattggggataaccaaattaatttcccctcatgggcccataacaacctcaatcacaaccaattcatgtgtgaagatttggtggccagtgagcgaaccgtagaaataaaccaagcaaatcccccaaaaggtatgtatgaacttaaccctcaagataaccttttcgctcttcaacaaaagatgcaagtgcaaatagaaacaatgactaaggcaatccaacaaatcctgcaacaactccaagggaccatctcaaagaaaccccaacaagcgttcatgtgtgaagaatgtggaggaggccatcaaacatcaaaatgcactaaggtaccaaccgaggaggctattatctccaccatagagtgtgatgaggtaggtgaagaagaagaagacgagatgatgagaggagagctgaaattcgagaaatacatagagatgctacaagggaaaaaggaggaaccacctattgaaaaactcacatgggacgtgctacatcaagtaagacccacaagacatttagaggacaaggaggaccagcaagttccaatcattgtaggaagatctttcatgagaactaatcatgtaaccatcggtgttcgtaaaggagtctacacacttagagagggcaagaaacaaatgttttactgctacattcaaggcattgaagattttcccaacgaatcggctcaccaacaattccatcatacaacaccttga

SEQ ID NO: 88265 - DNA, 1269 bp, Glycine max
  Peptide Sequence Number=SeqID_205043
atgttgtggggtcaagaagcgtatcatgtcttcaacaagatggatgaagactctaagcacaccctaatagccaagtgtttaattgaggctcatttggtagatctagatgccatcaacaaaaggaagcaaaagaggctagccaatgccattactgatgaagatcagggtctgaacagctttggtatctccaaaaagatacagaagattatggttgagcaaaaaaaaagaaagaagacaaggaagcaattccaaaaagaagaagaagaggaagagctactttctagggaacacaggacaaagataagacatgaagttattacatccacccctgtgtgtccaactgtcataaccacagtcccacaaaggttgaaagagctaagtgacgctgatgaaaaaaataaaggccttcatgactatgagcatactccatttgaggcctttaaggctctaccaatagatgctataattcatcttcctcttccacattggacttgtccaatccagcccaatgttatcaagatgcctcttcatgttcttgcacttgaagcatggcgaagtcttcagaagttcaaggataaaaagacctcacaaagcagcatctctagggatttgtttgacaaactaaaaaaggactcttcacaagaagtggaacccctaaaaagcgagtttcagataaaggtgcatatgtggatgccaatcaccaaactatttctagtgcatccagctgatctcaatctctctcaagaagaccgctcatctcttggtaaattgcatgaacaaatatacttaagagatcaagccactgcctatccttctagtttgcacatcttaagggctactgatataaagatggttgttgacaaagtgagtccatgcctaccggtttgggatgatgcccaaaagaaagggttcaagctatactacaacgaagacatgccttcaagaaagatgaaggtagcgattgtcaacttccctcgcaattggagtttgttgttcaatgggaagaacctgatttacactcctaatacttatgatgccaggaccttttggaatcagactgtgttatggactcttaaaatgccttcacttctggttatgatggaagtgaaaatgttgagcaccacaacgttgtacaagtgttacgtcctgttaggaagtattgctttgataatacttgtgtctacttcacaaaggatgttgacagatattcgtttattcagtgcctactcaaacttcctactattcaataagaaggccgttataatctga

SEQ ID NO: 88266 - DNA, 621 bp, Glycine max
  Peptide Sequence Number=SeqID_205044
atggtggcctggggtgaggatctcgttcaacataaaggttcttattcggttacttctttaaaccatgctttccctatccttaagggtggtttgggagggggatggcacttggagaatatctacaatgttctcccttcccatattagggaggacattctgaatacaagacttgctcttaactcatctatccttgacatacttacttctttgctcgagaacgttaagtttttcatgtgccggcttggccatgaggctcttccgtctaaagagttcctaagtgaaattatagcgcatattctctgggactgtggcaatacgcatgtggtgtggtcgggttgcaaaaatcctttgccctctagtgctagtataaggtcgagctttattccagaactgatggtgcctccttacactatcattacaagggcgcataatttgcttaaggttgcgcttaaagccttccatgttatggtggcctactgcgagactcatttggtaattggattcaaggatttattggttgatatagggcgtagcggacattctcaaggaagaattgatggtgattctggaaggcctgagggtgttagagggtggcatcgttacgcagccatatattgttga

SEQ ID NO: 88267 - DNA, 669 bp, Glycine max
  Peptide Sequence Number=SeqID_205045
atggacaaagcaataaagacccaaatttctactaaactccaagactcagaatgtgatatcgtaatagcactgagagcattaaagaatcttaactctatgttccttaaggaacttgtcggtaccttcaaggttcatgaacaagaacttcaacaagatgaaggacccaaaagagaagagtctttggctctcactcttaaagacgatgattcatttgatgatgaatctgaggaagacttggatgcagatgagctcgcctttatttcttggaagatccaaaagatgtggagaatcaaacatagacatttcaagtctaaattcacagaattggagaagagtcaagataagaagaaattcttcaagactaaagaaaaaaagggtcttatgagtaccaagaaggacctaaataacacctcatctgatgaagaatccaatatatgcctgatggtagatacaacttctaacgagtctgaatcaaatcaacaagatgagggtcaagtagatgtttcactggataagtccactaaaacatgtgaagcttgtataactcttaaagataaagagtccaagttgtgtcttgaaattgagactagtgttaaggaaagagctattcttctcaagaactttcaagagttggaaaatagacttaaagatcttcaaaaggatcagtag

SEQ ID NO: 88268 - DNA, 507 bp, Glycine max
  Peptide Sequence Number=SeqID_205046
atgtctagttccagaaaaaaactggttctgaataccgtgtccgtgagcctgggctgcggcagctgcagaaggcccgggctcctccggcacatattccacccgaagcggaggcccaagaagcccgcgtaccaggcccacgggtttcattgggacgacaccgcgacgagcagcagcaccaccaacgcctccaccgctgccacgttctcgccatgctacgcggaggcctcggcgcagttcagcaactacgggcgaggcgtggcggtggagaaggactctgatgatccatacctggacttcaggcactctatgctgcagatgatactggagaatgagatatactctaaggatgatctcagggagcttctcaactgttttcttcagctcaattcgccggaccaccatggtgttatagtgagagcgttcactgagatctggaatggagttttctccgtgaggaggtctggttcttccactgggttccacctcaaccgctgtctttttggataa

SEQ ID NO: 88269 - DNA, 219 bp, Glycine max
  Peptide Sequence Number=SeqID_205047
atgaagctttgcttccacaccaagcggttatctgtacaaatgatttctgttaatcctgacccgggaagtcaggtggcaggcgggggtaccttatggttatccgcaccttttgtcaaccaaggcgaacgagttcaatgtttttactttcatcatccggggacattcaagcccaacgaagcacgagattcttctctgttaggcggggacgatcgagtttga

SEQ ID NO: 88270 - DNA, 765 bp, Glycine max
  Peptide Sequence Number=SeqID_205048
atgaccccgaggataaatcacctaagcaggtttgcactcttgaggcctgatcctcaagagttggctgctaagctctatatcccagggaggggattcgagctaaatgttgatgggcaaccgttgaagatactgaggaagaacatgaccaccttagctcagacatggagtgttttttccttctctaacctgattcctacctcctacacatctgatgtcaccatagacagagccaaattaatttatgacatcattatgaatatggatatgaacttggggtacctcatctcccaccagatctctctttctgcacaacatgatacatccagacttggattccctgccttgatcatagctctatggaaggctagaggagttcaatcagattctagatccctggagaacttgagccctgccattaacctgacatatattaagaagaactgttggaatcttgatgatccaacagtgacatttagagggccaaggaaggctaggggtaagagatcaggtccccactacttcagcaccaccagagacaacagctccttcttcttccacagctccagtacctctcattcagactccaactattcctccaacatctacacagataccacttccagctcctttatctgcaagaccttcagatttttcatttacaccacaaatgctgcattccatgctccagagcttacacagggggcagtccattatcatgcagagccttcagggcttgggcttgccatccatcatgagcatggatga

SEQ ID NO: 88271 - DNA, 244 bp, Glycine max
  Peptide Sequence Number=SeqID_205049
gaaggtattgttgatcctgagggatttctggaatgttccagtcatccatgttttgattgatatcttcgaatcggacttcctcatcgaagagattgtgtttgggggcgacctcttgggtctggctctaatactagaggtcagtggaataggatcaaacggacaggttttcataaacaaagaaaccgaaacggcggcacaaccgcacaggatcggtggtgggagagagaaaagagacggaaaatag

SEQ ID NO: 88272 - DNA, 180 bp, Glycine max
  Peptide Sequence Number=SeqID_205050
atgagccatggacgcctatatcaacaaagaatgaagaatgtgttcgacaagaaggggcagaatcatcttaggccgtggtcagatgccgggactaagctgaaggcaaaaaccaatcaaggtaagacagtaacacggccacagtttgctgcacaatgtcgtttcctactttcaggtacttag

SEQ ID NO: 88273 - DNA, 266 bp, Glycine max
  Peptide Sequence Number=SeqID_205051
gaagggtagtacatctcgggttctaggcattttcttgcagatcccaacgaaaaatggtggtgcagtgcaggaacctccagtaaacatctcaaggcgatccaacggggttgatggggacccggtgctgagaggaacgaggataagggctactggtacctggagatatgtcgcgggggtcaggagaccttggggacgtcagggtgatagggcactgataatcgattatcagttgggtgtaatcgattacacagtgttacctgctactg

SEQ ID NO: 88274 - DNA, 1827 bp, Glycine max
  Peptide Sequence Number=SeqID_205052
atgggtcctggacagtacataagcccccaaagctctgagccaatttgtgggagtttgtttgatgtccggggtagtagtcttaacaagcagagagtgacgagtttgtcaagcccccaagtgtggacgagtgttgtccagtgtgagaattgcaggtcgatgtggcttgtcaagtcctcaagccttgagatgtgttgtctaggctacttctatcaagttgtcaatgatggaggtgtctttggcgtgctagttaagatagcattgaagatagcacgacctcgcgttgaactagtgggagtgcctctcgccctcacgagaggtagtggcggtggagatgtgagggtgagggacgacgtgttgaagtataagtcatgtttgacctcggcggcgagtgtcgctgtgcttcagtgcaagcacttgaatgaggccccttcccaacttcacctgaacaattgggcgatggtgagggcatttgaaatcttgtatcctttcttcaacatccagcctagtgtgctggaccatttctttaaggtcttggctactgatgtcgtggttgatggaatgccactgatgttcaatagggacggggagccctgcttctcgttctactggcagtctggtcccaccaagttcaagtcatatgacgaggatctattgatcgttatggagacggtcgacaaagcaattttggagcaactgccagcctcgttggacgcacgggccattttgtctcttccttcgacgagtgatcctctcgctgccttggatggtattgtgggtgactttccttggaggccactcgtgaagtggggttgtgccactgtctactggagagggggtcaacctgttggtgaggttgtccatgttgttgttgctgctgaggtcacccttaatgcttcttcctatattttggtaaaaaggaagaggaatgttgctattgggccaatgggccgcaagaagtcaaaggcccctatgagcctccacaccctaagacaggctacacagaaggggcccattgcgagtcacctcataactacacaagatatgccttcggctccaccgaccgtcgaggctcctgcttctgctgctatgactcctgctactcctgctccttcacctcttcctgcagctgttgttcaagaggtttctcaggctgttgttgaagttgttgtgccagctactcaagctgagtctgcctgtggcaaccattggtgctcccacgatgttgcctccttcttcatcggctccggtggtcctcttgctacaattttggtggctatggcgttgccttcttcgccctcgtgcctttgtgtctcccttgatcatttatacacctttagtgatgttgactcattgtggggtgcgacttacaagctagagcaaaagacctcgactggctttgtgtcagcctttgacaaaaatctcatcaggtcgactggggtgcaagatgctagtgattatgccaaagtgtttctccaaaggagtttggcacttttggaggagaacggattgtggcaccaagaagcggtgcaaaaggtggcattcttggaggcagaggctgtaagggaaaaccgccatctatcttccaaggttggtggtgcactggccaggttgttgcgtacctggttagatggtgatgacttgtttagacgctgcaaggacttgcaggctgagaagatagacttgggtggcagactggagagcatggcgactgagaaagatgggtttgctaagagagttgctgagttagagacctggcttaaggagtcgaagtctagattaaaggagtccgagctgcgggtagccaaggagaggaaggccagcaaatag

SEQ ID NO: 88275 - DNA, 450 bp, Glycine max
  Peptide Sequence Number=SeqID_205053
atgagggcatttgggactatggcagctcgcccaggtgagttgatgcttagtcctacagaaactggcacacccaggcgagctggttcctttagccctaaccaatttggggccccaggcgcgcctgggcgagccaggggtatgacaccacccatggtctacaaaacccaaggcccgttcttggtccaaggctcgacaaacccaaggaccacctttgacgaagcctcacataactacatttccatccccacgagaactcatggaataaaagcttatcaaaaacccaaggcccacctttggtaccaaaacccaaggtcagtccttggtacatacttctaccaaacccaaggtaccccctttggttcgctcacatgcagcaactatgacgaccaccgtcaagggtctaagttccaccaagaaaactaccatcccattatttggcaagacttttaa

SEQ ID NO: 88276 - DNA, 342 bp, Glycine max
  Peptide Sequence Number=SeqID_205054
atgaccactggtggccaccacagctgccgagtctttcccgctgaaccaccacaccaagaggaacattttaattggagtggaatccttagaatctacctcaaggattcggtggagaaaaaatccctcaatcatttctttcgtagcttctctgaggacatgatcaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttgtgagttgtatcatggcccaaatggaggaggactaa

SEQ ID NO: 88277 - DNA, 1002 bp, Glycine max
  Peptide Sequence Number=SeqID_205055
atgggtgttcagtttcacaccaatgttgttaatggcagatggcgggcgagccctggtgcagcggtaaagttgtgccttggtgacctgttggtcatgggttcgaatccggaaacagcctctttgcatatgcaaggtcaccgctttcgtctgccaccacctgccgctgtcatactttcgctggccactggatctgtccctgtcggtcgcatgctacccatccgccggtctctagcctccaaaaattcaccgcaacaccacggctatggtcgtcagctcattccagttctgtttcagtcctcagatcgtcattttgttgttgtttggatagtgggcttggtttcccgtgcttgtacaacagctgtttggttagctgagtttctggagctcagttttctgtcctcttctcttctatgcatcacttcaggttattctaaaaggatgtatcacgtgtatgtgggtaacttggattcacgagttaccgagagagatctcaaagacaaattcagtgcttttgaagttattcggagtgtttgggttgcttgcagtccaccgggttatgtcttcattgactttgatgaccgcggagatgcacataatgctatccgtgaattggatggaaagaatggttggagggttgagctttctcacaactctagaggaggagctgtccagcagccaagctcaattatgtacaatactgagtgcttcaacagcttgtacttctcaatcattggacagtcaagggcaattaaatgtgtctttcttaactatgatgacactttctgtcctgtggccaaaatcactactatccagctctcctttgccatggctgccattcatcattggcatctccaccagttagatattaaaaatgtcttccttcatggtgaactagacaaggagatttacatgaagcaatctcctgggtttgttgctcaagggaaatctggtttagtttgcaaacttcatcagtctctttacggactcaaacagtctccttga

SEQ ID NO: 88278 - DNA, 282 bp, Glycine max
  Peptide Sequence Number=SeqID_205056
atgcgttcataccatttggacatgcatggagttgtcttcgctctttccactcctaaacctgatgtcgttgatgatgccagtcaacttcaacaatgggttcaagccaataagacagagattcatcgtcgccaactactatcgttggaccacgaacaaagaaaaagacaacaagtacaaatcaatgaataccacaagctgctggaagatctaaagactgaaaacatctctctgcctgatgagttcatttctgaactcttgattgagaagttgttggagtcctag

SEQ ID NO: 88279 - DNA, 606 bp, Glycine max
  Peptide Sequence Number=SeqID_205057
atgggagcttgtccctataccccccaactcatggacctaatgttaaacttctctcaggcagacttaaattatctcactgtcaccaaaccaaacatcacattcgttgtcagtgtggtgagccaattcttgaatgcaccttgtgatagtcattggaatgtcatcacttgtattcttcgatacatcaagaatgcaccaggtcgtggaatgttgtatgaagacaaaggcataccaagatcatttcttattttgacactaattggacaggggaatatgatttcatggagaagcaagaagcgagacacaattgctagatctagtgttgaagctgaataccgtgaaatggcaatagctgcttgccgcattacatggcttagacaacttctccaacaactcaaatttggagacactcaagccactacattaatttgcgacaatcaagttgctctccacatagcatcaaatccaatttttcatgaacaaaccaaacacagagatagactgtcactttgtaagggaaaagatattttgaccaaatctttgagaggacatcagatccagtttatatgtcccaagcttggagcatacaatctatacgctccagcttaa

SEQ ID NO: 88280 - DNA, 102 bp, Glycine max
  Peptide Sequence Number=SeqID_205058
atgccttcaccagttcaatcactggggtggctagaaatctatcagagggaaaacagacttgttgctgctcctgctagctcttacaccgcaatactgacacag

SEQ ID NO: 88281 - DNA, 527 bp, Glycine max
  Peptide Sequence Number=SeqID_205059
atgggtgactcagacaaatacgggttgtacattgaagaaaatcctccccgcctggttgccctaggaagactttatgagggatctacaaccgttcacaacatttcttttatgcatgatcaagtcaaggttggtgttgaggaggttagagatgcaaatactctcattcatgtacccactgaagagggagctgtggaacccatgaaacttgcagataggccggatcatgatctcgatgatcccctatatctgatgacattgaccatcccacaactttttctaaagctattgcaggttatgtgggatgctaccatgtttggggtgtttaatgacaacttccccttgtacataaagcatgaagatctgtctgaaatagcatacggtggtcaatgtctcagcatctctattatacagttgtggattcttgcacattggcaaatggttgtcattttgcctaaggaaaatgttgtgatctggttttgttcgttgcataataggtcagacaactatctgaaaggaataattaacag

SEQ ID NO: 88282 - DNA, 219 bp, Glycine max
  Peptide Sequence Number=SeqID_205060
atgttggagtcgatgtttttcaatatcgtcatgaaaggtttggtgacacttcctccatcggtgctaggcagatctgtgatccccaaatgtcattgccaccaacaacatcaatggctttcggtgttttgcttcatggaggcggcaacaactccacgcatggcatggtcgatgttggagaagcttgatttgacatcctcacaggccacgatggtggtgtag

SEQ ID NO: 88283 - DNA, 201 bp, Glycine max
  Peptide Sequence Number=SeqID_205061
atggatggcacgtttgacgatgaagttgaaccggccgttacaatcggtgagtacctcgaggaagttgaggaacgggaattgaaatttttaaatctccaattcaaacacatgattagagtatgtaataatttctcaacggttttgtctacatctccgcaatacaatggggtagttaatagaacagaggagttcctgcaatga

SEQ ID NO: 88284 - DNA, 183 bp, Glycine max
  Peptide Sequence Number=SeqID_205062
atgacgatggaggagaatgaagtcacaccaattattttgggaaaactcttcctcaacacaataggaacattgattgatgtcaaggaagggaaattgacttggtggctaggtgatgaggaagaagtatttaaggccactaacaagataaaagtcattttctcctcaaatacccataaaccctaa

SEQ ID NO: 88285 - DNA, 351 bp, Glycine max
  Peptide Sequence Number=SeqID_205063
atggttcagtcatggagtagacaacataagagttggtcaggaaaaagacagatcaggaagctgagtccaaagaaggtcaacttggttgctgctctggttcgtggtatgcttgttaaagatgcatcgatgcagttggaatcgacaataaaacgagcagcaaaaactgtatatcaggttaaagagttccatagaagagatggttttgaggtagcaagtgctgacaagatggctaagtcatgcatgatgacaagggacctgaaagaggaatgccgagcttcaattctgagttacccaattccaattcatgggttgaggatgttacaagagtttgggatccttgctgaccagtga

SEQ ID NO: 88286 - DNA, 354 bp, Glycine max
  Peptide Sequence Number=SeqID_205064
atgggagacagaaaggaagcaatagcaataacaatgggttggataggtgagagtgttgattccatcaaatctcttcagatccgccaggtcctcacccaggctgttagcctcggcatgattgttacctctgcactgataatatggaaggcattgatgtgcattactggcagtgaatctcctgttgttgttgttctttctggaagcatggaacccggattcaagcggggagacatcttattcttgcacatgagtaaagacccaattcgggcaggggagattgttgtgtttaatgtcgatcttatcgttaccgtcgacctcgagggggggcccggtaccagcttttgttccctttag

SEQ ID NO: 88287 - DNA, 106 bp, Glycine max
  Peptide Sequence Number=SeqID_205065
atgggttcaaacgaggcctatgcatatatgttcgtgcaacaagagtttgatgttatattaaaatgctttgcaaaggttgacatagctgggaaagttactacaaaag

SEQ ID NO: 88288 - DNA, 273 bp, Glycine max
  Peptide Sequence Number=SeqID_205066
atggaggctaaacggaaggataactttgtttgggcacttcagaagttcaaaggaattttttttagagttgatggattgcctaaagtgattatcactaaaagagatttaaccttgatgaatgcattgaaatatatatttcatgaagctagtagtttattgtgtcaatttcacattgacaaaaatgtgaaagcatgggaccaagtcatgaaagcatggggtagtgttaaagatttccctactcagtctgagtatgaggagcatgtcaagatgtag

SEQ ID NO: 88289 - DNA, 401 bp, Glycine max
  Peptide Sequence Number=SeqID_205067
aattgatcacaggtctctgccagtcgttcgaggttcccgtcacacctagtaaggccccagacgcaccgccaccacctcatcaggctgatccagctgggtcatttgacacggagcggtatttacggcatttggttcgccagcaggcagccaaccacagggcgcatgtgcagacccataactgtctctaccagctcagcctcagtctgcagagccagggtttcgctccttttccgtgccctactcctgatcagttcagggcagaggtcgcatggctcggagattggcctgaggcccaagcaggggaggcgcccgcagaggctcccggtgatggaaaggaggcccgcatggatgaggagatgacggatttgctcgatttcttgggaggcagcggagccacgtga

SEQ ID NO: 88290 - DNA, 525 bp, Glycine max
  Peptide Sequence Number=SeqID_205068
atgcctcagttggtgtcctggcaccccccaaggcaggattttgtggcattgaatacaaatggaaatgtatcaagggaagaatgcaaagctggaactggaggcttaattcgtgagggaagtagcaattggctccttgagctatttgccatatttaagggactacaggaagcttggaatcatagctacagacagtacatattagccatatttttgtgggagggagatgcatttgatggtggttgcggtgacggtatggcagctatgtactctaagaatgagatgaatttgaaagaagttcttgatgggtatgataaagctgttgaggcattgggaaatgtttcaaatattaaagacgtgtatgttgaagatcaagaactggagatggaattaggattttgggaagtgagcatggatgaagccccttacctcaaagacataaacatgtggttatacggaggcttcacacaactcaaaccactacaaaacatgttcaaattagttgaccatagacgagagatgcagtaa

SEQ ID NO: 88291 - DNA, 206 bp, Glycine max
  Peptide Sequence Number=SeqID_205069
gtcattcctccaacctagttgaatttgtaccacctaacgaggaccctcacattgttcttgatggatttggttatatgcgtggtagagatgactataaggaatcatggactaaattcttcattgttggacctttggctttcattggcgaacctattggagtcggaaagaaggacgaaatattcttcagaaaaaagacggtgaaatag

SEQ ID NO: 88292 - DNA, 252 bp, Glycine max
  Peptide Sequence Number=SeqID_205070
atgtggggtcatcggctgaagaaaataatattgcctggtgcgcattccattaatgatctggccttcttcattctggctgattccccggatgctgtactgattataaaaacttacattggaaacgcctgcaacatttttcagtacatctcccagcctgaacgcctgcctgtcgttgatgagttctttggtaaccgtattcagcgtgagcggaagatctttgtttttcatcgcaatcttagtggctgcaaatga

SEQ ID NO: 88293 - DNA, 369 bp, Glycine max
  Peptide Sequence Number=SeqID_205071
atgtccagcgtagacccaggaggaaccatcaacatggtaactaaaaaacctttggcaaattcccgttacgaagtaagtttatcgggaggaagctttgatacctatcgcctttccgcagatgtaaccggacctttgaataccagtaaaacgcttttatatcgtttcaacggtgcccatcagcatgccagatcgtttcgggatcatgtaaaaaataacggaattttaatagctccctcgatctcctttatccctaatgatagaacatcggtgaatgtagaaatgatttacaacgaaatgaacggaaacctcgacagaggacagcctatctttggagcagttgccggaaaaaccgatctcaacagtactcct

SEQ ID NO: 88294 - DNA, 165 bp, Glycine max
  Peptide Sequence Number=SeqID_205072
atggacccaatcaatactgcacagaatgatgcatgcactgactcaacactcatatgcaatgtgggaattgtgctgagtttgtcgagaccacccgattatgcacgtaacagcccccctcccataggtgatcagcctgggagcccaaaggtgttccctaccaggtga

SEQ ID NO: 88295 - DNA, 882 bp, Glycine max
  Peptide Sequence Number=SeqID_205073
atgtccgcgtcctgctcgattgcgcccgattcgcgaatgtcggccatcactgggcgcttgtcgcgcgatcaccggcacgtgcagttccttggccaggcccttcagcgaacgcgagatctccgagatttcggtcgcgcggttttcgctgttgcccggcacgctcatcagctgcaggtagtcgatcaccaccaggcccaggtcgtgctcgcgcttgaggcggcggcacttggaacgcagcacttccggcgacacgcccggcgtatcgtcgatgaagatcttggtttccttcagcatcttgatcgcactggtgacgcggctccagtcctcgtcttccagctggccggtacgcaggcgctgcgcgttgatgcggccgttggaggaaatcaggcgcatcgccagctgcgatgccgacatttccatcgagaacaccgccacgcccttcttcgatttgatcgccgcgtactcggcgatgttcagcgcgaaggtggtcttgcccatggccgggcgcgcagccaggatgatcaggtcggtcggctgcaggccggaggtcatcgcatcgaaatcgttgtagccggtcggcaggccggtgatgttgccgccgttctcgaagcggctgcgcagctcttcgaaggcatccttcaacgcaccgggcatggccacgaaatcggtacggccacgtgcgccctgttcggcgatggcgaacacgctcttttccgccgaggccagcagctcgctgctgtcacgcccttcgggctggaaaccgtcgttgacgatgtcggtgcccacctggatcagctgccgcaacaccaccttgtcgcgcacgatttccgcgtatgccacgatattggcggccgacggcgtggtactggccagttcgatcag

SEQ ID NO: 88296 - DNA, 459 bp, Glycine max
  Peptide Sequence Number=SeqID_205074
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaa

SEQ ID NO: 88297 - DNA, 498 bp, Glycine max
  Peptide Sequence Number=SeqID_205075
gatcgcgcccgcaagacacccagtggacctggagaagtccaacagggtcatggggtttccagctctgattacgggcctttgtcagttctacggggtgcccgtcgccgccagcaaggcgtagggcgagacaccacaacagcctggagatggccggcagcgggcaacagatgcaccgccaccacctctaaagcccctcagctcatctacaaaggctggagcgttgcctatgactcgtggtcgaccagcaggcgaccaagtccaaagtcaaaggtagcgaaaataccttttgctatcatgacccgagagttcggtggcatgcggagacacccgacggtaacccgcacacaccctttgccatccagcgacccgagagtccggaagcatgcgggggtaccttatggttatccgcacctttggtcatctagagacggcgagtctgatgacatgcggggggtaccttatggttatccggacatttctgttaatcctgacccgtga

SEQ ID NO: 88298 - DNA, 246 bp, Glycine max
  Peptide Sequence Number=SeqID_205076
atgatggaaagggagatgatcacaatgatagtggacacgttaccaatgttctactatgagaagatggtgggttacatgccttcaacctttgctgatttggtttttgctggcgaaaggatcgaagttggtttgagaagaggaaaatttgatcatcctgctttgatgaataggaagcttgtcaagtggtggctggacagaaatatagaaatggcaataactgaagctacagggctccaaatgaggtga

SEQ ID NO: 88299 - DNA, 459 bp, Glycine max
  Peptide Sequence Number=SeqID_205077
atgatcttaaaagaagagttagctacttgcgcaaggtccaagaggagtttggctcaacacttggaagccacggagcaaagcatgctagctatcatagggcaatacaaggaagagttgaacaagtctgtgacccatgcacaaaagctagcggaggattttgcacaagtatacgccgaaaaagaagcaaaagggagggtgattgatgcattgcatcaagaagcgactatgtggatggataggaatttcatcataactaagaaaacaccaagtgtcgcaacctacccttcggcgggagggcgacgcgtgactcgcgggatgcgtgttccacgaaaggaatacgcgcggagtcgccaccaacgtttatttgaggaaaacgtcgaaaaaaccggaaaagacgcgatctatgaacttttaagtgaaaggctcgggagttgtatttacgcacggggaaggtattag

SEQ ID NO: 88300 - DNA, 862 bp, Glycine max
  Peptide Sequence Number=SeqID_205078
atggcaaggaaagcccggtcgtcgccatttcggtcatggatgaaacgttcgaccggggatgtgaaaagagcggggcgtctgttaaatggttccctcgctagaaggaaggaagaatcaggattctatcttcatgcgaaggatgtcccacgagaggagtgccatcagacgaaagcatcacgcctttcatcgcacgagctttcagtgaccacaacgcgagggtactccaaggagttcgcaaggcatgggatgcggcgtgaagaaaggacagagagcttaggggaagcagtaatgggatcatcagcggctatcactgtgagagacgatgaggttaaagcttcggaagaaagtgatgaggtacaagccctaaaggcagagcttgaaagagcccgggtagtcgaagagaagttcaagtccatagccatcaaaatgaagctttggaacgagaaacaagaaggcccgaaaggaagaacacgaccaaagcaaagttttgaggggctttatagggcagcaatagtgagctcaagctccgaagaggtgaaaggaatcatcacgggtcaaaggcatgatcttgaaggacgagctaaagggaatatgtgggccatcatcgataagtgcaaagagaagctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccacggacttctcagctatt

SEQ ID NO: 88301 - DNA, 309 bp, Glycine max
  Peptide Sequence Number=SeqID_205079
atgaccataatttgtctccgcatgtcatcgggtccgccgcctctggatgacaaaagacgcagaatgaccataacttgtctctgcgcgccatcaaacatgattgtgtctgaatggaaaaaggtgagcggaatgaccataatttgtctccgcatgtcatcgggcccgccgcctctggatgacaaaagacgcagaatgaccataacttgtctcgtcgcaccatcggacacaattgtgtctgaatggcaaaaaggtgagcggaatgaccataatttgtctccgcatgtcatcgggcccgccgcctctggatga

SEQ ID NO: 88302 - DNA, 156 bp, Glycine max
  Peptide Sequence Number=SeqID_205080
atgggtgtcaagtacctcgaggcggtcaagcgaaggttgcatgccaccaaacaatgctccccggacgaaattaggtatttcatgttagtatgcttttgccttgatcacgtggatccatgctcagttaaggtcactcaacattgggaaaagggttga

SEQ ID NO: 88303 - DNA, 240 bp, Glycine max
  Peptide Sequence Number=SeqID_205081
atggataaccatcaacatggaaatcatagtgatccagcacaagccaggataaagaaaaaaggtatcaggcagcacaaagttaattatcaggctcagaatattgattctaatattcctgattcatcagaggatgagagttctgaatcaacacaaggctctgcttcagtttcttcacctgaaaatcaaaactatatgtcctcagttaatgaggctgcaattaatagagaaggtaacaattaa

SEQ ID NO: 88304 - DNA, 1254 bp, Glycine max
  Peptide Sequence Number=SeqID_205082
gcgctggtcgcggcgccagcgctcgatctgcgcgtggtggccggacaacagtggcgccggcacttcccgcccttcccagacttcggggcgggtgtagtgcgggcaatcgagcaggccatcgagcgccggattgaagctgtcctgctggaaactgccttcgtcattgagcacgccgggctgcagccgcgcgacggcatccagcagggccatggcagcgatctcgccgccagaaagcacgaagtcgcccaggctcaactggtgcgtgacatgggtatcgatgaagcgctggtccaggccctcgtagcggccgcacagcaagattgcgccctgcccctgcgcccactcggccaccacggcatggcgcagcgtggtgccgatcggcgagaacagcaccacgggagccggctcgggctcgccggcatcacggcgcgcctgccgggccgcctccaggcaacgctgcagcggctcggccatcatcaccatgcccggaccgccgccgaaggggcgatcgtccacgcgccggtagttgccctgggcatggtcgcgcggattccacaggtgcacgccgacctggcccgaggcataggcacggcgcgtgacgccgctttcaagaaacggcgtgaacagctcagggaacagcgtgatgatgtcgaagcgcatggaggtcggcgatcaatagtcgggctgccagtcggcaacgatggtcttgcccggcagatccaccttgtccacataggcatcgacaaagggaatcatgcgctcgcgctccttgccatcctcttcataggccagcaccagcacggtctgcggaccggtggacagcaggtcgcggacgacgcccaggaccacgccctcgcggttgaccacggacaggcccagcagatcgacccagtaatactcgccatcttcgggctgcgggaaatcgctgcgcgccacgaagatgcgcgcgccacgcagggcctcggcggtgttgcggtcgttcacgacaggcgatgtggcgacgacggaatcggagtggacgcgcgcctgcttgaccggcagcagcaccgtaccggtgaactgccgcgcacccttctcggggggctgcagataccactgctttgcggtgaacagggcctcggggtcggcactgaaggcggccaccttgaaccagcccttgatgccccaggcatcggcgatacgcccgacctccacggcatcggcgggcaggacgctggcttcgagttcaggcatgtggctcatggcagtcggtag

SEQ ID NO: 88305 - DNA, 552 bp, Glycine max
  Peptide Sequence Number=SeqID_205083
atggcaagagtagcaaaagtggttaagatctcggcacaagagttagaccgagtgaaaaaaaatagaaatggggaggttgggataccaaggaagctcttggaggagaaggcaaaagctttggtagatcaaggagagtggacttcattcattgatgttttagcattgttggtgtttgggattgttctctttccaaatgtagacgggctagtggatttagcggtgatcgatgcttttcttgcttatcaccacagcaaggaaagcctggtcattgctgttttggccgatgcctatgacacactcgacctaagatgcgaaaagagcagcacgagaattgtccattgtacaccacctctttatgtatggttggtctcccacgtttttcgtcatgaaaatatacttgtttgtcccttacaaggtcgtcacatgtgtgtcgagaaaggaaaagcaaattgggaggaactcttggcaggtatggtaggagcatccgttagttggttccccgatgaaaggaaggaagggccgaagttttgtgctcatgtgaagggttcctga

SEQ ID NO: 88306 - DNA, 147 bp, Glycine max
  Peptide Sequence Number=SeqID_205084
atgcgagcattcgctaagcatgacactcagtggctaagcgcgaggaagaagccagaagaagatgagttgtcaggttcgctgagcgcaccactccaggtcatcaagtgcaccgctcaaagcagaagccgttctgagagcttgagatga

SEQ ID NO: 88307 - DNA, 171 bp, Glycine max
  Peptide Sequence Number=SeqID_205085
atgactaaagcacgtcaaaagggggtacggaaaaatgttacagaactttacggattgcgccttaacacgtcctttcaaactcccgacatgccgcggaacttcacgaactgtctaacgatgggtgtcaagtacctcgaagtggtcaagcaagggtcacaccccaacaaatag

SEQ ID NO: 88308 - DNA, 327 bp, Glycine max
  Peptide Sequence Number=SeqID_205086
atggaacttatgagactccatcaacatgaagagaatgatataaagagaaaaggaatagcactcagagtctcatcatcttttattcaagaagaaagtgacaaagaggacttgactgaaatagaagaagatgatgatgatttcagattctttgtgaaaagggaatcaaacatcattacaaagaagaaagaagaagattcctccttagccccaacatgctacgaaagcaatcaatctgggcacatgagattcgattgtcttgtctttaaaagaagaattgaaaaatccgacaagaggaatctcaaagaaaagaaagaaaagaaagcataa

SEQ ID NO: 88309 - DNA, 273 bp, Glycine max
  Peptide Sequence Number=SeqID_205087
atgaagacaacaaacacagctgcgaatggtacaaataatcaaggaactcctaagtggattgaagtcaagagtcatgttcaaagcggagggtatgagtgtggctattacatgatgcattggatgtggaacatcgtcagtgggggtttaaagaatgattggaccatgtggtttcttgatggaacgacgttagacaaggaaacaattacaacgattcgccagaaatgggcagcatattttcttaaagttcaaagcaatcaatgtacaaagtcgtag

SEQ ID NO: 88310 - DNA, 1173 bp, Glycine max
  Peptide Sequence Number=SeqID_205088
atgaccgccctggagaacgctggcattaccggcggcatggttgaacgccgcctgcaggatctgccggagcagctgatgccgatgattctgctgcggcagaacggcggcggcagcattgtgctgtcgcggcgcattcacaccaatgaggaaaatcagcgcgagctgcgcttccagctgatcatgccggaggtgagtgataaagcggtggagatgagtctggcggagctcaacgagatttacgccggctttgcggtgatggcgaaaccggcggcggtactggatgagcgcgccagcgaaatgctgccggaagttaaaggtcactggctgttcagcactctgtggcgctaccgccgttactaccgcagcgccgccattgccgccgtgctgatcaacgtgctggcactctccagcatcttcttcaccatgaacgtctacgatcgcgtggtgccgaaccaggcgtttgttacgctgtggtcgctggcgattggcgtcaccatcgccatgatcttcgaagccattacccgctttgtgcgggcacatctgctggacatggcgggcaaaaaggccgacctggtgctgggcagcatgctgttccgtcaggcgttgtcgatccagatggagcacaaaccggcctcatcaggtactttcgccaaccagatccgtgaatatgaatcggtgcgcgattttgttgcttcggcgacgctggcggcgatttcggatctgccgtttatcctgatgttcgttggcgtgatcttctttatcagcggtccgctggcgattattccgttgatgatgatcccgctgatcatcatcgtcagcgccgcgattcagtggccgctggcgcgcatcatgaaagagaacctgcgcgatgcgtcgctgaaacagggcgtgctgattgagtcggttgaaggcatggaaacgctgaaagccgtgggcggtgaagcgcatatgcagcgccgctgggagaacttcagcgcgctgcagtcggctaactcaatgaagtcaaaacgctattcgacgctggcaaccggcgtggtgacctttctgcagcagtttcagaccgtgatgctggtggtggccggggtttatctgatcaacgccggcactttcaccatgggtgcgatgatcgccaccgtgatgctggccagccgcgccactccaccgctggtgcag

SEQ ID NO: 88311 - DNA, 401 bp, Glycine max
  Peptide Sequence Number=SeqID_205089
gtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggtgcgacagg

SEQ ID NO: 88312 - DNA, 495 bp, Glycine max
  Peptide Sequence Number=SeqID_205090
atgtccggccctctcaatgagtcaatctcttgctttctcaaaagggtggacccttgggtactagtaccctcaccttccgaggactacacgtcctccccatcagaggactacacgtcctccccattagaggactacacgtcctcgccatcagagggattcacaccctcgccttcagagggctacgcgtcctcaccttcagagggctacatgcacgccctcagagaactatgcgtcctcaccttcagagggctacatgccctcgcctttagagggctacacgccctcaccttcagaggactgcacgtcctcacctttagagggctacacgtccttgccttcagagggctgcacaccctatcctttagagggctgcatgccctcgctttcagaggactacacgtagtcgccatcagaggactacatgtcctcgccttcagagggctacacgccatcaccttcagaggactacacgtcctcacctttagagggttgcac

SEQ ID NO: 88313 - DNA, 1122 bp, Glycine max
  Peptide Sequence Number=SeqID_205091
gggctggaaaacttgcagcgcctgccgacggtacaggccagcatggaaattgttccgggcgaaacgcctgggcaaagcgatattgtcattaaccgccgacaggaacgcttctggcgcgtcgacgcctcgctcgatgattccggctctaatgccaccggccgctatcaggggaacctgacgctgtcactggatgacccgctagccttaagcgatcttttttacctttccggctcacataacctcgacggcaacggcggtaaatcctcaaagaacctgaccggccactattcgattccgctgggttactggcagctcggattaaccgccagccagtacgattatgtgcaaaccgtggcgggggccaacggcgattaccagtacagcggtaaaagcaagaacgttgatttccagatgagccgcgtactgcaccgtagcggtagtcagaagaccacgcttagcgccgatgtgttagcccgcgagcagcgcaacttcattaacgacaccgagattgccgttcagcggcggcagacggcggcctggaagcttggtctgcagcatcgccattacctgggcaacgccactctcgatgccggagcgagctatcagcgcggtacccgctggtttggcgctcagcccgcgccggaagagcagtggggagaagcaaccgccctcagcaaaatcctgcaattcaatgctcagctcaatttgccttttgccctgggcgggcaaaattttcgctttaccagccgctatcagcggcagatgagcagcacgccgctgacttcgccggatatgttttccatcggcaaccgctggacggtacgcggctttgacggcgagcgcaccctgaccgccagtcacggctggtacgtacgtaacgatatcgcctggtcgactccgttgccggggcaggagttttatctgggggcggattacggcgaagtcggcggcgcaggcagtgaaacgctggtgggcaaacacctcgccgggggcgtggcagggctgcgcggccagtaccagcgcgccagctacgacctgttcgccggtatccctttagccaaaccagatggctttaaaaccgacccggcgacttttggtttcagcgtcagctggaactactga

SEQ ID NO: 88314 - DNA, 168 bp, Glycine max
  Peptide Sequence Number=SeqID_205092
ctcaaacatgatatcaaaattcccaacggtgaaaatgctcggaactgggttgcaaaagtagtgctcaaatttcacgatgatccaacggtgaacgagtccaagatcgtcatttttctgagacaggttaggtggcctgtgggaaaaagagaggattttgagagaagatag

SEQ ID NO: 88315 - DNA, 258 bp, Glycine max
  Peptide Sequence Number=SeqID_205093
atgtcagggtttggccagcggttcggggataaaggggacgtcccacattatttccatgatacacatgcaacaatgatgattaggaaattttatgcaaaactggtcatgcatgcacctatgtggacactcaagcatcaagggaggagcttgccacccagctcgcccaggcgagctcagctcgcccaagcgagcaaggttgcttcctccagaagcaacaaccttctggaggaagaatcaggaaggcccaagtgggcctga

SEQ ID NO: 88316 - DNA, 417 bp, Glycine max
  Peptide Sequence Number=SeqID_205094
atggcttctccacctagctcgcctcctcctcctcctccttctccttcagacacatcagtttcaccgtctgccgtgaagcggacacgtaaagccacacatctacgatccttgtctactagaccacctggtgctgagagaccagtggtccacattgatcctgctaccggcaaggccgacggtggacgtcacgtacgagaactggaaggaggtccctactgctcagaaggacttgatttgggaggatattcagaggcttctgatgataggacaaaaaagaagttacttcacactatcggcgagagatggaggcagtttaaatcagacctcataaggaaatgggcccttgcagccgatcaggacggtgtagacgacactgtctgtgagaaatacggcataagcaaggaaaaatggtcctag

SEQ ID NO: 88317 - DNA, 459 bp, Glycine max
  Peptide Sequence Number=SeqID_205095
atccctgacgctgtaacgtctctttatcttacccttgccggtctaccacccccgggaaatgtccccaaccaaacacccccacacttggcccgacttcttgctttagcaacccagaaatttatcgcggatatcgccgcggactcctaccagtacgcgcgtattcgggcttctaatagttcctccgccagcaacccaatgggcagtcttaacgctgcgtcgggtctcggtatgcccgctggtgcgtctggcgcaggtgcagcaagtggtgctgctggcgcttcgggtggagatgcaggcaagggcaaagccaatacacatttgggaattcaaaggcccggctttggcggtggtggctcaggaggctcagggcagggacggacggtgctcaccatggaagatctgggaatggcggttgccgagtacggcgtgagtgttaagagaggcgagttctaccggtag

SEQ ID NO: 88318 - DNA, 177 bp, Glycine max
  Peptide Sequence Number=SeqID_205096
gtcttaggaggagtcagctcatcctccccctctactgctgctgttggctcctctggctcaggctcctgggctgtggaggccccaccctctccagaaggagaaggctgggctcctggccatgctacctgcgtgtcaaactcatccatgctcatgatggatggagggcccatgctctga

SEQ ID NO: 88319 - DNA, 573 bp, Glycine max
  Peptide Sequence Number=SeqID_205097
atggatcaattgttcacaatgatactggcgtttacttccaaacttcaaacttcggtgcccattcgagtaccaaatagttgtgattttgcaagccttataaccagaatacacaatacccttcaactatctgacaaacaatttttggatgaaattcactaccggaagccattcaccgatacaggtaaccaaattcgctttcagtgtatgaagttgataaatgatgacgatgtcaacacaatgttaatgtgtaatgatcaattttcttgtgttggtccgattgagttattatgcaccgttggaagaacaccagatgaaataataaacttacttgaacgcactatgccccgtactcatgacgcgatcctgtattacaacgggaaatggaacatgccaccgcagaacaaatttgttggatgcgcgttcataggaaaaaatcctaagaaatttcaaattccttcaacatgtaccatcgatgaactgaagaatttaataaagcaagttgcacctaaagggattccccctcttggaattcacgaatcacaaacggtgttatttgatggaaccagggaatga

SEQ ID NO: 88320 - DNA, 195 bp, Glycine max
  Peptide Sequence Number=SeqID_205098
atggcttcatcttttctccgtctctctgacgtttgggaattctatcggagcagtcagaggagtaactggaggaatctcagggaaccgctagagatgctgctatcgttggctgaagacactgaattatatatgtttgatgaatcagttgatgtcccaatgagaaattgctatgaaattgatgtgttcttgtgttga

SEQ ID NO: 88321 - DNA, 705 bp, Glycine max
  Peptide Sequence Number=SeqID_205099
atgaagaaaattctcaatatcattgcattattcgtattctttctcggttttggccagattgataatatagcagatggcgaatctattactttcaggattcattacggaatactaactgccggaaatgcaacgcttacaactcaaaaaacaacttacaaaggagctccccacctctatgtaaaaggaacggggcaaacctccggtgctgtaaaagctttttttaaagtggatgatctttatgagagtttcattgatatacagacgggacttcccagtttctacgttcgaaatgtaaaagaaggaagctatcgccaacattttgaaactgtgttcaaccatgacaacaatacactgatcctgacggataaaaaaacaccggctaacggctccaaagtaatcaagtctgtaaaaggaatacaggatatgctttcctgtttttattatctcagaagccaaagccagacggagcttaaagtgggtaccgaaaatttaaagacaaagttcggagtcatcaattgcttaaaaatcgttccgtcagtaatgagtggaagagtatttaaagataaagagggagtaaccatgtgggtttctaatgatgctaatcacgttcctatgttacttaaagctgaattagctgtcggttctttaaaagcaagtatcgacgattttaaaaatgtaaaataccccttaaggttttctaaataa

SEQ ID NO: 88322 - DNA, 228 bp, Glycine max
  Peptide Sequence Number=SeqID_205100
atgagtcttcattcttcatctagtgttaatggtgagggttctactctgatgcaatcctaccccgcaagggcattggatagaagaatccaagtagattgggctagagatccaagggaaggccctaggattctcatgagcctaaggctaagctctagcttctttaggaatcttcttaaggaatcttctcaaggaggtgagcttagttatgagaggggtatgcgtatctaa

SEQ ID NO: 88323 - DNA, 330 bp, Glycine max
  Peptide Sequence Number=SeqID_205101
atggatcatgctggtgaggaaagaaagttgcaactgagtgagttagatgagatccgcctagaagcgtatgagaatgccaagttctacaaagaaaagaccaagaaattccatgatagcatgataattaagaaggacttcatgattgggcaaaaagtgttattgtataattctatgcttggactcatgagtgttgagatcaaaagcgactccacacacaagagcttcgaggtcaatggacaccgacttaatccattcctcacaaacccttctttagtggacgtagtggtggaggagacttcattactccaccctactcttcctccaccatga

SEQ ID NO: 88324 - DNA, 179 bp, Glycine max
  Peptide Sequence Number=SeqID_205102
gatgtttctactctacaacagttggaggattgagatgctatgagaatccaaagaaaaagattactgcagtacctgccgaggaagagcaaatctggggtgcattcttcaaggtaatcttagagcttaagaagttagagttgaatatccattacgtaactaggattgccagttgcaattaa

SEQ ID NO: 88325 - DNA, 321 bp, Glycine max
  Peptide Sequence Number=SeqID_205103
atgggaaagacacatgaaattccccaccacaatctagccgacttcgagccttggctcggatataccaccgaagggcaagcagttggtggtataccctacaacaccctttggagggccctcagtatcacccacaactgcacctcttgcattccgcagcggttaaaaaccctcatgactatggcaggaatgggaaagttggatcatctaaaggaaaggctcagggccattgaaggaagtgaagattatgcctttgctaacctaggaaagttgttcctaatacccaaacatggtcattcccaagttcaaggtgctggactttga

SEQ ID NO: 88326 - DNA, 192 bp, Glycine max
  Peptide Sequence Number=SeqID_205104
atgtttgtattgaacagtgctttgaaaggatttgacgatactccacaaagtaaatccaaggctgcagctaggtggattattgttaaatcaagcaagtcggagacccaacatggtatctacaaaatttactcacacgttattgaaacaccaccaagcaagtcggagacccagcatggagtgcatggaacgtga

SEQ ID NO: 88327 - DNA, 298 bp, Glycine max
  Peptide Sequence Number=SeqID_205105
gggattccacgtcaaagaattcaaatgcttacaaatctttctttgcataccccttattttctcacattcaactcaacaatcaacacatactcttgtgggttgacgttgctcatagctccattgatgtgtatggagcagagacagagaatggagttaacagaagaatgaataggagaagcaacatcatcactattgaaacgagacaaagaagtagtggtggtgctggtgctggagttgactttgtcaaaggaaacaaagacaaaggagagggaatgttgaattttgtcgaggcttggag

SEQ ID NO: 88328 - DNA, 960 bp, Glycine max
  Peptide Sequence Number=SeqID_205106
atgaatatagcatccgatccatttacaagttctaaggtcactacaacttttcaagaagcttcccaacatggtttgaatgtagcaagaacatgggcattcaacgatggaggttacaataatgcccttcaaatttctcctggttcttacaacgagaatgtcttcaagtataaagttgaaagtaaaaataaatctttcatggagatcttgagcacatgtaagggattggattttataatttcagaagcaggaaaaaatgggatacgactgatactaagtctagtaaataactggaacgattatggtgggaagagtcagtatgtccaatgggcaagagaacgtggtcaatatgtaaacaatgatgatgacttcttcactcaccctattgttaaggaatactacaaaaatcacgttaaggattgggtgagggagaaggccgcctatgtgaagtctattgatagcaatcatttacttgaaggattttatggtgattcaatgctggaaaagaagcagttcaattttggaaatcaagtaggaactgatttcatttctaacaaccaagttcctgaaatcgattttgccaccattcatctttatccagatcaatgggtatcaaactctggcgaaactgctcaagatgactttgttagcaaatgggtgcaagcccatattcaagactcaaacgatgttttaggaaagcctattcttcttaccgagttcaaaaagtcttcaaggtcttcaggatacaatgttgataaaagggatagttacttagggaaactatacaatttcatattcaacagtgctagcaatgggggcccatgtgcaggtggacttttttggcaactaatggcccaggaaatgaatggcttgcatgatggctatgaagtcatctttgatgagaatccttcaactgccaatgtcataactcaacaatctaaaaagatgtcaaatcttgaataa

SEQ ID NO: 88329 - DNA, 483 bp, Glycine max
  Peptide Sequence Number=SeqID_205107
atgaccggaaggctgcttgccggttcattggctcttgaaagctgcatccttcactatcttattgttcgtatcttactcccaagatcttcaaaccttgcacaggtttctgaagaagatcttatagtcatgtgggcctttcataccggccgacaaattgattgggcacatttagtctggtatcgcatgcataaggcattgcgattaaatgctctcttaccctatccacatttagtcactcttttccttcaacattttaacatctctcttgattctgaacgttatgttcaaatcaagagatctttcttgattggtgctgttgtggttacgtcctttggttaccgcaaagagcgtgatggatcttggagtattttggacaggttcgatggactccaaacctatgttggtgaaaggtttgatgctttggaacaacaagtggacatgcaattcgatgcaatggactcaaggatcacaaaggttgagtaa

SEQ ID NO: 88330 - DNA, 709 bp, Glycine max
  misc_feature (674)..(674): n is a, c, g, or t
  Peptide Sequence Number=SeqID_205108
gacgtccccgcgctgcggcgcccgttcggcagcccctgcggaagctttcgccggcctgctgggtacggccacggcgctcgtcgatgccggccatcagcaccagcgcatcaggcgattcgggtgccagcttcagcgcctcgcgcgccttgcgttcggccgcatcgaggttgccgacctgcatgtcgcgggcggccagtgccagcaggtcctgcaggcgcacctgacgccgcacgttgtccggatcgcggaccgagtagaccggcgcttcgctggggcccagcctggccttgggttgggatttgcagccgccgaccgcaacggccagcacgcctgcgagcagaaccagccagaggcgcgtcttgttgaactccgcctggcggcgggtgcggtccatcacctggcccttgagctggccacaggcagcgtcgatgtcgtcgccacgggtgcggcggaccatggtcagcacgttgttgtcgagcaggatcttctggaaggcgcggatatgcgcctcttccgagcgctcgtagcgggtacccgggaacgggttgaacggaatcaggttgaccttgcccgaatccttggcctgcaccgcgttgtcgaactggcgcatcaggcgggccagctcgcgggcatgctcgggcttgtcgttgatgcccttcatcagggtgtattcnaaggtgaccgattcgcggcgcttgttggcgcgcag

SEQ ID NO: 88331 - DNA, 407 bp, Glycine max
  Peptide Sequence Number=SeqID_205109
atggctccgaagaagctttccacaaagaggtctaggagagacgccacggcggaagggtccaatgctgcccccgagtttgatagccacaatttccggagcgtcgggctccagcagcgcttcgaggccatcaaaggatggtcgttccacagagagaggcgcgtccagctcagggaggatgagtatacaagtttttggggggagatagctcgcaggcattggacgtcacaggtgactcccatggctaagtttgaccttgaggtagtcctggagttttatgctaatgcttggcccacagaggagggagtgcgagacatgcgttcatgggtaaggggtcagtggattccctttgacgcagatgccttcagccagttcctaggtgacccgctagtgttggaggaaggccaaca

SEQ ID NO: 88332 - DNA, 534 bp, Glycine max
  Peptide Sequence Number=SeqID_205110
atggagaccacaagtggtgctggtaataggattggttataggagtgcaagaagattcaagggggagagaaataaagatgtcacctacgaagaaggctcaaattttttgaagaaattgaagattttcctaggctgcatgttttttagttcaaaacaggaagactcgaggagtgacaagagcagacagggaagaaatgttacaaatgatttggttagacaccaaccagttacccaaagatccttatccaccaaaaggtcaaaaagatcctcagccaccaacttaagccaggaaataatccaagcttcttcccttcgaagattcacctttaatgatcttaagttggcaacaagaaattttgagtctaagaatcttcttggtgaggggggttttggaactgtgttgaaaggttgggtcaatgagcatgagaactttgcagcacgacctggaacagggactccagttgcagtgaagactctcaacccaaatggatttcaaggtcataaagaatggcttgtatgtgacgtaccattctaa

SEQ ID NO: 88333 - DNA, 350 bp, Glycine max
  Peptide Sequence Number=SeqID_205111
gaagaaatgttacaaatgatttggttagacaccaaccagttactcaaagatccttatccaccaaaaggtcaaaaagatcctcagccaccaacttaagccaggaaataatccaagtttcttcccttcttcgaagattcacctttaatgatcttaggttggccacaagaaattttgagtctaagaatcttcttggtgagggggggtttggaactgtgttgaaaggttgggtcaatgagcatgagaacgttgcagcacgacctggaacagggactccagttgcagtgaagactctcaacccaaatggatttcaaggtcataaagaatggcttgtatgtgacgtaccattctaa

SEQ ID NO: 88334 - DNA, 879 bp, Glycine max
  Peptide Sequence Number=SeqID_205112
atgaaaattgagcatgtcatcaaatctcacaaacttaaaaggtttgttgtgcatccgcaaattccgttacgatttctcactgaaacagatcgtgatgcaggaattgagaaaggcgtgatgcgagccaaagcaaggcagcttcaaactgaattgcatgagatgatgcttgaagacaagtcgatgcgtaagttttttcttagaatcaaagaaatttccaacttacttgcctttgtcgaaagttccatttctcttcaggaacacattaatgctatacttgaagggctttcgcaagattaccattcagtaatctcagttatcgataataaattccaacctcttcctgttgaagaagttgaagtgaaccctaactcttctttgtcgtttggttttgatccttatgcagcatcgaacaaattttcccaatggtatgattcggagaactttcgtggtaactttggccgtggtggaagttttaatagaggcggtcgcgtggtggtgtggcggcggttgtggccgtgtaggaggatgctttgcaaattttcaatgtcaagtgtgttacaaatattggcatacagcatctgtctgtcactattgtattcaaatcaaggaaataactctggtcaaaataactatggacaaaacaattgtttcagatcatcaaattcatggaatcaaggaaccaatcagaacaggtcaatgcagagcagtcagaatcaacagcctccaagtgcaatgattgcaactccaattttcagcctggatcctctacaacctggattccagattcagggagccaatgaagtcttacttcaaggctcactaggacctgatggtttatgtctttccaaatcttcaactccaaggctcaactgctgctag

SEQ ID NO: 88335 - DNA, 972 bp, Glycine max
  Peptide Sequence Number=SeqID_205113
atggcgtcaatacctccttggacaccaattcatgatcctgacagaccattgaagtttaaaggaattgatgacccagatcattcaaacgccagaacaacaatactatctatccaaattattggggcaaattttacttgggaccatcttgggcgtgatgttaaatcattcataaaaaattgtcaaacttgccaacaaatcaaacatgccactcgcaagctagctgggttattacaaccacttccaatcccaactggtatctgggaggacttatctctagatttcattacgaatctcccaagttctcagggttacactgtcattctggtcatggtcaaccaattttctaaaggcatgcattttggttccctttcttcacatttcacgacttttaaagtggctgctctgttccttgatacagtctataaactccatggatttcctaggagcttagttttcgaccgtgacccaatatttgtgagtcaattttggagcgaactattcaaattaagtggttcatccctccagatgagcattgcttaccacccacagtctgatggtcaaaccaagttcttggccctcaccgaatggtcatacaatatgtccactcactctagtacagggttaacacctttcaaggtaatctacagcaagcctctgtcgtttgtcctaggatatatcttgggctcgtcccgaaatgaagttgtggattccatcctcatgatccgagccatccttcataatgctttgaaacactgtctcctaaaagctcaggagaacatgaaaagactagcagatgccaaacatcatgacgacaacttcaagttataccacgaccctcttccaccaagctccatgccagttccacctttggcatataatcatcatcctattctggaaccactttctattttggctcataggatggacaccacaaccacacctccaacacagatggtcctagtgcaatggtag

SEQ ID NO: 88336 - DNA, 303 bp, Glycine max
  Peptide Sequence Number=SeqID_205114
atggcggaggaggatattgctaaaatggcatttcggactcaccacagtcactatgagtaccgtgtcatgcctttcgggttgtgcaatgccccatctacttttcaagccaccatgaacgcagttctttggccatttttacgcaagttcactgccattttcttcaatgatattctcgtctatagcgcatctctgtcggcacatctcattcacttggaacagactgatgcttccggcagcgccataggcatcgtcctaatgcaaaagggcagacccattgctttcttcagtaagcaattcagctag

SEQ ID NO: 88337 - DNA, 522 bp, Glycine max
  Peptide Sequence Number=SeqID_205115
atggtcagggatgctaatcatgctttgcttatggaagggctgcatgatttgtggtccaagtcattaggaccaaatatagatgtggcaacatgggtattcctattgttaataaggagaggcttggctcaaacttctggaaaagggattgttagttgttgggatgatatagggaagaacatgtgttggcaaattggtaatggtaggattgtctacttttggaaggataattggatcccaactcttgggagtctttgtgaccaagttagcagtagtgacattactagccagatcgagttatcaacttgtatgtttgttgaaagcagtgggcaatgggatactaggtatcgtgggaactttctgcctcacagcattattgataaaatatgttctataaacctgcctttggggtcgaaaggggaggacactgctgattggaatttatctagtgatggggaattctccaccaagttggcttatgagagtattattggttgtatgtctaatgttgatatagggaaatag

SEQ ID NO: 88338 - DNA, 486 bp, Glycine max
  Peptide Sequence Number=SeqID_205116
atggtaatccacgcacatccgccaatagccatccttcttctccgccaggagcactggggaggaaaaaaggttgtggctaatacgaatcatgccagaacaaaggtatctgtaggggcaaacatttacgaggctggtggaaggctaaagagatatatgatgaacaatgtcgcgagatggggtaagggatgttggagtgaggaagatggggcaaatttggtcctgatggaacaaagaagatatggatccattttggaccattcgtttaaactacttggcagagcatggataggcccacttggaacatcaacgcaaatttctacagaaggaagggaatgttggcaccatcccaggatagagccactgcctaccatgacctacaacgatgatgtgtcctccatggataaggttaaaaacttggctacccaaggttggataaaactgtgggtactgccactgtttataagaatagtgaggcatgcctggtga

SEQ ID NO: 88339 - DNA, 537 bp, Glycine max
  Peptide Sequence Number=SeqID_205117
atggcggaacatggtactcggaaaacaaccatcgacagacttgaagacgcttcatcccgtttaaccgtccaccatgaatcccttgcatccaaacattcagacctcgcctctaaggttgatacccttcacaatcaagcctttaaggtcggtacccttctcaatcgcctcaatcacctacacaccatgcctacagtcccaccaatctccccccacccctcgcgtcctcatgtcaaactagacgctatgaggtttaatagcaatgaccccttgggatggatctttaagatctcccaattttttgactaccaggggatgccagaggaggagtgcattaccgtcacatcgttatacaaggatggtcccgctctcagcaggtttcaatgttcaaactggaacaacttcatcacctcctggccaggcttcctgcaagccttggagtcacattttgctccaacgtattacgatgatcctaagggcgcgctattcaagttatctcaacgaggttttgtcaaccaatatccttgtcgcaagccatga

SEQ ID NO: 88340 - DNA, 234 bp, Glycine max
  Peptide Sequence Number=SeqID_205118
atggggcgtggaatgctcaagattacaacagtgcaacttgttgatgatgaagacatcaaagaatttgatgctattaaggatcaacctcacccgtatttgagtatccctccaatagagcctacctcatcaacccaaccaaatgagcttgagtttacaatagagtttgtcttacctaacaaagaacttgattcctttagtgaggacgaagatgatgttctacacaatcaaccctaa

SEQ ID NO: 88341 - DNA, 432 bp, Glycine max
  Peptide Sequence Number=SeqID_205119
atgcactgcaaagcatggttgggaaagcaaaaagctattgaaaacatctacaccaactgggaaagattgtatcacgatttaccgagattattgcaagttaagcagcaatttcttcctggtatggtcgcggggaaggaaacactgccaatgccaccacaagaaagtcaagcagtagaggagtttcagactgtgtatcaatgggtttcaatattgcaagctcatggtttaggtcgatggaacataattgtacgaatattgaaattatatgtttataactactcaacatatgcaaggataaaacctacattcaatcaccactacaacattctgagagaggaagtagatattgatcaagcaattaattggctcaatgagatttcacgagaaaaatggactttccatggcatggtggctgacgatgggagcacatga

SEQ ID NO: 88342 - DNA, 342 bp, Glycine max
  Peptide Sequence Number=SeqID_205120
atgagggcggtggagttcgacggcgtcgagttccatgggagggtgctgacagtgaagctcgacgacgggaagaagatgcgggagaggagtgaagagagggcgcgctggctgcaagggaatggtggtgataagggagagtacccgtccacgaggcacaaggagagggacgggtccaggaagagcttccagaaggttctggaaacccagccagagaattggcaggccgttgtgaccgccttcgagagaattaagaaggttcattatcttgttctatatgctattcttatattagttgttgcttctattaactctttactctgtttagaagggttgcttgtgtag

SEQ ID NO: 88343 - DNA, 408 bp, Glycine max
  Peptide Sequence Number=SeqID_205121
cctgctagaaaagaatatggcttgatggttaaatattatgcacgacgaggggatatgcatcatgcacgccaaacatttgagagtatgcaagcaagaggaatagagccatcttcacatgtgtacagtagtcttattcatgcttatgcagttggtagagacatggaagaagctttacattgtgttagaaagatgaaggaggagggaattgaaatgactatagtgacatacagtataattgtgggaggattcgctaaaatgggcaaggctgaaactttgataccatgccaaagggaaaaattgaaaggtgtccagattgatttttatgcggctagcgtagactttcattttggttccagacttccagttcaatgcactggggtaaatcttttaagtttaaaggatagttga

SEQ ID NO: 88344 - DNA, 222 bp, Glycine max
  Peptide Sequence Number=SeqID_205122
cgagcattcgctaagcacgacactgtgtgcctaagcgcaaggaagaatccagaagaagataagctatcaggttcgctgagcgcaccgctccaggtcatcaagtgcaccgcctcagctcatttgctaagcgagagaagggtgctaagccacaatccacttatgtgcgctaagcgatccagatttgtgctaagcgcgcgagcacggaccaacccacctatttaa

SEQ ID NO: 88345 - DNA, 780 bp, Glycine max
  Peptide Sequence Number=SeqID_205123
gatgaggcagcaaatgtagtccgaaagcaggcagtcatcaccttgccaggcccagttgtccccttcgtccttgtacaaagcatccaggtcaagcacggtttaccattgctaggagaccttccggtactcggccagggtggtgtggggccacaggccgcgctcgtgctgctggtccttccagaagttgtagtagtagtcgccgatcttctgcacgccgggaatcttggcatcggagtcgagcacctcgcggatgctggtctccatctgcttgaaggccggggtctgcgccaggcgcgcctcggacttggcgttctgttccttgacccagccaggcgtagcgatcggtgtcttcagcggccacggcggtccccaccgaggcagcggtcatcatgccggccagcaggcaggcggaagcaagtcgagacattgcagctccaggcagtcataagccgtggaacgctagcatggatcgccgcggccgcccccgtgtcgaaggtcaggccgcggcggtcgagccgcgacggcctcgcaccgccccgccgctacggcgacgcgcctgtccaccggtacgacgcgccagccgcagccacgacaagcgcggcaacgggaagcgcagcaacgcccaccaggccaccagcggcatgcccaccagccacatcggcagccaacccagccaggcactgctgccgcgcgcggccggccagaccagtaccagtgccacgccggccagggccagctgctgcacgctgcgcagcaggcgggggtcgtgggatcctctag

SEQ ID NO: 88346 - DNA, 488 bp, Glycine max
  Peptide Sequence Number=SeqID_205124
cgcctcgggtcggtagccgggctccgggacattactaccacggctactatcgacccgagcccaaagaaggaaaagaacggactaaagcgaggagttcattggccatacatagtgaagggggatgggggtcaacctctttcatgacccatggccccattgagacacgtttttcggatatggattttttcgagatggttaaccacttttttaaccgtgagagggaggtcattcagaacccgctggctccagtccagaaccggtggaagttccccacgccgatcccccaacggcggctttccgttcactttccggaaattgaagaaatctattccagtgtcgcagagaacattatgtctcgcgatctggaaatatctgcggagatttctattgaaccctccgcggatggagccgggaataacggctggcatagaagtctctcgcacgcaaggagatgcatttctggtactggacaagctcttagggaataa

SEQ ID NO: 88347 - DNA, 171 bp, Glycine max
  Peptide Sequence Number=SeqID_205125
atgtatttacatcaagatggcttcctcttgaagctcagttctttgccagctcatccttcttctagattcttcctcgcgctcagccgcaagagtggtgcactcagcagatggatcgctaagccgacagattggcttagcgagaagctaaaaattagcacttcacaaacttga

SEQ ID NO: 88348 - DNA, 301 bp, Glycine max
  Peptide Sequence Number=SeqID_205126
atggagcagaatcgtctcaggccacggttagaagtcaagacaagtcaatggcagaaatcaaccaaggatagggtcacggccgaccgttgtcccttcccgacgctagacaagcagagaacgacgctgcatggcagcccagcaaacgctaacccgggtggagggggaacgttttcttcacccaaaactcttccccctcacttcaaaaaccctcaagctcatgggaactacgagaatagcagcccccaagcttccattgttgagtttttgcttcccttttcacgctttaattcactccccacaa

SEQ ID NO: 88349 - DNA, 270 bp, Glycine max
  Peptide Sequence Number=SeqID_205127
atgtctcctccacctctaggacctctcaatcactcacaaactcagctcatgctctcaggacggcttccttttccagctctggtctctgcaaatcttcacacaacaaaatctctcaaactctctggaatttggacctctctttctagaactgaagacatgcaagagatcctcaagaaaaatggccaaactccccctctaaatatgattttaggcttaaataggtggctttgttcgtgctcgtgcgcgaatggactgaagcagtgcgcttag

SEQ ID NO: 88350 - DNA, 381 bp, Glycine max
  Peptide Sequence Number=SeqID_205128
atggagggaaaggagcaaaatgtttcattgggagccaacaaattctcagagaggcaaccaattggaactgcggttcagagccaagacgatggtaaccgtcatggttatgcagccaccgatgccaagtgtaacgctagagactcacacgtccctattttggcacccttgccaattgggttcgctgtgttcttggtgcacttggccacaatcccaatcactggaactggtattaaccctgcacgtagtctcggtgctgccatcatcttcaacaaagaccttggctgggatgatcactggattttctgggttggacctttcgttggtgcagctcttgcggcactttaccaccaagttgtaatcagagccattcccttcaaataa

SEQ ID NO: 88351 - DNA, 1407 bp, Glycine max
  Peptide Sequence Number=SeqID_205129
atgtcttattcttcttcagcttttccttctgtggtctcaaaatgcaccgttgtccctcaccggaactcaactatgggagacctcaagctctctatctccgaccttaacatgctcttatctcactacatccaaaagggatgtctcttcaccactccttcacttccctcttccgctctcatccctcacctcaaaaacgctctttcccaaaccctctctctcttccctcccctcgccggccgtctcaaaaccgacgccgacggatacgtctacatcacatgcaacgacaccggcgtcgacttcatccacgtcaccgccgccgatatctccgtcgcagacctcctctccccgtcgtcgtcgtcgtcgtcgtccgatgtccctccaatcttcaaacaactcttccccttccaccacaaaatcagttacaccgctcattcctccccaatcatggccttccaggtcaccgacctcgccgacggcatcttcctcggctgcgccgtctgccacgccgtcaccgacggcgcctccttctggaacttcttcaacaccttcgccggaatctcaagaggagccaccacctctccctccaccctcccggattttcgccgcgaatccatcctcaactccaacgtcgtgctccgcctgccagaagaaatcaaggtgacctttaatgtagaggagccttttcgcgagagaatcttcagcttcagccgcgaatcaattcaggaactgaaagctactgtgaacaataatggcttgacatcgtttccgccgccggagaatggtgacgcggttgagttgatggcgaagatgagcaacgacacgcaaccgaaaacggtgacgacgacagagatttcgtcgtttcagtcactgtgcgcgttggtgtggcgctgcgtgaccaaggcgaggaatatcgaggggtctaaaacgacaacgttccgcatggcagttaacgttcgccaacgcttggaacccaagttgggggactgttacttcgggaacgcgattcagagcattgccacgtgtgcagaagctgctgatgtggcgtctaaggagcttcgctggtgcgcggagcagctgaacaaaagcgtgaaggcgttcgatagtgctacggtgcaccgcaacgtggaaaattgggagcgccagccaaagtgcttcgagctggggaaccacgacggcgccaccgtgcagatgggaagctcgccgaggtttccgatgtacgacaatgatttcggatgggggcggcccttggccgtgcgcagcggcggagcgaacaagtttgacggcaagatgtcggcgtttcccgggaggaatggcggcggcgccgtcgatttggagatggttttggcgccggacaccatggcgagacttgagtctgattctgagttcatgttttacgtgtctggttag

SEQ ID NO: 88352 - DNA, 351 bp, Glycine max
  Peptide Sequence Number=SeqID_205130
atggagctcaagttgcaaaagcagctgaacaaaagcgtgaaggcgttcgatagtgctacggtgaaccgcaacgtggaaaattgggagcgccagccaaagtgcttcgagctggggaaccacgacggcgcctctgtgcagatgggaagctcgccgaggtttccgatgtacgacaatgatttcggatgggggcggctcttggccgtgcgcagcggcggagcgaacaagtttgacggcaagatgtcggcgtttcccgggaggaatggcggtggcaccgttgatttggagttgttttcggcgtcgaacaaaatggcgcgactcgagtctgattctgagtttgtagggacacgttag

SEQ ID NO: 88353 - DNA, 231 bp, Glycine max
  Peptide Sequence Number=SeqID_205131
atgctccaaccatgtgggattggcacaaacttaaaggagcactcaaactgggtgacccccaaggcctacactctaaagagttcgtcagggcctctccctcctgattcagacaatgttcatgaattatacaataccaacaacctcacacttatatttcaaacatgtttaacaagttgcgctacagttcaacccttcaggatcctaactaggaatcctacaattttcctttaa

SEQ ID NO: 88354 - DNA, 702 bp, Glycine max
  Peptide Sequence Number=SeqID_205132
ctgacagcagcatcgacctagccttggtgaaggagttctatgccaacctctacagtcccgaggggccttccctaaaacaagtcagaatccgaggccacttgataaaaattgatgcagacagcctcaacaccttcctggagaaacctgtggtacttgctgagggagaatccttacccgtttactccagatactacaggaagcccactgatatcagagagattgaggcagctttgtgtatacccggccgagggtttggtttaaatgatgaaggccatcatgggaagatcctcaagaaagatctgacaactcttgctcaggtttggagtgttctcctatgctccaacctggctccgacttcccacacctcggatttgactttagatagagctaggttaatttttggcctagtttctcagctggacatgaatgtaggagctctcatctctagccagatcacatctatggcccaatctaactcctctagacttgggttccctgctcttatcacagctctatgtaggtccagaggggttgcttctgatagcctagtctttgaacgcttgagcctagtcattaacttggcctatattaggaagagctattggaaccatgctgatctgacagttactattagaggggctaggagagcgagggcaaggccagctgaggctccttccacttctgcagctcctcctacagcac

SEQ ID NO: 88355 - DNA, 436 bp, Glycine max
  Peptide Sequence Number=SeqID_205133
atggaagagggcatgtcagagttttgtattagaggtggtaacagtggcagtgccactggcaccaagtgtgggcgatggaatcccactactgaacaggttaaggttctgactgatcttttcagttctggactccgcacccctagcactgatcagattcaaaagatctctaatcagcttagtttttatggtaagattgagagcaagaacgtgttctattggtttcagaaccataaggctagggagagacaaaagcgtcgcaaggttgataacgatgtgattcgtagtgaaaactctatctccatcaattcttttacacaaacagattttactcagctatatcaggtttctgagcccgagagggtgatggagactcttcagctcttccccttgaactcctttggtgaatcagaatcaaagaatatgagggtccatgcaa

SEQ ID NO: 88356 - DNA, 279 bp, Glycine max
  Peptide Sequence Number=SeqID_205134
atgcgcatagacgaattttgcgccctttgccattcagatttcgcaaattgggtgataaacgcgcatagaggaattctgcgccctttatcattcaggaacaacaagttgggtggtaaacacgcagagacagattatgcgccctttatcattcaagagcagcaagctgagtgggtaaacgcgcagagacagattctgcgtcctttgtcattcagatttcgcaagtcgagtgataaacacgcagagacagattctgcgccctttgtcattcggggacagtaa

SEQ ID NO: 88357 - DNA, 486 bp, Glycine max
  Peptide Sequence Number=SeqID_205135
atgattgaagctcaatcatctaataatcctacaaatactaaagttccacccactcccacacctcattcaagttcatcaagagagacacggggaattgaagaaaagttagaaactcatgatcaaccagtgaaggcggaatgtgtaagtcctaacaaaagaggattaacttcaaaagcttggattcattttaaaagccaaaagatagatgagaaatggaaggcaatatgcaagtactatgataagaaacttgttggtgaaaccaaacaaggtaccaagcatttacatggccatatcaggtcatgtaaacttcacactgtgaggggtccaaggcaatccatactgaaaactatggagcaatcaacaagttctacgggaaatacacctgaatcagttgtagttggaaactactcatttaatcaagatgattctatgaaagaactagctacgaaggtttggatgacgccacttcccggtgaaggaagataa

SEQ ID NO: 88358 - DNA, 252 bp, Glycine max
  Peptide Sequence Number=SeqID_205136
atggaggcagataaggatgtccctattatatttgggcgacctttccttagtacttgtgactcacttgttaagggtgtattcccaagtgtggggaaacaagaccctccaagcatgaaaatgattccaaatgaccctggatggaataagaaaaaaggagatagcaacaccattcaagctcttggctatggagtggatgattatactagaggatcagtgaaaaaaagggaaatcaccttgttcgaggtttgttga

SEQ ID NO: 88359 - DNA, 477 bp, Glycine max
  Peptide Sequence Number=SeqID_205137
atgacgaacaaagatacattggggtgtagtgggcagagaggtacacgggacctaggggaattagtgagtagtgactacccgatatttggtgcactcatttggtgcggggagctcacaggccttgctttgctattcctgactggttctaagactacgctttttgagttgagagtgtttgaggagaaaagtactcacccatacaaccaacaactttcaggttcacgagatgtcgaggagtggttcaaagacatcaatttttatctgggcatggaagtgccgcatgacgctcaagaattcatagtgaccccaatgaggtttgatgtgagaggtaatgtgttgagttggagattcaagttagtacgttccatgcaggtcattgaggatcggggagatcacaccaatatgatgccaaaggaggaggaagagtatcgtgagcttctacgagacttagagccttcatctaaggaagaagattga

SEQ ID NO: 88360 - DNA, 162 bp, Glycine max
  misc_feature (51)..(51): n is a, c, g, or t
  Peptide Sequence Number=SeqID_205138
atgtctttaaaaccagcagggctgctagatctaatcatggctgatattggngtaaccgagcagatgaccatacagttgtcgaaaaaggctccaagggaggggagagatctcaacagatggtaccaggtgaaggctgagtgggagaggctgatccaaatctag

SEQ ID NO: 88361 - DNA, 252 bp, Glycine max
  Peptide Sequence Number=SeqID_205139
atgtatggaagggaattcacttactccaagaaccgaccatcaacaggggaggatctaagtaggagaaggaatgactatgaactgcaacaattcagattgtggttctctattcgtggtgtctcggactggatggcagtggcggaacaactgactgggtggaagcatctcagactgagatgtgacggcaacgcaatgaacatggagatgatggcattgaacagagttactgatctgttcgcgagagagaaataa

SEQ ID NO: 88362 - DNA, 583 bp, Glycine max
  Peptide Sequence Number=SeqID_205140
atggctgacagttcctcagtcaccggcgatgatcaaaattcccaacctccaaaacacgagcagagggaaagcttgggatacctcactagtaagcgacccaagcccgacactactgacccacaacacactgtgagggctgctgaaaactccatggtgatgacgtggttggtgaactccatggaggaagacatcagtaatcttgggaataaatctcagatttatgagctcaccttgcaagctagagaaatccggcgaggtaacaatgtgacaagatacttccactccttaaagcgagtgtggcaagaccttgatctcttcaacaattacaactggatgtcagccgaggatgccaaacactatcagcagacagtggaagaaggaagagcatttcagtttcttgctggtctcaatgaggagctagatgaagttcgtggtagaatcattgggatggcaaccttgccttcactaggtgaaatttttgcagaagttagaagagaggaaactcgcaggagtgtgatgatgggaaagatgaaagtggatccacctcttgagaccaatgctttggctgtagaagctactgctt

SEQ ID NO: 88363 - DNA, 171 bp, Glycine max
  Peptide Sequence Number=SeqID_205141
atgcgtgccatagctagagtaatgagtgaaataaaggaggtgcaacaggagatgaaggctaacattgaatccacgaaagagcaaatgaccacaatgatggaacccatgatgagtatgagaaggatgatggaggtcaatgcggctacagttgttgtcgcaagagaattgtaa

SEQ ID NO: 88364 - DNA, 732 bp, Glycine max
  Peptide Sequence Number=SeqID_205142
gaccagacttcggggaagatgattggcggtgctaaaatgatggatggtctctactatttcgaggatgctttcaagaataaagtagctcaaggtcttagtgatcctgaaattgataagggaaaccctgttccagacttaggaggagcccaaacagggaaagaaataccacagtcaaaaaaggagtttcatgtttatgctcgaaagtatcataaaaagaccagaaatcagttcatcatttctgcatcaagccaaccagaaatcccaaaagacggcccagcagaaatacctcaagaacttccaggaaacaccgaaattcccacttctaatactgatttgcccataaaaccagccaaacccagcacaaaccatcccatttccaaatatgtttcctaccaaaacctttcacaaaatcaccaagccttcacctgtaaaatcacaaatttgtttgtgcctagaaacattgaggaagcactagatgatcccaattggaaattagcaatcttagaggagcaggatgcacttaagaagaatggtgcttgggagaatgtaagcctgccccatgataaaaaagcaagtagggtagtaccagaggtactaatttacaagggatattacagcattacatctagtccacaagtagtcaatgaagagctacttatgtggtgtactctattgttgttctatttgtactaccctctacaaaaacaaaaaaccctgtctgatattgcttga

SEQ ID NO: 88365 - DNA, 309 bp, Glycine max
  Peptide Sequence Number=SeqID_205143
atgcccaaacggaaccaaacaggtccaaacaacaaccaaacgggttcgccaaaggataaagggcacgacggagaggtcgctggagagtgggtcaccggaaaacagcatcacacaccagaaaggagggtgcgtgaatctcacgagacagagaagaagcatgcgtgggagcacatgtggcagcatatgggcgacgatggtcagaggtcgctcgctagaaaaaggggtgacagtgttgctgccaattggtggcagagagggtgggcagcactgctcaccgtgaagccaaagggattgaaggaaaaaccctaa

SEQ ID NO: 88366 - DNA, 369 bp, Glycine max
  Peptide Sequence Number=SeqID_205144
atgaaagcagatgaccatgatcgtctccgcatgccaacggactcgattgtctccgggaaggcaaagaagactgcaaaggagacactaatagtcttgaaaacaatgaaatcagatgacaatgatcgtctccgcatgccaacggactcgattgtcccctggaaggcaaagaagactgaaaaagagattgttatagtcatgaaaacaatgcaagcagatggccatgattgtcttcgtatgccaatggactcgattgtctcctggaagggaaagaagactgaaatagtcatgaaaatagtgaaagcggatgaccatgatcgtctgcgcatgccaacggacttgattgtctatggaaggcaaagaagacattaa

SEQ ID NO: 88367 - DNA, 231 bp, Glycine max
  Peptide Sequence Number=SeqID_205145
atgtcgatgaggaaatgttcgatcggcgtcgtcagagtaaatgagaacatgccagtgtcggccgaagcacaacttcggttgagctcgcacgaaaaagcaatgccgacctatattaaaaatatcagtcggggctatttaacgactgatgtcagagtaaatgagaacatgccagtgtcggccgaagcacaacttcggttgagctcgcacgaaaaagcaatgccgacctatatt

SEQ ID NO: 88368 - DNA, 522 bp, Glycine max
  Peptide Sequence Number=SeqID_205146
atgtataagttcctagaaatacacaatatcccaaaattgaatcaagaagaaagtgtaaacataaacagaccgataataaattcagaaattgaatcagtaattaaaaacctaccaactaaaaagaaccctgaactagatggattcacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 88369 - DNA, 336 bp, Glycine max
  Peptide Sequence Number=SeqID_205147
atgcttaaggacttggaaattagtttagaagtggaaccgatggttttaaaagaaagcactgtgggaagcggtaaatgtgtcaataaagaggaggaccaacaagttccaatcattctaggaattgaagatgtttgtaaaggagtctacacacttagagaaggcaagaaacaaatgttctactacattcaaggcattgaagattttcccaatgaatcggctcaccaacaacaccttaacaatccacatgtcatacatcaagctattggtgttaaagaagcgcttattggaaggcaacccagctttctaactcttactttttacattacattcatttag

SEQ ID NO: 88370 - DNA, 930 bp, Glycine max
  Peptide Sequence Number=SeqID_205148
atggtcattctccaagaaaaaggaaagaagaaggaccatcaacaaaactttttcacatctaccagcaggggcaccgcatcggggttggcagcagaagggactgagtttttggatcaagcagcaggttgccactatgttggagttaggattccgaatccaacaatagtgtcgggagggtggagcgcgacactggtgaaatcacccaccttcccaacaaagaagttaattattgttgggttcagagtagggagtagggaggaaatatctttggttgttttgggtgggtcagaggaatatgcttctgggttattggaataccaagttgttgttgtcttggataggattagttatggatctaacctttgttggggttcagaactagggttgtttggaagctctgtttcaaaatttgagaagcaaaatctagatggtttctacaactcaattttgcttgaattgtctgcttttgatgattatgaagattttagaggagaggtggatgaaaagggattagatgtgaacgaggtgctcaattatattcttcttgagaaaggaggaggtgttgatgtgaatagggtctggggttctgatagagccattgctctccattgtgctattgctggtggccccaaatcctcacttgagattgtcaagctcttgcttgatgttggggctaatgctgagtgccttgatgcaagtgacaacaagtcggaggaccttgatgttgaatgtgatcaaggtggatacgagatgaagttcatggaaggcttcgttcaaactattgaacagttcaagtctactgacaaactggaggaaggggagcctgatgtagctccatgtggagcttgtaggccttggatcttcttcatcaatggagtcctttgcttcttgaagatcaatggcagtagaatggagaaggagaaaaggtga

SEQ ID NO: 88371 - DNA, 459 bp, Glycine max
  Peptide Sequence Number=SeqID_205149
atggacgaacctttgtccaaggctgcacctactcaacaccatccacctcctactctcattgctcctaaagcaacaagtgtcatggaaaatgtcaccaagaggcttgcacttaaaaagcaacaacaaaagccttcatctactgctcaatgcctaagggcaatcaatgagactaagagtgaggatgataggcctttggtcttcaggaaacgaaaagttgcaccaccttcagatgagacctctatgactcaatggagtctccaatcaccttttctccttctccattctactgccattgatcttcaagaagcaaaggactccattgatgaagaagatccaaggcctacaagctccacatggagctacatcaggctccccttcctcctactcaacctcgtacaaccaaacgggaaacaaacgggaaaagaaaggagcctagagaccaaagcgtctagaggataa

SEQ ID NO: 88372 - DNA, 513 bp, Glycine max
  Peptide Sequence Number=SeqID_205150
cccgcatgcaaggtttggattggctcccgagtttaagaaccactaaaggggtggaagttgaggctccggaggaggatgaaaaggagaatgccaaactgagagacgtaaatacagctaccaccaaggccttggaacaagagaccaaaagggatcgtagggaagaacacggccgaaacaaattccgaggggctctgtggggcaacaacagcgagcttaagctccagagggaggaaagggaccaatcacgagtaaacagtttgatcttgaaagatgagctaaatgtttgcctaaggtccaagagaagcttgtctcagcgtttatgcgagacagagaccaacatgttagccatcatcaacaagtaccaagaagaattaaatctagccatgcccgaatatacgcagaaaaagaggctaggggaaaggagtcaagaacttccccgattgctagccaaggccaaagcaatggcggacacctactctgcccccgaggagatccacagacttctcagctatt

SEQ ID NO: 88373 - DNA, 537 bp, Glycine max
  Peptide Sequence Number=SeqID_205151
atgcttattccccggataccgtcattgcttcttctccgggaaaagaagttcatgacccgtaggccttctaccttcacgcggcattgctccgtcaggctttcgcccattgcggaaaattccccactgctgcctcccacgcgagcccctcctcgggcggattcctccttttgctcctcagcctacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccacccctcgtgtaatcccacgagcctcttatccattctcaattattattcgatcacggcatacaaatagaaaaacttacattgggtttagggataatcaggctcgaactgataacttccaccacgtcaaggtgacactctaccgctga

SEQ ID NO: 88374 - DNA, 709 bp, Glycine max
  Peptide Sequence Number=SeqID_205152
caatactggtgtgcagaccgatgatgtaggatttatgttggtagatctaaagaaaatcgcttaccagaatgaccctttcatcatggcagaacaagctaaacaggtattttatgttcaagaccctagtgatgaaacatggaaaatggttacaccacccaactctcctcctcctcctactggtgcagcatcacagtcacgatctaccttgaagcaaacaagaaaagccatatggctaagatcattggcgactagaccagttggggcagagagaccgctagtccatgtcgatactatgactgggaaagctgacagtccccacagaaagaagttaagaacatatttggggatcatcgctcgtgataaggctgaatttgatatccctgaagcattagatccgaggacaaaaaagaaaatacttcagactatgggggagcggtggagacaatttaagtctgatttgacatcaaaatgggcacttgcagccgacaaggaaagtgtcgaagacactgtatgcgaaaagtacgacattagcaagaagaagtgggccccaattttgtcagacctgcagagaccacccttcgtgggagatgtgcgaaagaagacacatgtcatccagaaacaaaacacagcccctcacgtgttgtctcgtgggggttatgaatatttagaaaacaagttgatggatgagaaaagaaagaaaaaactgtag

SEQ ID NO: 88375 - DNA, 1074 bp, Glycine max
  Peptide Sequence Number=SeqID_205153
atgggaaatgaaggcgttaatgcggtggagaaggcgttgtcgctgctggattgttttaagccgggcgaagagagcctgtcgctgactgcgctgtcgcagctttccggctatcacaaaaccactgtctatcgtctgatgaactcgctggaaaggatgggctatgtggtgcgcagtgacagcggggtctacacgctcggcccgcgtctgttatacctcggcaagctttatgagcaatcattccatctggccagcgtggtgcagccggaattgcaggcgctggcaacggcgaccaacgagagcgccagctggtacgtactggataacggccagcgtctgtgcctgtttcgtgctgaatcgtctgatggcctgcgtcatacgcgcctgccggggacaatttttccgctcgataactcagccatcagtaaggtgctgcgtttctggggcatgaatgaaaatctcttcgatgcgctgccgtcgctgccaatatttagctcaggcgcgcgcgatccgcacatcgcggcctttgccgtgccggtattcgccgaaaatgatcggctgaccgctgcgctggcgctgaccggcccggtttcgcgtctgacgctgaatcgcaaagatgaagagttaggtgtgttgatgcgcgaagcggctgcacgcctgcctgccgcactccttcggatttttcaaagcaacacctcagttaatgctgttttccctgctgcgctaagcccggcagtgcgcgccggcaacaccgtttacgtgcgtggccagattggcaccgacttcgaaggcaacctggtggggctgggcgatccggcagcgcaggccgagcaggcgatgaaaaacgtgaagcaactgctcgaagaagcgggcagcgacctgtcgcacatcgtgaaaaccaccacctatatcatcgacccgcgctatcgcgagccggtgtatcaggtggtcggcaaatggctgaaaggcgtgtttcccatctccaccggtctggtgatctcgggactgggccagccgcagtggctgatggagatagacgtgattgcggtgatccccgacgactggcagccgcaataa

SEQ ID NO: 88376 - DNA, 564 bp, Glycine max
  Peptide Sequence Number=SeqID_205154
atgtcgccggtcgtcgcggcacccctgcatggccgcgttaaaccgctgtcgccgcagatgaaagtcgccgggccggccatcacagtggaagtgcgtccgggcgataacctggcgattcacgcggcgctggctatcgcccagccgggtgatgtgctggtggtggacggcaaaggcgacatcagttgcgcgctgctgggtgaaatcatggcaacccaggccgaagcgtccggcatcgccggcatcatcattgatggcgcggtgcgtgatgctgacgccctcgcgcagggcagctatccggtgtttgcggcaggcctaaacccgagcggccccaccaaaagtattcccggacgcgtgaaccatccggtgtcggtagccggtgcgtcgattgagccgggcgacctggtggtcggcgatgccgatggcgtggtggtgatcgctaaacaggatgtggaacgcatcattgccctggcggcgaagaagctggacgccgaaacgcgccgcatcgcgggtattaagcaggcgatttgcgtccgggctggctggaaggtgctctgcgcgcggcgg

SEQ ID NO: 88377 - DNA, 204 bp, Glycine max
  Peptide Sequence Number=SeqID_205155
atggaggtcacaaagctccattgctcgcacgcttgcgatccctgccatgccacggagctatcgtgcctacgaactcagatggaagatcatgcgctcaaggaagtccttgtagacaccaaggagcacgaggatgttatggtgtactgggaacttgacctcaccgacgatgtggcggtagtggcgaaggaggaggttgaaatttag

SEQ ID NO: 88378 - DNA, 280 bp, Glycine max
  Peptide Sequence Number=SeqID_205156
tccaccaagtctgctcaataatgagtttgcttccaagtcaactcgcaggactgaagtaatttctgacactcttcttgtcaatagaatatgtcctttccaagacttagtcattggacctctccaaagcagcttcatacctgggaagggaacaactgacaatgctcttattgctcaagaagttgttcatcaaatgcacaagaagcaagagatattggctctgatgattcaagaaaaggtctctagtggagagtggcactatgaaaatttcaagcaaagggtc

SEQ ID NO: 88379 - DNA, 528 bp, Glycine max
  Peptide Sequence Number=SeqID_205157
atggccacaatgatggaggccatgacgagcatgaaaaagatactggaagccaatgcggttatagttgccgctaccagcactgtcgctaaggcgaacccaatgcccccatctggcctcaagcaaatgtatcatccaacctcagatatggtaggcaaagatttgggaagtacggatgaccccatgatgtgcaaattcaaaacaagcatgccttcccgccatatggcttgcctcccaatgtggcgtacactcccaatgaggatgtcaataactctgctcccatactcattgagagccaacaaccccaaaacagatcatgcacatgtctctcaacccatgggggaggcacatgaaattccccaccacaatctagccgacttcgagccttgcctcggatatgccactgaagggcaagcagttggtggtatacccatgccaaacactttgaagggccctcagtttcgcccacaaccacaacccttgcattttgcggtggtaagagcccctcctgctatgcctgaaaagggaaag

SEQ ID NO: 88380 - DNA, 516 bp, Glycine max
  Peptide Sequence Number=SeqID_205158
atggcttacatggactggttagggttagcaggcctagttatgatgcaatatcctaccacaaacaatggcttcatgaatgcctttgtggagagcaagctcattaatgatgtcctttccacctttgacagagtcatgatgaagattctgttgatgactcgccttggcattccaactgaggaagagactatagaggcaacaatcgcaggtgccagggtgaagttgacgtggctggcagagttgcatcagtggaacgtcgcgttagggtcatgcatgtgggctgccacgacttatcttttgcccttggtcgatagtatgatacttgctgacaagtcctcaactcacattcatgtcgcttacctcctctacctcaataacttggatgcttgccatgattacgcatggggagtgactacactagcaactaatgctttggatgactcaatagttagtagatggaagtcagtgagaggttacatgtatgctcttctgatcaaggacaagctggatgacttgtag

SEQ ID NO: 88381 - DNA, 573 bp, Glycine max
  Peptide Sequence Number=SeqID_205159
atgaaggtggaccgtcttctggtggactacttggaagcaagcttagaagcacgtcattgctgcgacacaatccttcaagctatccatcaaacaagatttgcttacgcaagagtcaccaatgtcgttgtcaagctaagccaaacaacgtcttatgatgatgaccaatcccaaaaccctatccacacacaactttcttccttcttctgtgacatatattcacgacagatacatgaccctcttacgtatgctattgtcaaagaaaaggaaaattcaaagaatattaactataaagcgtgtttgcaagaaggaagagatttaagtggagtgagtattcgtgaaaggttcaacactactacaaactcttgtatgaaattgtgtgaacaacttgatgttgctgccaaaagggtttatgtggtgatcaatgagttggacactatgagccgaacgattaagaggttagatgatgaggttgaacattggagagagattgctgatatttgtgtgaagaattactgcaagtgtgaaatattgaagcggattgtgaaggaatttcaggacaacaaatctaattaa

SEQ ID NO: 88382 - DNA, 381 bp, Glycine max
  Peptide Sequence Number=SeqID_205160
atgaatagacaaaaatacccttcttttatctcttttactcacgagcgaggcacccctaccccactctcaaaccctagtgcacctccctcccttcgtcatcctcatgtggcgctcatatccctccctatgtcgatcatcatcgtcgtcaatggccacgcctccgccgtcgggttcctatttgcaatcaaccacgactacgtcctcatgcacaatgacaaaggggtgttgtacataagccagagaaatcccttgtcgtcgatagccaccaaagcagcaaattcttggttgtggttcttgatgaggtcacgagaaaagcgagacttgggaggttatcaattgtgcgagaatgggaaaaagggatttgcttgtgaggatgactag

SEQ ID NO: 88383 - DNA, 717 bp, Glycine max
  Peptide Sequence Number=SeqID_205161
atgcctaaacctatgaagaggctgaactgggaaattgatcaaagtcgtaactggagttcaatatattctagtaataagatattagaggttacccatgctttgaatgtgtctgctatgaaaggtcaaagattgtgggaaaatgctaggaatcctagttttgtgttgccacttgggtgtgggaaacttggccacaatctgaggaagtgcgatttgcctcctccagtggttgaggaacaagagaatgaaggcactgttattcaaccagtgaatgaaggtcatgcaaaaggtgacactgttgttaaaagcacagttgctataaatgacaacatagtaattgttattcagtcacaacaagctaagaatgaacttgttattaaggtacaacaacctgaggaaatgataccaaaaggtggtcatctgaataaaaggaaacaagttctcaaacagcttctcaagcacaaccaacttctcaagcaatttctcaatcacaaccagcttcacaacctgcttctcaagcacaaccagcttctcaagcaacttttggatcacaaccaaggaactggaacacgtaccaaaaaggtttctcagcaaacaggagatagaagggttgaggataacgccgaagttattagcccattaacaagagtcacaagaagcaaaggcaaaacaacatctaaaggcaatagtctttccgtcgggcagcaaggaaacacataa

SEQ ID NO: 88384 - DNA, 162 bp, Glycine max
  Peptide Sequence Number=SeqID_205162
atgactaatgagaatctgttagttgggaaattgttagtagcagatcgggcttacagagaaggatacattgctattatcatgccaaaacctgctgattggctcaaggtcaaggcttccctagttagccttcaggagtacaagaaattgagggaagtcaattga

SEQ ID NO: 88385 - DNA, 768 bp, Glycine max
  Peptide Sequence Number=SeqID_205163
atggctaaagtcatgtttgttttggtcagcttcctcgtattatgttgttacacaatcaacacttgcgccttctcatcttctggatggaccaatgcccatgccactttttatggaggtagcgatgcctctgggacaatgggaggagcttgtgggtatgggaatctgtattcgacagggtacggaactgatacagcagcattaagtactgcattattcaacgatggagcatcgtgtggggagtgctacaaaataacatgcgattatcaagcagatcccagatggtgcttaaaaggagcatcagtaaccataactgccacaaacttctgccctcccaattttgctttgcccaacaacaacggagggtggtgcaacccacctcttaaacatttcgacatggctcaacccgcatgggaaaagattggtatctatagaggagggatcgtgcccgtcttattccaaaggactccatgcgtgaagaagggaggggttaagttcagtgtgaatgggagacactactttgagcttgtgttgatcagcaatgtgggaggggctggatctattcaatctgtgtccatcaaaggctcaaaaacaggatggatgaccatgtcaagaaactggggtgctaattggcaatccaatgcgtatttgaatggtcaatctttgtcctttagggtcacaatcaccgatggtgtaactaggcttttccaagatgttgttccagcaaattgggcttttggccagactttccctactagtgtccagttttaa

SEQ ID NO: 88386 - DNA, 330 bp, Glycine max
  Peptide Sequence Number=SeqID_205164
atgtcaaccataaacaaggaccatatcgtcgatgaatcgaaccgttcagaaaccaaactagtcgaagaggaagaggaagaggaagacttacagaagcttctagtccctgacgtgcagaatcttcctctgatccctccttccgccgttgaaaccaactttgccacttacttcgccctagattttatgaagccagctcacgatcacttgtgcgtgattgggttggctccttcccacgttgctttcaaggatgaaggtggaatcacagccgttgatttcaatgttggaaagtctgatcgcagcgggatgaaagtcactggaaagcggaagaag

SEQ ID NO: 88387 - DNA, 777 bp, Glycine max
  Peptide Sequence Number=SeqID_205165
atgaccactactacagtcatgcttgttttagtcagcttcctcgtattatgctgtttcacaattagcaattgcggcttctctccttctgggtggaacagtgcccatgccactttttatggtggtatcgatgcctctgggacaaatggaggagcttgtgggtatgggaatattttttcagcaacaggttatggaactgatacgacagcattgagtactgccttatttaacaatggagcttcatgtggggagtgctacaaaatcacatgcgattatcgaacagaccccaaatggtgcttaaaaggaaaatcagtaatcgtaaccgccacgaacttctgccctcccaatttgtccttgtcccccaacaaaggagggtggtgcaatccacctctcaaacattttgacatgtctcaacccgcatgggaaaagattgctatctatagaggagggatcgtgcccgtgttctaccaaagggttccatgcgcgaggcagggaggagttaggttcactatgaatgggaacaactactttgagcttgtattgatcaccaatgtgggaggagctggatctatcaaatctgtgtatatcaaaggctcaaaaactggatggatggccatgacaagaaactggggagaaaattggcagtccaacgagtatttgaatggtcaatctttgtccttcaaggtcaccaccaccgatggtgtaactagacttttccgaggtgttgttccagcaaattgggcttttggccagactttccctacccgcgtccagttttaa

SEQ ID NO: 88388 - DNA, 420 bp, Glycine max
  Peptide Sequence Number=SeqID_205166
atggctacttgtaaaatcattgttatctggcttaaagttgtttatattgacgtcactgggaaattctatggggctcaaacacggaacttatctagggcttctgttatagaggaagtagcggagtctgcaacacaagtagttgggagctcttattataacaccataaagaatgccttcaatgacacaaaaactgatattcagaccagagtttcttttaagtttaattcaagtttatttgaaaatgcagtatgctgcttcgagaggggtgtatggacgccatttttctatgtcaatggattcttgttgcctgatactggaggtgctgttgactacaagacttggaggaaggtcattgacccattggttggagctaagaataagagtatccaaaatgaggagtcccttcatttcttcttgtaa

SEQ ID NO: 88389 - DNA, 435 bp, Glycine max
  Peptide Sequence Number=SeqID_205167
atggcttctgaattttcgggggctttgggaagtgaagatttgcgggtccagcttggtcctacaaacggggcaaatagggtgcttagagagccaggtgtcagcgcattggacatgaaatccatggttgcaaccggggaccactctagccggttgctcgctctcgatctcgtcgaggcagacggcgcattcggtgcccaagacgagttctttgccgcttctccaactccaaagcggatagacccttatcagttacgggcttcaccggttgaccgtcaatggggggttggttgcggcgggagtacccaagagattgggtattggcgacaattacccagcatatcgcaaattcacacggctctatgtcttgtgctatatgggaaaaccaagatcgaatcagagattccggtgagggttaataggcgagtggagagctaa

SEQ ID NO: 88390 - DNA, 123 bp, Glycine max
  Peptide Sequence Number=SeqID_205168
atgaaggatggagcccaagttgtgctgaatgataatggtaactacggcaaattctcacacctacttgcttcccaagatcgtgattatcttctctctccaactggggctcagatttgctcatga

SEQ ID NO: 88391 - DNA, 255 bp, Glycine max
  Peptide Sequence Number=SeqID_205169
atgggtagagggagagttgagttgaagaggatagagaacaaaatcaaccgccaagtaactttctcaaaaagaaggaacggtttgctcaagaaagcttatgaactctcagttctctgtgatgctgaggttgccctcatcattttctcaagccgtggaaagctctatgaatttggaagtgttgggtcgacccgtttcatcgtccttccacctgatacctccctattgtcagttaaaggtttcagctttgcgcactga

SEQ ID NO: 88392 - DNA, 309 bp, Glycine max
  Peptide Sequence Number=SeqID_205170
atggtgctctctctctctctctctctctctcataccaagagaaccaagaaggccggtattgttggaaaatacggcacccgatatggtgctagtttaaggaaacaaatcaagaagatggaagttagtcagcacagtaaattcttctgcgagttctgtggaaagtatgctgttaagaggaaggctgtgggtatttggggctgcaaagattgtggaaaagtgaaggctggaggtgcttacacattgaacactgccagtgctgtcactgtccggagcaccattcggaggctgagagagcagactgagagttga

SEQ ID NO: 88393 - DNA, 579 bp, Glycine max
  Peptide Sequence Number=SeqID_205171
atgagcgacggaggaaaacgacaaggtggaagagcgttgccgccgccgccaagaggccctccgcctcctcccccctctcgccctcgcctcgaacccgtcgatcgcgaaaaggagagagatgcgaagaggaaaaagacatgtccgttactgctgcgagtgttcactaagattgggagtcaccattccatggaagactttgccgtcagaggcaaagagcccaaagacgaggttcagatttacacctggaaggacgctactctccgagaactcaccgatcttgtcaaagaagttgctccggctgcaaggagaagaaacgccaaactctccttcgcctttgtattccccgacaaaaacggccgtttcaaagttcaagagtttgaggatgatgcctattgctttgattgtgaagtaactactacagttgctacccatgagtgtggacacataaagctcaagtgctgtaggaatgccattgtggttcaggcaacccatggcttttgcacatgtgatgtgaaaaattctctaaatgtccagcagctatccaacttgctaactatgaatgttgaagggataaaatag

SEQ ID NO: 88394 - DNA, 1944 bp, Glycine max
  Peptide Sequence Number=SeqID_205172
atgggttccgaagagaacggcacggaaattcaaattcagaatccaacacacacacaaacacaacaacatagtaatcctaataatattgcttcacccgaaatccacgctaacacctccaacaaccaaattgaaatcacttcccattatggcggtgacgacgccgagagtgacaggcatgtaactctagtagtccaccctcattcccttctccccatgcccgtgccaccgcagagtttcaaatccaacgaaaacgatgccgtttcgtcgaacgactcgaacttctccgtcggaagcttcctccgccagcgcagcagccacctctccgccgcgatcgtgaagcgcgtctcctctctccgccaatccatggaagaaaaaaccaacgacgacgaggaagagaatctcgaagtcacggagttcagcctttccggcgtcaaggtcacggtgacgccgaagccggaagaggaaaaggaaacctcgtttaaaggacgcatcagcttcttctcgaaatctaattgcagagactgcaccgcggtgagaagattcttcaaagagaaaggaataagatacgtcgagataaacgtcgacgttttcggcgagagagaacgcgagcttcgtgagcgaaccgggagcggttccgtgccgcaaattttcttcaacgagaagctgatcggaggtttggtggcgctgaactcgctgcggaacagcggagagttcgaccggagagtggcggagattgtcgccgggaaggtcgccggcggcgattcgccggcgccgccggtgtatgggtttgattatgtggaggaagagcgcgctgacgagatggttggggtggttagggttttgaggctgagattgccgattcaggatcggttgaggaggatgaagatggtgaagaactgcttccaagggaacgagttggtggaggcgctgcttcagaacttccactgcgcgcgtaacgaggccgttgagatcgggaaacaattatccaagaagcacttcatccatcatgttttcggggaaaatgacttcgaggagggaaatcacttataccgtttcctcgagcatgaaccctttatccccagatgctttaattttcatggtaccacaaatgatagtgaaccaaagcctgcagattcaatattcgtgaggcttaccaagattatgtctgccattcttgagtcttatgcctctgatgataggcaacatgttgattatgaggccattagcagaagcgaagaatttcgtaggtatggtagcactaattcaactgtgaaatctgcaatgcctactgttcacagttttacggtggctccatctctagatctgcagcgagtgaatctcttggaattatcagaaaacgagaagcttgcattcttcttaaatttatataatgctatggtcatccatgctgttattagcgtagggtgtccagaaggtgcaattgataggagatccttcttcagtgatttccagtatctggttggagggcacccttattctcttaatatgattaaaaatggtatcctcagatgcaatcggaggtcaccatattccttagtaaagccctttagcacaggagacaagcggttagaggttgctcttatcaagttgaatccgctattacactttggactttgtaatggtacaaagtctagcccaaacgttaggttcttcacaccacatagagttgtagatgaattaagaggtgctgcaagagagttctttgagaaccatggaattgaagtggacctggagaagagaacggtttatctaactcggattttcaagtggttcagtggggattttggacaagagaaagaaatattgttgtggataattaattacttggatccaaataaagccggtcttgtgacacatctcatgggagatagtggaccagttcacatctcttaccagaattatgattggtcaataaattcttga

SEQ ID NO: 88395 - DNA, 246 bp, Glycine max
  Peptide Sequence Number=SeqID_205173
atggaaagggtagctagccccacggtgcacatgaggtgcagtgctatggaactggcctcttttaaagttcaacgctcgatgctggcaacaagggcaagcaatgcaatgccagcaagcacgctcagtagtggtgatcagatgaaagctcaactggctgatggcaaaagtgagaggggtctacacccccaaaaatggaaactggcattaatgtccctttccacacccatgaaagctttctcctactag

SEQ ID NO: 88396 - DNA, 1839 bp, Glycine max
  Peptide Sequence Number=SeqID_205174
atgggttgtgcagatcaagattatatttcagctgttccaagtaaacaggttcttgatgttattgtatccagcacaaatgatttggggcctttcagtcttgacaatttcagaaaaaatttgtctgcttcatggagagttggattaggaaattcaaacgctgaacatgagctaaaccaacaaacaacacatgttagacaagaaaagccagaggtgaaggaaggtagatcttcaggtgataatccttctcagtggactgatagttccgcacagcaaacccgaaggcatttaatagagaaaaggcgggaaaagcgtgctgctgagttggtaaaaaaggataatgaagtagctgtaagagtcgaaaatacagctattgaacgctcaaaatctgttgagtcagccattataggtaaatacaacatttggaggaaagaatttgagaatgaaaatggcgattctactgttcggttgatgcgagaccagatcattatggctagggtatatataagcattgcaaagttgaagaacaaggttgaactgcatgaagaactaatttcccggctcaaagagagtcaacgtgctttaggtgatgcagtttctgatgcggatctacatcacagtacacatgggaaaataaaggctatgggtcaagttctatcaaaagcaagagagcaattgtatgactgcaaattggtcactggaaaactaagagcaatgctacagacagctgatgatcaagttaggagtttgaagaaacagagcacattcctcagtcagttggctgccaagaccataccaaatggaattcattgtttatctatgcgccttaccatagattactatctccttcctcctgaaaagagaaagttccctgggagtgagaatttggagaatcccagtctttatcactacgcactgttctcagataatgtcttggctgcatctgttgttgtcaactcaactattatgaatgctaaggatccatcgaagaatgtttttcaccttgttactgataaactaaattttggagccatgagcatgtggtttcttttaaaccctcctggaaaagctacaatccatgttgaaaacgttgatgattataagtggttgaactcatcctactgccctgtcttgcggcagcttgaatctgctacattgaaagagttttatttcaaggcaggccatccaaactcactttcttccggggcttccaatctgaagtatagaaatccgaaatatctctcaatgctcaaccatctgagattctatcttccacaggtttatccaaaattggataaaatcttatttcttgatgatgacattgttgttcagaaggatttgactggattatgggctgtggatcttaatgggaaagtaaatggtgctgttgaaacttgtggtcaaagctttcaccgatttgacaagtaccttaacttttcaaatcctcacatcgcaagaaattttgatccaaatgcttgtggttgggcatacgggatgaacatgtttgatctgaaggtgtggaaaaagaaggatatcaccggcatatatcacaagtggcagaatatgaatgaagacagggtgctgtggaagctggggacgttacctccggggctaataacgttctatgggttgacacatccactagataaatcatggcatgtacttggtttgggttataatccaagtttggatcgatcagagattgagaatgcagcagttgtacactacaatggtaatatgaagccatggttagaaattgccatgacaaagtatcggtcttactggaccaagtatgtcaagtacaatcatccctatcttcaaaactgtaagctaaatgaatag

SEQ ID NO: 88397 - DNA, 234 bp, Glycine max
  Peptide Sequence Number=SeqID_205175
atgttgttacccccacgaaccagaggcaatgccacaggaaaaagtgaaaacgagatgcaaagctttttgaaaatggagatggacaaaaataaggggatgtttgacaacataatgtctgaagaagttgatatgaatgaagaaaatcaagatgaacctggtgtgactgaagaaaatggagaggaacttggtgtctatgaacatgttgattgttttgatgcctttaatacttcttag

SEQ ID NO: 88398 - DNA, 153 bp, Glycine max
  Peptide Sequence Number=SeqID_205176
gctcccaacacacttccaatgaaaggcctttttgttataaaatttgaaagcaatgaagtgcttcttattccaatagctcttaaggtggttagccctttgcttcttgactcaaattcttcaagggatagcaccaatttcctatatggcaactaa

SEQ ID NO: 88399 - DNA, 330 bp, Glycine max
  Peptide Sequence Number=SeqID_205177
atggtgtttatagtatcaccgtcattgcctctcttcgcttcaaagacggtgcatattcgtaccttcttaaatcatttattttataaaataaatgccattgagctttctacgaaggcgctgcagtacccgttgttgaacaaaaaacaagataggatcgggggtggggttgggaaacttgatccccaagcaggggtggggatgagtataatttttggacacactggggataaggggcaagggcgagggcatggacgaggaggacttagggagttggagatgaagggcagggagactaaacttgtcattgtcgagtcccattgccatgcctaa

SEQ ID NO: 88400 - DNA, 462 bp, Glycine max
  Peptide Sequence Number=SeqID_205178
atggagataccgaatgtcaatggtcttaacatacaagatgatgatggagatctagaattcctcactgatcgcattattcatttccaaataatgaaagaaagaatgacattggtttggagacctaagtgtggagtggaaattactgaagtcaaatatggaattttcctttttcgattcttcttccacttggttgtccaacgaatactcaaaggtagaccttggagttttgacaaacacctcctaatccttggagtcattaaggaaggagccaatccaacaaccatccctttattcttggtccccttttggattcagatgcacaatctgcctttagggttcatgtctcaagaagttgggcaaagcataggtaactacattggaacattcttagagtatgatgaaaagaatagttccaatcttttacgttccttcaggcacattagggtcttaatggatgtttga

SEQ ID NO: 88401 - DNA, 126 bp, Glycine max
  Peptide Sequence Number=SeqID_205179
atgaagctgaaggtaattagaggaaatagtgtggtcactgttgaggcgcttgaaattcaagtgtttaagtgtaaattaacaatcaacttattcttatgtgacctgacaaatgtaaatatggagtaa

SEQ ID NO: 88402 - DNA, 216 bp, Glycine max
  Peptide Sequence Number=SeqID_205180
atgaaagagggaaacagtatctcacagaggtggcatcgacgcgagaagatgaagttgtcgtcttcggagaagaaatcgttggctgtggagatggaaggtcacgtagtgcatctagaaaagtctgtacaccttactttagcttatgcatcaacgttttcccgtgaatgtataagaatcacaacaaatgagacaagggccactttaaagtccaaatag

SEQ ID NO: 88403 - DNA, 624 bp, Glycine max
  Peptide Sequence Number=SeqID_205181
atgggcttcaaccttacatggagaaaatggatcaaggcttgtttgcaatctgccacaatatcaatcctagtaaaggccagccctacaaaggattttgttcccactagaggtttgagacaaggggatcctttagcccccttgctctttaatatagtggctgaaggtttgacaggaatgatgcaggtagcaacagccaagaacctgtacagaagtttcatggtagggaagcaaaagacataccttcgatggaagcgcagacacgaacttgacaatgtggttgcagtcacggaagcacaacccagtttgcgacaaacacgaactcaggcaaaaggagaaacaacaataacgccctgggagtaccctttccgggactctttcgtttcctacttttcttcgacctgcgaaagtgagcaaatgttaaaacgacgaacgcctaatgttaaaacgaaaggacgtacctcaatggataagtggcaaagacgatctccacaaacacgatctccacagtgtggttgcagtcacagaagcgcaggccagtttgacacaaagacgatctcaggcagaaggagaaagaagaagaacgatagggttcaagcgcgtgggttgtgcaatttcagaagttga

SEQ ID NO: 88404 - DNA, 300 bp, Glycine max
  Peptide Sequence Number=SeqID_205182
atggtggttccaaaggtttcaacggagaactatggcggttcgtggtggctactagtggttgtgggtggtgaagaagaagcttgggacattggggaagggttttggaagaaagaaagagaaatgtctgcagcgctgtctccctccttagtggcctccaaaggcgtggcggcaggcgtagcctctggagtctcctccggtgatgcctatggtgtcgccttcggctctggctgcggctcttggggtgtaggagcctcacctccccccgcaggagaaggctggactcttggccaggccacctag

SEQ ID NO: 88405 - DNA, 174 bp, Glycine max
  Peptide Sequence Number=SeqID_205183
atgtcgaaatttaattctgttatggcagaggagtgcacaacagtggatgtgcacagtggcacaatgatggggctctgtgtgatagtgatggaggggaatggtggcggtgcacggtgtggaggagataggatagggtggaggtcacgcacgagcaagaactttgcgagtcagtga

SEQ ID NO: 88406 - DNA, 303 bp, Glycine max
  Peptide Sequence Number=SeqID_205184
atgggcttagtgggacagggcttgcttagcccaatttggaaactagaaaacctgagaaggttttgggctcagcgcacaggtagagagctttctacgcttagcgcacagatacgcttagcgagaaactatgttgcactcagtgagcaggctcgcttagcccaattccatcaaatgcaatccagagaggtttttgggcttagtgcaattgtcgcgcatagcgagaccccttcagccaatgggtgggggttggcgtgcttagtgagagatgcttctcgctcagcatatgaggtatgtctcacttag

SEQ ID NO: 88407 - DNA, 189 bp, Glycine max
  Peptide Sequence Number=SeqID_205185
atgtcatataaaattgtcaacagggttctcatccctacacgatcttgttttgtttttagctattcaaatcagaaatcagaagctctaatatctgaggcagcatcagaaacagggtcatccacttcaagcgaaaatttcaaggcttatcatttactactgctaattggcgttgctgtggaagctatttga

SEQ ID NO: 88408 - DNA, 465 bp, Glycine max
  Peptide Sequence Number=SeqID_205186
atgtatagaaggagaggaaggggtggtgggtgtgagcttaaggagttggtgaatgagagtgtaagtgatggcgaccttccaaaccttccttacgtgcgtgccatagtgaaggaaaccctaagaatgcacacatcgagtcttttttcttttcaaaggccaagcattccgtacacgacacataaattggcaaccactttattccaactggcaccactactacggtcaaaatatgggctattactcatgaccaagatgtttgagtgcttcaagcagtcagacaagtccgctccacaatcacaaggcatccatttgaagttttgtaagaagatagcaagccaaagttcaacagtggccaagcctatggcttttccagggcacacccttcttttagagcaaaaaggtgtcaacctaaaatcagaccctgtaatggcacatcctcatccttcagaaaacgctttggcttga

SEQ ID NO: 88409 - DNA, 780 bp, Glycine max
  Peptide Sequence Number=SeqID_205187
atgaagagcaaaatcttgaaggcactgccaaaagcagtttcagcagtcacggtgacatttcaaaaccatccattcagcccaggcagggaccacaaatcaaagcctatcgtatccatgattccccatgaagctagaagaaaaacccatgatagaggcaataataacgacattgatgaaatttattctcaagaacccacttcaccgaaaatctcctgcatgggacagatcaagcacaagaagaaacaaatcgaaaaatcaaagtccaagagcaagtccatgacaaaagaagcgaggaatgttgctagcaaacaaacatcctcagcttccagagacatagaggtaaaaaatcacgtttcgacgtttcaaaagatgttattattccatgggacaaagccaaagtctgatggaaggaaatccaacgcttctgcgcctggagatattaacaaggatcgtgctcttgctgacgcagcacgtgcaccgcgcgtgagtcagatgagaaggttttcaagtggacgtgacgctcttggtgattttgattggaaggtggctcaggtggcgccagatgaagaggaaattgattactattcggatcattacagagtggatagtgatggcgatgaagaggaacagattattatccctttttctgcaccccttttggttggtgttggagttggtcatgggggtgtgcttaatttgaagccacgaatagaaattaacctgtggaagagaagaaccatggctccacctaggcctcttcaattggacagagcaaactga

SEQ ID NO: 88410 - DNA, 486 bp, Glycine max
  Peptide Sequence Number=SeqID_205188
atgttgccgcgttgccgcatcccgagcattccaatttcaattccaaaccgcaccttctccttcagttttctctctgctacgagctataaatttatttctgccaccgcgagcgccgcttctggctccgccggcgacacagactccgatggagagccaaaattgaacttctccggtgtgcggttggaggaggccgtcgatagcagaatcggatctggaaaactcagactcgacaactggatctcttcccgcatcaatggcattcgtagggcaagagttcaatcaagtatcaaatcaggactcgttcatgtcaatggccgtgtggttgataagtatttagctgatgctcacaaattggaggcgtttccttgcggtaatgatagcctagttgaaattgaaactaaacctgtaatgctgggtttttttgttgcgataagagacttcaagaaaccaccattacttatgatacgtaggtatcacgatgagtag

SEQ ID NO: 88411 - DNA, 1842 bp, Glycine max
  Peptide Sequence Number=SeqID_205189
atggccctagtccacaagtatcttcttctctcccggtcgccgccgccgccaacacgtttcattgctagtataagaacgcctacttcacttcaaacatcgccactcatggccttcataaaaccaagcgcacgcttccgccactcactctcacccctcctatcccccactttcaagccatattcttcttcagcttcggccttagttcccgaacttgatattcaacccgacactccccagaaccctaatctctcccccgaagaaacaaccttagccgacaagttccacgccgcaattaaagagcaccaccgcagaaaccccacacccaaccctaacgcccctcccccaactcccaacctcaccatccccgacctctccctcgccttttccgctatctccgccgcccacccaatctccccctccgtcgcccaccgcgtcatcgagaaatgcggcggcgtccgccacggcatccccttcctccaatcccttgccttcttcaactggtcctcctctctcgacggcttccccgcctcgccggagccctacaacgagatgctcgacctcgccggaaagttgagacaattcgacctagcctggcacgtcatcgatctcatgaagtctcgcggcgtcgaaatcaccgtccacacgttctccgccctcgtccgccgctacgtgagggccggattggctgctgaggcagtgcacgcgtttaaccgtatggaggactatggctgcacccctgatatggttgcattttcaattgtaattagtagcttatgtaagaaaagaagagcaaatgaggctcaatcgttttttgatagtcttaagcataggtttgagcctgatgttgtggtttacactagcttggttcatgggtggtgtcgtgctggtgacatatctaaggctgaagaggtgtttagtgatatgaagatggctggaattaaacctaatgtttacacttatagcattgtgattgattcgttgtgccggtgcgggcaaattacgcgtgctcatgatgttttctcggagatgatcgatgcagggtgtgatcctaatgcggttactttcaatagtttgatgcgggttcatgtgaaggctgggaggactgagaaggttttgaaggtttacaatcagatgaagaggcttggttgtcctgctgataccattagctataatttcatcattgagagtcattgtagggatgagaatctcgaagaggctgcgaagattctcaatttgatggtcaagaaaggggttgctcccaatgcgtccactttcaattttatttttggatgcatagctaagttacatgacgtgaatggtgcgcatcggatgtatgctagaatgaaggagctgaactgccagcccaatacgttgacttataatattttgatgaggatgtttgctgagtcaaggtctactgatatggttctgaaaatgaagaaggaaatggatgagagtcaggttgaacctaatgtgaatacttaccgaattttgatttccatgttttgtgatatgaagcactggaacaatgcgtacaagttaatgatggagatggttgaagaaaaatgcctaagaccaaacctgtcagtttatgaaacggttctcgagctgctgagaaaggctggacagttgaaaaaacatgaagagttggtggataagatggttgcgaggggaatgaaatgctgtatgctaggcaaatgtgttcctgttgttcgtggagttgctaacaacttacggcatgttcaaaagagactgagatgctcttacaagtgggaggcggtctatggatacctctctctcgagacttgcatcaacagcattttttgtactgcccgtgaatag

SEQ ID NO: 88412 - DNA, 858 bp, Glycine max
  Peptide Sequence Number=SeqID_205190
atgcttgtcaatggtattcttcatcattgcaaccttccaaatgttgaattttctaaagaggaggaagctctttcagatacagaagattctgatgatgaattcaatagctatcgctccctggcaagtttttgtgaggggttaaattctagactgtctgtggcatcaaattcaattcgctcagggattgtacacagattggacaaaggcacgagtgggttacctgttgcaaaggatgaacattcacatatgaaattgtcagagcaattcaagcaacataccatcaaaaggatttatgtcagtcttactgctgggctacccactccagttgctgggcgtgttgaggttccagttggccgtgatcctaataatcggattcgtatgactgctgtagctggaccagttaattctagaaaggcccgtcatgctgctagtaggtacaaagtaattgagatacttgctggggggagttgttctttggttgagtggaagttggaaactggacgcactcatcagatacttcatgacacaactttgaggaaatggttcatgattcgcacctatgctaagtatttgggagttcctctactgggtgatgaggtgtatggagggacaaaaaacatggtcttctcactgctaaggccccgaactcccatcagtttgcatagcaaagttgtaaaaatggtttctaggctagataggccttgccttcatgctttgactctcgggtttcagcatccccatacaggggagcaggtgcacttttcatgcgaaccccctgcagacttcgctgagatcttgagccagcttcgtagaattggtagtgagaccgtttctttctcaaagcgttcaaatttatga

SEQ ID NO: 88413 - DNA, 1209 bp, Glycine max
  Peptide Sequence Number=SeqID_205191
atgcaaacaaatgcggtgaaagtttctgatcttgaagggagagtagtgggtctattattcgctgcgaattggtacccaccatgccgtggattcacccaaatcctagttggaatctacgaggagctgaaaagcagagtccctcaattggagattgtgtatgtgtcctctgatgaaaacttggatgcctttaatagcttctatggaaacatgccgtggcttgcaattccgttctccgatttggaaacaaagaaatccttgaccagaaagtacgacgtggaagccgttccgtgcttaattttgttgcaacctgatgatcgtaaagagcacgtaacagttcgtgacggggttgaacttatttaccgttacggaatccaagcttatccattcagtaacgagaggttggagcagctgcaaaaggaagacaaagtgaagcgtgataatcagactctcactaatttactagcaaaccaccatagagactatgttttgagtcacactcacacgggactcaaaaagttttatttgaactgcatgcagagaatcatggatcctgttccgggtgacgggtgttgctcatgtacacaggtacctgttgcttggctagtgggtaaaacaattggactctacttctcagcggaatggtgcgtcccatgcgccaagttcactccaaaactgatttctgtttacgagaagataaagcacgagctagccggaaagggagaggaagacttcgaagttgtgctaatatccagcgaccgcgaccaagcatcctttgactcctactacagcaccatgccttggttagccttacctttcggtgacccagaaatcaagaacctcgttagacactacaacgtgcaagggattccctggttggtgatcataggccctgatggtaaaacaataaccgtacatggcaggagtttgataaacttgtaccaagaaaatgcgtaccctttcaccaacgccaaagtggaggagctggagaaacagcttgaggaagaggccaagggtcttccggcattggtgtatcatgaagggcaccgccatgatctgaatttggtgtctgatggaaacggtggagggccctttatttgctgcgtatgtgatgagcaagggtctagttgggcctaccagtgtctccaatgtggctatgaagtgcacccaaagtgcgtcagaactgtggaacgtcatgacaataatgtctag

SEQ ID NO: 88414 - DNA, 1155 bp, Glycine max
  Peptide Sequence Number=SeqID_205192
atgacactctttctaaccttagtgatcacacacatactacaggagcaagacagcgggcttcaactggtgcacctgctcctggcttgcgcagaagcagtagccaaagaggaatacatgctcgcaagaaggtacctccaccacctcaaccgcgtcgtcacccccttaggcgattccatgcagcgcgtcgccgtctgcttcaccgactccctaagcgccaggctcaactccaccctcacacccaaacccgcaacgccgtccaaacccctaaccccctccaactccctcgaggtcctcaagatctaccagatcgtctaccaggcctgcccctacgtcaagttcgcccacttcactgccaaccaggccatcttcgaggctgtcgagatcgaagaacgcgtgcacgtcatcgatctcgacatcctccagggctaccagtggcctgctttcatgcaggccctcgcggcgcgcccagcgggcgcaccattcttaaggattactggagtgggtcccttgttagacgccgtccgtgaaaccggacggtgtctcacagagctggcccactccctacgtattccttttgagttccacgcggtcggggaacaacttgaagatctcaagccacacatgttaaaccgccgtgtcggggaggcgctggcggttaacgcggttaaccacctccaccgcgtcccaggcaaccacttgggcaatttgctgaccatgctacgtgaccaggcacctagcatagtaactctggtggagcaagaagctagccacaatggaccttactttctagggcgttttcttgaggccttgcattactactccgccattttcgactcattggacgccacttttccggcggaatccgcgcagcgggcgaaggtggagcagtacatattcgcgccggagatacggaacatcgtggcgtgcgagggggcggagaggttcgagaggcacgagaggttggagaagtggcggaagataatggaggggaaggggttcaagggggtggcgctgagtccgaacgcggtgactcagtcgaagatattgttgggattgtattcgtgtgaggggtataggttgacggaggataagggttgcttgttgcttgggtggcaggatagggccatcattgctgcgtctgcatggcggtgttga

SEQ ID NO: 88415 - DNA, 126 bp, Glycine max
  Peptide Sequence Number=SeqID_205193
atgacgagttcactgcgaaatgaaatgctggcgactttgcctaacaaggatctcgccacctctactagcgagacagcacaaaccgctaggaggaacaggttgcaggctacgggagtgcagttttag

SEQ ID NO: 88416 - DNA, 141 bp, Glycine max
  Peptide Sequence Number=SeqID_205194
atggcccttgacataggcattgaagaagtcctcttgggtaaaaacaacatagtgcttctagcagaggcggtggtggcagtggcagtgcctatggtggtggaaagggccattgtcaaatgtaaggaatgtgtgcttttttaa

SEQ ID NO: 88417 - DNA, 279 bp, Glycine max
  Peptide Sequence Number=SeqID_205195
atgcccaaggagtcaaaggttgttccctgcacctgcactcccgtagcctacaacctgttcctccaagcgatttgtgctgtctcgccagtagaggtggcgagatcctcgttagacaaagtcgccagtcatgctggcggtttacatgccacgcattcattccgcagtgaactcgtcattgccaatgacggtttgcatggtttatgcatgcatgctacgttaaaaagagcaccatgccgaaattactttcaaaagggtcctatttcgggaataagtttataa

SEQ ID NO: 88418 - DNA, 982 bp, Glycine max
  Peptide Sequence Number=SeqID_205196
atggataattctcaagatcaaccactccctccaggtgttccttcgtggccaaattacgcctttgccactcccagtgccccctacaactttcaacaaggaaccctttctcactatggtttttcttccaatgctaaaccaactgaacaacacgaagaaaacaagtccttcaattctaaccatgttgagatcactgcagtagatggtgccacagtgagtgcttccaattactatggagcacagttaactggctcgcgcgacgatatcgttgttgctgctcaggatgccgtgctgcgtgaacaagaaattgccatgcaaaatgtcattaggagtcaaagagagggaagaactgtggattcacctaccaaggataatttagatttgttctcggagcgtcgtgaccccaatgctttgaaggagcatctgttgaaaatggccacagagcatagggctgaaatggctgtgaagcgtgggaaagctgcacgtgcagaaggtaacacagaaataggtaatggatatggtgtacctggtggaggtgcctattatgatgctccaacccttaagactactgcaggtagcaatgctttcagtcagcctgaatctattcttgatagatgttcagaacaaaaacctccagctaaagaattgcctgagtacctcaagcagaggttgagagctaggggtattcttaaagatgatacatgtaccacagatctttattttcaatctgttcaaaattcaaatacttacaggttacctgtttctgaatttcagaaaggcacagcaactgaagttacagaaaataaaaagttgcctccaggatgggtggaggcaaaagatcctggaagtggggcatgttattattataatgaaagtactgggaagagtcaatgggaaaaacctcaagaatcatacttaactgagcaatcaccatcatcttcgcatcttccagaaaattgggtggaggcaatggatgaaacaacag

SEQ ID NO: 88419 - DNA, 153 bp, Glycine max
  Peptide Sequence Number=SeqID_205197
atgtggatggaattggctgttccagacaagacagtcccttcctcaaccaaccgaaaggaaggatcaaattttcccaattcagcactcagcagtcagcaccaacttataacatggcgtgcccaactaattttaccattaaaaaatatctcatag

SEQ ID NO: 88420 - DNA, 363 bp, Glycine max
  Peptide Sequence Number=SeqID_205198
atggctctgtttatcaagttctttaattcttctttgacaagcttaatgctccgtttcatattattgttagttctatcgttcagaacgaaggctgtggtgaaactaccaccaaatataacatttcccgcagtgatagcttttggagattcgatcgttgacccgggcaacaacaacatggttaaaacacttgtcaagtgcgatttccctccttacggtaaagattttgagggagggattccaaccggtcgattttgcaacgggaaaatcccatcagatttgctagaaaagcaaaaacaccttcaaaaatcatttgttaaccggccatctacacagcattctcatcatagcatattacaagactaa

SEQ ID NO: 88421 - DNA, 282 bp, Glycine max
  Peptide Sequence Number=SeqID_205199
atggaactagatatgaggtatgccattatgaaacaagacttgatgtggatctacataaccagtcatgcacatgtaggatgtggcaactttcaggatgagattaattattctcaatctgctctacaagttgaacaacttccaactaattttgaaagtactccaactcctaatgtcgaaagtgctccaactccaactccaactaccactcaaagtgcttcgactcctagtgttgaaacaaacttatacctctaccactgtcaattatgtttagaccacctctag

SEQ ID NO: 88422 - DNA, 519 bp, Glycine max
  Peptide Sequence Number=SeqID_205200
atgaatagaatcagctttgttctcttcctttttcttctctgttttctctctattttttctcagtttatcgaaaaagtgttattttggctggtacagatatggagtatgaagcaggatacttatcttcatgacttaagggagcattccaaggagatatataccatcagatggagccccactggtcctggtacaaataaccctaatcataaactggtgttggctagtgcttcatttgactcaactgtaaagctatgggatgtggaacttgggaaactcatctacagcttggatggacacaggcatcctgtatattctgttgctttcagtcccaatggcgattatctagttagtgggtctcttgacagatccatgcacatatggtcattgagggacggcaagattgtcaaaacatacacaggcaatgggggcatttttgaggtctgctggaataaggagggtgacaagattgctgcatgttttgctaataatacagtttgcgttttggattttagaatgtaa

SEQ ID NO: 88423 - DNA, 1032 bp, Glycine max
  Peptide Sequence Number=SeqID_205201
atgattttttgtcacagtgcagaggctatcgttaagctaggaggaaatgaaacaatcccagcactgattttgtttggggattcgatcgttgacacaggaactaacaataacctaataacactgcttaagtgcaatttccctccttatgggagggatttccagggtgggataccaacaggaagattcagcaatggcaaggtccctgctgacttcatagcggaagagttgggaatcagcgaatatataacaccatacaagagtcctagtttgcagcctggtgatctcctcaagggagtcaactttgcttcgggtggctccggatatgattctttgaccgcacaaatagtgtctgtcacaccattatctgagcaactagagcaattcaaagaatacataggaaagctcaagggaaattttggagaagcaaaaaccaacttcatcttgtccaaaagtttagtacttgtggtgtcaagcagcaacgacattgccaatacttattttgcatcaggagttaggaaagtgacttatgatgtttcgggttatactgatatgttggtgcaagaagcctcttctttcgttaaggaattatatggattgggggcaaggagaataggagtgtttggtgcacctccactaggatgtttgccattcgtacgaacgttgtttggaggtctagagagagtgtgcaccgaagaaataaacatggcatcaaaattgtttaactctaaactatcttcagagctgcacaacctaaaccaaagcttgcctcaagcgaaggtggtgtatatccgtatttacgactctttgctcaatatcatccaaaacccaatcaattatggatttgatgttgctgacagaggatgctgcggtacagggacggtagaggcggcttttctgtgtaatccgttagatccaacaacctgcgtagatgattccaaatatgtgttttgggacagctaccatcccacacaaaagacataccaaattcttgttggtgaaatcctcaacaaatatataatcagcttctcttga

SEQ ID NO: 88424 - DNA, 276 bp, Glycine max
  Peptide Sequence Number=SeqID_205202
atgacaagcattgctacacaggaaggccctccaacaacactcaactatgatggggttgggactgttttacaaattattgtcttcccagctaggcatatccatgaccttcggatatcccagcaaggcaagatcagcagcttaactcttcatgatgatgatgatgatgatgatggattctcacaatatcgaacatgcacatttatgttttctgggcacctcatcaacttttttctctgttcagaccagcaaaagaaaatttttagcattcagtcataa

SEQ ID NO: 88425 - DNA, 420 bp, Glycine max
  Peptide Sequence Number=SeqID_205203
atgcataaggcattacgggccaatgcacctcttccatatcctcaattggtcactctttttctccgtcattttcaaattcctcttgatgatgaaccttttgttcaagtcaagcgatcttttgccattggtgctggtgcagtaactttatttggttatagtaaggatcgtgatggacaatggctaaagaaggacacgctacctctgcaagacgagcgtactctctctcctcctcctcagcgggatgattcctcagcccttatgaatgaagttctttcggaattaaggggcctccgcacctatgttggcgaacgctttgattccttggatggtcgctttgaaggcatggatacccgcatcacccaacttgaagaggatgtgacttatcttcgtcggtgctttgatcttccaccactgtcttag

SEQ ID NO: 88426 - DNA, 357 bp, Glycine max
  Peptide Sequence Number=SeqID_205204
atgacagaattgggatcattagccacaccttatgactatggagcaggggcaattacaacatctgaaccatggctagtttatgaaaccaccacctttgattacttgaactatttgtgttacaatggacttaacataaccatggtcaaggtcatctccggaactgtccccgacaatttcaattgccccaaggattcgaactctgatctaatatccaacatcaattacccttccatagcagtaaacttcactggcaaagcaaacgtggtcgtgagtagaactgtcacaagcgttggagaagaagtgaaacagtgtacttccccgttgttgaagctctcaaaggagtatttgtcacattaa

SEQ ID NO: 88427 - DNA, 258 bp, Glycine max
  Peptide Sequence Number=SeqID_205205
atggatgcttcaccggtgacccacaaattctactacttcacgctgggttcgacttcttatactatctccagaaatgttcctaataatttcagttaccccaaggattcgagttctcatcatatctccaacatcaactacccttccatagcaatctccgatctccaagggaaaagagtcgtgaaagtgactagaattgtcacaaacgttggtgaagaggacgaaacactgtactcccctcttgtcgatgctcccaatggg

SEQ ID NO: 88428 - DNA, 696 bp, Glycine max
  Peptide Sequence Number=SeqID_205206
atggatcctgttccatcccgttggaaaggcacatgtatgaaatcctacgacttcaattcatctaactgtaacaggaagataataggagcaaggtattaccccgatcctcaaggagacagtgagtatgtgacaccaagggataaaaatgggcacggaacccacgtggcatccacagcggccggagccaccgtgcccggtgcatcatactacggtgtcgcggcggggagcgcccaaagtgggtccccaaaatcacgattggcgatttacaaagtgtgcttcaaatatgagtgccctggctccgctgttcttacaaatggatgtgatttctctgtcggttggttccgatcagagttgaaatatgacacaattgccatcggagcattccacgccgttgaacgcgtcattctcgtggttgcctccgccggaaacaacggaccaagcttaaacaccgttgtcaatgacgtaccttggatttttaccgttacagcctcttccatagaccgcgattttaagtccaacgttgtcttcggccataaactgatccagcctgatattgcagcaccaggagttaacatgcagcatggattggcaacggcacagaaggtgttccaaaaggaaaaaagccctcccaattcaacatcatatcgggaacttccatggcatgcccacatgtttcaggacttgcagctaccataa

SEQ ID NO: 88429 - DNA, 618 bp, Glycine max
  Peptide Sequence Number=SeqID_205207
atggagatgaagaggttctacacggagcggccattctgggagtgtgagaggagcacaaacagcgctgcaactggtgttggggtcggagacagagagaagagagtggtcatgtttgtgaaagacagaggaggaagaggaagtagaagtgagagtgagaaaagtggaaagaggttgtctaagtcaacggaggaattggagagagaggcgagtttgatgtcgttccagacatgttcaatggaagaagaagaagaagaagaagaatggggccagcaatcacatggtgatgaggccatcgctttctctctcacactcaaacgaacaaaatatctctgcagggttgacaaggaggtcccagcaccagcactagcggcgatcgatgagctttcagagcaatgccgccagtcgtgctttcggagcaatgtttcctcctctagtctctctctccgtgtcgccgcgtcattggacaatagtgaagatggctttgatattgacctcagagtcctcgtcgctgctctcaccgagggccatcgacatcgacgaaggtgtgtgctattatggctatggaaggaggtcgccggtggtactgaagctttgggtttgaataatgttgatgcttga

SEQ ID NO: 88430 - DNA, 570 bp, Glycine max
  Peptide Sequence Number=SeqID_205208
atggcctcatcaccatgtgattgctggccccattcttcttcttcttcttcttcttccattgaacatgtctggaacgacatcaaactcgcctctctctccaattcctccgttgacttagacttgaacaacaacaaccactctgtctccgtttcttctttccttaaccaacctctttccacttttctcactctcacttctacttcctcttcctcctctgtctttcacaaacatgaccactctcttctctctgtctccgaccccaacaccctgcaagatcaacgccatacgcgtgtgatcaagaatcgagaatccgcggttcggtccagagccagaaaacaggcttatagaaaaggcttggaagttgaaatttcccgtttaacggaagagaattccagactaaaaagacaattgaaagaggaaaattgtgtacctggatttaaaggaaaggtgagcgagaaattaagacgcttgagttgttgcagcgctgtttgtgctcctctcacactcccagaatggccgctccgtgtagaacctcttcatctccattttgagaaggaaaggaacccgtga

SEQ ID NO: 88431 - DNA, 1284 bp, Glycine max
  Peptide Sequence Number=SeqID_205209
atggttaccaccaccgttgattcttcctctaaccatcactcacccactgctgctgatacctctaataatttcccgcaaaaaaccatgccatctccgtgggctcaggtcgttcgcggtgccgacgctgaacccaacgatcaatcgccgccatcttcttcctcttcctcgtccctcgattccattaattctaacggtcccgccgttcaaacaagcgatatcgccgtgaaacctgcgtggaagaaaccggaggccaatggcgtcgccgaagttgggcctgtaatgggcgctcattcttggcccgatttatccgagtccaccaagcccaccgctaaattgacatctgactcctctgttaagactgctgctgatgaagagtcaaccaccactcctcagggtcctgttacttcagacccccctcagaaacaagccactgctaatgcaaaacctagtcctactcctgcaatgaactatggtatggctaatagacaaagatcaatgaagcagcgtggaggggcaaatggcaataatgttgggtctggtcctgttcagaacaacttctctggtactaccccaaatcttcctccaccaccacctccgcccccctttcctgttcttctgatgcctccaagtacatttgcccatgggataccaggggctcctgttcctactccaagggatccttacaggaacaataactgggatgcaagacctcaacatgggggttttatgccaccaatgaatgagcatcggagtccctctcacaggggcaatgctgggcaccatccacgtggagaaggtccctatcacaacagttatggcaacaggcgcgatcaggaccgtgtaggttatgcaaatactagagatgctcatgtaaatcaacagaggatgcctccaaggggattaatgaggcccccaccacctaatcctgctccatttatggggcctcagcctatgcgaccccttgcaaaccctgctgggtttcctgaatactattatttcccaacacttcaatttgaaccctttgggggcatgccatttttcacacatgcacctcctcctgcgatgttctacccggttgcagaaactcctctcaccaatacaatagccaaccaaattgattattactttagtgatgctaatttagtgaaggatgagtatttaaggtccaacatggatgaacagggatgggttcctatttctttgattgcaagcttcccacgtttgacggtaatgtttgttaccttaaaagcagttgttatggttgaaactgaagatagaatataa

SEQ ID NO: 88432 - DNA, 378 bp, Glycine max
  Peptide Sequence Number=SeqID_205210
gatgggcagttggtcagatctagtatggatcgtacatggacggtagttggagtcggtggctctcctagggtttcctcatttggggatcctggggaagaggatcaagctggcccttgcgaacagcttgatgcactatctcccttcaaccctttgagcgaaatgtgggcaaaaggaaaaagaatccatggaccgaccccatcgtctccaccccgtaggaactacgagatcaccccaaggacgccttcggcatccaggggtcgcggaccgaccatagaaccctgttcaaaaaagcggaacgcattagctatccgctctcagctctccgttcccggttctcctgtagctggatcctccggaaccacaagaatccttagttag

SEQ ID NO: 88433 - DNA, 168 bp, Glycine max
  Peptide Sequence Number=SeqID_205211
atggagttgactcaaggaagggatcaggaaactctcctcaatgaacttgttatcatggaaatagatgaagccattcaagcttggttgacaatggaaatgcaacatgttgttaacttggaaagagacattgagtttcccagattagctttgcctaatcgtagtgtttga

SEQ ID NO: 88434 - DNA, 351 bp, Glycine max
  Peptide Sequence Number=SeqID_205212
atgcctcgctatgatgataaatacggcaatacccgcctctatgtggggcacttatctttgaggactcgttcctgggatctggagcgtgccttcagaagatatggatacattcacaaggtgcttcaagtcaaatcctccagaaccttggaactggaatgtttaattacctctgaggttcctgaccctacctcaatccttactgttttgtctaccacccaacctgcatctgctactaatgtcactagccatactacatcttcaccatccacttctccatatttgtccaacccgcaaccaaccatttcatccactattcctgatactcagtccctcactaccaatattgactag

SEQ ID NO: 88435 - DNA, 261 bp, Glycine max
  Peptide Sequence Number=SeqID_205213
atgaaagttggtaatgataatattgtccaaaggttgacgctatcacagatttgtggatggtgctatcgaaaagataagcagaatctagaagctgtttgttgccacaactcttcaaatgaattcctcgaggtaagtgggtctgttaatggttcttctaggcctgttagtgatattgctagctgctgtgctattatctgtagaggtagacattatgcagtgcaaaagaatgacaagtttggattttcaaagggaaatatatga

SEQ ID NO: 88436 - DNA, 708 bp, Glycine max
  Peptide Sequence Number=SeqID_205214
atgagggacagatcagagacaaggagctcaaagtcaaacaagcacaaatcaaaatccagaagccaatctcaaatcaagttcaaatgttttcattgttacaagaagggacattacaagaaggatttccttgaaaggagaggaaaagattcaatgaaatctcaagaatcgggagatgtggacattgctcaaattgagaaggattgggatacggattcaggttgtacctttcatgtatgtccaaggtgtgactactttgaatccttgattttgaatgaagctggagtagtgatgctaggaaacaacaaaccatgtaaagtccaaggatacactacacaaattgaacatggcatgatgacaatctttataaactctgtgattattgctaagggaattaaaatgaattgtttgtatatcctagatggttctattgttatagcacaagttgttgttgctagtcaaaacgaacatgataaaactagtttatggcatacgaggttaggacatgttagtgaaaaaggaaaagctaaaagtgctagttttggaataggcttacatgctacacgtagaacttttgaatatgttcattctgatccccgaggtcttgcatggaccatgactcatggtggttgctcttattttccatctaccattgatgattattccagaagagttttgatcattgttctaaagataaaagtgacactttag

SEQ ID NO: 88437 - DNA, 1137 bp, Glycine max
  Peptide Sequence Number=SeqID_205215
atggttaagactaaaggattaggccgtgcgttatgtagggttggtgccagaggtctggggagaggaagggatcgcgatgatactgacagtgcagaggcagaggctattgcagccggggatgagcccatggtagatgctgccgcacaggacaccggtgcagagactgacgcacaggataccgatgcagagactgacggggatgagcctatgggatttcctggtggacccagggacccatcagtgcttacagagtatgctgaccatgttgcgggcagcgtatggtctggacaggaacgtcctgagttgaagttatgctcccatgggaggaaggtgcataacttgggtaggcctattcctgcaattgaggacatggttgctaggacaggattaagtcctttgattgcatgttcgatagacatcggtgatcggggatttatatcctcttttgtggagaggtggcaccgggaaacttctagtttccatcttcctgagggggaggtgtcgatcacgctggacgatgtcgtgtctcttctccattggcctatcattggcacattccatgacttccagcctctgcgcaccgacgaggcggtggtgctgttggttgagttactgatggtctcagcagagacagctgttgctcgcgattatcttctacatcttttgggttgcactctttttgctaataagagtgcaacccatgttcatgtctcacacttacaggcgttccgtgacctcactcttgctgggtggtatgcatggggagctgcaggcctcgtccttatgtacgatcagcttaatgatgccattgcggagtccaatgttgatttagactacgacgaggtgtcaccatgtgcgtgtcggtggattgtaacaaagaagactgtgaagaagagggttatgtgccagttaggctacgtccagtgcattcctgcacaccctgtccattcgtgggtgtcatatgatgacgtggacgatacttggacgcactactcagaccatctggaggcagcaggtgatctatgtgttgtgccaagtgagtgtgcacctgactacatgaactgtcatatccctcatgaggcagcactggcatcgacacatgcggatcctgatgcaaacgagcccagacatgcagtg

SEQ ID NO: 88438 - DNA, 303 bp, Glycine max
  Peptide Sequence Number=SeqID_205216
atgggcggatcaactaccctaagcactacacaaagcaacaatagaaacataacgacagcgacggaggagtgcttacctcgacaatggcaacgtgctgaagaagaagaagaaacgaacaatggcgccgctgagggagaagacaacgatggagaacaaaaagttaccaacgatggagaagaaaaggaagaagaaacgaacaatggcaccgtggatcaacttgttgggtcgcacacgatcgcagaagaaggaggaagaaggatttacgggaagaagaaaagccaattgctgggtgcaaatttttaa

SEQ ID NO: 88439 - DNA, 216 bp, Glycine max
  Peptide Sequence Number=SeqID_205217
atggctcagtctgatggtcctacagatataggagctagaagtggtatctgtgtaggtgtaggaggaataactggagctgaggaaggtactggagctgtggaagaagaaggagctggtgtctcaggtggtgctgaagtagtggggacctctgatctcttacccatggccttccttggccctctaaatgtcactgttggatcatcaagattccaatag

SEQ ID NO: 88440 - DNA, 225 bp, Glycine max
  Peptide Sequence Number=SeqID_205218
atgaatgttattgccaagcgctgttcatgtgtcctccaccttcgagtctggacccccgccaagttgttgcgtatcggtgttataaatttctccaatctccagttttggccggaccccaaaaacggtgggagagggggtttgttaattgcgcccccgccgagtatatgggggcccccgaaagttgtggtgaagggtgttccgcaaatgctccttccgccactataa

SEQ ID NO: 88441 - DNA, 339 bp, Glycine max
  Peptide Sequence Number=SeqID_205219
atgtcgcttaagtcatggcctatccttagaacatcaatcagctcaaaccaattactcccaccgattagcactgttcaacaaaatgaaactctcgcaaacagccatcagccatgcgctttgggagtggttcttgagcaacgaagtgccgtcaagttccaacaagaaaacaagtgtagtggagatgagactgtcgagataggtcacaaatacattgaaaataagcatttgctggaaaagcatgcactgccaaagatttggcaggaaaaatgggttaaaaaaagatatgtgccaaccagaaatagaggccagactcctcccctaacagctgctacatcatga

SEQ ID NO: 88442 - DNA, 162 bp, Glycine max
  Peptide Sequence Number=SeqID_205220
atgccggaagaagaagtgctggagctcaagttccgtctctacgatggatccgacatcggacccttccgttactcccctgcctccaccatcgccatgctcaaggaccgcatttttgcagactggcccagagaaaaatgcagccgctcactattgcggtgctag

SEQ ID NO: 88443 - DNA, 522 bp, Glycine max
  Peptide Sequence Number=SeqID_205221
atgaaggtagagtgtcctcagttaaagagaaaaatacactttggtgacaagaaaaagaaaattttgatggtcatctgggatgacccaaacaatgagaataacaacaattcaaatgatgaggaagctaacatctatctaatggcagatacaaatgagaaagttgaggcaaaaacttgttttgaatttgattcttcctcttactcttcatcagacgatgaagaagatatgccctatgatatatccttggtaggaagaggccagggtttatgttggtacttggacaatagctactcacaacacatgacgggggaaaagtctatgttactcggcctaaaacccattgaaggaggaacaattacctttggagccatggataaaggaaaaattataggtataggtaaatttggcatcccctctttagcctccatagacaacgtcttatatgttgaaggtctaaaatataacttacttagtataagtcaattttacggattgtatccttctacaaagaccaatgtatag

SEQ ID NO: 88444 - DNA, 297 bp, Glycine max
  Peptide Sequence Number=SeqID_205222
atggtgggtgaaaaggtgaattttcctgaagtcatcttcttctactggcttaaagctttcaaggaaaaatttcacagtgaagacaagaagaaccatgttccttatgggatgttgtttgctcagattatgaggaacaatggaataaatgtgtttgttttggaaccatctgcaggtgccacacagcttaaaaagcatagcaaaagaaaagttgagaaggaggaaccacagttgttgcttggacagttggaaaaagttaaggaacaaccaatatatctagagtctagagcaacgtcttag

SEQ ID NO: 88445 - DNA, 177 bp, Glycine max
  Peptide Sequence Number=SeqID_205223
atgaagaagctacaacaggagaggaagccggaggacagaacgaaggagagaagacgacgccctttcatctggggtgctgggtgtcccagcaaaaatgctgggtgccctagcaatccccaagataaaattgatctgggatacgtagacttttggggcatccaatgtaatgggctgtag

SEQ ID NO: 88446 - DNA, 696 bp, Glycine max
  Peptide Sequence Number=SeqID_205224
atggaagaagaatttcatcagttcaccagaaatgatgtttggacacttgttcccaagccagaaaacaaaagcatcattggaacaacattggttttcagaaataatctatatgaacaaggcaaagtggaaatgtatgtcaaacaacctcttggttttaaggatcatacccttccaaaccatgttttaaaacataaaaaaggctctatatggtctaaaataggcaccacgttcttgggcttcaaatcaaataggatagcaaaggtatattcattcatcaacataaaatacactaaagaacttataaggaagtgcaagatgaaaagtgctaaaccaatgaaaactcccatgcatgcttccaatcctttgagtagtgacgaattaggctatgcaagagacaaagttgaaagaaaaagtacaagtggtggatgtcattatcttggatcttgtctaatatcttgggcaaacacaaatcatcaatgggttgatatctttactaatcctttgtctgaagattgtttcatctgtattagggaacatttaaatatgacaatgtcatcgtcttatagtctttcatcaatttgtttaacgtgtgttcaagtgtatagacgaaagggaaaacgagtcacaaagacaaaacttttcagttttcttttgaaaaacgtgtgccaccatcttttcgccatgattgagaaatag

SEQ ID NO: 88447 - DNA, 858 bp, Glycine max
  Peptide Sequence Number=SeqID_205225
atgagaaagaaagatgttgttaccaaggttgatgttaatgccaaacaagttgaaatcgaagagcttgagaggattcaatctgttgttgtgcatggagatgaattattctctacagttgatgctgcaaggaaaactgaagttgaaatggctttcattcctgatgacttggacctaatggaaaagaaagctcttgaaaaagcaatgtccagcctatcattgaagtttctctcaatgactctcaaacacaagtctgagctcacaactctggatggatacgccatgagaaggttcaacaagctgaagggatgttgctctgtagaagcaagcttcatgatgatgaatcaaggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggtttttacaaggttgaaaagaatctcaaggactgcaggttgcttggggactggatgtaggcacagccttttgcacctatgctcattgcttgaagtggaactcgtaaaaaccaaagaagcactagctcagaccttgaaggatcacactcatgatgcaaaggaagctcgcagatggtctttgattggtgactacttctacaagaaagccactaggtgggaacctctttatcctccaacaccacctggtagccctgctcatctttcttctaactctgaggactttggtgatgatattcttaagaagcttgatgaagaaattgtcaaacaaaaaggggataaaaagtaa

SEQ ID NO: 88448 - DNA, 1050 bp, Glycine max
  Peptide Sequence Number=SeqID_205226
atggggaaatttgccgtgaggtgggtgtttaaagtaaagctcaaaccaaattgctcaattgcaaaacacaaagctaggctcgttgctaaaggattccttcagaaacaaggaattgattatacagaagtatatgccttagttgctagaatggaaacaatcagattagtaattgttgttccactaggatttgaaataaaagggaaggaacacaatgtatacaaattacttaaagctctttatggcctcaagaaggcctctcgagcttggaatagattgattgacaatttccttggcaaacaaggatttgtgaaatgcacagtagagtttggtgtgtatgaaaaggaaattcagcacaagaacttgctatttgtatgcctgtatgtggatgatctgatcattataggagatgtgaatgaagaaatcgagcaattcaaagaaaagatgaagttagagtttgacatgatagaccttggaatcctgcattatttccttggttttgaatttatgcatacacagaagggaattttcctacaccaaagaaaatatactggtgaggttctgaaacgctttaatatggagaattgcaacacagcttcaatactcgtgatgccaaacttgaaattaacagaagaattggatgaaaagtcagttgatgcaacattgttcaagcagattattggctcactcaaattcttgtgcaacagcagacccgacattagttatggagtgggattgtttagcagatttatgggtaatcctcgagctcctcacatgactggagctaagcatatcctgaggtatctcaagagaacaagtgattttggtttattgtttccaataggaaatgatcataatagatcatgcattgaagcctactctgattcagactggtgtggtgataaggttgagagaaaaagcacctccggatacttgtttaagtatatggatgcaccaatatcttggtgttcaaagaaacaaagtgtagtgacactctcctcttgtgaagctgaatatatagggtcagctgaagttgcttgtcaaagtttgtga

SEQ ID NO: 88449 - DNA, 327 bp, Glycine max
  Peptide Sequence Number=SeqID_205227
atggggtcgtttttaaagttttttcaagagggggctgttttttacgtgatttgcatgcatgcaccacgcaaaccgccagtggaactggcgagtttgctctccgtgaatgaatcgccagtggcaatggcgatattgccatgcataggaaaccgtcagtcaaactggcgagttccactaggtaggctttcagctttgcagcagggatggctcaggcttttgttggcaggcgtgggacagggaaattgccattcctatgggcgatttagcctaagctggagttgccaatggtattggcgagttaggcgtgggaggcgccaccagcattag

SEQ ID NO: 88450 - DNA, 417 bp, Glycine max
  Peptide Sequence Number=SeqID_205228
atggcatacagctatggcgtgacacaacagccatcaattgcagcctatccaggtgttgggccttccctgaatagtgtttctacttttaccccgcctccaatggccctcatcaatgcctatggccccaatatctcgacaataaaattcccagtcctagatcttttcggcgtaaggttgcttagaaaaagccttcatacctccacccataaccttggtatgaccatgtcgtattttatggatttagatgttgtgttggagccaaaactatgcgttgagggcccgattaagctgaggacagacggatttcagctatatgatggtaaaggaacggaatttgtcaagcaaagcaacgcctgcgatttgcaattgagttttcgtgagtttgtttttccctcttacacaagattgtttctttaa

SEQ ID NO: 88451 - DNA, 330 bp, Glycine max
  Peptide Sequence Number=SeqID_205229
atggagcttgtttcatcaaagagagttgttatgggtctgggtgctggagtccaaatacaaaggatggataggcttatgcgaatgggaggtggcatcaaggaaggtggtgttgggaatttaaatagagggggggagtggtttgagtgggaaagaaggttaatggaggaacttcatgatttggtgaacaacacaaccattagtggtcaaggagaaaattcttggatttggcttgaggaccaatgttctaagttctcagataaatccgcctatgtggcattgcacaagatgaggattgggagccaacatattgatattttaaaaaaattctag

SEQ ID NO: 88452 - DNA, 306 bp, Glycine max
  Peptide Sequence Number=SeqID_205230
actcagaaagtggaaagggaggaagtggttgttgaggattctgagatggtacaaaagatggctggtcattctcaagcttggtcctcttctcagagtgataatctgctgaagattctttcattggatttcctatcacaccttctgatgctagggatgacaacacataagatagcatctgcgcagaggatgttgaagcagtcagttttgctgccactgcagcagctgcagacttgcgtggatcttcctcaatgtgtccagatttttgagaaaatgacacttgtggtgttggtcgcccgttctgactga

SEQ ID NO: 88453 - DNA, 960 bp, Glycine max
  Peptide Sequence Number=SeqID_205231
atggatcaagttcaacgccaagccttccgcaaggcatatgggaaaatctgggatttggccatgatagaattggtaccaaccataaaagagtttgaagggaacctgggatgcctgttaggaggaagaaagctgtatctttttttcgggttctacccctccatggcaagagtagcaaaagtggtcaggatcttggcacaagagttagatcgagtgaaacaaaacaggaatggggtggtagggataccaaggcagcacttggaggaaagagcaggagctttggtagataagggagaatggacttcattcattgatgttttagcactgttggtgtttgggatcgtactcttcccaaatgtagacgggctagtggatttagcagtgatcgacgtttttcttgcttatcaccacagcaaggaaagctcggtcattgctgttttggccgatgcctatgacacactcgacctgagatgcgaaaagagcaatgcgggaattgtctgttgtacacccactctttatgtatggttggtatcccacattttttgtgatgaaggtagacctgtctgttccttacaaggtcatcgcatgtgtgccaagaaagaaaaagcaaattgggaggaactcttggcagatatggtagaagcgtctgttagttggttcccccgatggaaagaaggaggggctggagttttgtgctttgtatatgcctatatgttcttggtagaagtaggaatagtaggggcaagatatgcggcccccacacttttcagacagctctctctctccctcacgttgccattttcttcttcttcattctccattgaagctccaagcaaagcttcaacctttgaccatcatttctgccccaaatcgcgaaaggagggcattctcggggtcgtgaagtgcgtggctacgagtgggacttcgaaaattcaggtttgggtggacttctttctctcttaa

SEQ ID NO: 88454 - DNA, 231 bp, Glycine max
  Peptide Sequence Number=SeqID_205232
atggctcacttagacccgggtgaagtgtgtgaatggagcaacctaaataactaccaaaccccacctgcaaaacaatcagaaaaattcctagacaggaagaatatcctaaagcgcatgaggcgagttcgagaccctgcgtcatgcaccacagaaacaaaatgccctaggggaattactaggcaagtccgagacttaccacgactatcccttgcaatgatgccagaaacttga

SEQ ID NO: 88455 - DNA, 600 bp, Glycine max
  Peptide Sequence Number=SeqID_205233
atgaccttcataagggaggaatatgatcaagttgatgatcatggatcacaaaacaatgccaacaacaacactgaaattgtgaccaccccagaaggggaaaacatgggagaatggcttagtctaggcctcacaggagacatcaacatgcctgtagaagcagcagcagaacaaaacttatcatcaaggcctctccacaacaaggaattctcatgcaacttctgcatgagaaagttttacagctcacaagccttagggggtcaccagaatgcacacaagagggagagagaagctgctagaagctaccaccaatctcatcatcacagaatggggcttgcttacacttctctggcatctaggtcactgggaattcagcctcactctcttgtgcacaaacctaacagagaaaggtctgctatggtggctagattcagtagtaatgatgccaataatggggttggaattggatcagtggcatcatcatggacaccctttatgcttgaacaagctgtggatttgtattggccaggtagctttcgggtggacttgccaaagcaagaatcatcagatgttaagaagattgacttagatcttcggctctga

SEQ ID NO: 88456 - DNA, 399 bp, Glycine max
  Peptide Sequence Number=SeqID_205234
atgccccggaatgccaccgtgataggcgtaggttgcattgggattgtaccatcgagggaagggagattgatatactttcccgggggtgaattcggagggctttctttccgggaagttcctcctctggtttgtgttggtgttgggattggcattttcggttggtcaagactatgtgggaaacaaattttgtgggtgaggcctttatggttgagtgggcaacctttgttggacgggtgccgtattgggaggggccatgtgggagctaaagtcacgacatgggtgtctccctccttcttcttggctccacccgttccagacctcctattgcttgtacttgctgaagcagcgtacttcttaagcctacttcaatcttctcgcccacaaaaaccaaatctgtga

SEQ ID NO: 88457 - DNA, 2664 bp, Glycine max
  Peptide Sequence Number=SeqID_205235
atggaaatggtaaatcaaactcagaacaagttaactaccgttcagaacgaagtggtcctcgataattctcctgattctcagcgtctcctttccgacaacaccagcttcgaaatccttccccatctactccaccgccgcgcatggtttctatccgccgccgccgccgttcaaactagagctattcgaatctccgagctcgaattttttcggaaattcaaccgtgatcggaggatccaacggcctcgtcgccagcatcaacaatcccaaacctgtcatcgtcgcacacaaaaccagaaacgtgttctgcctcaaatctcaatcgctctttctttagcatcgcgcgtagcagggagatttcccgggtttggatccgacccgaaacttcgtctttattattacgacccgaacccgttcgttcgtgtgcgtggcgcgcattacgcaccgcctccgacaaacatggcaataatcaaagcgcaaagaggagagaacaacataaccgttaacgtaacttcttcttcttcttccatcatggagaatcatgataataaccttgcagagaatgagaattcgggcactaacgaaaccgaagagacgctaccttcttcttcttcttcgatcaccgatcatgaagaagccgatcccaaacctgatgatgatgttgctgctgctaccaccgccgaagcagaatcaccatctccaaagaaagatgatgaggaggcagaggaagagaagaaagaagaaactgctgcatctcctgcttctcctccgccaagcctcgagaatgtttcagaggagattgaccagtttctcgtgactctgaagcagaaaaatgatgaaaatgctgcggagaagatggattttgagattcctggcttttttgagaggtactcggatctggtggagaagaagatagcgaaatacgatgcgaaagggaaggcaaaatggggagaggtggcggaggaagattcgtggttgcttgaaaccgcgaatcggatttcgaagctgatcatgttgatgaaagatcatcatcatgttgaaccagaggagaaagagatcgacggtggaaatggaaatggaaaagactcgctggtgaatcgcgttacctcgattcaccagcgtgtgatgtcgtatttggaggaggacttcagatttctaatggaagaatgtagaatcccaaccgaattggatccaggaggcaataataataacaacaacgacaccaaagggaaacaacaacaacaggtgccatcatcggaacaagaagaagtgaaagatcaagaaggcgaaatcgacgaaagtttcccgggttattctgatgagaccattgccagcctgagcaagatcgccggcgagatgatatccggcggctacgaatcggagtgctgccaggtgtacatcatctcgcggaggaacgcgttcgaggaggttcacaagaagctagggctggagaggatcagcatcgacgacatggttctaaaggtgcagtgggagactctggccgggaacatgattccagcctggatcaacacgctcaagcagtgcgcggcggtgtacttccccggcgagcggaagctcgccgaggccgtgttcgccagctgcccctcggtcgcggcggggctcttcggcagcctctcccgcggcgtggtgatccagctcctcaacttcgcggagggagccgctatgacgaagcgcgccgccgagaagctcttcaagctcctcgacatgtacgagaccctccgtgagatcatccccaaggtgaacgggctattcccggaggagtctgtcgaggagctgaagacggagatgaatatcgccaagtcacgacttggcgaggcggccatctccatcttctgcgatctggagaaccagatcaaacaggagaccgcgagaaccgcggtcccgggtggcgcagtgcaccccctaacacgctacataatgaactacctcagcgtggcgggagattacaaggaaaccctagagcaagtcttcaaagaccactccaagatcgaacgtgcagactccaccagtaggccacacaacgagaacgacggcgtgccggagaagcaagcatcgtcgccgttcgcggcgcaggtgctgagagtcatggacttgctagactcaagcctagaaggcaaagctcgtttatacaaagacgtggcgcagaacaatttcttcatgatgaacaacggaaggtacattctgcagaagataaaaggatcaagcgagatgagccaggtgatgggtgacacgtggatcaggaagaaatcctctgagctgagaacataccacaagaactaccagagagaaacgtggaatagggttctggcgtgtctgaacccggaagggttgaacgtgaacgggaaggtgcagaagccggtgctgaaggagaggttcaagagcttcaactcgttgtttgatgagatacacaggacgcagagctcgtgggtggtgaaggacgagcagcttcagtcggagcttagggtttcgatctcgggagtggtggttccggcgtacagggccttcattgggaggtttgcgcagatctttgacccgggaagacagactgagaagtacataaagtaccaacctgaagatattgagacttacattgatgagttgtttgatgggaagcctcatcagtccattgctaggaggagaacataa

SEQ ID NO: 88458 - DNA, 1161 bp, Glycine max
  Peptide Sequence Number=SeqID_205236
atgagatatggcggaggtaggaagaggcgaatgctgttgcaaccgtttctggttttgtgtgcgacgatgacaggtttgggattgttgatgctggcgacgaggccgttggatcctccgatcacgatggggaaggatttcgaagctggtgttgtcggaaaggagacgctgagaatcaggagaattatcgaggaccacttcgttctgaacggtgcttcgagaatcagggatttgcctccagagcagttctgttgtcatggatttgttcttggaaagactgccgaggcaggttttgggaatgaaatgtacaaggtcttaactgctgcagcactgagtataatgttaaaccggactgatgattttgaaaagccagctcaaacaaatgtcctctgtagcaattggaaggaatggaagcaacctatcatatgctcagtttttcttgaaaatatacactctcagatgaggattgctgcttttgatttatttggtgatccacaagttctgggatctcaaccaaatgtatttggagagctcttgagagttctcatatctccttcaaaagaagttgaagcagctgtcaattgggttattggtgatgaggagaatcctgacatctcattgcatatgcagatacttatgaatagatatgccggaccgttgagttgtcataaccagaccaaccaatgcgctttcacaccacttctccctcctgggtggtgggatggcctatggcagtctcctattcaaaaggatatcaatcgtcttgctgcctatggcatcaaactgtctggtcttggcacagttgattatgattcccttcaaaattactgtagtacaaggaaaaatgttgagagaactgtcacattcatcatccttgcacagggcatagggcatgctgatcttctctatatagttccaattgtcttagatgtctccaatgggagaattgatgtcaccaacttccttgaccttccggcactgggcaggcgtcagtccccatacatgatcttacgactttgcggagacttgttgatgcaagctccattggagcttgtaggcctacgatcttcttcatcaatggattcctttgcttcttggaagatgaatggcagcagaatggagaaagggaaagagagaggagacgccacttcaaggagaagatga

SEQ ID NO: 88459 - DNA, 402 bp, Glycine max
  Peptide Sequence Number=SeqID_205237
atgtacaaagataattggacccaaccttggcccatgggctcagaaatctaccctaaggttcatgagaaccctagggccttcttcagcagctctagcccaatcttcttggagcctcttgctcatggttctagtgattggtcccttcctagggaggattgcatcacttgtatttttggtaaacagtcgtccgggcctggtcactgcgaccccctttgtgaggaggcaccccttctcccgaagttacgggactattttgccgaattacttagagagagtggtctcgcgcctctaggtattctctacctatccacctgtgtcggtttcgggtacaggtttggcaagggatgccaacaaatcaatgcaatggaacaaaaatctacccatataatatcaaaaccctaa

SEQ ID NO: 88460 - DNA, 1048 bp, Glycine max
  Peptide Sequence Number=SeqID_205238
agttcgatgacttcaagacagagttggagaggcgtaatcttcacaaatgcctcaccaacttggttgatgggactattgatgttgctttggtgaaggaattttatgctaatctctacagctctgaagacccttcaccaaagcaagccagagttagaggccacttggtgaagatagatgctgacagcctcaacacatttctagagactcctgtagttctagaggagggggagacattacccacctattctaggtactgcaggccatccggggaggattctcaggaaggatctgactaccttggcctaggtgaggagtgttctcgcttcctccaacctggcccctacatctcacaccttagaccttactatggacagagccagtctaactcttccagacttgggtttcctgctttgatcaccgccttatgccgagcccgaggggttgtctctgacagcctcatatttaagcgcctgatcccggccattaacttggcctacatcgggaagaactgttggaacattaatgatcaaacagttgctttccggggggctaggagggcaaaggcgaggccagttgatattccatcttcttctacagctccagcacctactctggcatctacttctacagccccacttgagagaaaaaagagtgaaacacttgtgaaggaaaagagaggaaagaaaaagagtgaaacacttgagggcaaacagctttgtttagcaacaaaaagggaggattttgatgatgtgtttccaacaagtgtaccggatggtttgccacaattgaggggaattgagcatcacattgatctcattccaggagcgtccttgcccaatcggccagcttataggagcaacccacaagaaactaaggagatcgaaaggaaagtgtccgaactcctgagcaaaagttgggtgagagatagtatgagtcaatgcgctgtacctgtcattctagtacccaagaaggatggctcatgcaggatgtgttctgattgtagatccataaacaacatcaccatcaagtataggcatcaaatccccag

SEQ ID NO: 88461 - DNA, 1049 bp, Glycine max
  Peptide Sequence Number=SeqID_205239
atggtgaaagttggaacctcttacgtgccgatcaacgtctcattttcgccaaaagttggcccagagcttcccggtatcaacagggacaccaggatttatttattctgcgaagtgatcttccgtcacagctgtccctcctgttcagctactgacggggtggtgcgtaacggcaaaaagcaccgccggacatcagcgctggcaagtgtagcggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccccgatatggagtggatttttattgatggctctcacgtacgtgctcatcaacattctgccggtatagcgaatcaatccatttctaaaagtgtaggaggaaactcctcaaaaatacatttgattgttgattcacatggcaatcctattgatttcatgattaccgatggcactacacatgacatcaaagttgcacctgatttaatagcaacattagattatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 88462 - DNA, 168 bp, Glycine max
  Peptide Sequence Number=SeqID_205240
atgccaattttgaggctttgggaagaggatgaggaaaacaacagtatcagaggattttccctgccaatttggttgaaacttgaatgtaacgaggcctatttaatgcttctatgtccattgccatacacgtctgcatcagattcaaggctaaggctattaataatttaa

SEQ ID NO: 88463 - DNA, 267 bp, Glycine max
  Peptide Sequence Number=SeqID_205241
atggagaaagtgttgagccaatcaagatttgatgatgatggtgaaggtctgggtcgatggggcttgattgatggaaatccaaggtgttcggacatgatggtggtgagaacatgtggcgacatggatagagatctgggatggatattgatgcaatcctacccctcaagggcattggatagaagactccaagaagattgggccaaaaatgcaagagaaggccctagggttttcatgacccttagggtagatttcgggcccatgggctaa

SEQ ID NO: 88464 - DNA, 312 bp, Glycine max
  Peptide Sequence Number=SeqID_205242
atgaagttgattgagaagattggttgggtgtcactgaacagcgtgtttaagaagaagcttgagtttgaccttaacatgtttcgcaaatttaaggaccatttcttcaaggtcaaggcaaccagcgtcattgattacgggttgccattgatgcatgatgggattgaggaaccttgtttcctcttttactggcaatcggaccccacaagatttaagtctttcgatgagcgtctgatgtcttacgaggagagggcagacaaggctatcttggaacgattgtcatccaaaacattaaggtataatggccgactttga

SEQ ID NO: 88465 - DNA, 492 bp, Glycine max
  Peptide Sequence Number=SeqID_205243
atgagtccaacttgttgggaaaagaggttgttcaatgtcaaaggtggtaacctcgacaaatttaagggttgcgggctggtactcctcattctcgacaatgtctctatttctaattccgcattgggtataggtggaagcaattctgtgggttccatccaacaactgctggtggaatgggaagtggttcccattggtgattcctcgttggaggagtcgcctcatgaggcttctaacagcgtgtcatccttcttcgagaggttgatgggctcgagtcatgtcggtgagggcagctcccaaccctgtgaaggggtgaagccctttactacccctctggaagaagaattaatccatgtcacgacattgcttccctcttcctctttagtgactactagaaggaatggcggcggtgaagttagggtttcagcacgaaacaagtgtcgtcgtggcgatgaaatgccttcgtcctttgccttcgttgttggtttcgaatag

SEQ ID NO: 88466 - DNA, 363 bp, Glycine max
  Peptide Sequence Number=SeqID_205244
tatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggcaggcgtgccctcggcctaatggcttcgggcgcaacttgcgttcaaagactcgatggttcacggattctgcaattcacacaagtatcgcatttcgctacgttcttcatcgatgcagagcgagatatccgttgcgagagtcattgtatgtaa

SEQ ID NO: 88467 - DNA, 612 bp, Glycine max
  Peptide Sequence Number=SeqID_205245
atgagaatagcaactgaaaaaggaaaaaagaaagatgaggaaaagaggtggtggattgagggggagcgtgatgttggaaaagaaaacctcctgagatgggagagaagtcttccaatggaggtagaagctctccaaggaggagggagaagtccccttaaaattaaagggtacgtgttgtcgtgttctgttactaggattcctaggaaccaaaccggggacggatttcccgacccgaccggagacgctgctctcccagacgcagggcaaacggccggcgccggatctggccggaacaatctcgccggaatcgtggatgcgagtgacggtgagggcggtgttgaagtactctctgatttgagtgatcatcccatcagtgacggtccaggcgtggacccaggcaatgttgcgggcggagtcgcagccctcgacgatgacggtggagccgaaggcggcgatggactgcggaacgaatcggaaggagttgtcggcggcggagtcgccggtgagcatgcgcatcaaaaactgggcgtcatacagtgcaaccaccagccgcgtgttgctggaatcagcgtccgagccacttgcctgagagttagccagttcgagaaagag

SEQ ID NO: 88468 - DNA, 542 bp, Glycine max
  Peptide Sequence Number=SeqID_205246
atgagctaaccatcgaggaagaagctgagagaaaagttggatggctattgaagacgatattttttgtcactgcaggggtagcaggataccatttctttccttatatgggagagaatttgatgcaacagtctgtttcgcttttgcgtgtcaaggatcccttgttcaaaaggatgggagcttctagattggctcgttttgcagtagatgatgaaagaaggaagaagatagttgagatgggtggagctcaagaactcttaaatatgttaagcactgctaaagacgaccgtacacggaaagaagcattgcatgctcttgatgcactgtcacaatcagtgctagctagtactagccttttctgttctctttcgattgagataagctacttcaatgttatagatgaagctcttgcatccttgcatcatgctggggccatttcagtaattaggtctgcaccaaattcacttgaggatgcagaagttgagggattcaagttgagcttgatgaaaagatttcaagatctcagatatgatgtgccatcatga

SEQ ID NO: 88469 - DNA, 2023 bp, Glycine max
  Peptide Sequence Number=SeqID_205247
atggcggcgtacatcactgcacccaaccacaacattcagttaacgacgcaaggcatgacccagaccctccgcattggcgatcacctctaccacgtgacggatagcgatgactactcccctaactatatcatcggcttgagggaagagttacaagttcgagaacaagatttcggaaattttcaggtcgaagagaggatggagacagacaaccaagcgcttctcaagttaaaacatggttttgttgatggaagtcacattctatcttcgtggagcggtgaagactgttgcaaatggaaaggaatttcatgcaataatttaactggccggcatctcactttcttagatgtcagttttaatgatttacaaggagagattccaaagtgcattggttcacttactcaattgatagagttgaaacttccagggaatgaatttgttggttctgttcctcgtactctggcaaacctttctaatttgcaaaatcttgatcttcgggataataataatttggttgcaaatggccttgaatggctttctcacctttctaatttgagataccttggtctctcaaatgtcaatctaagtagagttgttgattggccatcatcaataagtagaatcccttctcttttggagctttatttagatgtttgtaggctacctcaagtcaatcctaaatctatttcccacttgaattcttccacttctctccaaatcatcagttttacctcaaatgaattagactcttcaattctatcatgggtgcttaatgttagcaaagtgttcacatctctggatctctctcacaattctttgcatagtgttccagatggatttgcaaacatcactctgtgtcaagtaaagaggttgtccctgagtcacaacaaattatctggccaactcagtgactacttaccagaatcatgttctgcacaacatgatttagaggagttggatctaagccacaacccatttagtagtgggccacttccggatttttcatggttttcatccttgaagagactatcgcttgaatataccaatgttgttgggcagttatcaatatcatttgatcatttgcggagtcttgaagatttggatgtttcccataatcaattgagtgggccaattccatatactattggacaactttctaatctgacgcacttgtatctatgttcgaataagttgaatggtagcattagtgaagcgcatctgtcaggcctgtcaagattgaagacattggatgtaagtcgaaattcactttcatttaacttggatccaaattgggttccacctttccaattggggtggttatctgcatcatcgtgcattttgggacctcaattcccaacgtggctcaaatatcaaagaaaactaagggtgctgcaaatctctaatactgataacataattgaaggaacattaccaacatgggtcggccacaacttgcttgatttaattgtttttagtctacgaggggaaataccacaatgcctcagccgcatagctgctttgtcaaatatggagtttcaaagaagctttattttatatttcagagatggatattccgatgatacatcaagtctaccttctattgaaataacagtaatgttagcatggaaaggacaaaacagagaattctggaagaatcttgggcttatgacaatcattgatctttctgataaccacttaactggagggataccccaaagtataacaaaacttgtggcattaattggcttaaatctttctggaaataatctcacaggattcattccgaacgacattggtcacatgaaaatgctggaaacctttgacttgtccagaaaccatctccatggtcgaatgccaaaaaggaacattgggctttgtggcccaccacttacaaacctatgctcagaggatgtggtcccaccatatggaataattgataaaagtgacagcaatgaagatgagcatgaacttgtagacattgggttttacatcagtcttgggttgggatttagtgctggattttgtg

SEQ ID NO: 88470 - DNA, 672 bp, Glycine max
  Peptide Sequence Number=SeqID_205248
atgtctccaataaaaaagatcacaatagcccccaaatgcactgaagcgctctcaattgttcccaatatgtctgaaacacgttcccagtcgaggttcccaagcgttcccaattgtttccaatcttttgcttctggttcgaaaatcagtcgacgagaggtgttgcagtgtggtttgagcataggaaacacaatggatgaatcatatttggctgcaaatccaagaaatgttgatgtcttggtccattttatgggagtgaaaggtgaaccatgtgaaatccacaacatagatcctgacaagtttggtgtttattgtgcgatagacaacatcaactcatttgtagaagatttaagtttgcctccttgtcatccttttatcatgtggtttcgatgtcgtaatgtaacaaatataagttttggcatgaaccttgactggctgcacctgttatcaatgaaccagtcaataagggttgaggaagtgtatgtaagtgaagaagacgtgacttgtggggggttgagtgaaggatcttcatctaacatggatgtcattggagttggagttgtacattcaaatttagacatggaagaaatttatgaggagaatggattgcatggaaaacaatttgagttggatagtgatggcaagatccgttttgagattaggaaattgttttaa

SEQ ID NO: 88471 - DNA, 591 bp, Glycine max
  Peptide Sequence Number=SeqID_205249
atgttggcaccactacaacgagtgttgctaggtgcacccaacatttttgctgaacctccatttttgttcattgtgcttctctcgttttctctttttcgtgcggcatcgtgtcttgttggtgagggtagcagcgttgagcgcaacggtgaaggtgaaggtatcggcatcgagcgttgcggtggtcggtggcggcaaacgaggtacgcaaatggtggtatctgtcgcagacgtacgaatgacttccggatcaagttgatccgtaagtgttttacggatcaacttgatccagaaagtctcttacggatcaacttgatccgtagcttacagatcaagttgatccatgagtggatgtatgaaataatgtctgaacgagcggatatggattatgaaaatgcagaatcatgtggtgcgaatgaaccacatgttgattgttcggatgcgttcaagacttctcagtgcagagaggatgttttgcggagtggcgagtataggtgtaggaaaaaagaatttatcagaagagacactgggactaggaaatgtgggtgtcccttcaagcttcgttgcaagccagtggttggaggagaaggctag

SEQ ID NO: 88472 - DNA, 585 bp, Glycine max
  Peptide Sequence Number=SeqID_205250
atggcagacccaacagttatttatgagtttttcaagaagcagccctcaaacagtggtggtggaaagagagcagcagcaccctcctccgccaccgccaccacccgctccttccaatgccacttctgccaccgcaagttctacacctcgcaagccctcggcggccaccagaacgcccacaagctcgagcgcgccgccgctaggagatcatccaccaacgccaacctcgacctcaacgtcaacgtcgtcactgctgctgctgctaacggacctctccggcttcccgtggagcccaccgagcccaagcctaggcccatgctggagcccacttcctcccccaccgagctctttttccaccaccacccccctccttactggctcgatgtggagcccttgcagtttcatcaccaccacactacaccacctctttcttcgttccacgctgctgctgctgctgcggcggcggcggcggcgtcttccgcaccgcaccaacaagttgttctctccggccacaacgtcaacgacgcttcttccgaccacgtcaacctcgacctcaccctccgcttcttctttgctgttgatgtttaa

SEQ ID NO: 88473 - DNA, 105 bp, Glycine max
  Peptide Sequence Number=SeqID_205251
atggaaggggaacgaagattctacttatgtaatgatttgagggttgtgttccctcaacgtcattctgatgccgatgagggcaagtgtcatactaaagcagcctaa

SEQ ID NO: 88474 - DNA, 204 bp, Glycine max
  Peptide Sequence Number=SeqID_205252
atggagaacattctgggtctcatcaaacttcgtatcaaaagaggcactaatctcaaagtttgtgatactcgtacctgtgacccatatgtctttgtcaccatggccgaacagaaactgaaaactggtgttgtgaaagatagcattaatccagagtggaatgaagaattgacactttatccaataatgagtggtaatggctggtaa

SEQ ID NO: 88475 - DNA, 603 bp, Glycine max
  Peptide Sequence Number=SeqID_205253
atgtctgatgaattcacagccttaatgaaaaatggtacttggtcccttgttccttcccaacctcactataacatcattggcaacaagtggatattccgattaaaaagaaatccagatgcttccattgctcgatataaggcaaggttagttgctaaaggcttccatcaatgtgcagatattgactttaaaggcacttttagtcctgttgtaaaacctcaaaccatcaaacttgtgctttgtattgctatattgaagtgctggactcttagccaaatggatgtaaatttggctttattcattagaacttcccaaatcatgtttgcaaattacataaagctttgtacaatctcaagcaagctccacgggcatgattatggattcatcaactcaaagtctgacccatctctctttatcttcaagaaaggtgatgttcttgcatattttttggtatatgttgatgaccttctcctcactggaaatgactccacctttcttgacaagtttaagagtgctcttgctaagaaaatatcccttaaagacctcggaactccaagtcacttcctcgatgtcgagcttttacctacatctactggcattttttga

SEQ ID NO: 88476 - DNA, 159 bp, Glycine max
  Peptide Sequence Number=SeqID_205254
atggaaggtggaagtgtgtatttggtgactgaaaataacttcttcggtttggatataccagccttcccacgagtgattgtggggtgggaagaagtaacaggggcccgaggtgctactgcaagagacggagttgaagatgatgtgtacacaagtgaggag

SEQ ID NO: 88477 - DNA, 219 bp, Glycine max
  Peptide Sequence Number=SeqID_205255
atgccattttcatggtcttgcaagaaacagtccacagttgcccgctggtcgacaaaagttgaatatcgtaccataggctccaccaccaccattgaacttctttggttacaacaagtccttcacaaacttgggatcaacatttcgcaaccaccaaccatcttctccgacaatattggtgcaactcatttatgtgccagcccgtctttcattcccggatga

SEQ ID NO: 88478 - DNA, 1311 bp, Glycine max
  Peptide Sequence Number=SeqID_205256
atgggcttgccacagattcccccaaatgaaactgctgaaaaggttgcacttgtgggtgcagctttaactagctcgccacatttttctgatgcaagcccctctgccataaacagcttgaacagtgtaaacactggtgggttggctgggtgtactctgggatcttcatttgatgatttcccgaagaatgcctccttagaaatttcaaatgtttctgacgatacattttatagaggagccatggaagtcgcttccaatgtccacagtttgaagattggttcaacagataaaagtactccttttgctccaaaaagtggacgcaatgttcatattcctgctttaagggttgttggttttgaatcaggccaaactaatacttcaaccgatggtttggctgatgtttcagttgtaaatcttcattcttccgtttctactaatttcccagccaatgacaacgagtcagccagttcattggtcaggaagcgacttttatctccactgagcagtatcctctccccaagtcatttcaaaggtgatcctcttgacattggctgcagaaataatgagactggatcccttgttaagaatgacaatgttagaaattccattgcacatgataataagaaggcaaatattggaagtaaaagcagttatacaatgtcttcttggtccttgacaaattgcttggagcaaagaatcgtgccacacagtacagaatccttttttcaaagtgatggtcctttgaaggaaaatagaggacttctgtctcagggtagttcacccactgctggaattgatcactttagtgaattgagtcaggttaggcctcaaaatggcataacatccatatctcctaaaaatgtgagctctcctctgtccttgtcacctcttggtcgtaaattctcggaaagaataaaaactgctggaggatgtaggaatgttgttgaagagataaagaattgcaatataacttcaaggagtatagaacaatcacttgacaattccaattcacgtctcatgttaaattataaggatgatgattccagagttgcacgcaaatcttttgatgatgttgaattcttatgcaaagatttctgtccatcttctctggatgacattgccgacatgagttggccactatgtcaagaatcagctcccacttctcactcgatgagattcactagaagtttgagtgggctttcggtcaggaggtctttagttggttcatttgaggagtctcttttatctggccggttcttatctggaaacaatagcaaggtctggctatatgctaattaccatactgtcaattga

SEQ ID NO: 88479 - DNA, 1074 bp, Glycine max
  Peptide Sequence Number=SeqID_205257
atgacaagtttagacaagaaccaaggagattttaaagtttcaaatagagtcagcagttattcagctccaatacttgcagaaaagaaatttgacccagctgaaaaagtaagacaacttttagcatcatctgcagcaaagtctaatgcatatgttctccctacaccagtcaacatcaaagaaaccaaaactagctcagccccccacattagtgcaagtggatctttgcataatttgtggcattcttcccctttggatgaaaaaaagaatgagaaagatgttgatagtaaattgtcagagccgactatccctagagctcactctgttctcaaagaaagtaacagtgatactacatacacccagttaccacgcccttcagctgatggactctcacctccacaagttgatcttttcagtgctactgatactaagaaaataaaaagacaagctttttcaggtccattgactaataaaccattatcagtaaaacctgtttctgggggttttccacgtttaccagtgccccagccttcatctccaaaagcatctcctaatgcttcacctcccctggtttcttcacccaggataagtgagcttcatgaacttcctagacctcctggtaatcaatctagcaagccacgagtgggtcactctgctccattagtattaaaaaatccagaggctgccatgactaataaatttccttcagttgtatttagtgcagcatctccacttccaactccacctgtctctcggagtttctctataccttctagtggtcagagagttgtggcattaaatgtctctaatactaagtatttggatactccccaagtttcaaaggttgataaagccgtgtcacctccactaacacccatgtcccagagagcatctaatatatctgacctggcttctcactctagcgaaatccaagtttccattgttatttgtattatggtttaccttgtcagcttcatcttgatgggaaacaaatgtgagtatgaggtttttcagtggatgcaggtgggagctaaatctcttgcgcacatactgaggttgagttctgctgaatcttag

SEQ ID NO: 88480 - DNA, 195 bp, Glycine max
  Peptide Sequence Number=SeqID_205258
atggagttgccaaaattcgacaatgacgaggttagatatgtggatgtggttaaaaaaaaggtttggtcgcctcaagaggttgatatggagatatatgcatgggatgagaccaacaatagcatgatgatggttggaaaggatggatttatggaagatttagacaatgattccaattttaacatgcaatatgtgtga

SEQ ID NO: 88481 - DNA, 252 bp, Glycine max
  Peptide Sequence Number=SeqID_205259
atggcgcaagctttatccatgaataggggaagaggtattaggcgaatggcttggggcaaactttctatgaggaaggaatttggaggcatgggattcaaaaacctatacgcctttgatttagcaatgctcaggaaacaaggttggaaattattaaccaatccaaaagctcttgtatctcatattttcaaagttagatattctccaaaaaggggatttcttggaggcttcattaggtcacaacccatcctttag

SEQ ID NO: 88482 - DNA, 456 bp, Glycine max
  Peptide Sequence Number=SeqID_205260
atgtttaccgtgagcactgttttgcgtagcagccgctgcagcaagcaggctatcgtagcaatctctcatgtcttgcatgtcctgctaaacggtgaaatggaaacccttaatgtcactataattagtaagcccaacgagggcgagttcgtcgaatttaacggtggggggaaagtcctttttgtccttggagacggtcttgtgaagtgcaattttcttcaacttgctgagcgaggacttcatcttttctgcaccctaggaagggaaaaagagggagagggtttgtttggagtggtgggaattgggggagaatctcaggggaaagagtgtgggaatggattgaggagtgcaaaagacattgaaggagaaggaggagggtgggtcaaagaagggaagaagagagatagatcagacagacagcaagagagagagagagagagatgcgaaatgggaaactag

SEQ ID NO: 88483 - DNA, 753 bp, Glycine max
  Peptide Sequence Number=SeqID_205261
atgggttgtggcatctcaacgctagatgttgaagatgcatcccttaatcaacattcaaagggtcgtcgccatgccattgttccatccattgtagacaaaaagaagaattttgagaatggtgatgagggtgatggggcattgttgcataccaacaatgacaataataataataataataaggataaggatgttgtcttggtaacaaagccattgggtagtgatgaaggcaaggatggaggatcaaacgggaaaatgttgaaagagaaaagctttgtggaaaggaataatattaataaggaggaagaaaaggtgtttgggaatggacaaaaagaaaaacatagcggtggttataataaatattgtgaaaagaataatattgaagaagagcatgaggatcaggataacagactccttgttggtccaagatcaccgagttttagggaatattgtaatgactatgattgtggggatcaaatttccataggagattccaatgattatgactctatggaaagcatcaagaatggtagtgaagactcatcaatcaataagaataagccaaagaatgaggaaagtgccaattcaaaaaaggaaagtgacaagaaagagagaatgggacgaggatttaggaatgttataaataagggaaaggtaagagggagaagaaattttctaaacttcgcttgctacaatgctagcaatgagtcccatgctgaagcttctttcaacaaaatagttgcaaaatctgcttga

SEQ ID NO: 88484 - DNA, 159 bp, Glycine max
  Peptide Sequence Number=SeqID_205262
atgacttgtatggctctaactttagcagtgctatcaggtgcagctgttgatcatttttatgagaaacgtgatgttcagccaaaaccagtggcagattatactattcctgctcccaatgtcactcagatggttgaatatgaacttcaatgtcctttctaa

SEQ ID NO: 88485 - DNA, 825 bp, Glycine max
  Peptide Sequence Number=SeqID_205263
atgccattgatattgaggcctccgaggaatacaatatgtggggcttgttatgaaggagttaggagcataatcaacatgatgagcaatgtcgaaagtgagaaagtaaaagcaatggctaatccaaatccaaacagttctccagtttcgcggcgaaattcgaaaaggcgtaataacactaacattgagattatttttcctctgcagacacttgatgattgtataagatggtgctcagagcagatggagcagtttaatcaacaaaaagaagacttggtttttctcagaggctttgtttcagccttcaaagcacagattcacacggatatattggtcagtccaggcaggcatggtccacctatacctgcacataagtccgttttgggagcaagatcagaaatatttaagaacatgctagagtgtgatgaatgcaaggcagcaccaagtaacagcataactatacccgatttgaaccatgaagaactagagtctctccttgagtttctgtacagtgggaccttgggtgtggaaaaattggagaaacatgtttacgctttgtcacaagcagctgataagtatgtgatcccacatttgctgaaacactgcgaacgatatctgctgagttcactaagcacttccaatgcccttgagacattggagatcgcggatacttgttccaaccacaacttgaaggagacaaccttgaatttcttagttaaaaacattgagcacatggtgccttcacctaagtttgaaacttttgtgcataggagtccacatcttactgttcaactagttacaagggcgtttgtgaatggtgccaaataa

SEQ ID NO: 88486 - DNA, 474 bp, Glycine max
  Peptide Sequence Number=SeqID_205264
atggtttctagagagcaaaagagagcaacactgaatgagaagctgcaacttcttcgttctataaccaactctaatgctctagacaaaacctcgatcataatagatgcatcaaagtatatcgaagagttaaaggaaaaagtagaaagactgaaccaagacgtagccaacgcacaaacttccagtgaccaaaatactttgcctatggttacagtagaaaccttagagaagggatttcttataaatgttttttcagcaaagagctgccccggtctgcttgtttccatattggagtcatttgaagagatgggtcttcatgtgcttgaagctagggttacttgtaaggacacctttcgatttcatgctgttggaggaaaaaatgaagaacaaggtgatgaggacattgatgcacaagctgtgaaacaggcaatgggacaagcaataaagaactggagccaaaatgctgaccaaaagtaa

SEQ ID NO: 88487 - DNA, 156 bp, Glycine max
  Peptide Sequence Number=SeqID_205265
atggagacagttcaatcatgggtttcaaagcacaagctcgccagcattggggcactctgggcctctggaattggagcaacacttgtggcttattcatgcaaaaagtctccaatgaagccaagtctcaggcttatccatgctaggtacttaccttaa

SEQ ID NO: 88488 - DNA, 477 bp, Glycine max
  Peptide Sequence Number=SeqID_205266
atgaagaatgctaatggtgttgctgccttggagccaaaacgaaaccctctttcagatctcaccaatactaattctaacccttccaaaccccaatcccttctatcgtcttcttcttcctccgctactaacacaacacgcgggacagttggccttaatgtttctgagccaatttcatcattctgcagcagaatacacgctttgaatgaaaagaaaaggaatgctaaaaaagcaatagcaaatcccaagacctctactgttcgggataaaaatgatggagttgaacttggaagtttggatctaactaacgctaggcctagggtgttaacagttcgctgcaggaagaagcggcgtgaacaagacgtgtccaatgatccacagatgcaagattatattgtaaaacagaaggcatacttcaaagagattgatgaatttgaactagcggaggaggaggttgaatctgttcatgagctggattaa

SEQ ID NO: 88489 - DNA, 552 bp, Glycine max
  Peptide Sequence Number=SeqID_205267
atgacgaaaagaaaaggagagaaaactgcagcacctaacaataattcagttagagggttcaacgtgatcgatgacattaaaaccaaggtggagaaagcatgtccccaggttgtgtcatgtgctgatattcttgctctggccgctcgagactctgttgtttatgaacgtggacatactattggccttgctagatgcgtaacattcagagatcacatctacaatgattccgacattgatgcctcctttgccaagtccctgcagagcaagtgccccagaagtggaaatgacgatttactcgaaccccttgaccttcaaactcctacccattttgataacctatacttccagaatttactggacaaaaagggtcttctccattccgatcagaagctgttcaatggtgattccaccaacaaactggtgaagaaatatgctaccaatacagctgcattctttaaagactttgccaagggcatggtcaaaatgagcaatatcaagcctctaacaggaagcgaggggcagatcagaatcaattgcagaaaagtcaattaa

SEQ ID NO: 88490 - DNA, 1767 bp, Glycine max
  Peptide Sequence Number=SeqID_205268
atggaagccaaagcagattacacccaagatggcactgttgatttccgtggccagcctgcagtttcatctaaaactggcaaatggaaggcttgcgcttttcttgttggctatgaagcatttgaaaggatggccttctatggagtggcttcgaacttagtgaattaccttacaacccaacttcatgaagatactgtttcatcagtgaggaatgtgaataactggtcaggatctgtgtggataacgccaattcttggggcttacgtagcagattcttatttgggtcgattctggactttcactctctcatctctcgtttatgtcttggggatgactcttctcacagtagccgtgtcactcaagagcctgaggccaacatgcaccaatggcatatgcaacaaggcttcaacctcacaaattgcatttttttacacagccctttacactatggcaattggggctgggggaacaaagcctaacatctcaacttttggtgctgaccaatttgatgacttcaatcccaatgagaaagagctaaaggcctcattcttcaactggtggatgtttacctcattcttgggtgctttgattgccactttaggattggtgtacattcaagagaatttggggtggggacttgggtatgggatccccaccgctggtcttctattgtctttggtcattttctatataggcacaccaatatatcgccacaaagtaagcacaaccaaaactcctgctagggacataattcgtgtgccaattgcagccttcaggaatagaaaactccaactcccaattaacccctcggatctttatgagcacaacctccaacattatgttaatagtgggaaacgccaagtctatcacactccaactctgaggtttttggacaaggctgctattaaagaagtcagtgctggctccacaagagtaccattgacagtatcccaagtggaaggagcaaagcttatctttggcatggcccttgtatggctagtgacactgattccaagcaccatttgggcacaaatcaacactctttttgtgaaacaaggcaccactttggacagaaaccttggccctcattttaaaattccatcagcctctcttggaagctttgtgacactctccatgcttctctcggtgccaatgtatgaccggtttttcgtgccgttcatgcgccagaaaaccggccaccctagaggaatcacattgcttcaaaggcttgggattggattttcaatccagatcatagccattgcaattgcctatgtagtagaagttagaagaatgcatgtcataggagcaaaccatgtagctagtcctaaagatattgtccctatgagtatattttggctgttgcctcagtatgtactaataggaatagcagatgtgttcaatgccattggattgctagaattcttctatgatcaatcccctgaagacatgcaaagtcttggaactacattcttcactagtgggatcggtgttgggaacttcttgaacagctttttggtgacaatggttgataaaataacaggaaggggtgacaaaaagagctggataggggacaacttgaatgattgtcacttggactactattatgggtttttgttggtcatgtcaagtgtcaatatggtggtttttctttgggtttcaagtagatacatttataagagggaatcaataagggtcaaggagggtctttgtgttcaaatggagggaggaaacccaactttggacgcctctcttggtttacaagtgtga

SEQ ID NO: 88491 - DNA, 243 bp, Glycine max
  Peptide Sequence Number=SeqID_205269
atgcggctaccgcaagagccctcgaacgagaaaccaagagggcttgcaaggaagagcatggccaagataaattccgaggagctttgtggggcagcaacaatgagttcaagctctggagagaggaaagagaccaatcacgagtacatggcatgggaactcaccataactaaaaaagcgcaaatgcacccctataacacccgatccagaagtaagatggataacgaagagggagtgcaagaatag

SEQ ID NO: 88492 - DNA, 693 bp, Glycine max
  Peptide Sequence Number=SeqID_205270
atggcaaggaaagcccggtcgttgccattttggccgacatgtatgacacgtttgatcggagatgtgaaaagagcggcgcaagaattgtttgctgtacactggctctctacgtgtggctgggttcgcaccttttttgccaagaaagtaggcccgtctgttcgctacaaggtcaccgctcgtgcgctgagaaaggaaaggcaaattggaaccaattctttgctagcatggagggggcgtccattgattggttccctcactggaaggaaggaagaaccgatattttgttctcgtgcgaaggatttccaaatgatacttcaaggagttcacaaggcatgggatgcagtgcaaaggaaggacaaagagcttaggggaagtagtaatgggatcatcgggggctatcgtcagtggctgagagtccgcacacaaggcttggattggctcccaaagctaagggctgcaagagaggaagaggccgaagctccgaaagaaagtgaggaggtacaagccctaatggcggaacttgagaaagcccaagcagtcaaggagaagttcaagtcaacaaccatcaaagtccgaagggagtatgatgaactgaaggacatcaacatggacaccgctgaagccttggaacgggaaaccaagagggccctgaaggaagaagacggccgaaccaagttccgaggagctctatag

SEQ ID NO: 88493 - DNA, 684 bp, Glycine max
  Peptide Sequence Number=SeqID_205271
atgagttcttatgtgataagagtatatcaaataaaggctattggggctgaatatggggaaggctttgagacttttagggcagatggaccactaaaagttgatgtggactatttgaatgagaaattgcaagatggttttcttcagcgcatacgctatgctatgaaaccagatgaagcttatggtttgatcttctcttgggacaatgtggtggctggtacacgagctctgaaaaggaaggcatgggagcagctggcctttgaagagggaaaggatattccggaaggtgatatgcacaaattactattttatgcaggtgctgattatgtgttacataagttttttctctcagataaggcagaaaatgagctgaataggctaaagttgaggttttctcagatatattatgataatcttgtcagacttgaaaaaccaatggatggcctcaacgactggttggaagcagtttatacagctcgcatcccctgtgctgtggtttcaagccttgatagaagaaatatgttagaggctttggagcggatggggctcagcaagtatttccaggcaattgtgacagaagaggatggaatggagtcaatagctcatagatttctttctgctgctgtcaagtataatactataattacactcaggcaagtttctaggtccatctttactaaattgtaa

SEQ ID NO: 88494 - DNA, 762 bp, Glycine max
  Peptide Sequence Number=SeqID_205272
atgacacctagaagacaccctgtggacctggagaagtccaatagggccctgggtttccccactctgatcacaggtctatgccagttttatggagtgcctatcgcccccaacaaggtcatccaaccccctatcactagagccttcatcgagaagtactacacctccaggaaggctcagggcgaggcaccacagcaacttggagacacccagccacaggcagctgatgcaccaccgtctcccctggagtccacctcagttcacttacgaagccaggatcccgatacttatgcgtggcctacccctgagcagttcggcgccatggctggagattggtctgatgctcagataggggcagggcccacaggcacctctggagatggatacggagctaaggaagatgatgacatggctgacgtgatggacttcttccttggaggaggcggagacaggcaagcaagcccattgacacgcaaagaccaatatgttcatctgcaccctttcatcgaagattcaacgtttattgacagagactacgttagtctcatctcgtcatccagagatagcaaggccgatgatacatggaggcaaactatagtcatatgccacctttgctatccagagacaatcgagtccgatagcatgcaaaggcaagcgagcctgttgaccgagactactttagtctcaccttcgtcatccagagacgataagtccgatggcacacggaaaccagtcatggtcatctaccacctttgtcaaccagag

SEQ ID NO: 88495 - DNA, 1683 bp, Glycine max
  Peptide Sequence Number=SeqID_205273
atggccgaatctcgagacgccgccgccgccgccgccgatggggttcccggaacgcccgccataagggaagtgagacccgagtcgggaacccatgcgggaatcgggtcgggtggtattcggagggttaatttccgagcggagattgacacgtcgccgccgtttgggtcggtgaaagaggccgtgacccgttttggaggtagcggtccttggataccctattttaacaacattgaaaattttgacttaaagaaagtagaggaacaagcagcagagttggagaaggatttgattgtcaaggaacttgaaacgcttgacgtgcttgaagaattaggagctaccaagaggattgtggaggacttgaagcagcagttacaaaaggaggctatgaaatgtttagcaactcgagatgtaaattcatatgaagaagctggaactcctgttattaaggagaaggatgaggaaaattgtggaaatattgtcaatgatgaagaacaggtgatgcaaattccaagcccatgctctatgtcatcatcacctgatatgatcttaatggagttgaaaaaagccaaattgaatctaggcaaaactataaatgaacttggggtgatacaatcctcgattgaatctttgaataagaagatgaagaaggagaaaaattttctggagaggacacgtgaaaagctagcatcaaagtttgcagcagaatctgctcaagagagggtccaagagcaaacaagattgaatccaccggcccctcatgtagagttcacctttggtaaccctgcaaataatttcaattctgattctgggcagtgcaatggaatggcagagacaagaagacctgaaccttcaaagcccttaagtgtatatgaagaatatggatttagtgttaaaactgctgagataaggtggcttgcggctaaaaagatggaagaagctgcaagggcagcagaagctattgctcttgctgaaatcaaggctctatctaatgcccagagatctttaggatttgttctgccagaacctgagaaagtcacttttgcttttggagagcgctctcccctaaaccccaaggctcagatacccaaggagtcaaccttgaagaaggtaatagattccaagtttcaaattgatgaaacaaaaatttctaagctgacaattttgaagaagttggaggaagcagctgaagaagttctacacagcaaacaagtcttgacagatgctttaaacagaattgaaactgcaaacagaaagcaacatgctgctaaggaggctctaaggagatggattccagaggatgatatgaaggagtatagcactattaattgcaacaagtttaatcaaactggaatttatcaagattctctgcaggatgtaaccaggtcaacaacagcaaacaatgatccaaagcctgctttaaggcccacaatttcaatgagagatgtacttagcagaaagcaggttcctgaaggatatgctacaagaaaggagatggaagagcacactgaacggcaaaaggtagcgttgagtcaaatgcttcaagcattgagggaagatctaactcttccaccaaagactgagaaagatgggaacaatcagaagccgtacgtagcacagaggaagaaatttggattcattcaaatatcactccccttggcaaagccaaataagaaaaggggatga

SEQ ID NO: 88496 - DNA, 204 bp, Glycine max
  Peptide Sequence Number=SeqID_205274
atggtgtgtggaacggggttggggatacccgatacccaacgggtacccgacgggtacggggatgagacaataaactcaaacccgtcgggtatcgggtacgggtatgaggatatgttgaggagtcgggacatgcgcacacaagaagataatagatgtgaagaggttcagtggactaaaaagaaagcaagatgttaccaatcatag

SEQ ID NO: 88497 - DNA, 648 bp, Glycine max
  Peptide Sequence Number=SeqID_205275
atgccgagcttagcgaagtctttgtttttatgttgtcgcgctaattatgccctgcgtgctaagcgtattctgttattttctgaaggtgcgctaagcgaatggcctctaggaagaggaaagctactgcctatagacctcgagagccctatgataccattagattcatatctgagggcgcctaggagagatatgcacagaacatttactctcgggacatccttctggagaggaacggagctcaagcagaggaactggcataaggccttgaccaggcagcctgatggtcacaatgatgtggccctggtcaaggaattctatgctaaattatatgatctagaggataagtccccgctacaagcttataaaggtgaggttagtctacggactggtcatgaagatggatatggacttgggctcgctcatttcaggccaaatctcacagatggcccaatccaactcctctcggctcgactttcatgcacttattacagccttggcgtagccagaggagagccacagccagagccggaggtgacacccgagtccactccagagactacacctactgccacaccacttgtagagatcaccgaggatgaggatggcactgcagacacagattatgcagctgacatggcagcggcatag

SEQ ID NO: 88498 - DNA, 748 bp, Glycine max
  Peptide Sequence Number=SeqID_205276
atggaagaaagcatgtctcctttccttgtgagagatttcggcgcgcaaaacttcaaggctatacaaagaatccataaggcatgggaaaccccgttaaggaaagatcaagaacttaggggcattcgcaatggcatcattggtggttaccatgaatggctaaaagttcatatacgaggtttagattggctcgccaagttaaaagttgtcaacgaagagagtttcgaagcaccgaaagaggacgaagaagtccaagatctcaaaaacgagttaggaaaggcgaaacttgccaaggagaagttcaagttagccgctacacacatctggaagggaatgtgccgggattacgggaagagaatgcaactaccgcaagagccccttgaacaagagaccaagagggctcgcaagggaagagagttagttgcctgttcaaggtccaaaaggagcttgtctcagcgtttatgcgagacggagaccaacatgctagctatcatcaccaagtaccaagaagaattaagtctagccacggcccacgagcatagggtcgcgaacgaatatgcccaagtatacgcggaaaaagaggctagaggaagggtgatcgactctttacaccaagaggcaaccatgtggatggatcggtttgctcttaccttgaacgggagtcaagaacttccccggttgttagccaaggccaaggcaatggcggacacctactccgcccccgaagaaattcatgggcttctcgactatt

SEQ ID NO: 88499 - DNA, 234 bp, Glycine max
  Peptide Sequence Number=SeqID_205277
atgtctgtgctttcaagtaacaagctaaataagtgttttatgttcaagatccttgtgatgaaaggttgtcagtggttctacacggaaaaacaattggtgttaatgttaaagatgatgattcaatcgttgatacttgtctcagtcctttctccacacaaatgctacctaacgtcactggagaataagttgacgacgtcctcgcaaatcataatgatcatgatgaaggagaattaa

SEQ ID NO: 88500 - DNA, 336 bp, Glycine max
  Peptide Sequence Number=SeqID_205278
atggctgatcatgcaaagagttactatcagttagaggttactttctatccaagtcctcaaaatagtttctattcaaccactgtctactcagaagccaaagaaagtttcaccaacactaaggtcaatgagtgtgctagtgttgacaagtcttatgaaagtgaagaaatggaaaattactatcatattaatgagaataggaagaccagcatatgtaaagcaagtactggcaatgatgctagtgatgagagcaacaccagtagtttgagcagtgtcatgtataaacaacacaaggcaaatgacaaaagatgggaagcgattactgccacccgagcttga

SEQ ID NO: 88501 - DNA, 228 bp, Glycine max
  Peptide Sequence Number=SeqID_205279
atggatgaaacggcttctgcggccaaggaaaagaaaaggatggatactgaagccatcgaaaaaattgttgatgtaaaaagaaagatggatattgatgccatcaaaaatatgcctagactcagtagagaattggtggaacatagattgcctatctatgaagggaaaaaaccagtgaagcatgcaccaagaagatttgctcccaatgtcatagaggtcaccaaagcatag

SEQ ID NO: 88502 - DNA, 288 bp, Glycine max
  Peptide Sequence Number=SeqID_205280
atggagatcatgaacaagaccaagctggcaaatcgcaagaagcttttgaggtctcaaacagagagagaaatattgcagtctttagatcatccttttttacccacattgtatacacaccttgaggcaaagacattttcttgcttggtaatggagttcttccctggtggggacctgcatccactcaggcaaagacaaccagagaagtatttttcggagcatgctgtcaagagcctagaaggaaaacttcaccctttctttgggaataagtaccagttgaggttttcataa

SEQ ID NO: 88503 - DNA, 465 bp, Glycine max
  Peptide Sequence Number=SeqID_205281
atgcgtataaggaaggcattgaagagttcttataatttgcttccgaaagaagccggccggatgaggatggaaaataattttttttttctgcctctttgcatatgcaagggtaaggctgcgtacaatatccctcccccataccttcgcatagcgaagagcctctgggcaatggggcatgcagaggggtctcaaattgaaccagttgatgtagaaatgagagatcgcctagaggaaatgattcatgatcttggaaaagagtcttttcagcaagcacatgcccctatgtataatacattggaaagtgattctaagaagcctttgtatccggggtgtaagaaatctttgaccttgttgtcggcggtgttaagtttggttaatgccaaggccaaatatgggtggagtaacaaaagcttcacttcactgcttcaggtagggcaggaaatgcttccagaagaaaacacgtaa

SEQ ID NO: 88504 - DNA, 396 bp, Glycine max
  Peptide Sequence Number=SeqID_205282
atggagagtttaagaggtaaggaggatgatgagctgattaaagagtataatagagaaaaaaagaaccttaccaaattcttgttgcaagaggagagatttcggaaacaatgctcaaaggttcattggcttaggggaggagatagaaacatcaaatactttcatgtttcagttaaagctcgaaaaataattaagcaaattagttcttttgaggatgaggatgggagaaaagtggatagtcagaaggagatttgtgcactaacctttaattatcttccagatcttttcactgcgagtgttggagattatgattctgttgcaaataaaatatcccaaaaagataatgagatgttgattcatcccttcactaaagaggaattcaaagaagttgtcttctag

SEQ ID NO: 88505 - DNA, 494 bp, Glycine max
  Peptide Sequence Number=SeqID_205283
ttgactcattacaaaatgtggccaatatcattatgtcacaatgggttgaccaatgtttgaatgttatgtgccatggtgtcgggtttgtggcacaaacacaatgtttgggttctaagaaagaagaaattggatttgtgaaaattttggccaaggccttgtctgtgtttgttactatggagtgggtcccacctttggatcccaaagttaaggtcaactttgttgttgcaatgatagaggatgttgggactggattggaagtgatttttagtaattctaaaggtgaaactatggcatcagaatgcagaaacatgatgcagggcataggatcatctctcacattggtggctaagaatggcaacgaagtggcacagtgtttagcaacaatggcttatgattatggtgagagagtttggattgaggaggtgccgaatgaagcatcacaatgcttgcaatctgatgttgtagaaattgcaaatgtttttcttgttcaatga

SEQ ID NO: 88506 - DNA, 990 bp, Glycine max
  Peptide Sequence Number=SeqID_205284
atggtgtattcttcaagcgtggttttggactcaaggtcaagcgtgtggaagggcatatggcacgcagaggcgccggtgacatgcaggagcctcgcgtggcgggcgtgcagggacgagctccccgtgaggtccctgctggtgcagagcggtctggtcgacaacgccttgtgcccgatatgcggccgtctccccgagacggtcacgcacgcgttgctcctctgcgatgacgcgaaactcgtgtggttcgcgtcgccactagggcttagggttgagtcgttgcgcggcgtctcgaccctgtcacagtggatcgatcaatattgtgttgacactttggacgacgaagcgatgggcgtggtgtgtgctaccatgtgggcgctgtggcacagacgcaatgcgtgggttttccacagcaagggaatggactgcatgcaggttttggccaaggcgtcgtccatgttcgtggtggttccggatgggcctgatgcgtgggttttaccatcaagtccctatgttaaggtcaattttgctgctgctgtgaaggacaatgttggtactgcgatgggaatgattttcagagactcttttggcacaactcgggcttcaggtacaaattttctggaagatgaatgttttgagccccaaattgctgaggcactatgctacaagtgggctttagagcaatcaggggaccttggattttcggaaattattttcgaaactgattgccaaaagctatacattcagtggaaccaattaaaacaaggaaaagctagtgatgattcctaccttcattcacttctagaagagtgcataatgatgatccaaggtacaggatcatctctcagattggtgcgtcccacagccaataaagtggcacaatgtttggcagatgtggcttttgattatggtgagaaagtttggatgggggtggtgcccgaggaggtgtcttcccatttacaatctgatatggcaaatgccaaacttccatga

SEQ ID NO: 88507 - DNA, 1155 bp, Glycine max
  Peptide Sequence Number=SeqID_205285
atgtctgatataccttttagaagcttgaaaagtgcgagaaaacgagctgcattttttgtgttttctggaaaacgcgatgaactcgctaagcgagcatgctgcgctaaccacgcgctaagcagagcattcttgagccaagcgcaattggttgcggcatccactgagttaagcgagctttactcgttaagctcccaacacttagtgaaatttttgaagaaccggaggatccttccggaaaggaatgtggaactttatcattctgaatttgacgagtttaaaatagaactggagaggcgaaacctacacaaacgtctcgccaaccttcatgaaggaagcatagatgtggcagtggttaaggaattctatgccaatttttatagtccagcatatcaagctcctaaatgtgctaaaataagaggccatttaatcaagatagatgcagacaacttaaatgagttcctccagactccaatgttattagaggagggggaatctttacccacttattcaagattttgcagactaaggtatgatcccagagagatggaggctagactgtgcattccgggcaagggctttattctaaacacggagggccaaccagggaagctcctcagaaaagatcttaccaccctggctcagacatggagcgtcttctcgtactcaaacctagctcctacctcccgcacttcagatttgaacacagacatagctaggttggtctatggcttaatcacaaggatggacatgaacattggcggtttgatctttggaaaaatgaccatgatcgctcagtctaactcttctcaattaggcttcccagctttaatcacaaccttgtgtagatcgaggggagtgggatctgatgcccttacctcctatgaaaacctaagaccgaccattgacttagcttatatcataaggaactgttggaatgcaaatgaccaaatagttaattttctagaggcaaggaagaccaagctcagagcaactgatattccctcttcctttacaccaatagctagaatccttgcatcttctacttcagccccacctccaactttagcagacttatatgctcagagctctcagaattcatatgccaaatttcaaagcttgtttgaaggaaaaattctcattatacaaagcttgtag

SEQ ID NO: 88508 - DNA, 861 bp, Glycine max
  Peptide Sequence Number=SeqID_205286
atgggcgttgagaactaccacgtcatcgagctcgtcggcgagggttccttcgggaaggtatacaagggaagacgcaagcacacgggacagaccgtcgcgatgaagttcataatgaagcacgggaagaccgagaaggatattcataatttaagacaagaaatcgaggtcatttgcttaattgatatcttacgaaagttaaagcatggaaatattattcaaatgctcgattcctttgaaagcccgcaagaattttgtgttgttacagaatttgcacaaggtgagctatttgagattcttgaggatgataagtgccttccggaagagcaagttcaagcaattgcaaagcaattggtaaaagccttacattatttgcattccaatcggatcatccatcgtgatatgaagccccaaaatattctaattggtgctggatctattgtcaagctttgtgattttgggtttgcgcgtgcaatgtccacaaatacagttgttttgcgatctataaaaggaactccgttgtacatggctccagagcttgtacgggaacaaccatacaaccacactgtagatttatggtctcttggtgtcatattgtatgagttatttgttggccaaccaccattttacacaaattctgtatatgctctcatcagacacattgttaaggcaccagaaagtcgactcacatggccgactcttcttgaacatccatttgttaaagaaagctctgatgaacttgaggccagggaattgcgagagataaatggttcacacatgcacagtgatgaagcacgggtggttgaagggaaaacaattcaaactccgacaacaggttcagctacttctagtactgcaagatga

SEQ ID NO: 88509 - DNA, 2768 bp, Glycine max
  Peptide Sequence Number=SeqID_205287
atgtgcagtgatcaagatgttcctgaatcaaaccagtcgttgaggattctctcaaacctagttgcagctggtgccttcagttctagtggactaatagatgaactaataaaagagctccttgtgtttactgaatctgttatagccatgaaatcctctgaagttactgacatgatggcaaagctcctccttcccttggctcgtggtggtttgttacctgcattgtcgcagtggtttgttacctgtgttgccttcgttgtctttatggtgggtgttgtggtggcaatgactgtccggagcattatgtttgaagaaattaatatgaatgaagacacgggagaggaacttgctgtggttgaaaatattgattgttctgacgcattcaatacttctcaggacgcattgccatgggcttgtattgttgtgtatgatattggttttgtggctgtgatagtgaggtctgacacatcaactggaaagagaggaaggacctcatttgttttaattggttgcgagaggagtgtaaagtatagagtgtacaagaaaggtttagtactgacgatgactagcactagaaaatgtggttgtccttttaagctgcgaatgaaaccagatgggaagattattcttagtgatatgacaaaatcaatggtaaaatcaaaggatattcttctcattttgaaggagcaatatgccaacaattgtacaacaatgaagcaagtctacaatggtttctccatcactaaaattttgctagataatggtggaagtttcacttcaagctcttatgtaagtcactgggttgaatttgttgagatctattctcaggttgtaacttcaaataatgatgcatctggaagagttctgtatgaatctagtgcctgcattacagtcatgctatctagagttgctcaggtgcttagatcatctcctaaaatttcaggccaagagaaactgaatgaaactgcttacagaattttagagcattcaaaaacaactggtttagtagaccatttgtgtctgtgtttagccacttcaggatcgagtcttattacaggttcttccaatatgctacgggctgcttctgaagcatgcaaagctgtctggatggaagttgtgcatcatgagcaagatctcttgcataaagctgattcgactaaagttgttgatgcaatgacaagagcattcctgagatctaaaactgttctggttgctgtttactattgttttcaccaaggacttgaatctgcaatgaattgtggtcttcagcttttatcaaggtgctgtctacataatggaattgttcctgctctcctttgtggtcttcccagttcccttcccgtgactactgttgttagtggtggcggtgatggaactattgtttcagaagttttcactgttttatcattatgcagttcctctgttaacaaagacacacaaagtgtagaaccaagtaatgccaagtgcaaattaacaaatccttctgctctggttcgtcattcatgtctccttgttgcagtaattgctcagtgtttgaagtcatctggaagaaattcagcaatttttatgctcactacctcaccaaagaagcagtttgctcgactatcagtgcttgctcaccaaatttcttctgatgataaaataaaagcctctattgagcctcaaagtgcatcagccatgttggctctggcatccattctatccctcgaatctggggctttggttgagtctccaatatctgaaattgctatgcctttaattcctcgaacttctacactaagtgaccatcttaaattttcatctagcaatgtaaatgaattggacccttgcaacatcagtgggaagttctcatattggcaaggggtaagagatgggtttgttggtcttttagattccagactcaagtggggaggaccattagctgttcaacagttgtgtgcaagtggcactcctctacttcttatgggcctattaggcaatgatgtcttaaatgcttctcatggaaatgaccatgtaaatgatagagttggattgtctcctattggtgttgtatggacaatttcatcattatgtcattgtctttctggtggtgctttgacttatcgtcaaattttgattaggaatgaacatattaagctcttttccaacttgatatgtgatgttcatatgaagttggtaaaatgttggatcggacctggtggagggagagcaggagtcagagatctaataaatggagtgatagatctcttagcatttccttttgttgctctgcaaaatgcgcctggcttgccatctgccactgcttctgtcagcagtggatttcttcttaatattggctctcctggtcagagagtatgcatggaagataagggtatagttaaggcaattgaagaagacatgggaaaatatattaagattcttgtagaggtgggtgtgcctggtattatccttcgatgcctagatcatatggatttgaatgatttgggcaggcctgttgcctttatggctaaaatggtatgccaccgacctttagcaatccaacttgtgagtaaaggtcttctggatccaaatagtatgaggaagttgtttgactgtttggccccaaaagaggtcaaattggatgctcttatgattatttctgatcttgctcgcatggacaagggattctatgagtacattaaaggtgcttctattttggagttcttgaaagattttctttcacacgaggatcccaatatgcgtgccaaagcttgcagtgctcttggaaacat

SEQ ID NO: 88510 - DNA, 282 bp, Glycine max
  Peptide Sequence Number=SeqID_205288
atgtttcaggctcatgttggagactttggcttggcaaagtcgattgacttttcctactcaaaatccatgtctgctgtggctggctcatatggctacattgccccaggcaagaataagttcactacattggagaagaagctgctttctggaatgggctgcgggagggccgaagctgaagaaattatgggtgccaatggagaaaatatggacagaaaatggccaaaggaaatccatgcccccgagcttactatcgatgcactgcttctccatcttgccctgtaa

SEQ ID NO: 88511 - DNA, 267 bp, Glycine max
  Peptide Sequence Number=SeqID_205289
atggagtatgtaaaacagtcaggtcaccacttggctaaaacattgtatggaacagaagttgagtctacaatagatgcaaaggatcccttcttgacaaaattatgggttgttaaggcaacaccaaagtgcaaaacactgtcctgggattttagggaggtgattgccaaagcttggttgcagaaacttaaccttagacagcataaacaacgtgaagctcctagtacaatattacatggaaacgcccagcaattcatgaaatcaaactga

SEQ ID NO: 88512 - DNA, 348 bp, Glycine max
  Peptide Sequence Number=SeqID_205290
atgatgagaatgaaaatttgcaatctgaaaatcagtgaactgagaggaatctttgtctggattctagtccatgtcttgataagtgttcatatcaaatccacttctctgctgaaactaatttccgactgtgcggtatcagcgctaaatccaagtagaaatgattcaggaaatgaatctcctctaaagatagctctcttttccctagcaaagatgtgtgcacatccattgtgcagacacttcatccgttcatcaccattgttccctgtgattggaaggcttcagcagtctccagaatcatccattgccaaatatgcttctgcgatcattagcaaagttgctgaaccttga

SEQ ID NO: 88513 - DNA, 648 bp, Glycine max
  Peptide Sequence Number=SeqID_205291
atggaagtcttaaacccaattgaaggcaagacctacaagctcccagttggatacagatttgatccaagtgatgaaattcttgctggttactaccttaggaagaggatcatggcccaaccactccctaatgacctcattcaagactgtgatgtttaccaaacagtgccttgggagctgccaggaggtggtaataagtatttgaattggcagaggtttttcttccatgatttgaggacctgtgtgttcgataaccttaacaagagagaagccgggaacggtcaatggagaacaatagaggaagctcaagatgttgagctctctaacgatcaggttgtggcaaaaaggaacgttttggctttctgggaggccaagggcaatggttttgccaaatctaattggctgatgcatgaatttcgccttgtgtcgaaatcacttccttccatggtgtcttctgtggctgtgtaccgcatattcgagaagaaggagggaagaaagggaaagaaggcgaaagggtctgaaggggagacctctagcagcagcagcagtgaggaagaagttatggatgaggcacccattgtcattgatttcacaatggagagttgcattgggactggtcctccctctcctgctactagtgaaaattcctaa

SEQ ID NO: 88514 - DNA, 237 bp, Glycine max
  Peptide Sequence Number=SeqID_205292
atggtttcactgattgggcttttgctaggggccggtcggatgaaggaaatgtgcaaaatattcaaaagaagtgcaaaagggtcacttttggggcattttttagcccctgggcccaccaggaagcttagggctgaagtaaccagttcgcctgggcgagcaaggttacttctggaggaagcaagtagctcacctgggcgagctgtcacacaacctccacccttcatttcctataaatag

SEQ ID NO: 88515 - DNA, 252 bp, Glycine max
  Peptide Sequence Number=SeqID_205293
atggagatcataaaccctatcaccaaggaaaagacctatgtgtttcctgttggatataagttcgatccaaatgatgatgatctcgtgagttactacctgaggaagaagatcatacgtgaacaactccctgaaaaactcattcaagagtctgatgtgtttggaactgagccttggggactgccaggaggccatttgcatgttattggaatgtgtataacatgttttccaccatttgattacatcaataattag

SEQ ID NO: 88516 - DNA, 785 bp, Glycine max
  Peptide Sequence Number=SeqID_205294
cctgcggcgccagcagagacggtgcaaaacagcgcgccagctgctgatccggcagtttcaccttcagcgtcgtcagccccagccgcaacggcagcggtaacgccggaaaaaccgcgcgaagcggaggcgcagcctgctccgccgccggagccggttgcgcaggtttacatcaagctgcagcagggcgaacgcgtccaggtgaatggcaaaccgcaggcgctggtgcctgccgccaacggttttgccgcgctgcagctggcgccaggcaattatacctttgccatcagcggccagggcggcacgcgcgagcaaacgctgaccatcagcgaagaaggcgtctggttgctcgatccacacactgaacgccgagctgctggccacggatgcgcgcatcgaccggcacgcgctgctggggcagccggtcacgttcacgctgccgacgcagagcctgctgtcgccgcgctacctcaacgggaaaatcacgcgggtggcggtgcgcagcgaggagctgagcgggacgcgctacgcggtgtaccagctgcgggtggagccggacctgtggccgatgcgccgggaccgcaacctgcggatatttcagggtcagacggtgccgcagatagtgcagacgctgctgcaggagaacggggtgaacgtggagacgcggctgggcagcagctaccgggtgtgggagtactgcgtgcagtaccaggagagcagcttcgacttcatcagccggctgatggagctggaggggatttactactggttccgccacgaggcggagc

SEQ ID NO: 88517 - DNA, 390 bp, Glycine max
  Peptide Sequence Number=SeqID_205295
atggccgatcactcagattcttctcctcttgttcctccccttcccctcgctgacccttccgagatcgacctcgaagccggtccctccgaacaaatccagtgccgaatttgtctcgaaactgacggtagagatttcatagccccttgtaagtgcaaaggtacatcaaaatatgtgcatcgagaatgtttggatcattggcgagcaattaagtctagtgatgaaaagaactgtagacaacaagctaatttttctttggaaaaaaaatcctctaatgtatatggtgcattgtggggtgtaaggaagggtttgcctttgctcactgcactacgtgcaaggctccttatcatttgcgtgttcatgttgccgctgataggaaatggcgtaccctga

SEQ ID NO: 88518 - DNA, 201 bp, Glycine max
  Peptide Sequence Number=SeqID_205296
atggctcaactgcagaagcaacaaaacttctgctttgtccttcttctctttgtggcactgggtatagcttatgctagagaagcttttgaagttagcttccaacagaactacaagattgcatggggaaagcatcatatcttctttctacagcatggtagagaagttcaactctcaattgataagacttcagtgcgtgcttga

SEQ ID NO: 88519 - DNA, 378 bp, Glycine max
  Peptide Sequence Number=SeqID_205297
atgattcttacattccctctctgtctcattcttgtcaattattttggaggtaacttaccagtagtcagcggcatgcaatatatctgccattgtgcagcctccaactcctcccacagaatatattatcatctcaagctgacatgtcatctgtgtggcaatagtgagaacaacatgtcttccattggggcacgttcagctgaaatttatgttatggagaagaggcagaaagagaagttgaagagaatggaagtggaaagagtacgaagaggtgaggtgagtactgaagagagaaaggtggctagttctagtgtgggaaagaacaaggtgcatccaggtagtgaacaaggagtcacatccgataatgcctttagggcataa

SEQ ID NO: 88520 - DNA, 322 bp, Glycine max
  Peptide Sequence Number=SeqID_205298
agtttgtgcagactgtcatttgccaggcactctttgtatgtggactgattgcaccacatgctttgagagttgtggaaccatggcaactgaatgtggtggttgtttggggggtgctggggaagcagggctaccattattattcattatggctttgattgttctgggactttttactgtaattgggatattctacagtgtattggttgctaccatggagtatgtggttgaagatgttgatggagagttgacaggatcggattggtctcccccggctcttccacccgagcatattcaacagttgaaaacattaggcctactatga

SEQ ID NO: 88521 - DNA, 588 bp, Glycine max
  Peptide Sequence Number=SeqID_205299
atggtaaagcaaggtgttattggaggattggcaatggtgattctactcatgtctggactcaaccttggctctaacaataatcttaatccttttgtctcaaccaccccaataatggtatctctcctcttaaagaatgatattctagattcaaacttcaaccaagaggatgctcaaaaaattcgttccctaacactattgaatatcacggagagagatcaactaagccggaaatattcaacgaatggtgagtacactgttaagagcgcatatcatgccattatggatcatttgctagacaatagccacctcaaggaaagccatcttttatggccctctctcttgctatgcagcatttggcagaatggaagcatgcccgtgccttgcacaaccaataacgtccacctacaactcataatggcacagcatcataaattcctcctcaccaaagacatatcaaatggaaattttatcaaagcaaaatctgctacaattcaagaacatccaaaacctgaagttgcagaggcatgggctctacaccagtccatcaattggataaaaagatctacaactccagaacgtgatttttga

SEQ ID NO: 88522 - DNA, 840 bp, Glycine max
  Peptide Sequence Number=SeqID_205300
atgatgtccatacagttcccttctacaggacttacaagccaaagccaggatcagggggttcttcaggtgcctttgcagcaaaaggacctgctgaaggagcttcttatgatccctggattggaaggaaagtttggacaaggtggcctgaagaccaccacttctatgaagctaggatcatcagctagcaaagaacatcaaacagaggtgcaggcacagaacagaggggttcagatagcaagaaaggcaaagagggtcatcacaaggccctctcaccttagtgactacggactacatgctttggtttatgatatgaattcagcaaatgaaacatgggagtgggtcaatcttaaagagatatctccagaagatattcgttgggagggtcaagatcctggaatatctggtaaaggtggccggcccggtccaggtagaggattgaagaagtctatgcctcacggtggtgcagttactggttctggaagaggtaggggaatgatgaaggtgcagcctaagaaagatttcactttgtcacaaaaaggggcaggaagaaggctacaaatgatattgagatactccatacagatacccttatcaaggaggaagatgaacaggctcttgttaatgcaattaccaggctcggagatgtgtctgagggtgaaagtgccagatgtagaacctcccttttcgcaagaccagtcaatggatcaggaaaaacactggaagaaacaacagtataattcgagtggtgttagagtaccagacggttcaaatggtgataaattaccaagagaaactagtgctccatctgagtatccgcacgaagttggcaacaaggcatga

SEQ ID NO: 88523 - DNA, 426 bp, Glycine max
  Peptide Sequence Number=SeqID_205301
atggagcataacaataatgaactaagtgcatacatgacactctctatgtttcggcatgagagaattaaaacggtaaaaactgagaagaacaagaacaagaacactaccgatgtgataaatggtgatgggatcctccttaatgctttccaaaatctccaacttggtaaagcttttgaacagccattgccatcacatgcactctgcatgcctgcaagggagaacaagctgattgggattagggttagggttggggttgggattgacggaaacctggcgattgaggggcgttttgattttgtggttggagaaaggaaggagccaaaaccaaaaccaaaacgacgtcgtgctttaaggggagcgatagaagaggttgaaaatgttgtggcaaccgcgaaggaagaagaccagacgacacgatcaaaatga

SEQ ID NO: 88524 - DNA, 300 bp, Glycine max
  Peptide Sequence Number=SeqID_205302
ggtctcttgttgtaaaggatttcctgaacacaagggaagggttgtccctgtgtgattcagacttcgtaaaaggattttacaaagagagtggaaactctcaagcgggttgcttggggactggacgtaggcacaggaagaatgtatggtctgcttgggccaacagcattttggaaggaaagagcaggctgctgttgttgttgctgagggctagaccatctgagattagggtgattcctccatccagggttgtatctgttgctggagaggttgctgcatggaagggcaaaggtctgtatggtg

SEQ ID NO: 88525 - DNA, 216 bp, Glycine max
  Peptide Sequence Number=SeqID_205303
atggaatcggttaaaattgaatcgcgcgagagacagtcagagagattggaggtagcagatcaacagctactaccgaggaatgggagtggaaagcgtgcagcggggtcaacgaaaaagtcaaagcgaggtgagagagaccttgagggagtgagaagcgaagcagggagtgtttgtgacaatgagcaccgacaacagctccagcctgcaagctcatag

SEQ ID NO: 88526 - DNA, 585 bp, Glycine max
  Peptide Sequence Number=SeqID_205304
atggaagcaaagggacagaagaataaagatctgttagggtcttatattatgggaaatattataaaaaaattgtatacagaacaaggcctaatatctgctgaacatcgaatacaattatgtcatttagccggcaaaagttcagatttgataatggttgatccatgggaggcaagtcagagcacatatcaacgcactttaactgttctctctagagtccacaattcagtttgtgagacagggttggtatctcaagaatccctcaaggtcatgcttctttgtggttctgatctccttcattcttttagcattcctggattctggattcctgaccaggttaaaactatatgcaaagattatggagtagtctgcattcccagggaaggacaagatgttgaaaagactatatttaaagatgacattctgaatgagaataaggataatatcaaagttgtgaatgaacttgttccaaatcaaatcagctcaaccagagtaagggattgcattgcaagaggactatctataaaataccttaccgcggatgaagtgattgattatatcagagagcaacaattatacttgaactaa

SEQ ID NO: 88527 - DNA, 264 bp, Glycine max
  Peptide Sequence Number=SeqID_205305
atgtgggtcatgcttgaaggaaagcttgcccaatcttctaagtcaaagttgcacttgagaattttcttggataacaataatggagttgaaacaatcaaggaatatttggagaagatggaaaaggaagtaggcaaaaaattgaatcttagatcacctcaaaggaattctacatcattggcaacattaggaagccctacattggtcataattctgcgaagaggtcggggtcttgatgctataacgagtagttacaggaaaatatga

SEQ ID NO: 88528 - DNA, 246 bp, Glycine max
  Peptide Sequence Number=SeqID_205306
atgtctaatgcatctgtggaagttgttcaagggagtcgatctgttgaggtgcgagatgctaatgttacaaagagtgtatcggctaacaaagatatgactgttgtagattacgatgttatgaccattatggtaaaagacagaggccgatcaagttcaggagctggaggatatttagtgaggctaaataagagacagaggagcccttatgccacattgcaattgaacattatttatcaaacattatga

SEQ ID NO: 88529 - DNA, 1171 bp, Glycine max
  Peptide Sequence Number=SeqID_205307
gcatgattttggaaagcaatcaggtggtgatacatttgtgatagagggattaacaaattggaataagaaagaaagactttcatctcatgttggaggtcctaatagggctcataacattgcttggaggaagcatttgacaatgtcgattgattgtattcgttttctattaaagcaaggattagctttccgtggtcatgataaatcaaccaattctgctaaccaaggtaatttcctggaacttcatagatttcttgctgaacacaatgaatcaataaatcatgttgtgttggaaaatgctcctgaaaatcatcaattaattgcttcaaaaatccaaaaagatattgttaatgctgctgcattagaaaccactaatgctattattactgatcttggagatgaattagttgctatcattgttgatgaagcacatgacatatcaaacaaggagcaaatggatattgctttgcgttatgctaacaaaaagggaagtattgttgagcgtttttttggtatggttcatgttaaagatactacagctttatcattgaaaatggcaattgatgaattgttttgtaaacatgggcttagtatatcaagaattcatggacaaggttacgatggtgctagcaacatgcaaggggaattttctggtcttaaaagtttgaatcaagaaactagacttaaacgagctgttgatactcgttggggttcacattatgcaactttgatcaatttgatattgatgtattcttctataattgatgttcttgaaattataaaagaagatggatcaaatgcagatcaaagagctaaagcaaatggtcttttacatttgctagaagattttgattttgcattcacattgcatttgatgaaaaatgtcttgggtatttcaaatgaattatcacaggcattgcaaaggaaagatcaagacatcatcaatgctatgaacttggttaacatcacaaagctacggttgcaaactatgagggataatggatgggagtctttactgcaggaaatcacgacgtggagcgtaggagtgtctcaatattgtgcgtccgagctccacaaagttggaagtgaagctggagcagctatagtctgtgtcttgctgatcgaatctacttctgatgagtacgatagttttgatgtagctgttattgtttaa

SEQ ID NO: 88530 - DNA, 177 bp, Glycine max
  Peptide Sequence Number=SeqID_205308
atgtggaattgggaagtcagaaatacagttgacgagataacagaagccaatataatcatggcagttgtaaatgggggtgagttctctgcacgaagaggcctcagcacagtttcaatagcaaagaaacaaccagcaactggagcattgaagcctgaagagaggacaattgaaaactaa

SEQ ID NO: 88531 - DNA, 234 bp, Glycine max
  Peptide Sequence Number=SeqID_205309
atggagttcattgcaatgatgaatctaaaggatgaccaacttaatcctgatagtgctgagagaccctccatgaggagagtgttgcaaattctaaacaatgaggttgcaccacttgttgtgccaaaagtgaagccaacactcaccttttcttctgacctacctctgcctctcactattgaggacattgtttcagaggctgatcaagagtctatttgtgagatcaaaattgactga

SEQ ID NO: 88532 - DNA, 1472 bp, Glycine max
  Peptide Sequence Number=SeqID_205310
atggcggctttttatcttgttgttccggggactttcatgactgctttaaaccgcctgctcaccatcatgcaaaccctgcgcgatccggtgcgcggctgcccgtgggatcgccagcagactttcgcctctatcgcgccgtatacgctggaagagacctatgaagttatcgacgccatccagcgcgaagactttgacgatctgcgcggcgaactgggcgatctgctgtttcaggtggtgttctacgcccgcatggccgaggaacagcagcgtttcaatttcgatgacatctgcaacgccatcagtgacaaactggagcgtcgccatccgcacatcttcggcgaagcccaggtcgattccacggccgaagtgctgaaaaactgggaggcgatcaagcagcgcgagcgtgcggagaagtcgcagcactcggtgctggacgatatcccgaaagcgctgccggcgctgatgcgcgcctataaaatccagaagcgctgtcacagcgtaggcttcgactgggacagcctcgggccggtgctggataaagtgcatgaagagatcgacgaagtgatgcatgaagcgcagcaggccgtggtggacagcgacaagctggaagaggagattggcgatctgttgttcgctaccgtcaatctgtcacgccatctcggcagcaaagcggaaaccgcgctgcagagggccaacgacaagttcgagcgccgcttccgtcagccggcgaataaccttattcagcctctctgcgcagcgcaggctgtaatgcgaggaggatggtgtgattcatcaattgtggctgcggacgacttcgggtatactgttttcccgtcctggttattccaccgcattgccgcagcctccctcgcagccatccttgaagcacgtggtctgaatgtgaccatcatgaaactcgatccgtatatcaacgtcgatccgggtaccatgagccctacgcagcacggtgaagtgttcgtcaccgatgacggggccgagaccgatctggatttaggtcactacgagcgcttcatccgtaccaaaatgtcgcgccgcaacaactttactaccggccgtatctactcagaagtgctgcgcaaagagcgtcgcggcgactatctgggcgcgaccattcaggttatcccacacatcaccaacgccatcaaagagcgcatcattgaaggtggcgaaggtcatgacgtcgtgctggtggaaatcggcggaaccgtgggcgatatcgaatccctgccgttcctggaagcgattcgccagatggcggtcgatgttggccgtgaacacaccatgtatatgcacctgacgctggtgccttacatggcggcggcgggtgaagtgaaaaccaagccaactcagcactcggtcaaagaactgctgtcgattggtattcagcctgacgtgctgatttgccgttcagaccgcgcggtgcccgctaacgagcgcgcgaagatcgccct

SEQ ID NO: 88533 - DNA, 543 bp, Glycine max
  Peptide Sequence Number=SeqID_205311
atggaagaagaggaagatttggacgaggtcgattccaccaccgagatcgagattgagctagaaaatctcggggaagggggtcttgtaggcatggtagccgtggttggtggcaacaaaagcgaatcacccatggaagaggggacgcgaagatggcacgccgtgtttgatctggctggtttggtggtgttggaggtggatgttcgccgaggaggttccgatctagctgatggtggaggtgtgggaggtgcgagagaaagagaaaagaaaagaaaaaatgaaacttcacatccgggaatgatcgtggagtcgccgacctcgtcgagttcaatgcccggagggatcaatagctgggattcaaaggaagacgaaggaagagggttggtggtgggggttttggaggcgttgcttgaatgggaaagagggtggcggaaggagaaaagagaggtgggacactgcaggttttggagaagagagaggtggcggaaggagaagagagaggtggaggttttggaggcgttccttgaatgggctacacgacactga

SEQ ID NO: 88534 - DNA, 1871 bp, Glycine max
  Peptide Sequence Number=SeqID_205312
caaggccttttgttgctttatataaggtgctttctaaccccaagtccttcaacttcatagctttgcaattcacagctatggaaacctgcaaatcagaggatttgcacatgcaggttgacattgagaagaacgcgaaggacataaggtctcagtgggtgcttaacgctcctgagcccccaagtccatggcgtgtggttgcagattctgtggtttttccaattcttgcttggggcagaaactacactgctactaagttcaggaaagatcttcttgcaggtctcactattgctagtctttgtattccccagagcattgggtatgccaccttggcacatcttgatcctcaatatggcctttatacaagtgtggtaccaccacttatctatgctgtaatgggaacctcgagggagatagcaattggtccagtggcagtggtttctcttctgttatcctcaatgatggagaaattagtagaccctgctactgatccagtgggttatacaaagctgattttgcttgctactctctttgctggtatctttcagacttccttcggactcctcaggcttgggttccttgtggatttcctatcccatgctgcaatagttggatttgtggcaggagcagccattgtgattgggcttcaacagttaaagggactcttaggaattacccattttacgaccaagaccgacatagtctctgtcatgaaagctgtttgggaagcagttcataatccaggtaaaaggaagaagaaactattctggttggcatcaatctctcctcttgtatctgttgttgtgtcaactctaattgtgtttatcacaagagctgataaaaatggagttaaaattgtgaaacatgtcaaaggggggttgaatccaagctccatccatcagttagacttcaacaacccctacattggagaagtggccaaaattggactagtggttgctgtcgttgcccttactgaatctattgctgttgggcgatcgtttgcatccatcaaaggataccaacttgatggaaacaaggagatgatgtcaataggtttgacaaacatcataggatctttcacctcctgctacgttgcaactggttcattctcccgtactgctgttaattatgcggctgggtgtgaaactttggtgtcaaacattgtgatggccatcacggtgttgatatcactgcagtttttgacaaagctattgtattatactccaacagctattcttgcttctgtgattctctctgccctaccaggactcattgacctcagtgaagcttacaaaatttggaaggttgataagatagactttcttgcatgcgctggagcattctttggagtactgtttgcttctgtggagattggtctacttgttgcggtggtaatatctttttcaaagatcattctcatttcaattcgaccagggacagaaactctaggaaaacttccgggaactgatttgttctgcgatgtctatcagtatcctatggcagttaaggttcccggggttatgataatacgagtcaagtctgcgttgctttgctttgcaaatgccaatttcgttagagaaaggatcattaaatgggtcactgaggaagaatcagaagatgacaagggaaattcaagaagcaccattcaacttctaattcttgacacctccaatttggtgaacattgacaccgctggaatcactgctctagaggaactgcataaaagtttgtcttcacatggaaaacagttagccattgcgaaccctaggtggcaagtgatacacaagctaaaggtgtccaactttgtcggcaaaatccgaggcagagtctttctgactgttgaagaagctgttggctgcaagagccgctgctaa

SEQ ID NO: 88535 - DNA, 570 bp, Glycine max
  Peptide Sequence Number=SeqID_205313
atgtgttggagctctagtaactcagaggtggttgcttcaaacaaaaccacgttagaagaggttttggacattgagaacaacatggctcatcagtgggtgctcaatgctccagagccaccttccatgctgcgtcaggtggtggacaacgtcaaggaaaccctcttaccgcatccaaatccaaacacattctcttatctcaggaaccaacccttttccaaacgtgcctttgccttgttgcaaaatttgtttcccattcttgcttcactccaaaactacaatgcccaaaagctcaagtgcgatttaatggccggtctaacccttgcaatcttcgctattccccagtgtatgggaaatgcgactttggcgcggctaagtcctgaatatggcctatttaggcacattggttctagaattaatgtccttaagcatgatttggtcagatacaggaattgtcccacctcttatttatgccatgctggcgagttcaagggagatagtgatcggacctggatccgtggattcactgctactttcctcaatgattcaaacattgaaagttcctattcatga

SEQ ID NO: 88536 - DNA, 874 bp, Glycine max
  Peptide Sequence Number=SeqID_205314
gactacacgtcctgaccttcagaggactacacacctcgccattagaggactccacgtcctcaccttcagagagctacccgtcctatctttcagagggctacacgctctcgtcttcagaggactacacgtcctcaccttaagaggactacacgttcccactctcagaggactacacatcctcaactttagaggactacacatccacgacttcagagggctacacgtcctcaccttcagagggctgcaggccctcaccttcaaaggactgcacatcctcacctttagaggactacacgtcctcaccttcagaggactacacgttcccactttcagaggactacacgtcctaaacttcagagggtttcacgccctctcctttagagggatacacgctctctccttcagagtactacacgtcctcaccttcagagggctacatgccttcgccttcagaggactacacatcctcgccataacagggtcacaggactacacgtccccgccatcagagggcaacacgtgctcacctgaagaggactacacttcgtcgccatcagaggggccacatgtcattgccttcagaggactacatgccttgccattagaggactacacgacttcaccttcagagggctacataggactatacgtcctcgcctttagaggacttcacgtcctcaccttcagaggactacacgtcctcgacttcagagggctacacgtcctcgacttcagaggactacagaggactacacacctcgccatcaaaggactacacgtcctcaccttcagagggctaaatgtcctcaccttcagagggctacacgccctttccttcagaggactacacgtcctcaccttcagaggactacac

SEQ ID NO: 88537 - DNA, 594 bp, Glycine max
  Peptide Sequence Number=SeqID_205315
aggtacgagggtgatcggctagatggcaagtacgatgggtatggggtggaaacaagggcgcatgagagcagcttacacgggtgttactggcaggggctgaggcacgagtttggggtgtataggttttacaccggggatgtgtatgctggagagtggtctaatggacagagccacgggtgtggggttcacacgtgcgaggatgggagtcggtatgttggggagtttaagtggggggttaagcatggccatgggcattaccatttcagtgattcaagtgtattgataaaggattggacatacaaagaccggggtaaggggcatcgatttgatagcagcattgtgcttgttgatccttatgcgaaactagttgaaggtcgaagatatttcggggatattagcatgaagttgtctaagtttcttggcacatatgattttgatagcttgccttttgactggggagaaaattacaagcttccaaatatttctgagaaagatcttgttatatatgagatgaatgtctgggaatttacaagtgatgaatctagtggtttggatagcaacattcgtggcagctacctcggtatgattgaaaag

SEQ ID NO: 88538 - DNA, 264 bp, Glycine max
  Peptide Sequence Number=SeqID_205316
atgacttacgtcccaatttgtgatttgatttggtctagagaagaagaaaaatatgttgaagatggaagaaagtgtgagaaagaggaggaagcaatggtggattcggtgcaatgctcgcagatagatgggtttctaggtgatgtaatcaacgatatcacagatgatgaggaaggcaatgttagtacagatcaaactctgctatggaatatgagattgttgttggagttgagggatctccccagattgagcgagatgcattcttga

SEQ ID NO: 88539 - DNA, 1269 bp, Glycine max
  Peptide Sequence Number=SeqID_205317
atggggtggaactggttcaagccaaagtccaagcgatccaacagtggcatgctcctagttcccttaaagctctatggggagcagtttgtatggtcccatgacgcgcaacaagcttttgatgaattgaagaatgcagtcagcattcacttagggatgcttcaaccccattacactgcgcacacaatcacccttcttttcatggagattgttggcaaacatcatggtatgcctcgaagcctagttttagaccatgatcctttattcattagtcacttctggaaggagttattcaaactgagtgggaccaagttgcgtatgagttttaatctggtggccagacaaaagtgttcatcaccttatcgacaatatctgcaagcatttttgcacaatcaaccttcttcttggggcatacccttgatatgggatgaatggtcttataacacttctaggcactccagcatgggtgtttctccctatgaagtcacctttgacaagaaacctcctagcattccacaatatattgtgggtacatcaaagattgaagcagttgatgatttttggccaacaaggaagctgtgtttgccagttatggtcaagctacgccctcatagacaaacatcaactactgatgcaccttataccaagcttgccaagcgttttaatggtccatttcaaatattggagcaaattggcaaagtagcttataaactccaattacccgaaggatctcacattcatcatgtttttcattgttcaattcttaaagcatttcaccaattgccaatagaagcaagctatccagtagtgttactaccaataaaagttggcaaccaacctaccatcacacctcttgcaatcctcaacacacgttgggatcactctactgttgaacctagattgatggtgctagttcaatgggcgggcctatcccctgatgacacttcttgggaagattgggctagtttgaaagccacctatcaccttgaggacaaggttctgaacttgatgaataatggaccaatccgacagcactttgtcttggaagatctccacattgcaagccttccaaatctgccaacacctgactgcaaaaatagcgccatagtcagccttgatgtgtctctgcaaccaagtttggaaatcttcattatgattcttggaaacatccaagtgaagcatattccaaattctgctagcattggggtaatgaagcagaacatgaaatatggattcaatagcagctccacacttgaaacaagaaaaatctag

SEQ ID NO: 88540 - DNA, 204 bp, Glycine max
  Peptide Sequence Number=SeqID_205318
atgtcgcaaaactttacggattacctaatgatgggtattaagtacctcgaggaggtcaagcgaaggttgcatgccaccaaacaatggtccccagacgaaattagaggggaactcgcccaggtgtacttcttgcttaggcttgaaggaatcagctcacccaggcgagctcgagctcgtctaggcgagtggcttgcttatggctaa

SEQ ID NO: 88541 - DNA, 219 bp, Glycine max
  Peptide Sequence Number=SeqID_205319
atgagaggctttacacatcaggggttaatggaagaaggtagcttacttttcccgttgacttcgcgcttagcgtgggctttcacgctaagcgtgcctttgggcttcttcgtgggccttatgcatgctaagcctacagtgcgggctaagcctatatcgcgctctaagcctgcagtgtgggctaagtctggagtgtgcgctaatcctccatcgcgcacttag

SEQ ID NO: 88542 - DNA, 342 bp, Glycine max
  Peptide Sequence Number=SeqID_205320
atgttgtcgataccaaaacttgaagcccttataaaaaagggtgaggaatcaactgttctgataccaaaacttgaggacaatatcccaaaattgcaaaagttgttgcttgatgaggagaaggtcttagaagaaatcacagagagttcgaaagttgaaactgagaaataccgctctgagcttgctaaagttcgtgctgagcttgaaccttgggaaaaagatttgattgagcacaatggaaaacttgaagttgcatgtacagaggctaagcttctaaatgataagctgaaagtaaaagatgaaagggatttattaagtctaaggaaaataaccacggacacttaa

SEQ ID NO: 88543 - DNA, 279 bp, Glycine max
  Peptide Sequence Number=SeqID_205321
atggtcatgcgcaacttcaaatcctacgccggcgaacagcgcgtcggtcccttccacaagagtttctccgtcgtggtgggacctaacgggagcgggaagagcaacgtcatcgatgcgaagctgtttgtgttcgggaagcgagccaaacagggacgggattgggttgggtgtgaatcgaatctgagactgggaaaagaaaacgaaaacgacggttcagattggtttctcagtgaagaaggcagagaatcaacgtctgttcttggtgcaagattctcataa

SEQ ID NO: 88544 - DNA, 381 bp, Glycine max
  Peptide Sequence Number=SeqID_205322
atggtgactgcaaagtgtgttatggacatagggaaaggcaacttggagatgagtgccaagactcgagtcactccagacattcctccagctccttcaccagcagtccctccaccagatgtgtctcctctacataccggccaaacttctatgccttttactcagccggagaagctcctccctatgttgcatagcctccaccatggccagtacctactaatgcaaagcctccagcagccggtgatgacaccagaggcattcctagtccaggggggtgacacctttggtgtagctggtgatgatgctatagatattgtagctgatgatgattatgttgcggacatcagagatgctcatagagcttgggatccagggcctacataa

SEQ ID NO: 88545 - DNA, 293 bp, Glycine max
  Peptide Sequence Number=SeqID_205323
gttgtaggagagcatcatccacagaagttggttcaagccaaatttgtcccaaatttgggggagttatttatcaaggtaaatttgtcccaaatttgggggagttattatcaagcaattgggctaagtgcataaccaccgctaagcgctgcttcagcgcgcttagcgcaaaggagaatctggcagaacatcagtatcaaagcagcgctaagcgcgagatcagtgcgctaagcacagcaggtgccttaagccaggctaagctcgagattggcgctaagcctgaacccacttactag

SEQ ID NO: 88546 - DNA, 456 bp, Glycine max
  Peptide Sequence Number=SeqID_205324
atgcacaatgataaaccttttggaggaaaggtcattgttttttgtggtgatttccatcaaatactaccagttgtgccaagagacataggtgatggcaaacttggagaacctaacgatggttatggtgaaatcaccattcctgatgagtttcttatcaaggactttaatgatcctatccagtcaattattgagtcaacatatcctaacttattacaaaactataccaacggggatttcttgcagcaaagagctattctaacttctacaaaagatgttgttgatagtataaatgattatgtcatgtctttgatatccactgacgagaaagagtattgtagtgttgatagtgttgataaatctgatgaattactcaatcctacttttggagttctaacacctgaatttctgaactcattgaaaacatcaggaatacctaatcacaagttaaaaatcaag

SEQ ID NO: 88547 - DNA, 210 bp, Glycine max
  Peptide Sequence Number=SeqID_205325
atgcgctcagtcaatcatgctgcgtccagcggatcatgcgctcagccagaggaggatggcttagcgaactgcaaaaatcaaacttcaccaaacttgcttattttacctgaaattgaaatggaaagttttgcttgtactcaagcaaataaagaacagctcactggtctccaagtgacaaaacatgcagtgattatgtacaaaggtgtgtaa

SEQ ID NO: 88548 - DNA, 885 bp, Glycine max
  Peptide Sequence Number=SeqID_205326
atgaaaaaggtcatctgcacgttatgtttggtgtttgcatcggttagttctgcgctggccaccacctatcctctcacgattgaaaactgcggctataaagagaccttcaccaaaccgcctgagcgcgtggtggcgctggggcaaaataccgcagaaattttgctgctgctcggcctgcaggataaggtcatcgccagcgctttctggccaaccaaagtgttgccacagctggctgcacagaatgcaaaaatcaaaacgctgacggttgaaatccccaccctcgaatccgtgctggcgcaaaatccggacttcgttcctgcccagacgccgctgctgctgggacccgagagcaaggtggcaaaacgcgaagatttaatcacccttggcgtgaacagttatgtgtcgcctggaatgtgcgccaccaaaaaagccgcaggggatatgtatggcagtcgccagcagctgtgggatatgacgttcctgtatcaggagattcaggacttcgccaaaattttcaacgtggaagatcgtggccaggcggtgattgccgatttcaaaaaacgtgaagcggcactgcgtcaggagtttggtagcagcaagaaagatctctcgtttgtgttctggttctcaagctcgtcaccgtctgcggatgcctatgtgggcggtaaaaacagtccatccggattcatcgccagcgtgctgggcgggcacaacgccatcacgtcagagaccgaatggccgacggtcagctgggagagcatcattgctgccaatccggatgtgatcgtggtctccagtctcgatcgcaatcgctgggcgctggataaagccgaagagaaaatcaaattcctgaaaagcgatcctgccgtcagccagctggatgcg

SEQ ID NO: 88549 - DNA, 333 bp, Glycine max
  Peptide Sequence Number=SeqID_205327
atggagttcatccgctttggtgtcgtcagacccaccgccattggtgccatagtcggtcttctagcacttcctctcattgaaaatctcggtcttcttgcgcttcctcaaatcttcgaggacaccgaatcactctcttctttcacctctattttcaaacttcgaaacattaaaacccccaaatggccataccctcaacacaattgtaatcaaatggaagaaaagcaggagaacataccttcaagtaacactcacaaaaggaaaagcttaagtgccctcgatatgactttgtttgtgtcgtttggtttgctagatactttctctgtgactttgtaa

SEQ ID NO: 88550 - DNA, 138 bp, Glycine max
  Peptide Sequence Number=SeqID_205328
atgacgacagaggaagcggttgtcagagtggcaaaggttgctggaggtgccgtcggaggcaatgaagattctaaggcggttatagacgatcgtcttagaatgtctttcgatggcaatattgtaattatgaggaagtaa

SEQ ID NO: 88551 - DNA, 264 bp, Glycine max
  Peptide Sequence Number=SeqID_205329
atggtactaaagacgtgttcaacatactatgatgcttctggcattgtgaaagatcttgacaatgataacatgttgaagtttgagtacattattcaagtatgcttcttctgggttgatgccattggttgcaacttgccattcggttctagactaaaatggggagaacttgtaattgtccttaggaagttgtttataaggctattgacatggctatggccatggaaccttcacaatgtcagagccaagagacaggctatcacataa

SEQ ID NO: 88552 - DNA, 192 bp, Glycine max
  Peptide Sequence Number=SeqID_205330
atggattgtccatcggacatggtggagagaaagggaggcgctctacagtggttggcgaaaatggttgctagggagaggtttgtgggagtgataatctggtgtagaggatgtaaatatgacttatggaatgagattaatctaacggctcagaattatgtccattctagaccaatcgaaatactagaccattga

SEQ ID NO: 88553 - DNA, 246 bp, Glycine max
  Peptide Sequence Number=SeqID_205331
atgagtaaggaacatgagatcgttcttgtcaatgttgccgcgatctctttagcgttgatggaattcttagatgtgagattggagttgcgacagtggattctaagttgtgacataagattcacaacggggttcaaaatgttgtgccgggatgacgaagtcatgaaggcagaatcagaacagcaaaaccacaatgccggagttgggattggggaaggaatggatttgtgtaaagcgctattgatctag

SEQ ID NO: 88554 - DNA, 306 bp, Glycine max
  Peptide Sequence Number=SeqID_205332
atggcactggcgagggccaacatagatgaacataatgaggcaacaatcgcttattttctaagtagactaaaccatgatattagagatgttgtggagttgcaggagtatgtggagttagaagatctattgcacaaggcagtaggacacattacatctaaatgtccaaccaaaagcacaatgctcatgaaggaagatggggaaatcaccagtaaatccttagccagtgaaagagaacaagaggaagagatagaagaagaagcattagattatgatttactattggtcatgaggttgcttggaagctag

SEQ ID NO: 88555 - DNA, 607 bp, Glycine max
  Peptide Sequence Number=SeqID_205333
atgcgtgcgtcgcctgccttacttcatctggcaggcggcggcgaacgggtcgtgatactgcgtcagcaccgtgcccgacagcttgttggccagcttgccgtccgcgcccttgacgatggtgcgcaggtagtagttctggatcgggtactgattgcgattgaacttgaattcgccgcgcaccgacttgaaatcagcgcggcgcagggccgggcgcagcgcatcggcgcccagcttgccgccggtctgcctgaccgcgctgtccagcagcatggcggcgtcgtagccttgcgaggcgtacagcgtgggggtgcggttgtaggttttcctgaagtcctcgacgaacttgcggttggccgggttgtccaggtcggccgcccattgcgacgagttatgcaggccttcgatcggcgcgcccaccgccgcgatcgtatcctcgtcgcccgagaagcccggcgccagcagcgcgatctccttgcccaggccggcgccgttgaactgcttgatgaaattcacgcccatgccgccgggcagaaagaaaaacacggcatccggcttgctggcgcgcagccgcgtgatctcgacgccgtagtcgagctggccgagctgg

SEQ ID NO: 88556 - DNA, 361 bp, Glycine max
  Peptide Sequence Number=SeqID_205334
atgaccgcaaccatcacgacgcgcgaggtgaccatcgcctcgcacgacggcaaatcattcagcgcctacctggccgtgccggcctcgggccacggacccgggctggtgctgtgccaggagatattcggcatcaacgacttcatgcggcgcaccgcgcaggcgctggccgaggaaggctacgtggtgctggcgccggacctgttctggcgccagcagcccggcatccagctgaccgacggcccggccgacatgccgcgcgccttcgagctgtatcatcgtttcgacgtcgagctgggcgtcaaggacatcgccgcgaccctggcggcgctgcgcgccctgcccgagcagcagggcggcgccg

SEQ ID NO: 88557 - DNA, 297 bp, Glycine max
  Peptide Sequence Number=SeqID_205335
atgcgcctaccagggaaggagagtctgctgatgggatcccccataaccataaatgagatcttggatgttagcatttcgtttctaaatgaccatttagaggaaacactgggttcgacaaaaatagaagaaatctactcaaagtgtatcaatctcgcacaggtcaaggttcatggtgagtcaggatcttggctcaaggtttgtagaatggctagacatgatacatgtcggggtttggtttggttcaaggataaaaaagggatgccccacattatttccatgacacaaatgcaaaaatga

SEQ ID NO: 88558 - DNA, 639 bp, Glycine max
  Peptide Sequence Number=SeqID_205336
atggcagcagttgatgcatccaaggaaagagatgaagctaacttggcaaatcttgccatgaaaaaggtgcaaaaagtaaagcttagtgagcttgtagacccatcctttgggtttgagtcagaccaagtagttaaaaggatactaacttcagtagcagggttggcctttcggtgtgtgcaaggagacaatgaattaagtccttctatggatgaagttctggaagcactcaacaaatttcaaaatgagaattatgagtttgagaatctagagaaaaaagatgatctattagtggtacaagaagaacaagaccaagagcttgagcttgttgatgttatattcaagtatgaaaagaaggaattagaaggagttgaacttgagaaaagcaatatccttctaatggggccaacacgatcagatgcaacttcactcactcatgcaagtttccatgtttatatcacatgtctaacctcagtgtcaccttcaaacaggcaggttatgttggagaggattacaatccgtattatacaagctcctcatgtgacgtatctcaatcgcggcagagatgaagtcgtttgcaatagttgtagcttcaacgacaatggtagcttcagtgcagtttccagcagtcatagggtgtga

SEQ ID NO: 88559 - DNA, 771 bp, Glycine max
  Peptide Sequence Number=SeqID_205337
atgttgaaagtacattgcaaagaagctattaaattttgttcagagtacattgcaaaggcaaaacctgttagagttcccgggtattggtatgacaagaaagtgggagatgggcctaaaagaaatgttagaagttgggaaggatatgatatcaacaagtattcattctacaccaaatcacaagactacaagagtacaatgcaaaacagtggggttagtcttagggttgaatctcaacattttgctactatacatgatgacaatcctcgtctggcatccatgacttactttgcagtcattgaagatgatgattcaacccttgatacttgtctcactcctttctccacacatatgactaacttcaacacagaagaagttgacgatgtccatgcagattgtaatgatataatgcacatgactacaccaccgagcttcgttcctcctcctaagtcaatgccttcgccgtctatgtcaaataagattagaaaagcaacacagcttagatcattggctaccagacccgttggaatggagacaccagtggttcatatggatcctgccactaggaaagctgatggtccccatagaaagcaattaagaatgtatttagggatcgttactcgagacaaggtggatgttacatttgttaactggaaagaagttcctgcagctcagaaggatttgatttgggaggacattaaggctgaattcaatattccagaaccgtctgaccaaaggacaaagaagaaaatccttaaggtggtaggagagtga

SEQ ID NO: 88560 - DNA, 285 bp, Glycine max
  Peptide Sequence Number=SeqID_205338
atggctctagtgactggtcccttcctagggaggattgcatcacatatcgacaacatcaaaagcataggtgaaaaagtgatgtctttgttgatctgcaatatatctggctttggggtcttagataaggcagataggttgctgaatgaggactttgaggaatcacttaatgagatttcacaaatgattcctcgtgagcgaaggacatttctattttctgctacaatgactaagaagatatgcgtaaatttattaattaatgctcagtcagacaatttttgttcatga

SEQ ID NO: 88561 - DNA, 344 bp, Glycine max
  Peptide Sequence Number=SeqID_205339
atggcaatgaagggaagtcttaaaaaagccaatatagtggatgcagtaactgcattttcaacttgtggtggagtaacagatgatacccttgttcgttcccaaaacctcactcccattcaatccaccatttctgcaactattgattctcagtcttccttttgtggtaccgaagtagagagggtcaggagcccagtgtctgctaacaaaccaaacgtgagagataaacaagtaaaaggggtcgccaccactacaggtggttcctcacgtgagccgtctgaggaggatgatgaagcaggtccttgtgaacaaagcacaaacgctatagatatgaagcgccttagaag

SEQ ID NO: 88562 - DNA, 273 bp, Glycine max
  Peptide Sequence Number=SeqID_205340
atggagtccaagtggggtggcgcccccgccagcatcatggcggcgaatttcgacgacttcaagtggatcgcctccatgttcgatcccggaaacgacgacgtcaagcccttctccgacgcagctttccaaaaccaggaaagaaacgatgttgctgaaaggacatggaagtggaacctgaaaactacgatagaaacatttttcatcaacttgaaacatactggtgacaaatatgacgaacgaccgaatttgactaatggtcatattaccaattaa

SEQ ID NO: 88563 - DNA, 164 bp, Glycine max
  Peptide Sequence Number=SeqID_205341
gtagaacggatgtggaagggggggttgaacggctgagactggaaaatgcaaacctatttaagcagcttacagatgccagccaacaatttcgtgacgctgatacgaataaccgagtcctaaaatcagatgtcgaagctttgagagctaaggtatacgttctttag

SEQ ID NO: 88564 - DNA, 845 bp, Glycine max
  Peptide Sequence Number=SeqID_205342
atggctatcggaaagctgcacgagcagcagcgactcttggacggaagtggatttcgcaggcaatgcgccttctcctgtcaggcgaggcgtcgtcgttggagggaagccatcacacagacctcagcgctgcagcaccggctccaactcgtggccgcaggccaggcagtggctgagccattcgccgaggaacaggttcagctggttcttctcgtccggctggtgcatgtcctggttcggataggggtagatggccagcagccggcgcgcctgctcggcacctatgacttcggccatgcgcgcatcgtggtagacccgcacttccaggcgcggcgccggcagccagggcaggccgagctcctgacgcacctgcagggtggtggtgtacggacaggcttcgatcacttccagggccagcacaccgagcagacgctcgccctcgctgagcgcaacgcgccgggccgtgcaattttctcgcatgtccgggagcaggcgcatcaggcgcaggtagttggcctcgcaggtggcctgcaatccgaccaggtctacacgataacgctcgcgcagcaggttcacacccataagcctcgaacctcggcgcggttgagcgccagccattgcagggcgagcatgctcgccgcgttgttgatgcgtccgtcgcgaactgcctgcagcgcatcctcgaagggcagcacatgcacgcggatgtcctcgccctcctcgtccaggccggggatgcccgaggccccgctgctgtcgcaacggccgacgaacaggggcaccagttcgttgcagccgccgggcgacggcagatactggctgatcggccagagcgcgccgaggctcag

SEQ ID NO: 88565 - DNA, 842 bp, Glycine max
  Peptide Sequence Number=SeqID_205343
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctcgagcaatgtcggtccaggacagccctatcagcattgtagccagtttgggtccatggggacctatggagtatggcagcctaatatatggcctcattctaattggagcagcaatcattagattcggtatactttgcacaaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 88566 - DNA, 165 bp, Glycine max
  Peptide Sequence Number=SeqID_205344
atgaaagtcgcatcagcccagaatatgaggaaggcgtcgagcaattcttacaatttgcttcagaaagagtatttcactgatcctagaccattggaaccagaaagattgaaggcgcttcgcaaccagtgggcaaagtactatttgaaagtgaaaaatgaaacttag

SEQ ID NO: 88567 - DNA, 651 bp, Glycine max
  Peptide Sequence Number=SeqID_205345
atggacttgaaagaaaattgtacttatgtcatgcacaattttaaagtgctaaagagacaagtggtcagtacagaggagtgtgttctaggggacatcccttttagaaaatacaggtttgctagatttgcagatgttgtggctggccagtttgaacgtggactattggttgatgttattggtgttgtggaggaggttgtctttcggcaagtttcaggaaaaggtagaagggtagttttcaaattaaaggacttgagccagcaattgctatcttgcactttgtgggatgattattgcttgcagtttttgaagttcttagatgattatgaaggtgatggtccaattacagttctattgagccattgtaggatcaaggaagcgcagggatcttatcccgcatcgatcaacaattctttcaaggcttcaaagttaattattaaccagcccatgatggagattcaagaattcaatgaacggcttgcagagttgggcattgaggcccggtcaggttttaaatcccatggtgaagggagtacacaactttcaggttctatccaattatcatcaaaagaatcattctttggcaaggctgaggcaaagactattgctgacattaacaccatctctgaaataatgattttatatagattttaa

SEQ ID NO: 88568 - DNA, 336 bp, Glycine max
  Peptide Sequence Number=SeqID_205346
atgactaggtggatgactttaaagaacctcgttccagaggatgttgagacacaatgctctgataagatagggtgtcacaatgatgaggaagagaagaaacaaatgaaaactttgttgtttggcacagaacctccaattttgtatgtccttcactatctaggtgtgaagccatggttatgcttcagggactacgattgcaactggaatgctaatatatttcatgaatttgcaactgatgttgcacaagcaaagtggtggaaggtacatgatgcaatgcctgagcttttgcagcagttttgcctgttgaagtcaaagcagaaggcacaattggagtag

SEQ ID NO: 88569 - DNA, 174 bp, Glycine max
  Peptide Sequence Number=SeqID_205347
atggctttagagttatcgacagacacaaccaagacaattactagttctgattcatcatcagcaacaagcaaggttttctttgtctcctgtgttggaccttgtggcctcaataacttaagaaggataggcttagaatgtagaagaagcaacaatcaatttaataatgttctttaa

SEQ ID NO: 88570 - DNA, 590 bp, Glycine max
  Peptide Sequence Number=SeqID_205348
tcctgaacatcttcccaagcatcgataccggcgtctgcgcgacgtcggtgcgtaaattcaaccagctggccagcggcctggataacaccgtggtgctgtgtatctccgccgatctgccgttcgcgcagtctcgcttctgcggcgcggaaggcctgagcaacgtggtcaccctgtccaccctgcgcggcgccgagttcaagcaggcgtacggcgtcgaaatcgccgaaggcccgttggcgggcctgaccgcgcgtgcggtcgtggtgctggatggccaggacaacgtgctgtacagcgagctggcgcctttcttattcttcgccctcggcgccgcctttgcggctgctcaggccatactcgcgcagcttgttggcgatggcggtatgggaaacgcccaggcgcttcgccagcttgcgggtgctgggataggtgcgatacagacgcgtcagcaccgagcgctcgaaacgcttgctgatgtcgtccagcgagccgtccagcacctcgtcgcccagcgacatctccacctcgaactccggcaacacgatatcctgcggccgcagttcgtagccttcggtttgcgtcagcgcgcg

SEQ ID NO: 88571 - DNA, 141 bp, Glycine max
  Peptide Sequence Number=SeqID_205349
atggcggtggtgggagcagcaggtccacttcagcttcaagtacttcacggcgggaaacaaaacgtcagggtggtagcgggatggagttcacggcgggatgaagtagttcaggcaatagcgggggcgctaggtttttggagg

SEQ ID NO: 88572 - DNA, 922 bp, Glycine max
  Peptide Sequence Number=SeqID_205350
atggctgacgctgccggcgctgctgttcttctgcgccttctggctgctgccgtttgtccgtctgctgcagatggcaatgcaggacgaccgcagcacccggcacagcggctactggacggtactgacgcagccgcattacctgctcagtctgctgaataccgtgctgctgtcgctcgccgtcacgctggtgacgctggccatcgccgcgacagtcggctgctttctggcacgccagcgcttcagcggacgcagcacgctgctggcgctgctgacgtttccgctggcctttccgggcgtggtggtgggatttctggtggtgatgctggcgggccgtcagggactgctggcgcaaatcagcctggcgctgttccacgagcgctggatgctggcctattcgtttaccggcctgcggcgcgttcgctgggcgccagtcagtggcgcataacctgggatgtgattgtgccggggctgcagccggcgctgctctccaccggcgcgctctgttttgccaccagcatgggtgccttcggtactgcgtttaccctgggcaccgatctggcggtgctgccgctgaccatttacggcgaattcaccaactacgccaatttcgccaccgccgccgcgctgtcggtgcctgcaactgctggtcaccgtgctcaccgcgctgttcatgatcgtgccggtggtgctgtcgatgctggccggcgtgaccaacaactactttaccggcctgcgcagcggcctgacgctgaagtgggtgacccaggtatggcagctttacgccgacaccttctggctgtcactgctgattgcgctggcctgcctgctgatcacgctgctgatcggcgtgccggcagcgtggggattgctaaaagcgccgcggcgctgggcggcgcgcatcgaagagtgcctgatgctgccg

SEQ ID NO: 88573 - DNA, 1020 bp, Glycine max
  Peptide Sequence Number=SeqID_205351
atgctgcataaaaaagtaaaaatttacgccggcgccatcgcgctcagcgccagcgcgttgtttaccagcctgacgcaggcggcggaaaccgccatctgttacaactgtccgcctgagtgggccgactggggcactcagcttaaagcgattgccagagacaccggcattcaggtgccgcaggacaacaaaaactccggccaggcgctggcgcagctggtggcggagcagggcaatccggtggccgacgtggtctattacggcgtcagcttcggcattcaggcggacagcgccggcgtggtcgccagttacaaaccggcgcactgggatgacattcctgccggcatgaaagacagcaacggcaaatgggtggcgctgcactcgggcaccatgggctttatggtcaacgtcgatgcgctgggcggcgcgccggtgccgcaatcctgggacgacctgctgaagccggaatacaaaggcatgattggttatctcgatccggccagcgcctttgtcggttacgtggcggcggtggcagtcaaccaggcgaagggcggcaacatgcaggacttcacgccggcgctgaactggttcaaaaagctgcaggcgaatcagcctatcgtgcctaagcagaccgcgtatgcgcgcctgatttccggcgagattccgattctgctcgactatgacttcaatgcttaccgcgcccgctacaaagatcacgctaacgtcgcctttgttattcccaaagagggcacggtaacggtgccgtacgtcatcagcctggtgaagaatgcaccgcacgcggcaaacggcaaaaaagtgatcgactatgtgctgtcggacaaagggcaggccatctgggccagcgcgttcctgcgcccggtgcgcaccggcgccatgagcgcagaagcgaagaaatatttcctgccggacagcgactatgcgcgtgcgcacaccgttgactatcagcagatggcggcagcgcagaaaaccttctcggcgcgctatctgagtgagattcgctga

SEQ ID NO: 88574 - DNA, 1299 bp, Glycine max
  Peptide Sequence Number=SeqID_205352
gataaaatcggccggctcaagtcagaggtgcagagcgatcccatgaccagcctgctcaatcgccgcggcctgagcgcggtgctcgactatttcgataccatgcagcagtcgtttgccgtgctggcgctggatattgaccacttcaagcgggtgaatgataacttcgggcatgatgttggcgacgaggtgatcaaacaggtggcgcgcacgttgcgccagagcgcgcgtcagaccgacgtggtgtgccggaacggcggcgaagagtttctgatgctgcttcccgccaccgcccctgatgaagcgcgggtgattgcggagcgcgtgcgcaccagcattgccggcggctggattgatccggtcgggcagatcacgatttcgattggtatcgccagctggcagccgacgcacggcagtcaggaacagattctgaagcaggccgatgatgcgctgtatcaggcgaaaaacgccggacgtaactgcgtggtgatcgccgggcaggaggcgctggccagcacggtaatcgagcacgatatcgtggtggttcgaggttttaaaatcgtcgaacaccttctccactttgccatcgccgccaatcaggaagctgatgcggtgaatgccgtcgtaggttttccccataaaggttttctcaccccagacgccaaactgctcgcaaacctgatgatcttcatccgacagcagggtgaagttgagcaattctttctcgacaaagcgagacagtttttccggcttgtcgaccacaggcctgcgtggtgcagcccggcgtcatggctttcgggtagaaatagaccagaacgcgctgtccctggaacggcaaaagcgccaggtggagtttacctcagggttatttcactacacggtatgccggcgcggcagagtgtgtggcggaataacccggagcctgattcagacggcgctgtgcgcgtcgtcgttcttcgcacagccgatggaaagcctgctcaaacggtgcgctggcatgattcgccgggctgtgcgcggtcatctgaatatagagcaccggcggcgcgtcgtcctgggcgggcatcggtgaagcgttcgatgatatgcggtgaatccggcacttccacctgtacccagacgggtcgattcaatcagggtaatggcgttccagctgccggagagcagcataataaaggtgaactcgtcgcccagcatcgccaggcggctgtcttcaatattgcaaccacagctgctgacgtggcgggtaatggtattgacgatacccggacgatcaacgcccagagcggtgatcaccagatg

SEQ ID NO: 88575 - DNA, 514 bp, Glycine max
  Peptide Sequence Number=SeqID_205353
ccattgcttaagttttccatgtgcccggtggtcggttttggcccgtggctaggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 88576 - DNA, 705 bp, Glycine max
  Peptide Sequence Number=SeqID_205354
atggaatctatgtcaaagcgactttttgccgaattttttggcacattttggttggtgtttggtggttgtggtagcgcagtattagcagcggcattcccacagctgggtattggtttcctcggcgtcgcgctcgctttcggtctgaccgtggtgacgatggcctatgccgtcggccatatttccggcgggcactttaacccggcgatcaccgtcggcttattcgccggcggccgtttcgcggcgaaagacgtgatcccttacgtgatcgcacaggtgatcggcggtatcgccgcagcggcggtactgtatttgatcgccagcggcaaagccggtttcgacgccaccgcaggcggtttcgcctccaacggttacggcgaacactctccgggcggttattctctgcaatcagctatcgtgattgagctggtgctgaccgccttcttcctgatcgttattcatggcgtgaccgacaagcgcgcgccggcaggattcgccccgctggcgatcggcctgacgctgaccctgatccacctgatcagcatcccggtgaccaacacttccgtcaacccggcgcgcagcaccggcgtagcgatcttccagggcacctgggcgctgcagcagctgtgggtcttctggctggtgccgctggtcggcggcattatcggcggcctgatctaccgctgcctgctggaagataaaaaataa

SEQ ID NO: 88577 - DNA, 681 bp, Glycine max
  Peptide Sequence Number=SeqID_205355
ggcaaggatttgcagcgccttgcacagttactggaaccgcatgccggcgcgcgcctgctcgatctgggctgcggcgccgggcatgccagcttcacggcggcggccagggtagcgcaggtggtggcctacgatctgtcggcgcagatgctggcggtggtggagcaggcggcggcggaaaaaggcctgaacaacattcagctgcagcagggcgtggcggagtctttgccgtttgaggacgccggcttcgatctggtcatcagccgctattcggcgcaccactggcacgacgtcggccaggcgctgcgtgaggtcaggcgggtactcaagccgggcggcagagcgatctttatggacgtggtctcgccggggcatccgctgttggatatctatctgcaaaccgtggaagtgctgcgcgacacctcacacgtgcgcaactatgcgccgggcgagtggctgacgttgctgaccgaagccgggctggtggtgcgcgaggtgacgtcggatcggttgatgctggagtttggcagttgggtggcgcgcatgcgcacgccggcgcatttcgttaccgcgatccgtgcgctgcagcaaagcgtgtcgcaggaggtggcggcgcacttcgccattcagccggacggctcttttaccagcgatatcatgatgtttgaagtgacgaagggctga

SEQ ID NO: 88578 - DNA, 252 bp, Glycine max
  Peptide Sequence Number=SeqID_205356
atgtggcggaagtcgaaaagaggtgtttttgcgcaatccgtaagtttccatgacttcttcgaaaggttactccagaaggctgttgcttctggaggaagcaacctggctcgcctgggcgagctgggcggcaagcatctcccctattttgctataaataggggaggaagtgaagaagaaaagggttcagccccttacgcacttctctctctttcgaatttgcttggaaaaattgtttccgtgaagaaaatctaa

SEQ ID NO: 88579 - DNA, 300 bp, Glycine max
  Peptide Sequence Number=SeqID_205357
atgccgttgccaggcagcctaattagcttgcctgggcgagcaacccctgcaccaaaatataaaaaaacgagggaggggaacgttttctgcactcaaaaactcccccccccccccatcattcaaaaagagaaggcttacgggactcacggttttcgctcccccaagctacctttggttgcattttgctttcatttttggtactcctactcactccaacaagggatggccttaggcctatgttgcatcctgaagcaatggggcatgctgcattgcccccactctcttgctattcatgcctaa

SEQ ID NO: 88580 - DNA, 231 bp, Glycine max
  Peptide Sequence Number=SeqID_205358
atggatttgtcattttctcgctctccattacttcaaaaccctaatagagcaatcggaggaggagctcaagagagcaccagaaacgccatcattgctaacggggaacgcttgatcgactacatcgaggatataggtatacatgtgtcataccctaatttcgtccggggacctttgcttgatgacatgcgaccattctttggtccttgtgaggtgcttggcacccatcattag

SEQ ID NO: 88581 - DNA, 286 bp, Glycine max
  Peptide Sequence Number=SeqID_205359
aactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcacaccctggaaacggctcagccggag

SEQ ID NO: 88582 - DNA, 408 bp, Glycine max
  Peptide Sequence Number=SeqID_205360
atgcatcatacgcatgccattgcggaactgtttactttacaatactcaaggttggatggtccacaggaccagttattagatataccggttgatatggaaccagaactggccatgatactttacactgatagaacagtctttgatgtgccatcaggactaccccctagcagaactcacaatcattcaatcccattggttgaaggtgctggaccagtaaaagtcaagccatataggtatcctcacagccggaaggatcagattgaagatggcacttggagattttgcacagattacagggccttgaatgccatcacaatcaaagatagctttcctattcccactgttgatgaactaattgatgaacttcatgaggcagtatatttctcaaagcttgatttgagatatctg

SEQ ID NO: 88583 - DNA, 289 bp, Glycine max
  Peptide Sequence Number=SeqID_205361
ctggtgaatcaggaggggcagccgcttcatctaatgatgcgtcagaaatgacaatcagagaaggagatgttggaactgcttcaagctcagagcagcctcgttgggtctcaccaatggaagttgagcttcaggccagtgtcgcaacctacccttcggcgggagggcgacgcgagactcgcgggatgcgtgttccacgaaaggaatacgcgcggagtcgccaccaacgtttattcgaggaaaacgtcggaaaaaccggaaaagacgcgatctacgaacttttaagtgaaag

SEQ ID NO: 88584 - DNA, 432 bp, Glycine max
  Peptide Sequence Number=SeqID_205362
atgggaaagttggatcatctagaggaaaggctcagggccattgaaggaggtgaagattatgcctttgctaacctaaaaaagttgttcctagaacccaatatcatcacccctcccaagttcaaggtgttggactttgacaaatacaaggggactacttgccctgagaaccatctaaagatgtattatcggaagatgggggcatatgcaaaagatgaggaattgctgatacattcctttgcaagaaagccttactggggcagtgtcagtataatggcttcggataggatgctactacaaaacatgtgcaaaaagggggcacgaatccttcaaaagaatacgcccaaagtattctactatgaaaagatggtgggctacacaccttcaagctttgatgatatggtcttcaccgacgaaggatcaaagtgggtctaa

SEQ ID NO: 88585 - DNA, 436 bp, Glycine max
  Peptide Sequence Number=SeqID_205363
gggacatatgactattaccagagctctctagaactacccgatccaagcaatcttctactagacttgaaggaggtcataataatcagtttagggagtgggggtacagacgggcatgcagaaagaattgtttcgaaaggaagtcgcgagagaaatatagtcaaagtaaacaatgatattgctgagacgggagaaagcaggaaaggaatgacaatctccgtaggaagtctcatcttagctatcgcccacggctcttataaaaggctttggttggattgctgctatcttgctcagtggattgttagccagttgcttttctcccttgaccttgctactttcatagccatagcaggaagcctggcaactttctttcgagacatggttgaagaaaaggctaatgccctgactccaacggcgcctactccttcccctaaagcgg

SEQ ID NO: 88586 - DNA, 930 bp, Glycine max
  Peptide Sequence Number=SeqID_205364
gggctgtttggtctggctggaatagccggagcgctggcggcttccagaagtggcgcctgggctgacaggggaaccgggcagcgcgccagcggatgcgcactggttttattaacgctctcgtggctcccgatcgccttcgcgcaggcctcattattgttgctggttattggtgtgatcatgctggatttcgccgtgcagacggtgcatgtcatcaaccagagcatgctgattgccggcaaacccgctatcaccagccggcttatcggtgcctatatgtgtttttatgcggcaggcagcgcgctgggcgctattgctgccacccaactctatgcgcactggggatggtatgccgtgtgcggcggcggggcactggtcagtgcctgcgcacttattctctggtatggaacacggctgcacgccatcgatccgtttattctggcagggctgcgttttacgctgtgtgccatcccggcgctcttctttattaaaaagcctgacgtcccgtggcgctaccttattggttacggactggtattcggcattggcttgtggggcctggtgaatctggggataaaaaccggcctgtcggcggggatcgcctcgctggtgctgcagttcagtgcctttttcactctgctgctcggcagttatgtgttcaaagaacagctcagccgctatcagatcgctggctttgtactggcgtgcagcggattgatgagtattgtgtttattaccgacggctcggtgacgtttgccgggttgctgctggtgctggcaggcgccatagcctggagcattgccaatatcatcatgaaaaaagccggcacgaagcaggtctaccccaatacgttattaggctactggatctggaattcattgcttaagcagtatcctgtctccaccgtcgcgccattatcgttgctggtgccg

SEQ ID NO: 88587 - DNA, 177 bp, Glycine max
  Peptide Sequence Number=SeqID_205365
atggcgagttggtcatggctcagtcaaacgcaaggccctaaggcagactgcagcaagtcagggataggggcaacattgcagagtgctcagggacgcgccattgggggttgcgatttgcaagagggaggcgccattcgttcctgcgacttacataggttggtgttgatgatttattag

SEQ ID NO: 88588 - DNA, 840 bp, Glycine max
  Peptide Sequence Number=SeqID_205366
atgggatcaagtcaaaagccttcgtttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccacagagtccattgcctcccttgcccagtattatgatcatccgttgaggtgcttcacttttggggacttccaactatcacccatggtggaagaattcgaagaaattctaggatgtcctctagggggaaggaaaccatacctcttctcagggttctatccctcattagctagaatttctaaaatattccaaatcttggcgaaggaattagaccaccaaaagcaaatggggtggtcgggataccgagaaaatgtttggaggcaaaagcaagaatcttggcagcgatcgacgcttttctcgcctatcataaccacaaggaaagccccggttgtcgctatgctagccgacctatatgacacgttcgaccggggatgtgaaaagagcagcgcaagaattgtttgttgtgcactggctctctatgtgtggttagtttcacacctttttctccaagaaggtaggcccgtctatccgctacaaggtcaccactcgtgcgtcgaaaaaggaaaggcgaattgggaccaactcttggctagcatggaggggcgtctgttaattggttccctcgctagaaggaaggaagaatcaggattgtatcttcatgcgaaggatgtccaaatgttccctggatgggaacatggggttgtattaattataatcccgtcctcgccataa

SEQ ID NO: 88589 - DNA, 344 bp, Glycine max
  Peptide Sequence Number=SeqID_205367
gtataactgctgcatctggaatagcagcagagcttggaattccattaactcaccgtggcattgcaaatagtgtgagattcctcacagggcattcaaggaaaggaggatccgatcctctctttgtatcggaaaatgctgctgatccggattctaccttggtggtttacatgggcttggcgaccttcccttcacttgcacagaagctaatgcatcatggtctgtcccctcagaccccagctgcagccattgagcgaggaaccacacttcatcagcgcacggaactctttttgcatatgaagaagaatgaaggggggcttgctccagtatcatatatggaaacataa

SEQ ID NO: 88590 - DNA, 273 bp, Glycine max
  Peptide Sequence Number=SeqID_205368
atgttggaaggtgaagggtggatggtgaagttaatatgtgggagtcataatcatgcattgcctaagtcattcgttgaaaattcatatgttgatcaactaactaaagatgaaaaaattattattggtggtgtgacaaagtcaatgatgaaactaaaggatattcttctcattttgaagaaacataatgccaacagttatacaacaatgaaacaagaaaaagaaacacagaggctgagggtgacaacaaaactcacgacgacgatagctgaatga

SEQ ID NO: 88591 - DNA, 498 bp, Glycine max
  Peptide Sequence Number=SeqID_205369
atgaggatctcttcgttcaccaatctcagatcaaatttgaccgttaagttcgccattaaatttgaatctgatggacacgttaggactattgatgtcactagccccgacaacgccaacattcagggaactagacacagtggtgatggtggccgaagctatggcgggggacgaggagggggtggaggtggatatagcgacgatgacggctacggtggtggtgatggctatggtggaggtggtggctacgatggtgacaggcttgttacaactgtggtgaatcgggacatctggctagggactacagccaaggaggaagtagagacaggtacaacagaggcaatgggtggtggtggcaagtatggaggcagcaatggtaggaggtacgatggtggtggaggaggcggtggtggaggaggaggtggtggcggcggaggaagctgctacagctgtggagagtctgggcattttgccagagattgcccatcaagtgctcgttga

SEQ ID NO: 88592 - DNA, 1819 bp, Glycine max
  Peptide Sequence Number=SeqID_205370
atggcgaagtcaaagaacaatgctaagaagttgtcctacatatcagttccatctcagatcatcaactccatatcatcatcttctctgcaatctcttcttgactctcccaagaagtcttcaaggaacaccaacaacaacaggttctttatcttcttcaccaacagcaccagcaccatcatcttcagaaaacaaagactctggtttttcacactctttctctttggtttccttggcatgctcaagtttggcctcacccttcacacccctttccccccctacccatgtgccaccacaacccttctgccacagaacatgatctcaaccaccccacattcaaagtcaaaccttggtgctgttttgagagagaacaatgaccaaaaaaaagatgaggtcttgttgtctcatgtggagctgagagcacagggattggagaaggtggaaggtgatgagggtgttgagaagagtgagttttgggagaagccagatgggttgggatacaaaccttgcttgagttttagcagggattatagaagagcaagcgaaggggttctgaaggataggagaaagtacctcatggtggtggtttctggagggttgaatcagcagaggaatcagattgttgatgcagttgtcattgctaggattcttggagctgctttggttgttcctatattgcaagtcaatgtcatttggggtgatgaaagtgagtttggtgatatatttgatttggagcacttcaagagagttcttgccaatgatgtgcgagtggtttcagcattgccatcaactcacctaatgacaaagccagtggagggtagtcctccacttcatgtcactcctagttggatccgttcaagatatctcagaagattcaacagagaaggtgttttgctcttgcgtagtttggattcaaggctgtcaaaggatctcccttctgatcttcaaaagcttagatgcaaggttgctttcaacgcactacggtttgctcagccgattcaggaactcggtgacggcattgcagagagaatgcaaagcaagggaccttaccttgttcttcatctaagaatggagaaggatgtgtgggtgaggaccggatgcctccccggtttgagtcccgaatttgatgagattgttaacaatgagaggatacaacggccggagctcttgactgcaagatcaagcatgacttaccatgaaaggaagatggctggtctatgccccttgaatgctgtggaggttactaggcttttgaaaggtctaggagctccaaagaatgcaagaatttactgggctggaggacaaccattgggtggaaaaaaagccttgcttccattgatccaagagtttcctcatttttatagcaaggaagatcttgccttgccaggagaactacaaccatttgcaaataaggcttctataatggctgccatagattacatagtctctgagaagagtgatgttttcatgccatctcatgggggaaatatgggccatgcaattcagggtcatcgagcatttgccgggcacaagaaatatataaccccaaacaagagacacatgctcccttattttcacaattcttccctccctgaagaagagttcaacaggattatgaaagagttgcaccaagactcattggggcagccagaacttagaactatcaaagctgggagggatgttaccaagtttcctattcctgagtgcatgatgtgcaattttgatccctttggaaccatttcaggtgcctttcagggtaaccataacagttctgagcacaaatttctactacatatgatttcaagcactcctcaccttgcag

SEQ ID NO: 88593 - DNA, 1725 bp, Glycine max
  Peptide Sequence Number=SeqID_205371
atgtcattgcaagcacaagatgtgataccaagtgacagaaaccggctgccagaggtttttgtcaaggctcagatggggagccaagtgttgaggaccaagatatgtccaagtagaacaaccacaccactttggaatgaagatttggtatttgtggcagctgaaccatttgaggagcagttgacaatcactgtggaggatcgagtgaacccttcaagagatgaagtacttggtaagataatcttgccactgaccctctttgagaagcagctagaccaccggccagttcattcgcgctggttcaatcttcagaagtttggttttggaatgatggaagctgataggagaaatgagctcaagttttcaagcaggattcacctaagaatttcccttgaaggtggataccatgtccttgatgagtccactttgtactccagtgaccaaagaccaacagctagacagctatggaagcagcctattggggtgcttgaagtaggcatcttaggagcaaaaggactcctcccaatgaagatgagggatggccgtggcaccctggatgcatactgtgttgccaagtatggccagaaatgggtcagaaccagaacaattcttgacacttttagtccaaaatggaatgagcaatacacatgggaggtttatgatccttgcactgttataacacttggtgtctttgacaactgccatttaggtggaggggaaaaagccactgctggcactgcagccagggattcaagaattggaaaggtaagaattaggctctcaacacttgaagctcataggatatacactcatagttatccacttcttgttttgcaccctcatggtgtcaagaaaatgggtgagcttcagctagcagtgaggttcactagcctctcactggctaacatggtttacatttatggccaacccttgcttccaaagctgcattactttcgccctttcaccgttaacctagtagagagtttgaggtaccaagccatgaacattgtagctgttaggcttggaagagctgaacctcccctcaggaaggaggtagtagagtacatgttagatgttgattcccatatgtggagcatgagaagaagcaaagccaacttcttccgaatcatgtcacttttctctggattcatcacaatggggcaatggtttacccaagtttgccattggaagaaccccatcacatcaatcctagttaacattctcttcctaatactcatttgctaccctgaattgatacttccaaccttgttcctctacatgttcttgattggcctgtggaactataggtttaggcctagacacccaccccacatggacacaaaactctcatgggcagaagttgttcaacccgatgaactcgatgaagagttcgatacattcccaacttctagaccacatgatgtggtgagaatgaggtatgacagacttagaagtgtggcaggaaggattcaaacagttgttggggacatagcaacacagggagagaggtttcagtctctactgagttggagagacacaagagcaaccagcctctttgtagtgttcagcttttgttctgctgtggttctctatgcaacaccaccaaaagtggtggctatggtagcaggcttgtactatctgcggcacccaaagtttcgcagcaagcttccttctgtgccaagcaacttcttcaagaggcttccagctagaacagatagcatgctgtga

SEQ ID NO: 88594 - DNA, 927 bp, Glycine max
  Peptide Sequence Number=SeqID_205372
atgggccttttagtccacgaaagtattttcacaaagcccggcccaatagaaacatcaacccggtgcgttttcaggcgcttatataaaccagagttagggttttgcgtcacaagcctcagtctcaacacagaagcagaaggaggagaagcagaaagaggagacgaagcaatggcgccgaagaagccccgaaccacgtcgaggaaccctgatttggtcaggggaattggcaaatattcgaggtcgcagatgtaccacaagaggggcatctgggccatcaaggccaaaaacggcggtgttttgcccctccacgatcccaagcccaaacccgaggccccggcccagaagccgcccaagttctacccggccgatgacgtgaagaagcccctcgtcaacaagcacaagcccaagcccgcgaaactcagatttggggttggaaggaaggaggtgcagattgggattaagcatgggaaatgggatatgagggctagcattactccagggactgttctgatcctgcttgctgggaggttcaagggaaagagggttgttttcttgaagcagcttccatctggattgcttcttgtaacaggtccctttaagatcaatggggttcctctgagaagggtgaaccaatcgtatgttattggtacatccacaaaggtggatatctctgatgtcaatgttgataaatttgatgacaagtactttgccaaggaagctaagaaaaagaaaacaaagggcgaaggcgaattctttgaggcagagaaggaggagaaaaatgtgcttccccaagaaaagaaagatgaccaaaaaaccgtggacactgctttgttaaaggccattgagagtgttccagagctcaagtcttacttgggtgctaggttttccttgaaggcaggagtgaagccccatgagctagttttctag

SEQ ID NO: 88595 - DNA, 383 bp, Glycine max
  Peptide Sequence Number=SeqID_205373
gtttcatatcgataagaatgtgaaggcgaagtgcaaatctttaatcgatgaaaaaaatgtctgggactatgtaatggataactggggtactttggttgattgttcgtccgaacagcagttcgctgagtcacttcagaagtttcaagttgcttgttcgccttggccgatgttcattgactatgttaacgacacatggattatcccccacaaggaaaaaattattacagcatggacgaataagggagaccagtcagggtcacagtgttttgcgagaatgctccaaccatatgggatcaacataggcttaaaggagcactcaaaccgtgtgacccccaaggcctacacttcgaagagtccgtcaaggcctctccctcctgattcag

SEQ ID NO: 88596 - DNA, 435 bp, Glycine max
  Peptide Sequence Number=SeqID_205374
atggcttctcttcactcttctttcctccttacatcaaattttctttccctcacaaccccatcaagttttcccactcacattctctttcccgtgagactctccacgacccacttgcgaccccttcttctcaccacacgacacggtttcgggagatcaccccgccaccgcgaccgaggcggccgtgaggaggctctacgctggcaacattccccgcactgtcaccaacaacgagcttgccaagattgttcaagaacatgttattcctgtgttggattgaattttattggagaatccaatgaatgtggcttgtggggaggagctgggttccattctcacgctttgattgaacctgactatggaagtggatgtcaatgctctgaaaagaaggtagcagacatcgaaagaggaagcataagggcaactattctgatataa

SEQ ID NO: 88597 - DNA, 807 bp, Glycine max
  Peptide Sequence Number=SeqID_205375
atggcttctcttcattcttctttcctccttacatcaaattttctttccctcacaaccccatcaagttcttccactcacgttctctttcccatgagactctccacgacccacttgcgaccccttcttctcaccacacgacacggtttcgggagaccaccctttgccgcggtggcggaacaggcggccaccgcgaccgaggcgtccgcgaggaggctctacgttggcaacattccccgcaccgtcaccaacgaagagcttgccaagattgttcaagaacatggtgctgttgagaaagctgaggttatgtatgataaatactctggaaggagccgccgctttgcatttgttacgatgaaaactgttgaggatgcaactgctgtgattgagaaacttaacggcactgaaattggaggacgtgaggtcaaagtaaacgtaacggaaaaacctttatcaacaccagatttgcctttactccaagctgaggaatctgaatttattgacagtccccacaaggtgtatgtgggaaatctggccaaaacagtaacaactgatactcttaaaaactttttttctgagaagggaaaagttcttagtgccaaggtttcacgggtccctggtacctcaaaatccagtggatatgggtttgttactttttcgtcagaagaggatgtagaagctgcaatctcatctttcaacaattctaggatgaatttccatgttagatccccaattagaaaagcatacatcagaagaaaggatatggagaacattaggctacttgtgcccatcttgggatgcattagttaa

SEQ ID NO: 88598 - DNA, 987 bp, Glycine max
  Peptide Sequence Number=SeqID_205376
atggggaagttatcaatcaaattgcacgataagtgcaagaaccgcaaggaatcatcatcatggccattaacaaattgttttcaccacggtggtggaagagatgatgcaattggaattgcacaagaatgtaacgttgatttttctaatctcttcattgggcgcaagttttctcaaggtgcacatagtcaaatttaccatggtgtatacaaaaaggaacatgttgctgtcaaattcgtcaaggtacgagataatgatgtaaagggaatcccaaaatcccttttggaggctcaatttttaagagaagtcatacatctacctcgtctccaccatcaaaatgttgtaaagttcataggcgcatacaaagacactgatttttattacattctcacggagtatcaacaaaaggggtctttgagggtgtatttgaacaaggtagagtccaagccaatttctctgaagagggtgatagcttttgctttggatattgctcgtggaatggagtatatacatgcacaagggatcattcatagagaccttaaaccagagaatgtccttgttgatggggaaattcgcctcaaaattgctgattttggcattgcttgtgaggcttcgaagtttgattcgttgaggggtacctaccgttggatggctccggagatgatcaaaggaaaacgctatgggagaaaggttgatgtgtacagttttggtcttattttgtgggagttgttgagtggaacagtgccatttgagggcatgaatccaatccaggttgctgttgctgtggcagataggaattcaaggccaattattccttcacattgcccacatgttttgagtgatttgataaagcagtgttgggaattgaaagctgagaagaggcctgagttctggcagattgttcgagttttggagcaattagatcaaggttgtagtttcttgtcccccaagaaactcaagcaacaccacctttcattacgaaaatggtaa

SEQ ID NO: 88599 - DNA, 1014 bp, Glycine max
  Peptide Sequence Number=SeqID_205377
atgaggagtgcacttaataacactcgtgatatactgcggaaaagaagggatgttccttcatctagtttgggtacctggaaattgaacaatattcgaagaaaagaacacatttttgaccagcccttgttaactgggattggcaaggatcttttggacatatccaaaagtgaatatgtacgttcaagatctcatttggtcatctttgaggaagatcatgcagatgttaggatgggtgaagaaactctttctccaactaacgaaccccctgaagaatcattagctgctactaatgaaccccctgaagagccaatagctgctactaaccaaccccctgaagagccaatagctgctactgaccatccccatgaagagccaatagctactactgaccaaacctctgaagaggcaataactgctacttctcctgttactgatatgcaagttgaacacaatcgaaatgttgctgtcaccccccctgccaccgcccaagcaccacatgaagatgattatacgagccctaatagaagagattgcttcaatatgccttcatctcataacatatccattgcttctttgaatacaaatattgcatctgagagaatgcatacattagattatgcagtgtcacctggagttcatggattggaggcaatgcaaacaccagattcagatactcatgacttgatgagttctgataaaacagatgagttttggtttctgaaattggacagcaccacaccagccagttcacaaggtacaagtggaagtaacaagacattgtctgaaaggaccaagcatgcagctcaatattttgaaagactttcttcaatctccccaattttggaggaacctgctggagatctcagcttaaacaagatcttgaaagggaaaactaaaaatattgccgctcgtatgttctttgaagtattggttttgaagactaatggacttcttgatgtacaacaagaagaaccttatggtgatgtcagcttgaagttggtccctatgctttga

SEQ ID NO: 88600 - DNA, 756 bp, Glycine max
  Peptide Sequence Number=SeqID_205378
atggttgaaggaacatgcactgttgcactccatcgtaaagggaaatttaactatgagacatcctcaatttatgatgatcgtgaagccgtaacatatcatggtcaagacataaatgaatggtgcttctttgatgtcgtgggattgttgaagggtgaagtttatgatagatttaaaggcaacctgaaaccatttttggatgacaatgatgcaatggagttggtcacttatgcagttaaaaaaaatgtgaagtgggtatttatgttgaacacattctcaaaaccagattatattcatgagatatgctttgaagaagatgggcattgtcagggtgtgaatgaggaggttacaagacattgtaacgatgaagctgttgaaactgttgaagatgaagttgcttgtaatgttgatgaggatgattatataggtagaagtgagccaaattctgaacatggtatgaatcacgggctacctagtgtgaatgcgagtctaatgaagtggaatattgatgccgaaatcaatgtcgaggtgcatgaaattgatgaggattacttaagtgaagagttgttgagtgaaagtgatctaagtgataatgaccggtctcatataactacaaaagatgctcccttaactataaaagttgcacctctcatttttaaaaaggatgacatgtgtaaagagtacaagttcaaacttggcatgaaccttcatctattcaagaagagaagccatattggaacactttgtattgaatggtag

SEQ ID NO: 88601 - DNA, 219 bp, Glycine max
  Peptide Sequence Number=SeqID_205379
atgacgttgctacttagcaacattctgcccagcgaccgtagtgctgatctccccctgcggaagggtagcgtccacaagacacccagtggacccaacagggccctggggtttcaagctctagttacaggcctctgtcagtcctatcgggcgcccgtccccccagcaagttcatgccatcgtgacataggtaagtacgcacctcccccaactgatttctga

SEQ ID NO: 88602 - DNA, 741 bp, Glycine max
  Peptide Sequence Number=SeqID_205380
atgtgcatgaagaaactcagagatgagttgaccagagcgctaatagaggcaaatgatggcaatgctaatgaaggaggagcaatgtcatttaacgagcttgtgaaagtgttggcgttaaaacaagacctcaaggcatttgctttcaagaccaaagccatgctgtcacagatggaacgtgaggtgcaatcagcaagaaagaaggagtcacttaattggcatatagcttcacacggtgttcctcaaagtctgcattgtctttgtttgaagttggctgaagaatacgctgtaaatgccatggcacgatctcgtctaccttctcctgaacatgtctctcgccttgttgaccccacctttcaccacattgttctcctaaccgacaacgtccttgcagcttctgtggttgtaacctccactgttgaaaattcagccaaccctggaagactagtctttcacgttgttactgacaagaaaacttatactccaatgcatacttggtttgccatcaactctattaactcagcagttgtacaagttagagggttacaccactgtgattggtctaaagaagtgaacgctggtgttaaagagatgcaggaaacaaatcagttaatttggaagcactactacaacaactataaagaaaaggagcttgaccatagtgaagagcatgacagatattttgaagctttaaggcctagcagcctttccttgttgaatcatctccgcatctatatccctgag

SEQ ID NO: 88603 - DNA, 378 bp, Glycine max
  Peptide Sequence Number=SeqID_205381
gtggaggcctctggtaatcgattaccagtctgtgcaatcgattacacagaggaatgggtcactggtaatcgattaccagatgaaccggcgcgtacgcttcagcgcactgtagagtggatactacccacgcctacaccatatcgtctagtggagccagcccaagtgatcgaggtgacgtcgtccgaggaagaccctgaggaggatcttgaggagctacctctcgagcctgctgaggatgctcttgactttctagagggtgatgaggacccactccctgaggtggattctcccgaggaagtcatgtcggcatctgaggcagactctacggaggatagtggcccgagagagatggcgaccagtggaggctcttcatcatag

SEQ ID NO: 88604 - DNA, 731 bp, Glycine max
  Peptide Sequence Number=SeqID_205382
taccaaccgttgaagaatttgaggagattctaggatgtcctcttggaggagatgcttcacgtttgcacggatcatctgttgtttactcgctctttgtgtatgtagattgggaccaacacttggctgggataggaggcggaacagtcaattggtttccacgatggaaagaaggaaaggagggtgttctcttctcatgtggaagctacccaaacatcctgttgataggaacgaggggttgcattaactacaatcccgcgcttgctataagacaattagggtaccccatgaggggagcaccgacggaagaaagcctgtctcctttccttgtgaaagattttggcgtgcaaaatttcaaggttatacaaagggtccataaggcatggggaagcccgttaaggaaagataaagaactttggggcattcgtaatggcatcattggtgattatcatgaatggctgaaagtttgtacacaaggtttagattggctcgccaagttaaagattatcaacaaagagaacttcgaagctccggaagaggatgaagaagtccgagctctgaaaaccaaactaggaaaagcgagacttgccaaagaaaaattcaagttggtcgctacagacgtccagaaagagtgtgccggggctcgcagggaagagcatggctgtgacaaattccgtgaggcattatggggcagcaatagtgagctcaagcttcgaagggaagagagagactga

SEQ ID NO: 88605 - DNA, 426 bp, Glycine max
  Peptide Sequence Number=SeqID_205383
atggttatgggggatcccatcagcagactctccttccctgcatgtttgcattttagtggagaaaacaccgagactttttcaagtctcacaagttatcaagaactacgtaggtctgagttcctcattggaggatacgtaggagcaagagcctcgcttttgtcgaccacaccgccttttgctgccatgacccaagagctggtagcccgcggagacaccttacggttatccgcacctcgtcattcagtgaccccaagtgtgattgacgagcagaggccaatgtggtcatctgcgccctttccggagatgtcagcattttccgatggagacttttcaagtctcacaagttatctagaactacgtaggtctgagttcctcattggaggatacgtaggagcaagagccttgcttttgtcggccgccccataa

SEQ ID NO: 88606 - DNA, 264 bp, Glycine max
  Peptide Sequence Number=SeqID_205384
atgaagaagttgcacattaatcccccaatggtgtaccagctggagatcaatggggcttgcaagaagcttaagcagatagaacttgcagattgtgaaatctatgcttcttgtgaaccttgccccatgtgctttggtgcaatccacctttctcaaattaagtggttggtttatggagcgaaggctgacgcagcaattgctattgggtttcatgatttcattgcagatgcactgcgaggtactggattctatcagaaagcaacatag

SEQ ID NO: 88607 - DNA, 849 bp, Glycine max
  Peptide Sequence Number=SeqID_205385
atggcaggtgatgttgctgttaaagatttcaatataaaaccaattgcagaaaaagtggcaaaatgttgtgctggtttgcctcttttgatagttactgtggcaaagggtttgagaaaaaaacatgtcgttgcttggagggatgccctaattcaactagagagacttgatcacgaagatttgcgtgagaaagtcttccccactctggagttgagttttaatttcttaggagatgatcagaagtcactattgttattcattagttcatttggcctcagttatatccacattggagaattattttcatgttgttggaggttgggcttttatgagcgcatgaacactttggcaaaggaaagaaacatagattacaaattaataaatgaccttagggcctcttccttgttgcttgaagctgaggctgaacctgaatgggttagaatgcatgatgtttccagacagaggtacaccgaaatcaaagagtggcccatggtagatcagcttcaaaagttccattatattatcattcctgggtcatattatgatgaacttcctgagaagttggagctacttgtacttggaaattatggtgatcaccatgtcaaattccctcacaactttttctctgggatgagaccactgaggactttgcttataggtggaatggcatttaccccatccctacctccttctcttgatttcttgactagcctccgttcattgatactatgtgattctaatttaggagacataaggatagttgctaaactcacaaatttagaaattctcagcttggaaaaaagtattattccaagagctgccaaaagaaatagggcatctaactcatcttag

SEQ ID NO: 88608 - DNA, 309 bp, Glycine max
  Peptide Sequence Number=SeqID_205386
atggatactattgtctcagttgcttctccaattgttaaacgtgaatttggttacatagtctcctatgaagagaaccttcaaaggcttgaaaccatggctcaaaggctggaggatactaaagccagtgttcaacactctgctgctgaggcagaaaggaaaggagaaaagatggaagatattgtagagaattgggtgaagaatgccaatgacgctgttgctgaggcaaataaacttattgagattgatgggaatgcagaagcagatgttgtatggggctatttcccaatctgtggacaagaagccagctga

SEQ ID NO: 88609 - DNA, 154 bp, Glycine max
  Peptide Sequence Number=SeqID_205387
atggataaccatcaacatggaaatcatagtgatccagcacaagccaggataaagaaaaaaggtatcaggcagcacaaagttaattatcaggctcagaatattgattctaatattcctgattcatcagaggatgagagttctgaatcaacacaag

SEQ ID NO: 88610 - DNA, 681 bp, Glycine max
  Peptide Sequence Number=SeqID_205388
atggtttccggtgcagggctacaagccgctggccgagggcttcggccccttcctccatcgcatcctgctgccggggctggcgctctcctccttctatgtcgcattggtctcgcgcatgacacgcgcctcaatgctcgaagtgctgcgcgaggattatgtccgcacggcgcgggccaaggggctgggcgagcggatcgtcctgttccgccacgcaatgcgcaacgccgcgatcccgatcctcaccgtgatcggcaccggattcgcgatgatggtttccggcgtcgtcgtcaccgagacggtcttcaacattcccggactcgggcggctggtcgtcgatggcgtgctcgcccgcgactacccgttgatccaggcgatcatcctgctgacggccggcgcctatgtgctgatcaacctgctgatcgacctctcctatgcgctgagcgacccgaggatccgctaccaatgagcgccgcatcgaacccagcgcagagcggcctcccccgccggcgcctgctgcgaaacccgccgcactggacgacggtgctggccatcatcgttctcatcgccatcgtcgcgatggcggtcttcgccccactgctcgccaatttcgagccgaccaagctcaatgcggcgatgcggttgaaacctgcttccgagacctactggctcggaacggaactc

SEQ ID NO: 88611 - DNA, 575 bp, Glycine max
  Peptide Sequence Number=SeqID_205389
tcgagaggttggcccagcctggttcactgactatttccctgctgtcgatccggacaatgaagaagaagtgaacgaaatatggtcattttacttgaatccacagatcctatcttgtcgtacaggtgttcaatcgaactatttaggcctggttggataccagcctaatttggtttcaagacaatttggcctctcgcaaattcgtcctaaaagcttgttcgaagatcctcaagacgtcataagaggggccaatctttcggaaaagactttcaagaagtttttgaagatttctcttgatgaaaactataacctgcatccttttgagttcaaccattcccacttctgcaccatggggcttgagagtggttttacacaaccaacggtcgagaatattcgctcaaaccttcaagctcgaggcaaaacaatcatgacgaagaaaagtgctgaaacgtctcgagctgatgtgagacccaagaaacctactgggattcaaaagaaagatgacagtactgagactaccacgacttccaaacgctcgaagcatgcaggcgtcgaattagatgaagagaaagatgcaa

SEQ ID NO: 88612 - DNA, 468 bp, Glycine max
  Peptide Sequence Number=SeqID_205390
atcattgcaattgttggtcttcaacgaggaattcctagtaagcgcgagtcatcagctcgcgttgactacgtccctgccctttgtacacaccgcccgtcgctcctaccaattgaatggtccggtgaagtgttcggattgcggcgacgtgagcggttcgctgcccgcgacgttgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaagtgcgactcccgggggcccggagacgggtgtcccgcgggagtcgtcacgacacaacatttacatacaatgactctcggcaacgggatatctccggctctttgcatcgatgaaagaaac

SEQ ID NO: 88613 - DNA, 231 bp, Glycine max
  Peptide Sequence Number=SeqID_205391
atggcaagttcgagccctactaagcctaccacccccttctcttcacccgatacaagaaggcagtcgaagtcccctccactcttcattttatgggaagacatcgcgttcctagtcgatttccctcattgcactgtccccttaatgctacgaagtgaagcaggcatagagaccaaccaaaccatagggtatctatcctgtgatctttcatcaaggccggctcggtatcggtag

SEQ ID NO: 88614 - DNA, 684 bp, Glycine max
  Peptide Sequence Number=SeqID_205392
atggtaacaagaagtacctccaaattaattaatgtcattaatgaagatagtgaccaaaactcagataacacaactgagataggatcagtgtcagaaaagaatataaatctaattaattccaaacattggaaaacaccttccaaattatattatcaacgtccaactgcccctgaccttctattagaagaaagaggagaaaacaatttcaagagttttagtgcaaacaacatctatgaatggaacatagatgcacaaacggagtataatatcatgaatacactccaacatatgaccatggtagctacggcttaccaaacctcccacgaatgttcagaagaaaccattatagacatcttagtggcagggttttctggacaactgaaaggatgcgcagtcaaaacggatctcaacggaaaagtcattactaatgacgatgataaagagattcctgacgctgtcaataccttaatttttacaatagctcaacattttattggagacccatccttatggaaagataggtctgcaggccttgacatgaaagaaggatcaatcccagcggctttaatctataggatccagtacaaggtcatgaacacttgtgcctctagagtcctgttgcaaccacaaaagggagaaacaaccttgtttattacggatatgacaaaagccaatgtctattaa

SEQ ID NO: 88615 - DNA, 264 bp, Glycine max
  Peptide Sequence Number=SeqID_205393
atgccgactttcgagaacgacgttcctaaaggaaaactctacaaggtttcagaatttcaacaaacattatcgacaataacgaaacaaaagaggaaacataaaagagaatatgaatctgtggatcccacggtcatgtggctccgcatgccaccggactcttgggtcacggtaacaaaaggtagggtggtcgacaaaagcagggtttttgctactacgtatcctcaattcgtgatgaggaactcagatctacgtagttcttgctaa

SEQ ID NO: 88616 - DNA, 429 bp, Glycine max
  Peptide Sequence Number=SeqID_205394
atgacgctgagtgagaagcaggcgctaagcgcgagatccaacacccgcgttgatgtaaggccctcaatggtactacaaaggtgcgtagaaacaaacttggtgttaaattgggagaagtgtcacttcatggttcaagaaggcatagtcttgggccataaaattttagcccgaggaattgaggtagatcaggcaaagatagatatcattgaaaagttgccaccaccatcaaatgttaaaggcatcaggagtttcctagggtatgcagggttctataagaggttcatcaaggacttctctaagattgcaaggctgctgagtaatctgctaaacaaagacattgttttcaaatttgatgaagaatgttcagcagcattccaaaacctgaagaacaagcttgcaattgccccagtaatgatcgcacttgactag

SEQ ID NO: 88617 - DNA, 408 bp, Glycine max
  Peptide Sequence Number=SeqID_205395
atggaaccaattgcatccctttcccagtattatgaccagcccctaaggtgcttcacattcgaggacttccagctagtgccgactgtcaaagagtttgaagaaatcctgggatgcccactgggaggaaggaagccatatcttttctctgggttctatccctccacgacaagagttgccaagtcggagtaccaaggaagtgtttggaggaaagggcaaaggccttggcaaaatcaaggcgaatgggcttcttttattgacatcttggcgcttttgatctttggaggtgtcctctttccaaatatggaagggttagtggacctaacagcgattgacgctttcctcgcctttcatcatggcaaggaaagcccggtcatcgccattttggccatgcatgacacgttcgactag

SEQ ID NO: 88618 - DNA, 327 bp, Glycine max
  Peptide Sequence Number=SeqID_205396
atggctatggaagtctacaatggccctcctacatcccaagagtatggtagatttcttgaggcaactcttctcagaacaagagctcatgttgaaagagaagccaaagatggaaactcctttgagggcaccattttaggcagtatgttgatgctttcttggatagttcatctaataatgaacctggagataagttctttcacaagcttcaagaggaagaagaaaaaagggggagaaaaagtaaaaaatgaagaatgcagccatagcagaagatgcacacacaaaacggcagcgcatcatctgagggggagattttccttaaatctttaa

SEQ ID NO: 88619 - DNA, 231 bp, Glycine max
  Peptide Sequence Number=SeqID_205397
atggcgggagatgcatcaaagtttattcatatttctcccaaaaatagtgaacatgtgacctatggagacaaaaacaaaggccaagaaatgggttttaatggtgccaaagtagaatcaaacaaggttgcttcaacaaatattcaaaggttaagcattgtttcaagaataattcaaggtcaagcaaacaagatcaagaaaaagataaggtctcaaaaaaatttcactggttga

SEQ ID NO: 88620 - DNA, 255 bp, Glycine max
  Peptide Sequence Number=SeqID_205398
atggatatccctgtttctcatgaagggaaatacttctacttgggggcatgtcactcggtttggaactcccttgagactcaggccaatcaccttgggaggggggagttgtctgtgcacgacaagtctggaggaagtatcatgtttttgacggaaaatttcagttatccagttcacgtaggaggtgtgccccaaatagggtgtcatgcgtctagcaccaatagctttttggtggagtcgagaaagaaaaacacgtaa

SEQ ID NO: 88621 - DNA, 207 bp, Glycine max
  Peptide Sequence Number=SeqID_205399
atggagaaatctgaaaagaaaaattttggtgaaaagaagatgaagaaggcctacatcacatgggatgacaatgatatggaatcatttgaggattcagaaaatgaagagataaacctgtgtctaatggctaaaagttatgaaagcgatgaagaggccttaagcacaacttgcttagtgttagtcaactatgtgataaaggctatctag

SEQ ID NO: 88622 - DNA, 267 bp, Glycine max
  Peptide Sequence Number=SeqID_205400
atgacgactataatagtgaagaaaactcaaaaaaaggccccccaacgaaggtgttgtggtatcttccgatcattccaaggtttaagtatctctttgctaatgaagaagatgcaaaagaccttacatggcatacaaatgggagaaactgcgatggaatgcttagtcatcctgttgattcctcctagtggaagaagattgattgtttgtatccgaattttggcaaagaggcaagaaatcttaggcttggacttgccactaatggaatga

SEQ ID NO: 88623 - DNA, 657 bp, Glycine max
  Peptide Sequence Number=SeqID_205401
atgactcatcattcatctagtgctaatggtgagggtactagtcataagaaccctctatctagaatattagatgagttgagttcccacaaattatggaaagaaacactagaaagaaaggaaaaaggaaaagagagggaaaggaaggttcctttggctacccttagcttccaagggtatgccctttattggtggacttcccttgttagggaaagaaggattcatggggatcctctagtaaagtataagaatgacttgaaaagtgcccttaggaagaggcacatctcctcctactatgaaaaggagcttatggacaagctccaaaggcttagacaagggagtatgagtgttgaagagtataggcaacaaatggaactacttattttgagagttgggcttagggaggaggaaagaacaagtactgctaggttccttagtggactaaatatggaagtgagggaaaaggttgagctccttcaatataaggaccaagatgacctagtccaactttgcataagggtagagcaacaacttaaaagaaagtctacttcaaaatcatatggctctcgctcttatccaaagaaagaccaaggtcaaggcatcttacgggctgcaccttctaagcccaaagatgataaggggaagacaatagaaaagtaa

SEQ ID NO: 88624 - DNA, 234 bp, Glycine max
  Peptide Sequence Number=SeqID_205402
atggcatatcccggaaatcgtaggaagccacggtggggaaccttcgacgctgctgatgacgtcgaggaggcggtgaaaacccttggggatgaaggcgtcgacgtagataaagagcccgctctgggcggcgaagagcatgacgtcagcggggaacaactgggggagtgcgatgagaaggaggcaaaggagggcggagagttgggagagcaaggcggagacggagaggcattctaa

SEQ ID NO: 88625 - DNA, 219 bp, Glycine max
  Peptide Sequence Number=SeqID_205403
atggctggaagttcatacacgaggacgtccggaaagagtgtgcttagttacgagaagaaaatgcagctaccgcaagagcccttgaacaagaaaccaagagggctcgcaaggaagagcatggccaagacaaatttcgtggagctttgtggggcagcaacaaggaactcaagctttgaagggaagagagagaccaattacgagtacatagcatggtcttaa

SEQ ID NO: 88626 - DNA, 531 bp, Glycine max
  Peptide Sequence Number=SeqID_205404
atgactagaacacgaggtttaggtcgtgtcataggtagacttgtaggcggagatagacatgatgatcatgatgtagctgatgttcccgagagacgtatgcctattgtctctgcccgtaggcaacgagttcatcagatgactgcggatacacgtgatttggctgaggacgttgctgacatggctgacgatgtccctgatctagctaaggaggcacctgagatgcgtgcggacatagatggtgctgatggtgctgaggggtcagatgctgatgatgctgagggattccctggtggaccacgtgacccgtcagtgctgacatcatttgcagaccatgttgcacacgctgtttggagtggacatgaacgtcctgatttgaagttggtgtcacatggggaggaaggtgacactgattggggaggccagtgcctcagatcgaaggactggttgctgccacagggattaagtccactgatcgatttttcagttgttactggcgatcctggactgatattcgcatttgtggagaggtga

SEQ ID NO: 88627 - DNA, 380 bp, Glycine max
  Peptide Sequence Number=SeqID_205405
gggttgcgcccacaagacacccagtggacccggagaagtccaacaaggacctggggtctccagctttggttacgggcctctgtcagtcctacagggtgcccgtccccccagcaaggtcatgccatcgtgacatagggatcacgcccgcaagacacccagtggacccggagaggtccaacagggtcctggggtttccagctctgattacgtgcctctgtcagttttacggagtgcctgtcacccccaacaaggtcattatgccccacattaaccgggctttcatcaagaagtactgcgcccccaggcaggcgcagggcgagacacaacaacagcctggggatggccagcaacaggaacaaatgcaccgccgccacctctaa

SEQ ID NO: 88628 - DNA, 489 bp, Glycine max
  Peptide Sequence Number=SeqID_205406
atgggcccgaaatctaccctaaggctcatgagaatcctagggccttctcttgcatctttggctcaatcttcttggagtcttctatccaatgcccttggggggtataggaatgacttgaaaagtgcccttaggaagaggcacatcccctcctactctgaaagggagcttatggacaagctccaaaggcttagacaagggagtgtgagtgttgaagagtataggcaacaaatggaactactcattttgagagctggacttaggaaggaggaaagaacaagtattgctaggttccttagtgaacttaatatggaagtgagagacaaggttgagctccttccatataaggacctagatgacctaatccaactttgcataagcttagagcaacaacttaaaaggaagcctacttcaaaatcttatggttctcactcttatccaaagaaagacaaaggttacggcatcttaggggctgcaccttctaagccctaa

SEQ ID NO: 88629 - DNA, 339 bp, Glycine max
  Peptide Sequence Number=SeqID_205407
atggaatatgtagactcgaagaaacaagagttcagctactcagaggttcaaatgattacgaataattttgagagggttgtgggtaaaggaggatttggaactgtctactatggttgcataggtgaaacacgagtagccgtgaagatgctctctcattcaactcaaggtgttcggcaatttcagacagaggcaaatattctcacaagagtacaccatagatgctttactccacttattggatattgcaatgaaggcaccagaacagcactcatctatgaatacatgaccaacggagacctagctgagaagctatcaggttttaaatatgtttatatgtag

SEQ ID NO: 88630 - DNA, 1053 bp, Glycine max
  Peptide Sequence Number=SeqID_205408
atggctccaaaaaagctttccgggaagagatctaggagggacgccacgactgaagggaccaatgctgcccccgagtttgatagccatcgtttcaggagcgccgatcaccagcagtgcttcgaggccatcaaaggatggtcgttccacagagagagatgcgtccaactcagggacgatgagtacactaattttcaggaggagatagctcgccgacattggacgtcgctggtcactcccatggctaagtttgaccctgatatagtcctgaagttttatgctaatgcttggcccacagaagagggagtgcgagacatgcggtcatgggtgaggggtcagtggattccctttgacacagatgccctcagccagttcttgggtgacccgctagtgttggaggaaggtcaggagtgcgagtttagtcagaggaggaatagggccgatgggttcgacgaggaggccattgcccagctattgtgcacaccggggcaggatttcgcccggaccgctgccgggaggcggttgcggatcatgcgcaccagcatgaccaccttgacccaaatgtggatgacgttgctgctcagcaatgtcttgcctagtgatcataactccgatctccctctgccgaagtgtcagctggtgtatgccatcctgacacggatgagcgttcacgtggctcagctgattgctgacgccatctatttgtttgcaggtatgccacccaccaggcaccatctagacccggataagtctaacagggccttggggtttccggcattgatcacgggcctctgccagtcattcggggttcccgtcacccctagtaaggatgcagacgcaccaccaccacctcatcaggccgatcccgctgggtcactaggcatggagcgttatctacaacgcttggttcaccagcaggcggctaaccaccgagggcagtttagggatgaggtcgcatggcccggagattggcccgaggcccaggcagaggaggcctgcatggatgaggagatgacagatttgctcggtttcttgggagggagcggagccacatga

SEQ ID NO: 88631 - DNA, 405 bp, Glycine max
  Peptide Sequence Number=SeqID_205409
atggcttctaggaaaaggaaagccgcaacttctaggccccagccttactatgatattcacagattcacctctgaggatgcctggaaccgttatgctgacaacgttcttggccggaacatccttccagaaaggaatgtgaaggtttttttcacagagtttgatgagttcaggacagagctagtcagaagaaactggcataggacgctgaccaacctcatggaggggagcatagatgtggctctcgtgaaggaattttacgctaatctttatgtcccgggggataagcctccaaatcaagttagggtcagaggacatttaattaagtttgatgcggattccctcaacacttttctggagactccggttattctagagccaggggagactcttcctacttactcctag

SEQ ID NO: 88632 - DNA, 327 bp, Glycine max
  Peptide Sequence Number=SeqID_205410
atgtccaagaacaaggtgttgaaagagcataaagggactttcctaagttggtttaaagaaacaatctttgcttatgataatgcttctgaaacattaagaaagttagcagatgggccgaaaagaaatgttataacttgtcaaggatacgatataaacaagtattcattccacacgaaaacacaagatgacaagagtacaatgcaaaacagtaggtgggttgacatcaatatcagtgtgcaaaccgatgatttcggatttacgttagtagatttgaagaagcccacttaccagaattaccctttcatcatggtagaagaagctaaacgg

SEQ ID NO: 88633 - DNA, 615 bp, Glycine max
  Peptide Sequence Number=SeqID_205411
atgagcaaaagccctacttttgtcgaccaccccaccttttgctaccgtgacccaagagtctggtggcatacggagacacccgacggtaacccgcaaacaccctttgctatccagcgacctgagagttcgttagcatgcgaagacaccttacggttatccgcatctcgtcattcggagaccccaagttcgattgacaagaaaagaccaatgtgtccatctacaccctttccagagatgtcagcatcttctggtagagactattttagtctcacaccgctttcccaagaactacgtaggagcaaaagccctgcttttgtcgaccaccccaccttttgttaccgtgacccaagagtccggtgggatgcggagacacccgacggtaacccgaaaacaccctttgctatccaacgacccgagagtctattagcatgcgaagacaccttacggttatccacacctcattatttggagaccccaggttcgattgacaagcagagaccaatgttttcatctgcaccctttcctgagatgttagcatcttccgttagagactattttagtctcacaccgctttcccaagaactacgtaggtctgagttcctcatcacaaattga

SEQ ID NO: 88634 - DNA, 297 bp, Glycine max
  Peptide Sequence Number=SeqID_205412
atgagcgtaatcatagatgctataagtcatcgactcattgtagattcacgaggacaacttgcaaaaatatccaagacctctggaccacccatcaaattcagaggagatgctagcagcccagcccttctccttcgagtccctgtgtcgttcttctccagccctgttgattcagcgtgcgtggtggtgtcttcttcttcttcgtccccttggttttgcgcgtttcgtcggcattgtcaagcctttgagttgatccgcactagacataggttaggtgtagatgatccgcatagcctttga

SEQ ID NO: 88635 - DNA, 387 bp, Glycine max
  Peptide Sequence Number=SeqID_205413
atgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgggtatttggagttacgaaggtgtggccggagcacatattgtgttttcgggcttgggtggcttgttttggttttggcgcatttcatgtaacaggattgtatggtcctggaatatgggtgtccgatccttatggactaactggaaggatacaatccgtaaatcccgcgtggggcgtggaagcaacaacccctattga

SEQ ID NO: 88636 - DNA, 237 bp, Glycine max
  Peptide Sequence Number=SeqID_205414
atggaatcataccagtgttttgaaacacttgatagcaatcaaatgcttccccatcaaagaattctaggtcaagatatttgggatcaagaatttgacgtgattgaaagagaaaggaaggatgacaaggagggtagaattggtgtcggggatgctccggtggccccgggacgtggtgttcgagttgctgcaacagaggtggatgaacccttacgcttcttggatgattctgccatttga

SEQ ID NO: 88637 - DNA, 1130 bp, Glycine max
  Peptide Sequence Number=SeqID_205415
aaggttccataagagtgtcatcctcatctgccaccaacaagaacaagctagaagcacacttatggccacatggtatggatggagacagtggtttggagggggtggagagtagaggtgcgggagagatggttgggggtggtcgtgggcctagtggtcctagagctagagagactgccttaatcaacgataatggttacaaggcttgtacctcgcagcagatctccgggctgagtccagagatgaagcagctaagcagaaatggcgccggaagtccgagaatccgatttgcaagggattcaaactcatataagtactcattaacagaagcacattgcactaggaagtcaattgagcattgcggtgcatccactggaaccatgataagacgatgtgaagattttgacgtaaaagtagagggactggcgacggatgaagctaagatgggaagaggtgagtttcacaatggcatcttcaagatgatccatcttggacttggagcgagtggattcagccattgttcaatgaaagcaccaatgttaagccttggaattcgaggactaagacaaccctccaaaagtttcatcaacgtcaaccaacactctaatttggttattgaaagaatggttcatgccttggagcttcctgcccattggaaagtaccatggtttgaggtcaaatggcacgtcaagcaatacaaaaaggagaaacacatggacccaaatttacttgaattggctaaattaaatttcaacttgattcatgctaaacttcaaatggaggtcaaggaattatccagaagcttcttgtgtgcagcaggagttgcatttgagcctaagtataaatctgagaggaaatggctcactaaagtgattactttcgtgccagtcatcgatgatgtttatgatatatacacctcatttgaagagttgaagccattcacaatggcttttgaaaggctgccggtaaaaccagaggaaggtgaggacggcgtcaagtcatcatgctccttatgcatgctggttgattcactttttccttcgtgcaagcatttggttcaccccttttgtgttgcatttttttgtgatcctctgcttcagtttgtgtttttcgcccctcttgatgattgttga

SEQ ID NO: 88638 - DNA, 1079 bp, Glycine max
  Peptide Sequence Number=SeqID_205416
atggaccaattctatgatgaggttcaagagcccgtgagtcctcatggacattatttcaacagttcggtgatttgctcctatgtttttggctttcttgaaatggcagttccaattgatgactcacagactatacctttgctggaagatgtcttcctccccatcaacccacgtttctcctctattatggtcagagaccaagctggtaaaatgagatggaaaagggtacaagtgaatcctgaagagcatgtaaaagtccctagatttcctgaatgcaattcagcagaattgtatgagcaatattttgatgattatgtgacaaggattctaaatgaacggacacctcagaacaagccactatgggaaatccatcttattaagtatccaacaagcagtgctgcaggcacaataattttcaaatttcatcattcacttggagatggttattccctcatgggtgcccttctttcttgtcttcaaagaactgatgacccttctcttccactaacttttccttcaaattcacagcatgcaaagaaaaacatgtttaagttacattcagtgatatcctccctctttagctccatgttagattttggatctagcataataaagactagaatgattgaagatgacaaaacacccataaggtctggatatgaaggaactaagcctaagtatttcaccttgtcaaacatatcattatctcttgatcatattaaagcaatcaagtccaatcttggagtggttgcgtctaaaaccttctacaacactctgggaaattgtagtgttcttatatccaacatgtttgggccaatggagcagatggctttggcaaatcatcctgtaagtggtgtttatttcgctatgtcgggtggacctcagaatgtaaacgtagaaattatgagctatgtgggagaattaagaatcacctcgaaaactcttaagggatttatagatgaacagaaattcaagttttgcatagagaaagcctttgatgaaatattcaaagatgctatggagatctacgagatacctaaatgggacatatatatggaaatattgattagtggtggcgcagt

SEQ ID NO: 88639 - DNA, 132 bp, Glycine max
  Peptide Sequence Number=SeqID_205417
atgacaagggtggttggaggtggtagcatgaaggtagtccatggtggtggttttgattgttttaacatcggtttatcaacattgattttggataaaatcgatgttaagttaaacgcggtgacatatttgtaa

SEQ ID NO: 88640 - DNA, 270 bp, Glycine max
  Peptide Sequence Number=SeqID_205418
atgggctgcggggggtccaaggtggaggacttccccgtggtggttctgtgcagagagcgaaaggcgttcctcaaagccgcatcagagcaacgctacgctctcgccgctgcacacgtggcgtatttccattcgctgagtgaaattggcgacgcccttcacaagttcgccgaacaagacctcaccaccaccaccggttcctcctctccggaagcgaaagaggacaagcagaagaggagtgactttgagttcttctggaagtttcacgcttga

SEQ ID NO: 88641 - DNA, 279 bp, Glycine max
  Peptide Sequence Number=SeqID_205419
atgactatcgacgccagcacgctagacagtgatttttcgacatacgctactctcagaaacggaaaacacttcgctggaatttcactgtacagtggagaggggatgggagacgaaccggtcaatttggtttatttcagcgaccgatcgaactcgtcaggcaacatttgcatgtctggttcgctcaacccgaagagcgtgcacagtaaggtggtggtttgtgacagggaactcaactcacgcatggagaagggtgtagtggtgcgcgacgccggcgggtag

SEQ ID NO: 88642 - DNA, 321 bp, Glycine max
  Peptide Sequence Number=SeqID_205420
atgtcaactgagagacacgttaactacagatatgatgtgcttcaaacacttcagcaatgtcagcaattacttctttgcaagttggttatccccagcacccatgtcgcctccaccgccgctagctctgccgtttccaacgccacactcctcggctacgccattggaacggcccacgggatggcgtcgcaggcgcgcatggcggcctacaaagtttgctggaccggcgactgcttcgcctcccgctctcccttggtggctcctcctcctcctctgtcccttactactttgacaacatccccattggagccttcgcgacgctag

SEQ ID NO: 88643 - DNA, 396 bp, Glycine max
  Peptide Sequence Number=SeqID_205421
atggcacgcagagaaaaattatggtcattttgcacccttttgtcatccagaggcggtgggctcgatgacatgcggagacaaattatggtcattccactcactttttcgccattcagacacaatcgtgtccgatggcacgcagagacaaattatggtcattctgcgcctttttgtcatccagaggtggcgggcccgatgacatgcggagacaaattatggtcattccgcacaccttttcgccattcagacacagttgtgtccgatggcacgcagagacaaattatggtcattctgcgccctttgtcattcagaagcagcgagtcaagtgataaacgcgcaaagacaaattatggtcattctgcgccctttgtcattcagaagcagcgagtcgagtga

SEQ ID NO: 88644 - DNA, 232 bp, Glycine max
  Peptide Sequence Number=SeqID_205422
gtacgacctcgatcagcgtgctaagcacaactccaaacattcaaaaacattaagagattggcgcttagcgcatcctgcggctaagcccaactatgaaagctcaattccagaatggatctggggcttagctcaggacagcgcgcttagcgctcctacaataaaattttccagagaaagagttgcgcttagcgtatcaactccgctaagcccaaatcatgaagttcaattctag

SEQ ID NO: 88645 - DNA, 225 bp, Glycine max
  Peptide Sequence Number=SeqID_205423
atgtgtaatgtttcttgggtgactaatcgtaatgggttgaagattcttattcatgataatgaagagcaaaatacttcaatcgcttcaaatgtggttttaacacatgctatggatgcaactaaagttacaccccctacaccaatcctatttgttcctaaagaaataatgccacgagcttccatcaacaagtccatcaagaaagtgacatcgaagaaagaaccttaa

SEQ ID NO: 88646 - DNA, 957 bp, Glycine max
  Peptide Sequence Number=SeqID_205424
ggtattgtcaacaaagttttgagattggctcaggattcggtggctgctcttgaagtcagcatgttggattctaaatccgtgactagacgtgttggagatataggtataaggtgggaacctccttgtagggtgcttctcctgggtgtgattcaggatgggtatggagtttttatttgttgctttgcaattaagctcggtgcttgctctattctttccgtggagttgtggggacaacctcttcatccaacagtagtgcggcttaacgctagtaacttaaatgtattttcaagacattttggtcaacctgcgaggaaagaggaggaggatgatgtagaggaagtggaaattgatcaaaaatgtctcccagctgattttgatcctgctacatttgatcccaatgatcatcgaggccctccatcagagagagttttcaggcttattgatgagattgcttctcttacggtagctgaagctggagaattgggtctcattctcatgaagaaaatgggagtgaaggagatgcctaatgtgggatttatgaaagcaggagctggaaatttggctggaatggcagcaaaagcaccaacagcagccaaggaggagcaaaagctagaaaaaactgtgtttgaattgaaactggagtcctatgaagcggcttccaaaattaaaatcatcaaggaggtccggggctttactgatttaggtttgaaggaagcaaaggatttagtggaaaaaacaccttctgttataaagaaaggtatttcaaaggaagaaggggagcagataatagagaaattgaaagctcttggtgcaaaggggtgctttgctcattccttggatgaattctccctcttgaaaagttttttggtggatattcatactcctaaagtgccttccatcaagcaggtggactggcgtttgccggtggctggctggcattgtgaaggtgaacactga

SEQ ID NO: 88647 - DNA, 969 bp, Glycine max
  Peptide Sequence Number=SeqID_205425
atgctggaatcacaagactggaaatcaatcatgaaatatcaaagaaagaatggatcgttgtttaactcacctgctacaacggcagctgtttttcagtgccataagaatgctgaatgtcttggttacctccaatccgtattagaaaagtttgaaaatgcagttccgacaacttatcctctggatatatatgcccgtctctgtatgattgatagtcttgaaaggttgggtattaatcatcatttcaaagaggaaattcgaagtgtattggatgaaatattcagatattggatgcaaggagtggaagatatattcttagaccccaccacctgtgcaatggcatttcgtatgttgcgtctcaatggctatgatgtatcttcagatccattttatcaatattctgaagataaatttgctgaatccttgaaagggtacttgaaggatgttggtgctgttatagagctatatagggcttcacaagccattatacatcccgatgaatcaattttggtgagacaaagtttgtggacaaaacatcttctgaagcaggaatcctccccttacagattatatgctgataaacttcgtagttatgttgacctagagatcaaggatgttcttaattttccttatcatgcaaatttggagcgattgttaaacaggagatcaatggagcattacaacacagtagaaacaagaattttaaaagcatcatatagatcttgcaatcttgcaaaccaagaaattctaaagctagcagtagaagacttcaatatctgccaagcgatacacattgaagagttgaaacagctttcaagctttctcataggacatctatggagagggctggtcacactagaagcagtgtccttccgttctgtgagcacactcttggtatggctaatgcctcatgcctctgttcctgaattggttccttgtttggctattgttgctgccaacactgctatttga

SEQ ID NO: 88648 - DNA, 315 bp, Glycine max
  Peptide Sequence Number=SeqID_205426
atggagcagatttgcaagtcaaaagaagaagcgcagagatggagcagatttgcaagtcaaattaagaacaatggggaacacagtggaaagagatccttgttgaaggagacagtgaacaaaagatatttgaggaagaggatgtttgagaggaattgggaagcacagaaaactgaattgttgaagaggttttcacctagtgatgctgcaatcccatatgagcaacttgatgccttgtaccaaaatggctgggtagaagattatgttcaaaagtttgagaaattgacaaactgccagaaatttccaaataacaactaa

SEQ ID NO: 88649 - DNA, 268 bp, Glycine max
  Peptide Sequence Number=SeqID_205427
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctcattattggggacgctggaggatttcaaagtcccacacgtgaaccac

SEQ ID NO: 88650 - DNA, 426 bp, Glycine max
  Peptide Sequence Number=SeqID_205428
atgatgaaggtctatgggaaaacattcctacaggctgagtgcgaaagtaatgctttgtttaatgtgatcatggccacagatccgacgtctcccccgcagtccgatggtcaatcaaaggcaacttccaagaggagtagaacaacgacacggctgagaacattgacattaagaaccgtggatcagcccagaccggcagtttatgtggatcccgctaccgggagagcatcgggaccgatgcgtgaaaagttccacagctacctaggcgtagtggcgcgagaaaaggttcccattatccacaataattggaaagacgtacctgaaacgctagaggacatagtgtggaatgacattctatggtccaaacatccactactagcggtggaacatgttgagataagtctgggaaggaagaatagcaccttctaa

SEQ ID NO: 88651 - DNA, 381 bp, Glycine max
  Peptide Sequence Number=SeqID_205429
atgacaaaagaatttggcagagcatcaatatcaaggccgcgcgctaagcgtgagatcagtgtgctaagcacagtagttgtcctcagccaggctcagtgcatgttcggcttccagcaagtgcaccggatcacacaagctatctcagcaaataggtgtttggtgtgtaaaggaagccttcttaacaacaaagagaagaacaagatgaaagattgcaaaaataaaagtggtgaggatgtctccttcacctctaggatctcacaatcacacacaaactcatctcaagctctcaaatcggttcctgcttcaagctctggtctctgcagatcttcacacagcaaaatctctcaaaactctctagaacttggacctttctctctctag

SEQ ID NO: 88652 - DNA, 204 bp, Glycine max
  Peptide Sequence Number=SeqID_205430
atgactccaggagtgcatcatgtcttagaaaaatacctcaaaaccgttctagatcctaaacaacattgtttacacgttctccctccaaataggcaaaagcagttaaaaatgtcatccttgttggtgtcacaccaacaatgccaagtactatctatgagaaataccaaattacaagcattggataatttcactgcatcaggatga

SEQ ID NO: 88653 - DNA, 765 bp, Glycine max
  Peptide Sequence Number=SeqID_205431
atgcggatcaacttgatctgtgggaaacatgcggatcatgttttcatggttacggatcatctacatacaacggagaagacacacacaatggaacaccaccacgacgccgtcaacaatggtgaacaacaacaccaccacttcgccggaagcaacaacacccagtggtcgcggaagcagcaaagcgaaagagaagacgagaggaacgtggaagaagaagacgaactaagctcgtggaacagaagaacaggaatgcggaaaagaagagaagcagcaacacccttggatagattgacatctgatgttgtgcgctggattccttatgatgaccaccgaccattcaaagaatttaagctgatctccttatttttcggacaaatcagatggggtccatctattgaaattgatgatagatggatgcagttctttgaataccttgaatcgatgggtcagatttgtgttgctcttgaacagtgtgcagcagaatacatggagtgggattctccaagacatccaccagtggtgcataatgatacatttattgaactagatcctcctcaacagcctgtcgccgcaatggctatgccagaaccacatgcacctacacctgttgatatagacatgcctcgttatgcagtggagggttgccaacgaatagcagaaaggttggaacacttgatcaacatgaggatgattactactggaactgaagcatacaccgtggccaaggaatgcctgagaatcgccaggggtgtcactgagcaatga

SEQ ID NO: 88654 - DNA, 981 bp, Glycine max
  Peptide Sequence Number=SeqID_205432
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagaattcgatcagaaattcactggtcagattgcgcatacagttcaacaggtggcaggagaaacacgtctcaagattcccgacacgcttgctgagctcaacacaatggatgttcaccaagcatctaccgatccatcgattcttcgcactcttgaatcacttgctgaagagtgggctgaaacggtttcgggtgctttggatcaagcttatcgataccgtcgacctcgagggggggcccggtaccagcttttgttccctttagtgagggttaatttcgagcttggcgtaatcatgctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 88655 - DNA, 261 bp, Glycine max
  Peptide Sequence Number=SeqID_205433
atgcgaaaagtacccaaaagggagggcaaaagggttattttgaggatttttcagacccctggctcgcccaggctagcctctggctcacctgggcccccaaatgacttaggggtgaagaaggggttcagactttcaacattgaaaggatttagtgaaattaaggagaagaaggagaaagaagaagaaaaaacgaggccgaggcgcttccgaatcataatcgtgactgattcctacatcgttcttcgttcgtcaacgggttag

SEQ ID NO: 88656 - DNA, 271 bp, Glycine max
  Peptide Sequence Number=SeqID_205434
atgattgaaagttttcaacaacaacaagaaatgggtgtcattgaattgtgtgttgaagtagatgttgtcggtgcttctgcgttgaatgtggcaaattcactattatcatgtgggaataatatagttggcaatgaatcaaaagttcaaagatttgcaataaatttagatgatgattccgacgatgatgattacatgatatctaattcatatgttaaggactcgttggatgaggaggaagatatcgatgatatatctgacacagatgaagaag

SEQ ID NO: 88657 - DNA, 477 bp, Glycine max
  Peptide Sequence Number=SeqID_205435
atgggtatttcacatcaaggccaggctcctcggcagtggtttgaaagattgcaaagcaccttggttcagtttggcttctcagccagtaaatgtggtccttcactttttgtttataaaaagcacaagaatgttgtgtatctcttggcgtatattaatggcaatgtcatcacaggaagcttcagtactcttgttcaatcttttatcaatcagctcaatttcacttttgctctcaagcaattgggacatcttggctacttccttggtattgaagttcatcgtactgcttctggctccattttgctgacccacagtaaatacatttgtgatcttcacaagactaatatggctgacgctaagtggatttcaactcctatggcttttgccatgaaactttctaagtctggtggtgatcacttatcaaactctgaactttacaagttagaagttggcgcacttcaatatgcaaccatcacttga

SEQ ID NO: 88658 - DNA, 510 bp, Glycine max
  Peptide Sequence Number=SeqID_205436
atgcggtggattttgtccctcgtcagggatggtaaacactttcggcacattctcaattggttaagggatggtgtggtgcctactctcgaggagtctcagtactcagagctgttgagggaggctgagtactatcagctacttgggcttattgatggaatccattctgtccttaataagaagaatgaagacgatgagttccatacagagttgacacgaacagatatcatcaagtgtatacaatctgagaaagatttatcttatgttgatttcagctatgcttgtcttaaaaacgtgtttttttcacgagcaaaccttcaatgtgcaaagtttcgagatgttgatgccgagggctccatctttcacaatgcaactttgcgtgattgcatacataatttctggcctctaaattatttcctcttgcctagggaagatgtgaatttactgcggcaaatcttcgtggtgctttattggctggtgcatgccttcagagtgcaaatctacaaggtctag

SEQ ID NO: 88659 - DNA, 429 bp, Glycine max
  Peptide Sequence Number=SeqID_205437
atggaaccaagattattccattctcttgataagtgttatcaatggcggatggcggaaggccgaaattccaccatatggcaggcctcccttaacaaattcttatggctgttggcgaaaaatccgccatggccactatttaacaacactgctgtcatgaaaggcagagcagcagaagaagaaggacttaaggctctaggagacgttgtggggaagggagggagcaagcagggttcagtgtctctaggagtagaagcagaagggtgtaagaagaaacctttaatttctgttctggatcactcctcctctagaactgcccccaattcatcttcacattcctcggcgccaccgtcaccaccgccaaccccttctacactctggagaggatggctaaagtcaaggattttgcaagagaaaacaacgtcaaagtga

SEQ ID NO: 88660 - DNA, 270 bp, Glycine max
  Peptide Sequence Number=SeqID_205438
atggtagtcctggttcttggcagggcatggcagctagctccagcaatggctatgggtgtcaggtcctttgttaagaataaggtccccattactaaattgtattctagagggaataagaagataacagactcaactgactcacaaggcagtgacatggttgggtcagctatcttcctattccttctagaatacattctgactaactggctatcaaaggctgagacagggactgcagatggcaaaggtatttgtctgaagcagggacagtga

SEQ ID NO: 88661 - DNA, 420 bp, Glycine max
  Peptide Sequence Number=SeqID_205439
atgaaggatttagttttcatcactgaaaatcttgggaatctcttcagctctcccctttttgacacctcaatcaagattgcttatggcttaggccttattctaggtgaaccttctacattctttatccatttccctccagttcctacaaagtcaatttctgcaaaaccttatagggttcaggaggatgttccccatgttcacattccaactccacctattgttgttgctaaacctttttctaggaccatgaatgagttctttgagagattcctcaaacttgaggagtggatttcagacaaggcaaaacctgccttgattcttaaagatgcagttatgcaacataagccaccaccacctctaagatctaccaccatggtcctcatcttcctcatcaaaaaacttatctcctaccaagcctga

SEQ ID NO: 88662 - DNA, 287 bp, Glycine max
  Peptide Sequence Number=SeqID_205440
tgacttcctttggatactgtaaggatcgaaatggtcaatggctgaagaaagatgcactccctcctcaagatgagcgtactccttcacctcctcctcagcgagatgattcagcactcatgaatgaagtccttaccgaattacaaggtcttcgttcttatgttggtgaacgttttgactcattggatacacattttgctggcatggatattcgcctcacacagcttgaagaggatgtgggttacattcgtcagagtttcgatcttccaccaccacctccaccttcttag

SEQ ID NO: 88663 - DNA, 279 bp, Glycine max
  Peptide Sequence Number=SeqID_205441
atgatcttgaaggatgagttgaaggcttgtcttaggtccaagaagagtttgtcccagcagttaagcgagatggaaggaaacatgttggccatcattgataagtacaaagaagagctaaacctagcggtaactcatgagcataggccagtggatgagtacgccaaggtatcggcagaaaaggaagcaaggggaagggtgatcgattcattgcacagagaggcaatgttgtggatggataggttcgctttcaccttgaatggaagtcaagagcttccctga

SEQ ID NO: 88664 - DNA, 210 bp, Glycine max
  Peptide Sequence Number=SeqID_205442
atgcggccacagctgccaccgccagcactgccactgaagcagacccgtgcttacccctacggactacccctcaactttacaccacctgccgtacatgagaacacggaccatgccgttccctatacctttgaagggcagcctccccagcctgtagggggcgctcgtgaagagcctcgggagcatgcccaaggggacgtcaactcattgtag

SEQ ID NO: 88665 - DNA, 528 bp, Glycine max
  Peptide Sequence Number=SeqID_205443
atgaagatggtaactgctttcaatggcaacatgaagaaagctgctgctggacttagacgcattaatcttgatggtcttcgatggagggtttttgatgcaaagggccaggtttttgggaggttagcatctcaaatagctactgtagttcaaggaaaggataagccaacttacacacctaatcgtgatgatggagatatgtatattggccatctcaagcaaaggactctaaaggatcaaatggccaaagaccctactgaagtcattcgcaaagctgttctgcgtatgctgcctagaaacaaactacgtgatgacagggaccgaaaattaaggatctttcctggcagtgagcacccttttgttgatcgcccacttgaaccttatgtgatgcctcctagaagtggacgggaaatgaggccgcgagcaaggcgtgccatgattcgagcacagaagaaggcagagcagcaacaacagaaggctaatggaatgaagaagggcaaaaatggagaagcacgggaagaaagtgcatga

SEQ ID NO: 88666 - DNA, 198 bp, Glycine max
  Peptide Sequence Number=SeqID_205444
atggctatcatttggaagaaaatggctccaaagaagcttccagctaagagggcaaggaaagatgccgctggagaaggttccagtgcagccccacaagtggacgtagagtttgacaaccatcggttccgaagtgaggaacaccagcgctgttttgaggcaattaagggttggtcattccttaaggagaggcgggtctag

SEQ ID NO: 88667 - DNA, 201 bp, Glycine max
  Peptide Sequence Number=SeqID_205445
atgtggatgtaccctcctcatgaactgatcgacaagagatgtaccctctattgttctcagtatagcaatccccaagtagatgtaccctctacttgtaccacaaaggatgtaccctccaatgtgttgggacaaagaattctcaggcggggaagggaagaatcaaaagaattcttaggcgttagtcctttgaatcttttgtaa

SEQ ID NO: 88668 - DNA, 479 bp, Glycine max
  Peptide Sequence Number=SeqID_205446
atggctccgaaaaagctttcggcgaagagatctagaagggacaccgcggctgaaggaaccagcgccgcccccgagtttgatagccaccgtttcaggagcgccgagcaccagcagcactttgaggccatcaaaggatggtcgttccataaggagagacgcatccagctcagggacgatgagtacacggattttcaagaagagatagctcgccgacgttggacgtcgctcgtcactcccatggctaagtatgacccagatatagtcctggagttttatgctaatgcttggcccacagaagagggagtgcgggacatgcgatcatgggtgaggggtcagtggattccctttgacgcagatgccctcagccagttcctgggtgacccgctagtgctagaggaaggccaggagtgcgagtttagtcagaggaggaacagggccgatgggttcgacgaagaggccattgcccagctattatgcat

SEQ ID NO: 88669 - DNA, 489 bp, Glycine max
  Peptide Sequence Number=SeqID_205447
atgattctggctgctacattcccacaaaagatacaacacatgactagccaagaccaacctttaatgcaggtggatattctggatttcaacatggccagcaatataatcagcaacagggatagtggagaactcaccctggtaatcaattcaataaagaccaaggtgggccaccaaacagtccaccgcaacaaaggccaggtctctatgacaaaacaacgaagatggaagagactcttgctcatttcatgcaagtgggacaattggcaaagcaactggcagactgaccgtcaagcagctttggagccaacagagaagaatcctaaggatgaatgcaaggctgttatgactagaagcaaaatggtgagcatgaatgaaggtgagaagaagataggtgaagaaaaacaacagctagtaactgaaccagaaattgacccagtggtggaacttttgagcaagactgatgtgccatcattttcttctattttctaa

SEQ ID NO: 88670 - DNA, 567 bp, Glycine max
  Peptide Sequence Number=SeqID_205448
atggacttcatcactaatttaccatcttctcatggctattcgactatcatggtcatagttgacaggctttctaaatttggccattttattgctttaaaagctgagtttaatagcaagttggtggcaaatgtatttatcaataatgcggcaaagatacatggatttcctaagtctattgtgtctgatcgtgatagagtgttcattaattctttttggcagcagttgtttaaagctcaaggaaccactttagctatgagttcatcttaccatcctcaaagtgatggccagacgaagatccttaataagactcttgaaatgtacttaaggtgctttgtgtttgataatcctaagttgtggtaccctatgctagcttgggcacaatattggtacaactcttcttatcatcacagcttggaatttggcccaatcaatcaaccagaacatgttttggatacaagaattattaagaggaatggtattgaaattcagcagatcctaattcaatgggagtcatttgatgccagtgaggctttgtgggagtcattggatcaaatggcctcagaataa

SEQ ID NO: 88671 - DNA, 216 bp, Glycine max
  Peptide Sequence Number=SeqID_205449
atgaggacgcgtagccctctaaaggcgagggcgtgcagccctctgcaggcgaggatgtgcagtcctctgatgattgactgtccttttgaaaaaggtgataattcatgcaaccttatcctatcttttgcaaatctctctgggaactccctcagagtgtatgttctgtttgatttattcacttgtccattttggagtgacgacaatggagccgtttaa

SEQ ID NO: 88672 - DNA, 393 bp, Glycine max
  Peptide Sequence Number=SeqID_205450
atgggagaaactctgatggaatggtccgtcatccggctgactgctcgtagtggaagaagattcatgcaaaaatacatgatgttgtctatgatgatatccggcccaagacagccaagaaatggcattgatgtttacctaagttcgttgattaaagacctgagaaagttgcaggacgaggaggttttagtgtttgatgagtttaacaaggagactactgccattgagcgaccagagcatcctggtcgtgtccgtgctgctggagccggtgtcaccataaagcaatatttcggatcggctccacgaacatcccccagttcttcctccatgcctcctgacgacctacagcagctgactcaacaaatcaaggaccagctagaggagtcgatcacataa

SEQ ID NO: 88673 - DNA, 378 bp, Glycine max
  Peptide Sequence Number=SeqID_205451
atggccattactgaatcaagggatctttctaatatgtctcttgctactttgtttagaatgttacaagaacatgaaatggaattaatgagattcaatcagcatgaggagaatgataagaaaaagaaaggaatttctcttaaagcttcatcatcaatccaagaaggaagtgataaagaggattcaaatgaaatagatgatgatgatgatctcagtctttttaaaaaaatagaaagatcagaaaagaaaacttttaatgacaagaaagccaagaaggcctacattacttgggatgacaatgacatggactcatttgaagattcagaaaatgaagttgtaaacgtgagtctgatggccaagaattatgaaagtgatgaagag

SEQ ID NO: 88674 - DNA, 688 bp, Glycine max
  Peptide Sequence Number=SeqID_205452
ggtgcggataaccgtgaggtgtttctgcgtgtcatcaaacttgccgtctccggatgacgaggtgcagataaccgtaaggtgtctccgtgtgtcatcggacttgccgtctccggatgacgaggatgaccatcttggtctctgcgtttcatcggacttgccgtctttgaatgacgagggtgcggaaaactgtgagacactgaggtctccgacaaagggagcagatgactatattggtctttgcgtgtcattggacttgccgtctccggatgacaagggtgcagataaccgtgaggtgtctccatgtgtctcagacttgccgtctccgaattacgagaggtctctgacaaagggtgcaaatgaccatgttagtctcttcgtgtcatcgggatttccgtctccaaatgacgagggtgcagataaccatgagggtgcagatgaccatctttgtctctgtgtgtcatcggacttgccgtctctggatgacgaggacgtggataaccatgagatgtctccgcgtgtcatcagaattgccgcttgccgtcttcggatgacgagggcgtggataaccatgagatgtctccgtgtgtcatcggacttgccatctctagatgacgaggatgaccatattggtctctgcgtgtcatcggacttgccgtctctggatgacgagggtgcgaataactgtgag

SEQ ID NO: 88675 - DNA, 553 bp, Glycine max
  Peptide Sequence Number=SeqID_205453
atgtcacagtttgaaggttccttatttggtggcattaggaactcggctggtggccatggttcaaatggcgacaatgtgaacaatggtggtgttagtgatggagctccactgccacctaaacaacgtgggagtgagagtggttgcaacttctttcaatggtgtccaaatgacattgatgacatagaccttgttattgagtgggataaggtctatgattatgcatactacaatgacttgagtgattatgataagggtgcacaatatgcttgtccaagtctaggagggtccattgaatatccctaccctcgaaggggaagaactggtagaccacctacaaaatcagattctaatagtgaaagtagattgaattttgtcatgagcttggacatctatgttccaagagatgaacaatttattcacttgaaattgtcatactttcttgctaatgcactgaaatccatagctcaagttgtcaaacctgagctagaatcgctattcgacaacacccctaaagagtttgatagctttgaagatgtgtttaaactctatgaag

SEQ ID NO: 88676 - DNA, 493 bp, Glycine max
  Peptide Sequence Number=SeqID_205454
gggagagttcttgttgttgaaagtcctctctgactgcgctacctccagggattctccaacaaagttgttcgagcttgcgtcacaatctaggtcctcaagaatgggggactttgatcaagcaatttgggggcttttcaagttgcaacctgatcctattgttctgcctagcacttgcgcttacatagacgctattgaggttgaaatcaggagtccactggataaggcagaggaagcctggctgaaggttctagttccctatagtatggatgcttatatcttttggcgaggcgaggctaaactcaaaataggtgacccggcctttaggcagaatcaatctaccatggtggttggtcctacaattgtggatgctctactagtactcctccacggagatcttaatggagaaagtatcgcccttgaggaacggggattgtgggtgacgaagggtcaagaagaaaggtccatgggaaaacgatgttgcgattggtcatga

SEQ ID NO: 88677 - DNA, 198 bp, Glycine max
  Peptide Sequence Number=SeqID_205455
atggtactcgcgtggagcccgcgtccgtatcttcctgaagatccatttcgagacccggatgaggcgcctcctgaggttgaatccgcggttcttggacatggccacgggtctgctatggacatggcaagccgaaactgggtgaggcaaatctccgagagcgttgtggggatgtttgacatggttttcaaacgtggttga

SEQ ID NO: 88678 - DNA, 603 bp, Glycine max
  Peptide Sequence Number=SeqID_205456
atgtcaaacatccccacaacgctctcggagatttgcctcacccagtttcggcttgccatgtccatagcagacccgtggcccttctcaagaacccacccagcaagtcccaagcacatgtccaagaaccgcggattcaacctcaggaggcgcctcatccgggtctcgaaatggatcttcaggaagatacggacgcgggctccacgcgagtaccattgcctgggtgactctcctccgtcacccatggtgaagctccttacgtggggccgcaagctgacagcgggtgccaagtcccgcttgaaagtggcgtccggatccggttatgcccaattaggaaccgatccggacccgagtgtgccgaaggggcacctggccgtgtacgtagggcagaaggacggcgagttgcaccgtgttctggtgccggtaatatacttcaaccaccctttgtttggagaattgctgaagcaggcggaggaggagttcgggttccaccacgaagggggaatcaccatcccgtgccggttcaccgagtttgaacgggtgaagacccgaattgcatccggatctcgcagaggcacccgtccgaaaagattggcctggcgctga

SEQ ID NO: 88679 - DNA, 366 bp, Glycine max
  Peptide Sequence Number=SeqID_205457
atgatggatactaacaatttctcatcctatatgatggatattggcaatttctcatccttcttttggaatagtattaacataaaacttttctatgttaattccaaatcagggtgccttatgtttatcttagtgcaaaaactaagattgctcaaaaaggcccttaaatcttggaataaaaatagtttcagagatgttcactcagaggttaatgaggctaggcagtccttggaatccatccagcaacatatcaggagtcgtatccctttggatgacctcttatctcaagaaaccaaggctcaagttgacctccaacaagctcttagataccatgatgaattttggaaagaaaaattgagggtcaactga

SEQ ID NO: 88680 - DNA, 735 bp, Glycine max
  Peptide Sequence Number=SeqID_205458
atggtggcgatagtggtggtatcagtgatagtgacaatggtggtggggtggaatggtagtggtggtggcaacggtgtggtggttgtggcggtggcactggcagtgatgggggcaacgaatggtggtagtggaatggtggtggtggagatagcaaaggcaaggtgtggtggcggtggaatggtggaagcgacaattgtgaggtgtggtggtggtgacggtggcaatggtggtggtggtgattgtggtcgaatggtggcgagggcaatgacggtggtggtgcttgtagtaagacacaacatggcaagccctgctagccaagttatcatcaatggggagtttgttttggatgtacctgcaaagtgtgaaggatctaaatcccttaatcaatatgcttctgatgcaatcctccctaggaagggaccagtcaccagagccatgagcaagaggctccaagaagattgggcaagagctgttgaagaaggccctaggtctcttaatcaatatgcttctgatgcaatcctccctaggaagggaccagtcaccagagctatgagcaagagtctccaagaggattgggctagagcagctgaagaaggccctagggttctcattaaagcgaggaatatggctcttccaaaggactttttcccaaggcatggcattggaccagtcaccagagccatgagcaagaggctccaagaggattgggctaaagctgctgaagaaggccctagg

SEQ ID NO: 88681 - DNA, 876 bp, Glycine max
  Peptide Sequence Number=SeqID_205459
atgtttgtaaagttcttgatggccctacgggatgattttgaggggcttcatggaataatcttatattgttctcctattcccagtgttgatgttgtggttgttaatgagttgttggtagaagaaatacgacttaagtctaactttggttctgacaaaggaattatctctactcccccatcagtgtttgttgctccttttaacaaaaaaatcccatcttctgttatctcaggtttttctcccttccaaaagttgtatggttgtgttcctgattactcttccttgaaagtatttgggtctactaactttgtgctttgtccacaagtaaaacatagtaaattgtcttatgctatatgtgactttcttggttatggggatggtcaaacgggttattgttgctatgatcctacaaaccaaaaactctatgtttctcgtcatgtggtgtttcatgagcacctaccattttattcactttcttctaatcctcgcaaccctacaaggtctagcctcactcgtattgatcctttttccatggatattagtgatttcaataactctaaggttgagaaatatagggttgatactagtactcctacaggtcaagatgtccccatgacccccagcgaacctcctatggttgttgatcctcctcctcctcattatcctccacatgttcataagaactttctgccttacataagatacctacttgagacttggtctctcttccaccaagaaaaacatggtattgggtctcgatgggtttacaagattaaaaccaaatccgatgggtcagttgagcatttcaaagcacgtctagttgctaaaggattctcgcaacaatatggtatggattatgcacaaactttttctccatag

SEQ ID NO: 88682 - DNA, 981 bp, Glycine max
  Peptide Sequence Number=SeqID_205460
atggcatatccagaggagcacaaggttgcttttggcatgtatactctggtagaaaaagttgagtattggttggagaacacttgccaatgcttggaggctgaagatgttaggaatgagaaggaaatggaatccctggagcttaagcaaggaagtatgattgtagatgaatatgcagccaagttcaaagagctggtgaggtacttccctcattaccaaggaagaaatggtgaaagctcaaagtgtgtgaagtttttgaatggcttgcgacctaaggtgaagcaagctatgaattatcaaggtgttcgtcaattcccactgttgggacgtattcaaagagacttcccctattccaagaaggagcataatggtggaagtttgaatgaccaaactggacgtttgaaggccatgggaagattatttactcttaatggagtggaagcttcgaaatccaaagatctaatccaaggtaaatgtttcacaagtgggaatcccttacttgtgctattcgattctgatgtgatccattcatttacatcttcctcgtgtgtggagaaacttaagttttttgtgtcttcgttcaatggtgatcttgtggtaaagaccccaactagtggttatgtgttaacttctgatgtgtgtttaaattgtcctgtagagatttttggtagaaaactcttgattgatcatattggtttacctctaacccaaattgatgttattctgggtatgggttggttatcttccaaccatgtcttattaaactattttgataaaattgtggtgcttggtgattctgaagtgagtagggataggatgttcatctctgtcaaccaagttgtgacatctttgaaagaatattcccaagtgtacatgatcctgtgtaacctagaattaaagaccaaggtttccatcagtgacctcctagttgttagagagtttcctgaggatatatctgatttactacctaagagagagagatag

SEQ ID NO: 88683 - DNA, 663 bp, Glycine max
  Peptide Sequence Number=SeqID_205461
atggcggaaccatcgaagaagcgcaagggttcttcaagtagaagccaacgacactccgaggctcaggatactccaattccttccaccatttcctcctcctcattgttctcatcgaaagaaaaacgtatacgcaaaggtgtaccatttgaaggtacattggatgatgattggaaatttgatttttttgtgtatgatgcctgccggttggtttgcaccaaccaagcggatatgagcggaaggctgcttgccggttcattggctcttgaaagccgcatccttcactatcttattgttcatatcttactcccaagatcttcaaacctgcacagatctttcttgatcggtgctgctgtggttgcatcctttggttaccgcaaagagcgtgatggatcttgggtaaaaaagggtgctcaaccaaatgatgatgaaggacaattaccagttaaaggggactcttctctccttcagagtattttggacaggtttgatggacttcaaacctatgttggtgaaaggattgtcatcatcaaaaaaggggagattgtggaagcaatgacttccaagattattttgatgatgccaaagaatcaaaagttaagcaagttccaaagaatcaggcttcaagaatcatgtctcaaagaatcaagattcatgaacaattaa

SEQ ID NO: 88684 - DNA, 477 bp, Glycine max
  Peptide Sequence Number=SeqID_205462
gcaaagtttgatatcggagaagctacgaaggtgaagacgaaggttatgtcaacagtagcgacgagatggcggcaatttaagtccacattgactagcaaatttgtgtttgctaagagtgaaggtcaacaaacacaggatgttgtgacaaaatatggactagatcctgaagcatggaaacaatttgaagaaacccggctcacacctaactgggagggtattaggaaacgagcacaatcaattcaaaaacacaatgactgcccccacatactttcacgtgggggatatgatttgcttgagaagaaattgttagaccagaaacgaaaaaggatacaagaggaagcattgttgagtgaaaatgcagcaagccttgatgaacccccatctccaataaaaagacatgttaagtggaaggttgctcggaccagggctgttggcaatatgacatctgagtccgcacaggaaattgcagataaaata

SEQ ID NO: 88685 - DNA, 210 bp, Glycine max
  Peptide Sequence Number=SeqID_205463
atgggtgacctagaggaagtacaggaacagatgaaagctgacatgtcagctttgaaagaacaaatggcttctatgatggaggccatgctgggaatgaaacgactaatagagaggaacgcggccaccgccgtcgccgctagcacggttgccgaggcaaacccggctctcccgattgctatgcaccatcccgttccaaacatggtgggatga

SEQ ID NO: 88686 - DNA, 267 bp, Glycine max
  Peptide Sequence Number=SeqID_205464
atggctaccattgtgttatcaagtagatatgggagcaagttagcatatgacaccggaatttggggtgaatcctacaggcttttcgctgcaaaattcatttcttggttggtgttttttttgacaggctttgtggttgatttagggatggcctttgtggataactgggtggtgggtaaggaggaatatcagtcacagcatgggtttctccctctttctcaccctcttcatttgccccagttttctcattcgtccaagcaggatgactaa

SEQ ID NO: 88687 - DNA, 228 bp, Glycine max
  Peptide Sequence Number=SeqID_205465
atggaactctatatgcagcacatggctgaccagcaggcagccaatcataggggtcagtttagggccacagttgcatggcctgaagataggcccaattttcaggcaagggcaggacccacagggaaccccggagatgaagatggagctcaggaagacgatcacatggttgatgtgatggacttctttgaggaggctcagtcacttggtcgggatcgcttaaaactgtga

SEQ ID NO: 88688 - DNA, 2388 bp, Glycine max
  Peptide Sequence Number=SeqID_205466
atgaaggaatccgacatagtagagtcaagtaggtatgccattagcttggtactgcacctctttttgttgttgttactgttctttcatttaatcacttgtaatccaattaatgtcccaaataaaatcctcctaaactgtggttctaatgaaggatcaacattcaatggagtaaattggataggagatgttggctctagtttcttgcctccggagtatgacaagagttcatcaacactcttgatctcaagcataaagtctcgagcaccaaaagttccatactcaacagcaagaataactcattctcctttgacctattcattcccttcctcccctggccttaaattcattcgtatttactttctctcatcttcatatctgaagaagatgaacctctccaaggcttatttctccgtaaaagctggtccttacactcttgtaaagctcaacttggtgtttttcacgaaggatttcttagtcaatgttggggaagaaaatctaaagattacatttactccatctccttcaatttccaatgcatttgcctttgtaaatggcattgagatattcccagtgccacatagtatatactttcccagttccatggttccttaccttgggcaccaggaacctttttttattaatgatgaatatgctctagagattctttaccgggttagcatcgctagtgaatatagtgcagatgttgaaaatgcttttggaacatggttggatgattctaattacatatctggttcacaatctggaagtgtccttagtataacgcaccgtatcgttagaatgaatttcaccactttgacctcaaaggattacaattattcagcaccagaagagctatatttgactgccaggacaatgggtagcaatggagatgctaacatgaagtacaatttaacatggtctttccctgttgattctggattcaaataccttgtcaggcttcatttctgtgagatctccacagaggtaacgcaagtacatcaaaaggtgttcaaggtgtacataaacaacgaaacagcagaggaaaggatggacgtagttgctttggctggtggaccatttactccgttatccagggactttgttgttatggttccctcagaaagtggaagaaggaaagatttgtggatcgcacttcaccctaacttggagctaaaaccaacatatgctgatgccatgctgaatggcattgagatcatcaagttaagtgatagcaatcttagtcttgcggcaatattcgaactaagaagggaacaaaggaagaagaaagttcctcatgtcattattgtggctggtgctattttaggtaccattttgggactgctcacgtttttcattcttatccgcagagcatggaaaaaactgaagtggggaacttctcatatactctcatcaaagtcgactagaagaagccacaaaaacattcaaccaacagtgacctcaggtcattgtcgtcaattcacattagcagagatcagcatagccaccagcaacttcagtgaagctcttgtcattggggagggaggctttggaaaggtgtacaaaggcatgatgcatgatggagttactcctgtggcagtaaagcgctctaatcctagttctcgccaaggatttaaggagtttcaaaatgagatcaatgttttctcattttgtcacttgaatttagtgtcactgctgggatactgccaagaaggaaatgaactgatacttgtgtatgaatacatggctcatggccctctgtgtgatcatttatataagaaacagaagcagccactgccttggattcagagactaaagatttgtgttggtgccgctcgaggactacattatctccacactggcacgagccaacgggtgattcaccgtgatgtgaagtcagcaaacatattattagatcagaattgggtggccaaggttgcagattttgggttgtgtcgaacagttccctcactttaccactcacatgttagcactgaggttaaaggtactttaggatatttagaccctgagtactataagagaagaaaactgactgaaaaatccgatgtgtattcatttggagtggttttgtttgaagtgttgagtggaagaccagctgtgaatcctgtggcagtggaagaggaaagtgagaaagctgggttggctgtgtgggccatgcactgttgccagtttggaactattgatcaattagttgatccatatttagaagggaatattaagccagaatgcctgagggcgtttgtggatattggcatccagtgcttggctgatagaagtgcagataggccaactatgggagagttgcttaatagtttggagaggatccttttgcaggatagtttagaggaacaagaaattaatgcaacttaa

SEQ ID NO: 88689 - DNA, 2441 bp, Glycine max
  Peptide Sequence Number=SeqID_205467
atgatgcacagaattatgaatactttgacatgctctatgtacatttttatcttgtatctcttacacctacaactccttgtacttgctgataatgccagttatgttccttcggagaacatagttctcaactgcgggtccaacgtatcaaatgttgtagaatatgttgatggcaggaattggagtggtgacattgcatcaccctatatgccctccgatgctgacaccaagttcctggtagccagagcccctaacactcttcaatctattcctgaagttccctacatgactgctaggatctttcagtctcaattcacctacacattcaatgtaaccccaggtcccaaattcattcgccttcacttctacccagcttcctacttgaatctcaacttgtccaatgctttcttatcagtaagtgctgctaacttcactcttctccataacttcagtgtttccctcaacgctgattacttaaatgtaaactatttcatgaaagaattcattgtccatgtaagtgggagagttttagaactcactttcaccccaacatataatgcttctgatgcctatgcatttgtgaatgggattgaagttgtttcaatgccacttggtttatacagtcgtggtgatgatgctcctcttcctttagttggtcactatcccgagcttgtgtacatctataatgattctgccatggaaaacatatgcagattgaaagtaggaggcgagcaaattccacccaaatatgacacaggcatgtttcgcacttgggacactgatggtgcttacattttagggagtgatactggtattgaaccctttaatatgagcatgccagttttgtatgatggtaatgctccaccatatttagccccggcagatgtctaccgcacatctcgttcaatgcgtacttttgaaaaaggccttgtcaatttaaattacaacatgacatggttttttcccgttgattcagctgaagaacaatttgatccaattgcttggagtgggaggccaggagttgctatacaacgagactatgtcgtgatggttcccaaagttaacgaggcaaagcaggatttgtggcttgatctacacccatacaaggattctaaacctatgatgtattataattctttctcgaatggtgtggagatctttaaactgagcaattttgatgataggaatcttgcagggcccaacccttctcaaagcttcgtgtctggatcagatgtaaagcctcaccatgttgcacaatttaagaaaagttcagagaaattaaaattcatcataattggatgtggacttggtacagtggtactaccaattctcctttgcttagttctattcaggttaaaggtgattagacctagaaaggtcatgtcatggtgcggtcttgctgtccacactcctaatcaaattgaaaaggcaaagaagtcatcattttgcagtcatttcccaataagagagataaaagtggcaacaaatgacttcgatgaggctctacttataggcactggtggatttggaagtgtttacaagggtagctttgatggtggggcaacttctgtggccataaaacgtgccaatccaatgtcacaccaaggtgtttcagaattcgagacagagatcctttggctctcacagcttaggcatgccaacctagtctcacttttgggttactgcaatgaagatggggagatgatattggtctatgacttcatggacaatggaactctatatgaacatcttcatttgaggcagagagatcaaccccctttgtcttggattcaacgtcttgagatatgcattggagttgcaaggggtttacactacctacacactggcacaaagcacaggatcatccaccgtgacataaagacaaccaacatactcttagatcataattgggtgccaaaaatttcagattttggtttgtcaaaggcaggttacccttccatactcatcaccaatgtcaagggtagtattggttacctagatcctgagtgttttcaaagccacaagttgactgagaaatctgatctatactcacttggggtggtgttactcgagattctaagcacaaggcctgcggtaattgtaggtgaagatgatgagcatgtaaacttggccgaatgggctatgttgtgctttgagaatggcaacttggagcaaatagttgaccccaacttgaaaggaaacatagttgaagagtgctttgagttatatttaggatttgcaatgaaatgtttggctgaaagaggggtggagaggccatccattggtgaagtgctacagaaccttgttttagcgatgcatcttcagaaaaagggtggtgttgtccccgatggaaatgttcaaagaaatgataattctggtttacagggttattcagatttgacacctggggtcgagttctctgaaatcatgatgcctgttggtcg

SEQ ID NO: 88690 - DNA, 531 bp, Glycine max
  Peptide Sequence Number=SeqID_205468
atggccccgagaaagcttccatcaaaaaggtccaggaaggacgccaccgaagaaggctccagcgctgcccagccagctgacacggattttggtaggcatcgattccgaagcgccgagcatcagcagtgcttcgagaccatcaagggatggtcattccttagagagaggcaggttcagttgagtgacgataagttccttgattttcaagaagagataggccgtaggtgctgggcgccactcgtgacacccgtggctaaattcaacccggagatagtcatggagttttatgccaatgcctggcctaccgaggagggagctcaggatatgcgctcttgggtgaggggccagtggatccctttcgacacagacgcccttagccagttcttaggccacccgctgattttggaagagggtcaacagtgtgaattcttccagaggaggagtcagttctctagttttgacgaggaggccattgctaagcttttatgcatactagggcaggatttcacttggaccgctgcaaggagacgg

SEQ ID NO: 88691 - DNA, 714 bp, Glycine max
  Peptide Sequence Number=SeqID_205469
atgggaaagagaggaacaaggttaccaggcttctgcctcaacagaattaggcctcatgctagggtgcgttcgccaccagcacaagccaacaacaagcatgacaccaccaccacaagtgctaccaaaattgatcagaaaactgaaaattcttgcaatgcatgtgaggagaagttcgatgacggggcaaaacccgggtctgtgattgctaggaagatcatgattgtggttgattctagccttgaggccaagagtgctgtgcaatgggcactcactcacacagttcaggaccatgacactatagttcttcttcatgtcatgaagccttctaataaacaagccactgatgaacaatccagcaaggaaatagctccaagggcttatgaacttgcttcctccttcaagaacatgtgtcatgggaaaaggcctgaggtgcaaattgagattgcagtaatagagggaaaggaaaagggtccaaaaatagtggaggaggcaaaaaaacaaggtgtggcacttctagttttggggcagaagaagaggtccacaacatggcgtcttctgatgatgtgggcagggcatagagtcacaggtggggtggtagagtactgcattcagaatgcacattgcatggcaattgctgtgagaagaaaaagcaagaagagtggagggtacatgattaccactaagcgtcacaaagatttctggctcttggcttaa

SEQ ID NO: 88692 - DNA, 525 bp, Glycine max
  Peptide Sequence Number=SeqID_205470
atgactcttgctactctatttggaaagttacaggaacacgaaatggaattgttgagattaaatcaacatgaagaaaatgacaagaaaaagaagggaattgctcttaaagcctcatcttcaatccaagaagaaagtgataaggaaattgatctaaatgaagatgatgatcttagcctttttgtaaaaaggttcaacaagtttatgaaacctggacatctgagggttgattgtcctatcttcaagaaaaagatggagaaatctgaaaagaaaaaatttagtgaaaagaaaatgaagaaagcgtacatcacatgggaggacaatgatatggaatcttctgaagattcagaaaatgaagagataaacctctgtctaatggctaaaagttatgaaagcaatgaagaggtaacatcttcaaataacttatccgtttcttttgatgaattacaagatgcatttgctaatttgcataaagagtcaatcaaacttgctgattttcatcttctaagaaaacaatttcagatttag

SEQ ID NO: 88693 - DNA, 2304 bp, Glycine max
  Peptide Sequence Number=SeqID_205471
atggcgtatgaggacattccaagaacagcctttccaactcatcatggccactacgagtatagagtcatgcccttcggcctttgcaacgcgcggtcaacattccaagccaccatgaaggcctattatcttaaacactctaagtgtttgttcggccaacgccaacttgattacttgggtcacgtcgtctctgggaatggcgtacaacctaacccctctaagatacaagccatcatcgattggccaacaccacagtctttgaaggatcttcgagcctttcttgaccttacagggttttattggaaatttgttaagggatacgcagcaatcgcaacacctttaacacacttactttgtcaggatgcttttcaatggataccgaaatcccaagatgcgttcgacaagctgaagcatgcaatgaccgccgccccaatgcttgcccttcccgaattttcccttccctttgccctagaaacagatgcctcaggcaccgccatgggtgctgtccttcaacaacaaagtcaccccatcacattctttagcaagccattctgccctcgcctgcaacacgcttctacatacgtgcgagagcttcatgcaatcaatgtcgccgtccgcaagtggcgccagtatctactcggccataagttcaccatttttaccaatcatcgtagtctccacgacctcatgtctcaagtcattcaaaccccggagcagcaattctatctagccaaacttctcggctttgactatgacattcagtataaagctggaacctccaatctaaagcatgcactagtatccagttcagattttcagaaacaaaaggaggctattcaatctcggcttaaggatcacccgtacttcacaattatcaacgatttcatattcttcaaagaagcaatttggatcgactctcgaaaccctttcattccctcattgttgcatgaatatcatgccactcctcttggcggccatttcggggtcaagaagaccttacatcgccttcgctctaactttcagtggactaccatggtcacggacgtcaagtcgttcatctgtcaatgcaacatatgtcagcaggttaaacacattacctgcaaatccacagggttactccaaccaatcctaccacctactggtgtttgggaggatctttctatggatttgatcacgcacctcccaagttctcacgagttcacggttgtcttcgttgtggtggatagattttctaagggtgtacatcttggtgcattacccacccactttacgacattcaaagtggccaacttgttcctggatatcgtgtgtaagctccacggttttccccacagcatcatttccgatcgtgacctagtgtttatcagctccttctggcgtgagttattcaggttaagtgacacgacattacgtatgaccactgcataccatccacaatcaaatggccagacggaagtaatgaatcacaccgttaaacagtaccttcgatctttcatgcacaagcagcccgtggactggtataagttcctcgtattggcagagtgggcgtataatacatcgcaacattccggcaccggcgtcaccccgtatgaggtcacatacggcaagcctccatcctccattcccaattatctcttgggttcttctcgcaacgatgcggttgaaacgatgttacgcacacgagaagacattcacgatacccttcgacgtaagcttctcaaggcccaagataccatgaagtacttcgttgacaaaaagagacgagatgttcaatacgaggttggacaaatggtttatgttaaactccagccccatagtcaactttcactctgtacccaccggccccataaactcacgaagcactatttcggaccatttcgtatagtggaacacattggtagtgttgcatatcgtttacaattaccagaagggtctcgaatccaccttgtgtttcattgttcgctgctacgacctcaccatggccctttcgaactgccaacttccccacttccaccggatacactccataaccatcctatacttgagcctttagccattctagactctcggatggatctttcaactgacccactgactcgattcgttctcgtacaatgggttggcctcgcccttgaagactctacctgggagaaatgggacgaagtttgtaacatccatcaccttgaggacaaggtgaatttcccagggcaggataatgttagcaccaacaaagtagcagaagatgacataggtccactcccacaaaggaatatcacacgtccaaagcatttagaagactacgtgtaa

SEQ ID NO: 88694 - DNA, 846 bp, Glycine max
  Peptide Sequence Number=SeqID_205472
acaatccacttggctaagaaggttgactgttcgaagcttagatcaaccacgactacagttaacgtcaatccagccactgggagaagattaggccctcataaagagaagtttcatcgttatctgggagttgtagcacgagagaaaattcctattgtccactccaattggaatggcaaatttgacatccccgagggtgacaatgcgaaaaaaaaggtgatgtcaacggtccctactcgatggagggaatttaagtcctccctgacaacaaaatatgtttatgctaacagtgagggtcaagcaaaagatgatccttctgttaagtatggtattgatgtagcaacttgggccgaatttgcaaaaagtcaccaaacccctaattcgcaggatatattgaacatgactattggtcgatcggagcatccaggtcatgtccgtgtggcgaggacagctgtgacaatcagccagtactttggtcatgcctcacgtggctccaccagttcctctacatcgatcatggaacaacagttggatgaaatcatggaacctgacacaaatccattaggtaaagatacttctgatctgcatgctgataccatgggcctgtatgtagttgccgagcagtctactcaactagtggcattgggaaaagtgtatgacactttggccaccatacacaatgtcccttatgcagatgatgtggttagggctattggcactttcgtggggtggccaacacatcttgtgaaacccatatttgatgaggattcacaaaagcgtctacgcataccggttaaatctgttgagatggacaatgtagtggctgcaattgatctattgggagagttg

SEQ ID NO: 88695 - DNA, 507 bp, Glycine max
  Peptide Sequence Number=SeqID_205473
atggttcggtgggagccaacaaaggtccacaatgatgatggagatcagtgtgacgctcgtcaaggccttgcgtggggtcgtgtgcagcagtgttttaagttggctgcgcatgtggacagtgtggcagtcttcggcgatggcgacagttactgttcacccctgaaaacaaagaaaaaatccaccgaggatgccttgagatggacgacagtggtcgaaggtaagctccaacgaaaagggatcaaaaagtttgtcaaacaaaggcagtcgcacgatattgttcaacacaaaaaggggctgcacaaaaaagagaaaacaaaggaaaacagggctacaaaggaacaccccccaaaacagcatggatcgtgcccaaactccagggttatggttgcacaaaaggggcgaccactgtgtgcaaagtgcgacctgaatggacgccagatgcaccaccacgtgctgttcaagtgcgctatttggctttctgaaaaagaggcatgtaggagcgcatga

SEQ ID NO: 88696 - DNA, 1070 bp, Glycine max
  Peptide Sequence Number=SeqID_205474
atgaattatctacaacaccaacaattaggggtggccacagatctggatcaatctaataacccagtgaatccaaagtccaaactgatccaaaccggaaaatctgcaaatctgatgagttcggatctgatctcggattttacttttgaaaatccaatccgatccaatccaccggattacttggcagaggaagtacaaagattacgcaaaagaagaaaggctgaaaagcgcttactggatatgcaaagaaggcaaaaagaacgtattgaagaagtgagagagacacagaagaaggatgaagaagttatgaacctgaaggagcaattgcgggttgaaatacagaaggggcttaatcaattggagatgcgatgccatgatatgccctcactgcttcgtggcttaggaatacaagtgggaggaagctttatccctttgccaaatgaggcaacctataaacgtgcgttgcttaagtttcatccagaccgtgcatcaaaaactgacgttcgtgctcaggttgaggctgaggagaagttcaagctcatctctcgtttgaaggaaaagtttgggatgacttcattggttacccttttgttaaaatggtttggcttcaatgttgacggccatgaccgtgacgtctgtaacacttgtgccgacaaaactcagcctgtgccagccatggtggtgatggaggtggtggcttcggtggtggtggtggatgtggtggcgggtgtggcggcagacgtcgtcgtcgatgatggacaaagcaagaggttgagggtcgatgacgcgaaccacgacgagaacggagcaagagggagagagactaagagaagagagatgggtttgttggcgatggagggagatggagctgatgcgcttcttgatgtccacggtggtgatgaaagcggagcgaagactcgggagggagtgggtgtgagagcggatagccagtcaaggatgacgtcaaccttggcggtcatctctagagtcttggtggtcatctccaaagtttgggtagtcatggtggataggttctgggggttctggcaggtagaggcagccatggacgacag

SEQ ID NO: 88697 - DNA, 1317 bp, Glycine max
  Peptide Sequence Number=SeqID_205475
atggatgatgaatatgagaaactcttccggagaatgaaccctcctagggttgtaatcgataatgaagcctgcaagaatgccactgttatacgggttgatagtgcaaacaagcatggaatacttcttgaagttgtacaaatcctcactgatctgaacctcatcataactaaggcttacatatcttcagatggtggatggttcatggatgtttttaatgttactggccaagatggaaacaaggtaactgatgaagccattttggattacattagaaagtctcttggtcccgaatcttgtgttacatctccaatgagatctgttggggttaagcaaacaatggaccacactgcaattgagcttatggggactgataggccagggctgctttcagaagtgagtgctgttctgaccaacctcaagtgcaatatactgaatgcagaggtgtggactcacaacactcgtgctgcggccgtaatgcacgtgaccgacgaagaaaccggttccgccatctctgatcctcagaggctttctataatcaaggagcttctgtgcaatgtgcttggtggtggcaacaagaagaggggggccaagactgttgtcacggatgaagccacacacactgagagaaggcttcaccaaatgatgtttgctgatagggattatgaacgagttaatgatgatgatgacttcgctgagaagcaaaggcctaatgtgaatgttgtgaattggtctgataaagattattctgtggttactattcagtgtaaggataggccaaagcttctctttgacacagtttgtactttgacagacatgcagtatgtggtttttcatgcaaacattgatgctgaggggccagaagcatatcaggaatactacatcaagcatatagatgggtcccctgtgaaatcagatgcagaaagacaaagagtgatacaatgtcttgcagctgcaattgagagaagagtttctgagggtttgaagctagaactctgcaccaccgacagagttggacttctatctgatgtcacacgtatcttcagagagaatagcctcacagttacaagggcagaagtggccacaaaaggaggcaaagctgtgaacactttctatgttcgtggtgcttcaggtttccctgttgattccaagaccatagaatccataaggcaaacaattggcaacacaatccttaaagtaaagggtagccctgaagagatgaaatctgttcctcaggattctcccaccagatcactctttagtggtcttttcaagtccagatcttttgtgaactttggcttggtgaagtcttattcttga

SEQ ID NO: 88698 - DNA, 369 bp, Glycine max
  Peptide Sequence Number=SeqID_205476
atgaggctaagtacaaaaagaggtccagaaacaggaagagctgagaagccaaaaatggactcaggagttgagtttcctggtttccagatttacagtcataaagatgagtttgcattcagagggtccatgatgagtaggctacaaaagagagctccatgtccacttcagataaagcctactactactgtgataatatcctctgcttgcaatggagcacagaactcagtgggggctgcttcaacttcctcttcaacttcatcttcattaaattccttcttcactagtaaagatccgatacctcttctttctcctcttgtggtgcttgaatccacctccatcagagaagaaaacactgcaaaatcacattga

SEQ ID NO: 88699 - DNA, 309 bp, Glycine max
  Peptide Sequence Number=SeqID_205477
atgacaggagtggaggaggtgactgcagatagcaaggcaagcaaagtggtagtgaaaggaaaggcagcagaccccatgaaggtgtgtgagagactacaaaagaaaagtggcaagaaagtagagctcatttcacctttgcctaaacctccagaggagaacaaagaagaagagataaccacaacaagaggagaaaaagggggaggttattcaacatttaacatcggtgcttacatcaccaacgatgtatttgtcactcatatgaagttagttttctctacctttcaaaaacaaggatggaagcagggatga

SEQ ID NO: 88700 - DNA, 225 bp, Glycine max
  Peptide Sequence Number=SeqID_205478
atgcagattgcagagacgggaatgtgtgtatttttcaaaacactgtacgtacaagatgggataaatatcacgatcacctacaatagccggtcatttattgttatcattgaggaaataggaattggctctttcaaaccagctcgtatcactatcgaaagagaggaaaatggtgctgctgcacttgctgctcatggagggtttaactttcccaaatctcttgtctga

SEQ ID NO: 88701 - DNA, 286 bp, Glycine max
  Peptide Sequence Number=SeqID_205479
atgttttgtgaaaaaacgacgtcatctgcgcgttacaaaaataggtttagtggcaccgttgttgaactgcattatccaaagacgggttttataaacaccgtctttgaatctaaaaaaatcgaaaagaaaaatttgactcaaggccagcacctccagaaaaggtggaaagaggttcgatctcgatcgatggaggccgaggcagagaacaacgacttgaagaaggaagaaaacaacaatgataacaacaacaataacaatgaaagtaacagaaaaatcgggaattcaa

SEQ ID NO: 88702 - DNA, 291 bp, Glycine max
  Peptide Sequence Number=SeqID_205480
atggttacaagccattctaacgagccaggaggtgaggtggcttcggagatgaccttcaagaaactgattgtggagtcagcccgcggcttcttaaaaatactaagtggcaagcaaggtaggactatgttcctaggactaggacagcgaatcgagtggctaatcgactcgccaatgatgctcgtaaattgttttctaatgaacttcgcaagtacccttttaccccagaaaattgtaccctattactcttggaggataataatgagcagggtatgtgatccagcttttagatga

SEQ ID NO: 88703 - DNA, 966 bp, Glycine max
  Peptide Sequence Number=SeqID_205481
atgggtcgccttcttctctttctcattattcccagccttgtcgcattgtctttcctctcagaggtacaatcagcgtcgttcaagattgtgaacaagtgccgccacacgatatggccgggattactctccggtgccacctcgccgccgcttcccaccaccggattcaccctcgagagcggcaaatcgaggaccataaaaattccaaagtcttggtcgggtcggatatgggcacggacactctgcggtcaagactctgacggaaagttctcctgcgccaccgccgattgcggctccgggaaagtagagtgcgtcggcggagccaaaccgccggcgacattggcggagttcactctcaacggcgccgacggtttggacttctacgacgtgagtttggtcgacggttacaaccttccgatgctgatcgtcgccaaggacggcatcaggggagggtgcagcgccaccggttgcctcgtcgacctcaacggcgggtgtccagcggagctgagggtggcgcgatcaaacggcagccgcgggagcgtggcgtgccggagcgcgtgcgaggccttcggggatcctcgtttttgctgcagtgaagcgtactcgacgcctgacacgtgtggcccttctccttattcactgttcttcaagcacgcttgtccacgcgcgtatagctacgcgtatgatgacaagaccagcacctacacatgtgccaacgctaactatttgatcattttctgccccttcccctataccagccaaaaactgttgggagcacgaaaagatggggcacagcttcctctggtaaataaaactatgatgtacttatcaaggctacaatcaggtggttcctcaccatcagctcatggtgccaagacccaccgaatcaatgtgcattttgaggttagggaaaggggagagaagaatctgaaattttataatggtctcaaagaagtgggactttcgtag

SEQ ID NO: 88704 - DNA, 186 bp, Glycine max
  Peptide Sequence Number=SeqID_205482
atgggatcccatgtcattaaggagtgttggcctatttcaaagacattgcacgttcacttgcaatatgtgacgatgggaatcccaggcaacatataccatagaggcatactagcattattgaagtacaaaactagcaaatgtgtagggaaatggtttgaagaaacattacaggctcttcgtgcttaa

SEQ ID NO: 88705 - DNA, 270 bp, Glycine max
  Peptide Sequence Number=SeqID_205483
atgggggcaacggcggcaatgatagaagaaggggtggttgtggcgggacgcgtcgtcgatttccctgctggttgcatgagtcatgtgacaagcttgggcaatatggtgttgaagaattaccacatgaattttgagcagacccttgcaaagagaaaagcagggcagcctcagaagcattcagagcagctgcatgttctcagaatcttaccatcagcaggcttcattaagtgcaactttcatatctccatcacccaacaggctttggactag

SEQ ID NO: 88706 - DNA, 153 bp, Glycine max
  Peptide Sequence Number=SeqID_205484
atggggttagtctttgagatcctaaaaatagggacttgggtacctgtcctcgtggagacctatttggttgccgcctctgtcagtgatatactaaatatcccgattcaggtcgtagttcttaagctatttcttcatgattcttatgtcacttaa

SEQ ID NO: 88707 - DNA, 402 bp, Glycine max
  Peptide Sequence Number=SeqID_205485
atggaattctatatccccttgacacatgcaaatctcatttccataatgagactactattgtggtatgcagatgtatgtggatcccaagacgatgttttgttggccttcattctaatgtttcatatctatggacttgtgttctttggattagggttgttgtgtgttggggttacaacaatttcgatgctgaaatatgacttcgaagctaaggttgatgccatccagaagcacaaggtatcaaattacttgtgtcaggtgggtcctgcagaaccggaatatgtggtgctaagtcacccccttatagttgatgcagcagttatactggttgaagatgaagaaactggacagataccaagggcatatgtggtgagagtagatggttttaggctcttagaaaaccaa

SEQ ID NO: 88708 - DNA, 489 bp, Glycine max
  Peptide Sequence Number=SeqID_205486
atggtgataacaagggtagtgcaagaagtggagatacttgagtcatctctacaaccccatgacgacccactttttgggttccctggtgaaagggtaggaataagaatgcatagagttgtagacaaggaaaaagagcagctgcttataattcaagttttagatgcaaatgccaatctatttgcatggtcaatgatcgatatgcctaacatagatcccaattaccattatcatcaggtgtcagtatgccaagacgccaaaccaatagcacaaaagaagagaaaattgggagaagagagacagaaggccattcaagaagaggttacaaaattgcttacaacccagtttggtcaggaagtcgggtatacaacttggttatccaatgttgtgatggttaataaattaaatggtaactggagaatgtgtaccggctacaccgaccttaacaaagcatgcccaaaagatgtttatctcttacccactattgactga

SEQ ID NO: 88709 - DNA, 459 bp, Glycine max
  Peptide Sequence Number=SeqID_205487
atggatcttgcttttggaaagatgcaatctgcccttttcatgtgtgagatgaggtcaaaagataaagaatggaagttgacaattgaaaaggatgtaatgtctatatcaattggatgcttcatgagggatttccaagagaacactgaagcaaaagtgaagagggatgagaatcagtggaaagataccaacaatgaaaaatatccacatgttgtatatgaagagcattgcaaggcttgttctgatgctgagcagtgtgactcaacaaaaggtaacatctacgacaagatagaagatgttttcatgttcattttaaaaaatctgtggtttggttttggaatttcacttcgtgtagtttttgtgtgttccaccacaccctgtgctcttacatggtcgaccttccctttcttttctgcttctatacaatctttggccaatcagttctgtctagaatacagctga

SEQ ID NO: 88710 - DNA, 797 bp, Glycine max
  Peptide Sequence Number=SeqID_205488
atgagtttggttctagaggccagtaacttcggggatttccaggataagtgttcgacttctacaactaggagcgcatggggtagttctatgtggtcgatcatcgatgagatgcttagtgagcctattgagattgagtttgaccaaaggatggatgcccaagcctcatgtagtgataacatggagattgttaagaagccaaactattgttccttgacgaaaaagaaagagtatccacaaattgccctacctgattattcatgggtggatgacggggttgctgtgtctttgttcaagtcctcatccatttttgcagatttaagggacaagactcatcctcagaagaagcttcaacaacaaactcttcaccagatcaacactcatcctcccagatcacttgacgctcttcctctagtgttggggaaagatttttttaatggcttcctagggctgaaagctgaaaagagaaaagagtttgttgcggccttgaaggataaggttgacaagttgaaggaatctttgatgagggccgaggtggaggtggataagggaagaactgagtaccaaaccatgatgagaggtgctcatgaaaggcataagtttgaaattatgggtaatgctgaatttaacatcctcaaagatgtagatgagggtgtcataatgtctactaattatatcccaaaaaagactcctcattccaatcgcccacctactctgtctatcgacaccatgatgattaatgcagcctctgagaaacaagaagataggcagcctaatgatgatgaagtgaatcaccaagg

SEQ ID NO: 88711 - DNA, 234 bp, Glycine max
  Peptide Sequence Number=SeqID_205489
atggtggtggcgatagcaacaacgacgatcatggtggcaaaggaggaggcagttgataaagatggtggtggcagtaacaatcatagtggtgacaacaatgacaacaaaagtcatggccagtgttactggctctaccacccgtggcatcatcgagtcaatgagcggttcgattttaaaacattggtcatggtggcgaaggtggtgatagttgacagcagtggtggtgattgctga

SEQ ID NO: 88712 - DNA, 231 bp, Glycine max
  Peptide Sequence Number=SeqID_205490
atggtgtcacgacaacttgatttagtccacaatggatgtctagaggggatcaccgatcccatgactttgagtggaagatcgagatcttggtgcgatcttacgaggtggattgtgattttaacaaccatgacagtggataccaaggttaggaagaaatcaacaacaaatcttggttcacactatgcagcaacggtgatagttttcaaccttaacctcaatacattgtggtaa

SEQ ID NO: 88713 - DNA, 844 bp, Glycine max
  Peptide Sequence Number=SeqID_205491
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataaatgatgatgccgactacaggatagatgaggtagagggcattggaactatcgacattaaagttgtgggtgagcaaatgctctacaaaatggacaaaccacttgagaagatttgccgctatgccagaagctaccccaaccaaaaaactaaggatgaggatgaactgcttgtgggtgatgctaccgttggtgagcttcttgagccaatggggcatgcgaagatgcgccggcgtgggaagcgcagcgatgctctctttgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaagctgcaccg

SEQ ID NO: 88714 - DNA, 1728 bp, Glycine max
  Peptide Sequence Number=SeqID_205492
atgccaatgccaatgccatctccctcattccaacccctcaaatccccccacaacctctgcatcgtcaagtccctcctctccaacccttccctctccgacgccgtttcctctctcgacctcttgcgcctcaagggcattcgcttaccctctcacgttctcgccaccctcttgcgccactgctccaaaaccaggtcttaccgagagggcaaattcattcacctccacttgaagctcactggtttcaagcgccccccaacgcttctggccaaccacttgatctcaatgtatttcagctgcggcgatttcgctcaggcacgcaaggtgttcgacaaaatggacgacagaaatttgtacacctggaacaatatgatttctgggtatgccaaactgggcttgatgaagcaagctaggagcttcttctaccaaatgcctcacaaggatcatgtatcttggaattcaatggtggctggatatgcacacaagggcagatttgctgaggctttgagattttatggacagttgaggagattgtctgtggggtataatgagtttagctttgctagtgtcttgattgtttctgtaaagttgaaggattttgaactttgtaggcagatccatgggcaggttttggttgttgggtttttgtccaatgtagttatatccagcttaattgttgatgcttatgccaagtgtgggaagatggaaaatgcgaggagattatttgatgacatgcctgtgagggatgttcgtgcgtggacgacattagtttcgggttatgctgtgtggggggacatggaatcgggtgctgagttgtttagtcagatgcctaaaagcgattcctgttcatggacatctttgattagaggttatgcaagaaatggtatgggttatgaagcacttggagtgtttaaacaaatgatcaagcatcaagttagacctgatcaatttacactcagtacttgcctctttgcttgtgccactattgcttcactgaaacatggtagacaaatacatgcttttttggtgctgaataacatcaaaccaaatactattgtcgtttgtgctattgttaacatgtattcgaaatgtggaagcttggaaactgccaggcgagtctttaatttcattggaaataagcaggatgtagtgttgtggaacacgatgatattggcactggctcactatgggtatggtatagaagcaattatgatgctatataatatgctaaaaataggagtgaagccaaataagggcacttttgttggcattctaaatgcttgttgtcattctggtcttgttcaggaagggcttcagttattcaagtccatgactagtgagcatggtgtcgtccctgaccaagaacactatacacgcttagctaatcttttgggtcaagctagatgttttaatgaatcagtgaaggatctgcagatgatggattgtaagccaggtgaccatgtttgtaattcttcgattggtgtatgtagaatgcatggaaatatagatcatggggcagaggtagctgctttccttattaaattgcagccacaatcttctgctgcctacgaattactttcaaggacatatgctgcacttgggaaatgggaattggttcatactttcactgtattagatgcgtcacatcctctgaaggaaacgacatactcagctttgtgggcacttagttaccgcatggaaggccatgccccattaacatgtgaaagttag

SEQ ID NO: 88715 - DNA, 3675 bp, Glycine max
  Peptide Sequence Number=SeqID_205493
atgaatctagggtttttgagtgacatcgaggattttgttatggattatgaggctgataaatttggtgccaatggagagggagagagtaagagagtgggtgaagtggtttctgaggagagtgtagctgggtctgatcaaacgaagggtttagaagcagagtatgtttttcaggaggcaatggagccacgggagcaggtccatgatcagggatccaaactcaattcggaggatgcggtagttgatgaacaagacgatactgaaaccggtagtgcattgacttctgctttggcggatggaaatactccagatgccgtgcaggagcccgattcctttgagcaggctgttggagctgatactgactctgggaagctcggggaagatgaagtaattgctaagcaggacttggaggaaagggatgggcagggaaatgattatgttcctttggatggtgttgactctggagtgcctggagatggagaaatttgtgatgagtcctgtggtgtgggggatgataatctggagagtagtgatgggggtgatggaaaggaagaatctgggttaaattctgacagagagatgttagttctggagaatggttctatggtggatggaaattctggtttggtgagtgagaaggctgaaattgatgattctgaattcatgactcctagagagaatggtggtatagtgttggacaatggaagcacagatgaggtggatggtgttgctactgaggctattatgaaatctgaatccagtgaggtcattccagcccaaggtactgatgctggggatttgaaggagtgtgccccagatcctgaacttggagatgacaagatagaggtaaagttaaatgcttcagttgatccttctggtgagattcaagatgatacatctgaagaagtacacggcaattcagctcacatgactttagaacatcaagatgaagtaactagggatatgaaggatgattctctgggcactaatatgagtcacaaagacagaaatggtgaagaaatgagtactgatggcattcaaaatactgaaataagagattgtgggaatggctatgctgaagctggaagctcaccaccctttttggaaaattcctctaatcagccactgtctgttcaggaggctagtgcagctgaaccaaaggaagctagtaataaggatgatcaatctcagatttctgatgaagagcatagagatcatgacaacacttctgtggttgaggagcctgaaagcatacaggagaagattattcaagtgactggagagcaacatgttcaacctgcagcagatatttcttcttcatctgaaaggtctgccggtactgtgcctactcctgtccgtccttcatctgaaaattctgctgccgctgggcccactcctgttcatccaactggccttggtcgtgcagctccattactggaacctgcatctcgggtagtgcagcaacctcgtgctaatggtactgtatctaatagtcagtcccagcaaatggaggactcctcgagtggggaggctgaggagtatgatgagacacgtgagaaacttcagatgattagggtgaagtttttacggttggctcataggcttgggcaaactccccataatgttgttgtagctcaagttttatatagattaggattggctgagcaactcagaggaaggaatggggggcgtgttggtgcttttagctttgatcgtgcaagtgcaatggctgagcagctcgaagcagcaggtcaggagccacttgatttctcttgtacaataatggtccttggaaagacgggagttggtaaaagtgctaccatcaattctatttttgatgaggttaagtttaataccagtgcttttcatatgggaaccaagaaggttcaggatgttgtgggaacagtgcagggcattaaggtacgggtcattgatacaccgggacttctaccttcctgggctgaccagcgaagcaatgagaagatcctccagtctgttaagcactttattaagaaaactccacctgatattgtgttgtatcttgataggttagacatgcagagcagggattttagtgatatgccactcttgcgcacaattactgaaatttttgggccatccatttggttcaatgccattgtggttctgactcatgctgcatctgctcctcctgaaggccctaatggtactgcttccagttatgacacgttttttactcaacgttctcatgttgtgcagcaagccattcgacaagcagctggtgacatgcgtctcatgaatcctgtatccttggtggagaaccattctgcttgcagaacaaatagggctggtcagagagtattgccaaatggccaggtttggaaacctcatttgttacttctatcttttgcctctaaaattctggctgaagccaatgctcttctcaagttacaagatagtccacctgggaagccatatgtagctcgagcaagagcgcctccattaccttttcttttgtcaacccttctccaatcaagaccgcaattaaagttgccagaggagcagtttggtgatgaggacagtcttgatgatgaccttgatgaatcatcagagtctgatgatgaaaatgaacatgacgacttgccgccatttaaacctttaactaaggcccaggtggaaaagctgtctaaagctcataagaaagcatattttgatgagttggagtatagagagaagcttttgatgaagaagcaattgaaggaagaaaaaaagcgacggaaaatgttgaagaaaatggcagaatcagcaaaagatctaccaagtgaccatagtgaaaatgtggaagaagaaagtggtggtgcagcttctgttcctgttcccatgccagatttggccctgcctgcttcttttgattctgataaccccactcaccggtatcgttatcttgattcgtcatcaaatcagtggcttgtaagacctgttttagaaactcacggatgggatcatgatgtgggttatgaagggttgaatgtagagagattgttcgttctcaaggaaaagatacctttatctttctctggtcaggttactaaagataaaaaggatgctaatgttcagatggaaatatccagttcagttaagcatgggaaagggaaagcaacttcattaggttttgatttgcaaactgtggggaaggacttggcttatacattacgcagtgagacaagatttactaattttagaagaaataatgcaaccgctggtctctcatttactttacttggtgatgccttatcatctggattgaagattgaagacaaattggttgctagtaagcgattcaagctggttgtcagtggtggcgcaatgacagggcgtggcgacattgcttatggtggcagtttggaggcccaactgagagataaggattaccctcttggtcgtttcttaaccacacttggcctttctgttatggattggcatggagatcttgctgttgggtacaatgtgcaatctcagatcccagtaggacgttatacaaaccttgttgcccgggccaatttgaacaatcgaggggccggacaaataagtattcgattaaatagttcagaacagcttcaaattgctttgattggtctcatccctctcctaaagaagctagttggttatcatcaacaattgcagtttggacaatactga

SEQ ID NO: 88716 - DNA, 306 bp, Glycine max
  Peptide Sequence Number=SeqID_205494
atggttaccatttctttgggaactgaaacggatggctccattatttgcccagctcaccacaactcagtagtgggactcaaacccactgttgggctcactagcagggcaggtgtgatacctgtttcacctcgtcaagatacaattgggacagtttcagacgcagttcatgtgcttgatgtcattgttgggttcgacccaagagaccatgaagcgacaaagtcagcggctaagcttatacctcctaatggatataagcagttcctaaaaatagatgggctcaaaggaaagaagttaggaaatttctag

SEQ ID NO: 88717 - DNA, 1156 bp, Glycine max
  Peptide Sequence Number=SeqID_205495
ggtcttgttcttccatcttcagcgaccaacacctgtgcagcaattctctgtcaccaaatttgatctttctttctttctttctttggcgggaatgacagaaacgggggtttctgataatttcaagggcttaatactggcgatgggttctagtgcattcatcggttccagtttcatcttgaagaagaagggtcttaagcgtgctgctgcacgcggtactcgtgcaggagttggtggctatacttatctactagagccgctttggtgggctggcatggtgacaatgattattggggagattgcaaactttgttgcttatatctatgctccggcagttctggttactccccttgaactaacatatccggtatgtgtagctattgctgttttgtctcacttcttgttgaaggaacggcttccgaagatgggggtattggggtgtgtatcctgcattgtgggatcaattgttattgtcatccatgcaccacaagagcaaactccgagttctgtccaagaaatatgggatctggccactcaaccagcatttctgttttatgtgatggcaacagtttcggtagttttggccttgatcgtacactttgaacctcgctatggacagactaatatgctggtctacttgggaatttgttcattagttggctcacttacggttgtgagcataaaggccattggaattgcaataaagcttacacttgatggaataagtcaaatagcttatcctcagacttggttttttcttaccgtggccacaatctgtgtcattacgcagttgaattaccttaatagggctctggatacattcaatgccacaattgtttctcctgtatattatgtaatgttcacaactcttactattattgccagtgcaataatgtttaaggattggtccggtcaggatgtcagcagcatagcctctgagatatgtggattcatcactgttcttacaggaacaatcatattgcacatgactagagaacaggaagaatctaatatgcaaactattaaacctgatgaagtgatggtatcttctctatttgatgcagagacctcaacatggtttataggtgaggatttgatgaagggtgttgagaatgaacacctgatccgtatacatgattcagattacctcgaacgttga

SEQ ID NO: 88718 - DNA, 249 bp, Glycine max
  Peptide Sequence Number=SeqID_205496
atgattgaagaaaacaccagaaacaaggttaatggaggcaatgaaggggagccaaattgtgatttaagtcatgggctgatcagcatgattgagaggatgaagttccatggcctgccatctgaagaccatgatcttcatctgaagaaattcctaagactcacaaatacagtgaggagcctaaccaatgttcttgacaacatcagattggctacatttttgttcacattagcaggacagactgaagattga

SEQ ID NO: 88719 - DNA, 177 bp, Glycine max
  Peptide Sequence Number=SeqID_205497
atgtgggtgcaagccattggtctgtttgctcaagcgacctgtgctcctgagtttggacttccaagaccgttcaatcagagattactcgtcttgcatgttggtggggagagaagtgagttatcaagaataggatgttggataaatggcctcagttaccttaagaaaaaggggggttga

SEQ ID NO: 88720 - DNA, 204 bp, Glycine max
  Peptide Sequence Number=SeqID_205498
atgcgcaacgagtattatgatggaaagcactgcggggacccgacgagtttaatcacaatatatgtgtcgcaacgtgcccttttgcgagtgagcgaacgcgaggctcacaagtgcgctttccaaaggaggaaagatgcgcggagtcgccaccaacgtttattagtagaaaacgtcggaaaaaccgaaggaaaccggtcgaaatga

SEQ ID NO: 88721 - DNA, 267 bp, Glycine max
  Peptide Sequence Number=SeqID_205499
atgaaattggagacacttactgtggttaaagtggttggctttgctgggcttctcgaaactcctccacactcacggacactgtggcagaactctcacgtgaaatcaatcatcccagtgggatccaatgatctctcctttagaatcattgcaatagcaatacccattgaatggaatgatggagtagttgtggcagtagaaacacacatggtgcaagtgcagattccagctgctaaaaccgctatagtcgaagatccatctgtactctga

SEQ ID NO: 88722 - DNA, 204 bp, Glycine max
  Peptide Sequence Number=SeqID_205500
atggatatcccggtttctgattcgaatcattctgctcaacataaatttcaatccctctctgtgacagcagatcatgatcccctgcttggactccccttgacgcctacaaagcggcagacatttcaggattgtgatgatgaactagggatctctcgaatttcacctgcgcagctttcattcaacaaattaaaaaaacatgcctga

SEQ ID NO: 88723 - DNA, 669 bp, Glycine max
  Peptide Sequence Number=SeqID_205501
atggaagaacattcaataagagattgttcaaatgatgggacatttgaggatgttcatatggaggatgatggggttgatttgaggatgatgagtttggttagcaagataaagaacatgtgtcgttggaacgaggatgggctagatgataatgaatgttttgagaataatgttttagatgataatgagttaaaggatgaagaagattgtgacaatgaggttttaaatgatgaaggttaccaattttataagtggtatgcacgggccaatgatttttctattcggaaaagtcatgccctcataaacaagaagggggagacactacaacaaacatttgtttgttcaaaggaaggttatagacaagatagaggattgagtccacaaaataggaagcatgaatataagaatttcactcgatgtggatgtaaggtatatatccgtgttcatgtgaatgaattgactgatcgttgtgttaatcatcacaataacacaatagtgtttgctactgctttggttactaatgagactgaggaaacatatatgtggcttttagaacaatttctgaaagagatgaaagggaaacatcctagttttgttattacggatggtgaccttgcaatgaggaatgctattagaattgtgttccctaggacacatcatcagtttgcttga

SEQ ID NO: 88724 - DNA, 732 bp, Glycine max
  Peptide Sequence Number=SeqID_205502
atggcggcgctacgtggagtggctctaccaacacaaggagttgggactctacctagacgtgagtcgggttgggttcactgcaaggttgtcaatgatatacatgggttttctactaagaagaacaaagagtaccaagagaagctaccccttgttgtgctcagggtagtggaaattatatactctaaagccaactccgagaatgttgttgtaacaggaagaattgttgcatgcaccattcaccagccaggtattgatatatttgaggcattcgatgagctcaccacttccactttactaagagaaagggatagtgggcataatccttcaataggtgtcgaatcgttgtacccatgtagtgctggtctttcattgccatctatgttgcattcatttcctcctattgatgctctgatggtttatgatcacagggctgaaagtggagctagcctaggcatgctttcttcaagcagtctttatggtggatatggatctttttcgatgggggataatggctatggatctatgtcctcgtatgccaccaagctgtacggcggttatggccgcgtgaagccagacatagttgcatatggacgggacataatgggatcaaaaattagtgcgggttgtaaaagtttatcagtaactagtgttgcaagtcctgtagttgttggtgatgcaaagctttctgggcctaacatctatgagaagggtgctggtagagttgatctgtaa

SEQ ID NO: 88725 - DNA, 861 bp, Glycine max
  Peptide Sequence Number=SeqID_205503
atgcatacttgtgttgagggaagtaaacgtcagttaccaccatggatgatgcagaaggtcggtgccactgccacccatgtgagtgactctaacaatgctgttgaaactaattgttatatcaaaaaaggagacatcattaaaactaatgcaaccaagaaagatcacaagagtgaatcttcaaagaggaattcaaacttaagagccaagtgtgaagttatgggaagaaaaaaattagaccaacaagatggaagcagcgacaaggttactcaaaagaagagaaaaggtgataggtctaaggatagagatcagagatcttctataaagaaaagaaaaaaattagaggatcctagccatggttgttatgatgttagtccagttagcgatgatgccatggatctgacacttgaagatttgatggccatagcagaacagtatgtcaaagattatgagaacaaggatcgaaaagaaatatcaagtagacagcatgaatcaaaatggcaatttcaagttacaaatgaaacaggacatactcttgattccccttgtaagaacgaaaactcatccaagtctggaagggaagatttatctcattttacttcaacaactggtgaattaattgctaccagcacctctcaaacaggtgatcctgctcaagacatgctggacctgttcttgggtcccttgctgaggaaaactcttgagaaggagaagagcaaatctattgtaaaaaatgtcgagattacccatgagttcactaggcaaagtcaagataaacttgctggagaagaaatagtccccttgacgaagaaaagaaacacctttaaagacaaggtggcaatgtttcttgaccaagatatgtag

SEQ ID NO: 88726 - DNA, 539 bp, Glycine max
  Peptide Sequence Number=SeqID_205504
ccacagatgtgggaactggaagatgctgcggcgctcgtccgttcccggtgcccctgacggcgttgcatggcttcggaggacttgatctccggcagcggcgagaacagcacggccaccgccagcaccaccagcagtgcggccatcgccaggtacggcgcatggatcttggcggcgaattcgttgagcagcgcgaccttggtgaccgcgtcggcggcctgcacctgcttgtccaggtcgccgatgccatgcagcaccagggtgccgatcagcaccggtgcgagcatgccggcgatcttgttgcagatgcccatcagcgcgatgcggcgtgccgcagtttcaatcgggccgaggatggagatgtagggattgatcgccgtctgcagcagggccagcccactgccgatcacgaacagcccgcccagcgcgccggggtaccagcgctgcgtcgggaattcaccgaagagtgccgcgccgccggccatcaccagcaggctcagggtgaggcccttcttcatgccggtgcggcgcaggatccatga

SEQ ID NO: 88727 - DNA, 909 bp, Glycine max
  Peptide Sequence Number=SeqID_205505
atgcccaccgggaaaatcaaggtacccaccacgcagcacagccacaacaaacaacaccaggttcgcagcttagatcggatcagaagcgttaaaatagcggtcatcccgctatccgctatcccacttttggagtcggccgctccgctccgctacaccggtattgacaactatgttagatctataacgttagatgttagggtttgggaaaataccgttctggagttatttgataacttaggtaatgcttattgtaattctatctgggagggcttgcttctacttgatcatgaaagggtaggtgaaccaaatgtgccaatgaaaccttgctctgcagatgccttccaacacaaggagaagtacatccaagcaaagtatgtagagaaatcactgatcatccgagaagaggatatacccgagaatccttcagtttccataagaatctggcaagcagttcaggctgtaaatgtacgagaagtgtatcgccttattgccacatcaacatcaaatctgataaacacaaaatattatgatgaggctcaccatgctgctgatgccaaagggcatcagcatggtcctgaagcctgtctgaaagttgaagagactactgagacagagaggtgtttccgtggatggtcattattacatctggcatgtcattctggcagtgcactcatggttgagttgttgctccaatttggtgctgatgtaaacatgtgtgactatcatgaaagaactcccttgcaccattgcattacaagtgggaaaaatcaactggcaaagtttctattaagaaggggtgcaaggccgtcagttaaagatgctggaggactcactgtacttgaaagagcaatggagaggggtgcgataactgacgaagagctatttatcttgcttgctgaatgccagtga

SEQ ID NO: 88728 - DNA, 264 bp, Glycine max
  Peptide Sequence Number=SeqID_205506
atgagaggtttttgttttgtaagaaagaaagaaagaatcggagatgaagtggaagatgagaagcgaggaagtcgtggttttgatgagtcgcgaatccaaccgaaaaagagaagcggagcagatgagttgggggaactagttcttgatgagtcgcaaatccaatccaatgatccacccaaaaatagaaaaataatccaatccaatagtgctgatggtggtggtggtggacgagtaaactctcttgtaaactccaacaagatctaa

SEQ ID NO: 88729 - DNA, 666 bp, Glycine max
  Peptide Sequence Number=SeqID_205507
atgaagacaccactgatcattactaaatggcccgtgatatctaagtttatcaccacactgcgtgagctagcttcttttaaagagcttcttcgttcacaggtagagcatgtgttgattgaccggctgacagagtttatgaaccttgatttgcaaggtgcaaaggattctcgtcgtcgttttgacaaagctgtgcattcgtatgatcagtcacgggagaagtttgtctctttgaagaagaatacaccggaagatgttgttgctgaattagaagaggtaaactctctcatgaatattgaagtgaaaaagaagtacgagttcttggagtccattagtgcaataatggatgctcatttgagatattttaagctgggttatgacttgctaagccaaatggagccctatattcaccaggtgttaacatatgcacagcaatcaaaagaacttgctaatattgagcaagataagcttgcaaaacggattcaggaatacagaacacaggcagagctggagaatatacgagcttctagcaattatacagaaactgttccaggttctgatggcacccatgttgtaggtttgaactcttacagaagttttgaagcaggggtgcaacctgcaacaaccaaaggggaggcaagtaattggccttttcttgttaatatttga

SEQ ID NO: 88730 - DNA, 513 bp, Glycine max
  Peptide Sequence Number=SeqID_205508
atgaatgtagcgttagggactgcattggtggatatgtacgcaaaatgtgggtgtgttgatgaagctttaagggtatttgaaaacttgcaagttaagaacgtgtacacttggacagcaataattaatggtttggctgtgcatggggatgcattaggagcattgaatatcttctcttgcatgttaaaaagtggtattcaacccaatgaagttacctttgtcggagttcttgctgcatgttctcatggaggttttgtagaggaagggaaaaggttatttgaatcgatgaaatatgtatatcatttcaagccagagatggaccattatggttgcatggttgatatttggtcgagcgggccaccaaaccatagtggtaattatgcacttatggctaacttgtataaaatgtttcaaaactgggaagtgtctgcccaggtcaggaagctcataaaaggattacgagtggaaaagactccaagatatagtttgacagaggtggatgattttaattcatga

SEQ ID NO: 88731 - DNA, 1629 bp, Glycine max
  Peptide Sequence Number=SeqID_205509
atgccgaagccttgtgacttgaaaatcaacattgatggtcagcagatattccttttgaaagagaaggttatatcaaaatactgtggagggttgaagaagatcttgaatcaccaaaagagaagatgtcatgtgaaggagttggggattagaatcaatgatttccctggaggaccaaaagggtttgagctagtttcaatgttctgttacaacaatggaaaaatccaaatcactgtggctaatgtgtctctcctccactgttgtgctgtttatcttggaatgactgaggaggcattcagcaacaatctcttgcaacaaacagaaacttttcttgagagaatctattactggaaatggaatgacatacttgcaagtctcaagagttgccagctgttttatacatatgcagatggctatggtctcttggagaagatcattagtgccttagcaaagtttgtccagaattcagattcaaacctcctcacttcctcgccttcggcatcatcatggtcatcttcaccagaaagcaactttgccaagagattctctttctcatccaagaaaactaccccagaaaaaatcaagtcatgtttgccgcgcaaggcatggtggtttgatgatttggcaactttaccaccaacgatcattgagaaactcttccagactattggagcatacaaagctgataacaaggatttaatcctcacaagatttctgttgcattatctgaaaatagctactcaaaccaaaatggttaattgcagaaacagcaatgagtatgctgctcttgcagaaacagctgcttatggggtcatatctgttggtaaagagacattttcttgcagaggccttttttgggtactaaggattgtatctaagtttgggttgagtagagactgcagaactgaattggagaaattgattggtggaatgcttgagcaagctacactggatgatcttctagtctctgggcatgacatgggagtttattatgatgttaatttggtgataagattggttagattatttgttgatatcaatggttctgatggactgtctttacagaaagtgaaaagggttggtagattaattgacaagtatttgagagagatatctcctgaccagaacctcaagatctctaaatttcttggagtagcagaatgcttgccagactctgcaagggattgctatgatggggtctacaaggccattgacatctatcttgagtctcatccaactatcacatttgaggaaagatcgagactgtgtagatgtcttaattacagcaaactcagctttgaagcttgtaaagatctggccaaaaaccccagaatacctccaagggttgcaatgcaagctcttatttctcaacagccaaaaaattcaacaagtgaccgtgtaactgagagtccaaggatgaagcattcccaaatagttttgtacaatgaagccagcagagaaagcttctcccaagagaggagagatatgagactaaacatagagaaaatgcaatggggtgtaatagaactggctaaattacgcaagcaaacgaacgttcagatgccacagttgtttacccataatgtcttgcttaatcctgctcgtgcttcatcctcaccaagattttgttga

SEQ ID NO: 88732 - DNA, 177 bp, Glycine max
  Peptide Sequence Number=SeqID_205510
atggacttggagaacgtcttgagaagcaaagggaaggttgcgatcattttgttgaagagtgtggatggtgccgaagagaagcaagagacagataagggtgttgctcatagcatagcaattggtgcaagaagccgcgagaacgagagtggttacttcaccaatttgtgttactgttag

SEQ ID NO: 88733 - DNA, 420 bp, Glycine max
  Peptide Sequence Number=SeqID_205511
atgcccaatagcaaaatgaaagttaaagcaaggggtaatgcggtgaatgagcaattgggagaagcgcgtgacatcgaagcgggaatcaaggtcgagaaagaggaccaagtggtcgaggcctccgtggcgtttggggagaacggaagtgatggcggcgtggatgagaatgtgcgttttggcggagggagagggccccacaagctcgaggacgtttccgacgcgaagaggaaccctgtggagcggcggaggaaacaggaaaggtcgcacgctgctcactctactcagcatctccgcgccactctcgtctccctcaatccacttttcagtcttgttcatttctcttctcacgctcccacacgtcttccccctacactctctactctctcctctttctttttcttactagttactagtgtctag

SEQ ID NO: 88734 - DNA, 507 bp, Glycine max
  Peptide Sequence Number=SeqID_205512
atgactaacggattggataactggaaaaaggaattgaagagtcatgagtggaatgatgggggaataatcatgaaaatggagattttaatgctaccgatggacttcagcggggcgtacaatatccattttcgcggaatcaagaacaaccaatttctacagggcaacaggagaacaccagaaaaatttgttgggaaagaagctgtgattacatctcagtgtctcaatggctgtcagcttcttttatgccttggtgcattttcccatttgaatgtggtaaggccatatagagttatgacagcggttttgccggtagtggtggttggcgatggcggctgctgttccaatggtggtagtgatggtgatggtatcagtgtcagtattggtggtagtaatgtcagtagtagtggtggagccggtggcggtggtgttgatggccatgttggtcgtggtgccaatgtggcatgttcttgtatgctcatgaaagcaaacactgtcacaatcaagtga

SEQ ID NO: 88735 - DNA, 411 bp, Glycine max
  Peptide Sequence Number=SeqID_205513
atggcaagggtcaagaggactatccaaaaggggattaatcttgtgggctacatttataatcactcatttgcattgaatactatgaggaggttcaccaacaaatcggagtttgttagatatggagtgacaagatgcttaattgatgagtggctgaagtcaaaggcagccaaggaaaataaagggaaaagagcaaccgacacggtgcacatgcctagtttttgggctcaaaatagcagtctttctgctattgactactatgctaacaatcatttggtacaatcagtagaatctgaagacatacataatataacagcagctctcttcacagagttatacattcagcaacacttgcacagaccaatagcagcagaaaaagaacagagcaatgaattagacaacctcaaggcatag

SEQ ID NO: 88736 - DNA, 866 bp, Glycine max
  Peptide Sequence Number=SeqID_205514
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaacaacaacaaaccaattggcacattggggagctccgcggcttttctccccaccaaaagaattcaggggcgtctgcccgcagggccctcggcggttttcaggagctactccaggcccctcggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 88737 - DNA, 798 bp, Glycine max
  Peptide Sequence Number=SeqID_205515
gattcctgaatgttcccttgatagggacgaggggttgcatcagctataatcccgttctttctataagacaacttggctaccctatgagaggagcaccaatagaggaagaaatcgcgcctgtcatttcacgaggtttcaatgagaccaacgtggagacacttcggaaggacaaagagctcagaggcagtaacaatgggcccatcggtggctactgtaagtggttgagaaccgctaaaggggaggaagttgaggcaccggaggaagacgaagaggagaatgccgaactaagaaatgtaaatatagctaccaccaaggccttggagcaagagacagaaagggctcgtagggaagagcacggccggaacaagttccgaggggctctgtggggcagcaacaacgagcttaagcttcggagggaggaaagggaccaatcccgggtagacagtttgatcttgaaggatgagttgaaggcttgcttgaggtccaagagaaacttgtctcagcggttatgcgagacagagaccaacatgctagccatcatcagcaagtaccaagaagaattaaatctagccacggcccacgagcaccaagtggtggacgagtatgcccaagtgtacatagaaaaggaggctagaggaagggtgatcgacgcgttacatcaagaggcaacaatgtggatggaccgatttgctcttaccttgaaggggagtcaagaacttccccgattgctagccaaggccaaagcattggtggacatctactccgcccccgaggagatccacggacttctcagctatt

SEQ ID NO: 88738 - DNA, 381 bp, Glycine max
  Peptide Sequence Number=SeqID_205516
atgaagatcaagaaaagaacaaaagaaaggaaagaaggattcccgatcgaagatcgaaaggaagtgaaaaggggaaaagaagcaactctcgatcaacgaaaggaagagaatagaaagtctccaaagccagattgccactcagaatcattcttgactggcaatattccaccccacatgaacaaagaggaaaaaaccgaaacacccagcttcctctccaaaaacgctgacctcgagaaaatcctattgctagaagttgacatcctacccttcattctcggttacaaggaagattacccttggcgcaagtatattgtttctctaagacgtggtgctctcgtgaatgatttatttttctttgcaaaaagcatgttatccttttaa

SEQ ID NO: 88739 - DNA, 201 bp, Glycine max
  Peptide Sequence Number=SeqID_205517
atgactctatcgctagagtatctcccatgtgatttaatgataaaatttgcacaatatcagggagcagttgcgctcagctcaccatttgggctaagtgcgcatccaacgctaggcatagcttcagcgcgcttagcacgacagaagaatctggcagagcataaatatcaaggccgcatgctaagcgcgagatccgctcgctaa

SEQ ID NO: 88740 - DNA, 234 bp, Glycine max
  Peptide Sequence Number=SeqID_205518
atgaacactcatcctcctattgagatacctgtggctaagcaaggcagaatcgctaagcccagatggcctccaggaaacataagagcattagggcaaggccaactgctcaatatgatactagacgattccattcacttgatgcttggaaccgttatacatataatgtcttggggaggaatattttgccagaaaggaaggttgaggtataccacacagagttcggcgacttcatga

SEQ ID NO: 88741 - DNA, 279 bp, Glycine max
  Peptide Sequence Number=SeqID_205519
atggcggtttccaaactcagaaatgatgcaaagggttcctctcggcgtggggtctcaacggagaacaacggcggtttgtggtggctactggtggttgtaggtgatggagaaaaagcttggaacattagaaatggttttggaagaaagaaaggagaagaaatggcatttttcctaaactacttggactacaaggctcaaaaagcacaagtgagcaattctctcgggaacagaaacctcgcgcaccctccaaatatcttctcaaagatcccaacggtctga

SEQ ID NO: 88742 - DNA, 810 bp, Glycine max
  Peptide Sequence Number=SeqID_205520
atggagaagtttatccatacaagggctttggaggattgggattcttctcccccctgcatggctgatatttttaagtgcatgggaaaggcgtctcgatctgccttgagtgccattgcgaggcatttgcgtcttagaagcgattttatgatcatgtgtgctcatgagaaaacagttgctttgtgcagtgtttttaaccatttgcttgatgatgctccattgcctgctaatgaggtgtcttcatcagttcttgttgtgacctactcacatgcttctttgcaaaatggaagaggtgccattggaggtggtaagcctcccatgaatggtgaagttgagaagggattgttgacattgatatcttcagacactcctggtcttcaggtatgtgaccccagtggtcgctggtatctggcagacagtgggtctgtgcctggagatcttttactcataacaggcaaggcacttacccatgctactgctggcctatgtcctgctgcatcatatagagcttctcctgattattttctgagtcctaatggtggaggaaggtactttcttgagctttgtgactgtaggacttctcttgcatatagactcatgccacagggcaatgctatattagattgttccccaattgcagcagctggccatgttattccccaaagttatgttcgaatatctgtaagccaatttatggatgaccttgctgccgaagaactgataggcagcagatgtgataatgctgattcttctacactgatcatgaccagacaaacaaaagaagatcctaaccatgagaaatggaagtgctaa

SEQ ID NO: 88743 - DNA, 105 bp, Glycine max
  Peptide Sequence Number=SeqID_205521
atgggtttctttgatcatcatctagatatgtcaaaagcatatggtagagaccgtagagtgagaatggaagtccttgcactcagtctaggccccacagaggattga

SEQ ID NO: 88744 - DNA, 1068 bp, Glycine max
  Peptide Sequence Number=SeqID_205522
atggcaagccatcctggaaatcatgctccttcaaatgggtctgtctatgtatgcaacttgccctatgggactgacgataacatgctggctgaatatttcggtaccatcggattaataaagaaagataaacgtacagggagaccaaaaatatggttatatcgagacaaagaaactaatgaaccaaaaggagatgctactgtaacatatgaggatccgcatgctgctgtagctgctgttgaatggtttaacaacaaagattttcatggcaatacaattggagtttttatagcagagtcaaaaaacaaggatgaccaagcatataatgcagcagttgaaccgggagttactgataatgttggtggactagaggaaactaccaaggatgttaatggtggtagtggaagaggtagaggtcaaaatgatacttcaggcaaagcatggcaacaagatggtgattggttgtgtctgaatacaagttgctccaatgtgaactttgcttttcgtggtgcttgtaatcgctgtggaactgctcgtcctgctggtgcttctggaatttcaggggctggtggccgtggcaagggacgtgctgcacaagaatcagggggtattggccggccagctggtggaggactctttggtcccaatgattggccttgtccaatgtgtgggaatatcaattgggcaaagcggactaaatgcaatatctgcaacacaaataagcctgggcataatgagggtggtgtaagaggaggacgaggtggaggttacaaagagcttgatgaagaggaaatagaagaaactagacgtcgtaggagggaagctgaagatgatggggagttgtatgatgaatttggaaatctaaagaaaaaattccgtgccaaaacacagcaagctgaagctgcacgtgggcttcctggttcagggcgtgctggttgggaggttgaggaactaggtatggctgcatatctagaattgtttatactacatgatcacctccgcactttccccacatgttccataacactagtacattttgggatagagttgcatgttattctagaatcatga

SEQ ID NO: 88745 - DNA, 306 bp, Glycine max
  Peptide Sequence Number=SeqID_205523
atgtggaggattctaaagatttcgctccaattaaagtgttcatctccatgcggaggtccagcggcaagcaacggcggcttgtggcggccaccggtggttgtgggtggtggaggaggaggtgttaggatctcgtttagcgagatgagcttgctaaaaaaaattcaacttttggtgttgagcaaattacctccttgggttggaattgcgtctagcacactggtctcgctaagcgaatttccttctcaggttgaaattgcacttagcacactgatgtcgctaagcgagatgtcccaagatgtcatttga

SEQ ID NO: 88746 - DNA, 852 bp, Glycine max
  Peptide Sequence Number=SeqID_205524
atggcttctgcgccatcgagaaccctaacggactttttccaacccgcttcgaagcgcttgaagcccactctccccgcatcatgcaaatccgacgacgccaatgcttccacgctctccgtcgatcagaagttgcgcatggaatacaacaagctcctcgccaagtccaagaggaatctcaaactctgcgtcgagagggtctccaaaagcaaagaatcaggtttaggtggcgtgaagctggaagagctgctggtggaagaaacgtggttggaagctctacctggtgaactccaaaaaccctatgccctcactctctccaaattcgttgaaagtgagatttcgggcggagacggcgtcattttccctccgacgcacttgattttcaacgctcttaactccacgccttttcatacagtgaaagctgttatccttggccagtgtcacaagttaaggacactagttaagaaagtaaaaggtaaagtttttattgggatgcagcaaaaggacccttatcatggtcctggtcaagcaatggggctttcattctcggttcccgagggaatcaaagtcccttccagtttggtaaatatatttaaggaacttcaccaagaccttggctgctccattccaactcatggaaatcttcaaaaatgggctgtgcagggtgttctcttgctgaatgctgttctcacagtcaggaagcatcaagcaaattctcatgccaaaaaaggctgggaacaatttactgatgttgttatcaagaccatctcacagaagaaggaaggagttgtgtttctgttgtggggaaactctgctcgggaaaaatctaggtacttccattgtgtgacaatatag

SEQ ID NO: 88747 - DNA, 258 bp, Glycine max
  Peptide Sequence Number=SeqID_205525
atgtcaacccgttggagcatccctaaagcaaagacaatcatagaagggcttgtcgtttcgaggctacttggtacatttacaaggacagttgaggggagagctagaaaaagtattggtttaggggggatctacattggtattgaaggtctacttgtaaatggtgacgtttttggagacaaagattctatatatttcccctacactacgattattaggagaaagaaagaaacaatggagtctggatcaatgatcaattaa

SEQ ID NO: 88748 - DNA, 195 bp, Glycine max
  Peptide Sequence Number=SeqID_205526
atgaaaaaattgggaagttgcaatatgcttatagaatgtcaataccagatgagtggtgaacttgagaagttgaacgtcgaaagctatcttgtgtttgagagggaatattttctacaggatgggagaggaatggttccctttgtctttgagaatgaggcaatgtctaacggaagtgccaatcggtcttgccgttaa

SEQ ID NO: 88749 - DNA, 2520 bp, Glycine max
  Peptide Sequence Number=SeqID_205527
aacgctcacgagaggcacgccgagatgaagggtcaggaggagacaaacgacaacgtcaccatcccgacggaaacgacggccatccacagaccgccgggaatcgcaggccaaaaccaggcgacaaacgccaaccaaaccagtccgtcggaaatggcggaaaaccaccgagcgtcgggagacgaagcccacaaccaggcgccgagatctgctggacacgacgaccacctcgacccagcggacaaacacgctgaccgctgggtttgcgtgccagaccaaggaaaagataagcagactttggggacttgtacctcggatggaaggagagagaatatgcatgagaaaggaaagtgggaggcagagaggactgttggggtggtggggaagggtgctttatgttcagaaaagccacgtgaccaagaagctgaagatactagcagcccatcatcaagcaaggtgggccaaaataactattacagactgttttacagaaaacgtaggtgcagaaagcaaaatgctacctttccggaagatgctatgggccaacaagtaacaccaacaccacccaatatgcaggggagtgaacataggccacaaagggtccgtgaacaaaaggaccattacctctcatcacaacaatcagcacttgaggaagcacttctggtcaacaacaagatgcaagaggcagagaaattatgggagatgacaaaagaattaggggttacaggagggaacggaggggggtcaagtggccagcagttagaaggagattctgatgttaggtgggaagctcagccttcagttaattcctcaggtggtattctgtgtatttggagtgataaatcattcaagttggaaaggaagattactggagctggctttattatgttggtggggaagtggcagcaggaggcacaaacacttaacattatcaacatttattcactgtgtgatattcaaagcaaaagagtactatgggataatatcaagcaattgaaaagtcagaatattggggaattgtggtgcatattgggggacttcaataacattatggccccgcagagagagtcagagcttataacagggggatggatatttggaggtggaagaagcgccatgggttgggagaaagttcacatgggtcaggccaaatggaacagccaggagaagtataagaggattgaggaagaattaaacaagatggaagaggaatcagatgacagacaactaactgatcaacaggtgcttgctagaaagaaattgcagcaagacttatgggaagcagcccaggctcatgagtcactgctgagacagaaggcgagagctaagtggattaaagaaggggattgtaattctagattttttcatcttatgatcaatgcaagtcgcagaaataattgcctgaaaggagtgctgattgatgggtcatggatcgaagagccggcaccagttaaggaggaagtcaggaggttctttttgcagcatttccaagaatctgattatgacaaacctagattggatggtatacgatttcagaccattggaagccatcataaggacatgttggtggagcattttcaagagaaggaggttaaaagggcagtgtggaattgtgggagtgataaaagcccgggacttgatggacttaatttcaaatttatcaagcaattcaagcatgtgattaaacctgatttttttcggtttctggatgaattttatgccaacggaatctttccaaagggatccaatgcatctttcatagctttaatccctaaactagtggatccgcaagtgttgaatgacttcaaacctatatcattgataggatgcacatacaagatagtggctaaaatattggccaatagattgaagaaggtcatgccttttattattcatgagaggcaatcagcatttatagaaggaagacatatgctacacagcgtggtgactacaaatgaggtagttgaagaggccaaaagatgccaaaagccttgcattgtcttcaaggttgattatgaaaaggcatatgattttgtgtcttgggagtttctcacttatatgatggctgagttcctacctcagaaaggactaaggcaaggagaccctctatcacctcttctttataacattgtggcagaggcacttaatggcctcatgtcacaagctttagagaagaggatttataagggatttctagttggcataaatagggtggaagttagtatccatgcggacgacacgatcttctttggggaggcaacaatggaaaatgttagagcaattaaagcaatattgagggcttttgagcttgtatcgggcctcaaaattaattttgctacaagtagttttggtgctttcggggttccggatcagtggaaaatcgttgcagccaattacctcaattgtagcttgatgtcctttcctttcacatacctcggcgttcccattggagcaaatccaagaagaagtcagacttgggaccctattattagcaaggtacctaaaaaagtggtggataagctg

SEQ ID NO: 88750 - DNA, 207 bp, Glycine max
  Peptide Sequence Number=SeqID_205528
atgtgcacctcagtgacacaacaaataagagacacctccacggaggaagcacaacccctgatgccactgagcgcaaggcctgacggcatgaggccgccacagggtgtcgaccatggcgatggcggcacgacgcgtcctcgccggagttggccaaaagaagaaaacatggtgagaaggaggaagatgacaatggagacatttgaataa

SEQ ID NO: 88751 - DNA, 378 bp, Glycine max
  Peptide Sequence Number=SeqID_205529
atggacaagagtcctcatcgttttaacaggtggcaaggtggagtaaatcaatacgcgtgtctcaagacattcagggagtcattcaaacttccgaaaaaacgctcagagcttcagaattcaatttcgatcgtctctgtcgcaacctacccttcggcgggagggcgacgcgtgactcgcgggatgcgtgttccgcgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 88752 - DNA, 681 bp, Glycine max
  Peptide Sequence Number=SeqID_205530
atgtattttattgctccgcatcaggtccttcaatttgatgatatactgcttaataaagtaagagggtttgtgctggtggtacatcctgattttctgcatggttatggacttgcatccagcataagagaatatggatatttttcctatacagtcaatgaagctttacatctttctgaaaaggaagagaaaaccatttttgatatcatagccaatgttgaacaggaaattgatatcaacatggattcctttacacaagatctacttgtctctaaccttgaccttctgttaaaatattgtgaccgttattacaaccgtcaatttttgacccgaaagaaagtgaacagtgaccttctttccaagctggagctattattggatgattacttcaaaaatgataagttaaccatcaatggtataccttccgttcattccattgctgatcaactgaacctgagtgcaaattatctgagcgatatgttaagagtgcaaacagggcaaaccacccagcagcatatacagaacagtttgatcgaaaaagcaaagggattactgtctactacctcaatgtcggtctctgaaattgcctatcagcttggatttgaacatccgcaatcctttcaccgtctttttaaaagccgaacatcattgtctccactggaattcagatcatcgttaaattaa

SEQ ID NO: 88753 - DNA, 921 bp, Glycine max
  Peptide Sequence Number=SeqID_205531
atggcgaccttcctgctggtactggtgctgtattgcgtgctgtcgattgtcggcatggcgattatggaagaggaatggagcgccgacgcgctggtctttatctgcgcggcagccattgcctgcctgttctcatctattgacctggtcaatatttacaacgaagcgaggctcaacgcgcgtctcaatgtgattgccaacgtcatcggtctggcgatcagcctgacggtgcgctttctgatctcctattaccagctggaaccggcctggctggcgattccgattgtgctcgccacctttattcctttcaccatcaagttaacgctgtttctgctgtatgagcggcgtgcaccgcttccggcgctgcgccacgtgaaaaagtattcgcgctacatgctggtgtccggcatgtcgctgatcttctctgcgattgccgttgcgctgtatacccgcgtgaatcaaatcagcgtctcttattttctcggcgtgaaagaggcgggcattttttccgtggcgctgacgttgtcgaccgcctgggtatttttacccagcgcgctgctggcgtcgttttatccggcgttttttgccgagcggaatgaccagcaggcgatcgtcaaagcgcagaaactgcatctgctggtgattggcgtttccgctgcggtaattatggcgatctggctgctgtcgggctggtttattcgtgacttctacggtgagcaatatcttgatgcggtcgcgccaacgttattactcagcctcggtgcgatgtgcgcggtgctcagcagcgttatggatcgcttcatcattaaatataacggctatcgctatctggtgaagaaaaccttcgcggtattagtgatttgtctgctgtcgtcgctgctgctggtgccgcatttcggtttaaccggtgccgccatgagcgtg

SEQ ID NO: 88754 - DNA, 312 bp, Glycine max
  Peptide Sequence Number=SeqID_205532
atggctaagcgagcattcgctaagcgcgacactcagtggctaagcgcgaggaagaatccagaagaagatgagctgttaggttccctgagcgtaccgctccaggtcatcaagcgcaccgcttcagctcatccgctaagcgagagaagcgcgctaagccaaaatccacttatgtgcgctaagggattcagatttgcgccaagcgcgcgagcaagaagttcaagagagagaaaggtccaagttccagagagttttgagaggttttgctatgtgaagatctgcagagacgagagttcgaagcggaagccgttctga

SEQ ID NO: 88755 - DNA, 603 bp, Glycine max
  Peptide Sequence Number=SeqID_205533
atggtgcttccacgccctcgtattggcacacgcgagatgccacaaagtaactggaattttctcgatcaggagctgctctcctggtgtatgacggaagacaactttcatcaggtgatcgatcactttctggaaatgcgtagcagccttgaaccccaggcctgtctgcttgccgccacgctcggaacagcagagcagaaagcgcaacttaacgcgttgatggaagaaatggtatacctgaaaaaacacttcaaccgggaacgctgggttgaggtcgatatggcctggcatgaacatatctatatgatgagcgccaatcccttcctgacctcctttgcctcgttattccattcggtgtaccacacctacttttcctctattacacaagacgaagtggtaaagctggatctgcatcaggcgatagtggatgccattcaggagagcgacgggcagcgagccctgagtgcgtgccaggcattgctggccgcgccaacccaccagcaggcactggatgccaccatcctcaacacagcgcttcccgctattgcacaaagcctcaccgctccccactggcaatgcagtccgccatcatcagctataccctga

SEQ ID NO: 88756 - DNA, 837 bp, Glycine max
  Peptide Sequence Number=SeqID_205534
ccctctcaacgagtcaatctcttgctttctcataagggtgaacctttgggtactagtaccctcaccttcggaggactacacgtcctcccctccagaggactgcacgtcctcaccttcagagagctgcacgccctcgccttcagagggctacatgtccttgccttcagagggctgcacgtcctcaccttaggtactcgtaccctcaccttcagaggactacacgttctcgccatcagagggttgcacgccctcgccttcagagggctacatatcctcgccttcagaggactacacgtcctccactttagaggactagatgtcctcactttcaatggactacacattctcgccatcagagggctgtacgccctcaccttcagaggactacacatcctcgccattagagggttgcacaccctcaccttcagaggaccacacgtcctcgccatcagagggcggcatgcactcacctttagaggactacatgtcgtcgccatcagagggttgggtaccctcaccttcaaagtgctacacgccctagcattcagaggactacatgtcctcgcctttagaggactacacgtcctccacttcagaggactagatgtcctcgcctttagaggacaatacgtcctcgccatcagagggctgtacgccctcaccctcagaggactacacgtcctcgccattagagggctgcacgctctcaccttcagaggactacatgtcctcaccatcagtgggctacacgccctcaccttcagaggactacacatcctcgccatcagagggctacacgtcctcaccttcagaggactacacgtcctcgccatctga

SEQ ID NO: 88757 - DNA, 657 bp, Glycine max
  Peptide Sequence Number=SeqID_205535
atggtagctcaacatccgcaatatggtcagatactggaaaattcaacattatggaaggttggttgtggggacaagtttaaattttgggaggacaactggatgggtggagtgggtaagttaatagagaagtatcttaggctgtatactatttcttcccagcaaaatcagttcatacatcacatgggagctttcaaagaatcagggtgggaatgggagttcagatggaggagaccattgtttgataatgaattagatatggcgatctcatttctaaaagatgtagagagctatagaattcagctgcaacatacagatcagtgggtgtggttgacagattcgaatggtcaatactcagttagaagtgcctataatgtgatgagggagaacgtagtagaggagatacaggatggagtttttgaggagttatggaagcttaaggtgccatcaaaagttgctacattcgcatggaggttactcaaagacaggttaccaaccaaggagagtgcaggtcacctatttttccattgtgacaagatactcccagtctggtgggaatcgatgtcttggacatctggagaaggatttcgactttcactacaatcaattgtctaccaatatcagggatgggtttctaagaagctaaggatcacaaaatag

SEQ ID NO: 88758 - DNA, 216 bp, Glycine max
  Peptide Sequence Number=SeqID_205536
atgacaacgttagactctgagtgtcaacaggctcgttggcctctggttgacaaatggttcgggaccataaggttcccccgcatgtcatcggactcgccgtctctggatgacaaaggtcagtatgacagagattgtggggcggctgacaaaagcgaggctcttgctcctacgtatcctcaatttgtgatgaggaactcagacctacgtagttcttga

SEQ ID NO: 88759 - DNA, 1164 bp, Glycine max
  Peptide Sequence Number=SeqID_205537
atggtcagcaattccagttctctcgatgtaagttccatctatcttcttaatgttattagttcttggcatttgatgcttgtgaagctgtttttgactaaacttctaactgaagatttacctaaactatttgtacgcccaaagaaaatagttttagatttccaaaagggaaaagctgttggtccagttgctggtggtgttaaatctggagaaatgcaagaaggaaacaaggattctgttggtgaactatctgttactctggtggatgctcgaaagctttcttatattttttatggcaagacggatccttatgttattcttagccttggaaatcaagttatacgcagcaaaaagaacagtcaaactactgtaattggaccccctggaatgccaatttggaatcaggattttcacatgcttgtttccaaccctagaaagcagaagttattcatccaagtaaaggatgctctaggatttgcagatttgactattggtacaggagagtacgtggtagattccctatattttatgccacttggactgacttctccaatggcagcaatgagaactattgttgtatggttcccttctggtgacccctattcacaagtcacgacacagaaaaatatagttgatttaggatctcttaaagacactgttccaacagacagaattgtggttttacaaggaggttggggattcttaggaaagcgctcttctggggagatattacttcggctaacatataaagcatacgtggaggatgaggaagatgataaaactgaggtggatgccatttatactgacatttctgatgacgagttgtctgattcagaagcaaatggtactaatgggaaggatgaaagagattctgtgtacgaaacagataaggagtcgtttatggatgttttggcagcattaattgttagcgaagaatttcaggggatagtagcatctgaaacagggtttagcaaagttttggataatggctcaaatgttggatctagagtgtcaaattctcaagttcccaatgttgaaccaattccctctagttctgataattccgaaggctctggagggtcagctttactttggcttgctgtgattactagcatatcactactaattgctctcaatgttgggggatccagtctcttcaatccgtaa

SEQ ID NO: 88760 - DNA, 1218 bp, Glycine max
  Peptide Sequence Number=SeqID_205538
atggttactctgaatgctcctgctattaatactggtggtcgtgatgctgcagctcttaaaccctctactctacagaactcatcatcagcgttggatttgatcaagaagaaattgcaggactcaggaacacctattactccctcttctattcatgcgccatcagtacaaataggacctgaatcaaatggttcaaaaacagttgattctacagctaagggcgtgcaagtagataataacaaagataaacaaaaagatactaatggtgatgccgatgtctctgatacatcctcagattctgaagatgaagataacgggccttcaaaggaggagtgcatcattcaatttaaggagatgcttaaggagcgaggagtggcaccattctcaaagtgggagaaagaattgccaaagatagtatttgatccacgctttaaggccatcccaagttattctgctaggagatccttgtttgagcattatgttaaaactcgtgcagaagaagaacgcaaagaaaaacgtgctgcacagaaggctgcaattgaaggatttaagcggttactggatgaagcctcagaggatattaattacaatactgattttcaaactttccggaagaaatggggaaacgatccacggtttgaggcattggaccgcaaggaacaagagcacctattgaatgaaagagtgcttcctttgaagaaagctgctgaagaaaaggctcaagcaatgcgtgcagctgctgctgccagttttaagtcaatgcttaaagagcgaggagatatgtcttttaactcccgttgggccagggttaaagaaagcttaagggatgacccaagatataaatctgtgaggcatgaggatagggaagttttgttcaatgagtatatatctgaactgaaagctgctgaacatgcagcagaaagagagaccaaagctaaaagggaggagcaggacaagctcagggaaagagaacgggagctgcgcaaaagaaaggaaagagaagaacaggaaatggaaagggtgcgactaaaaattcggagaaaggaggcagttacttcttttcaagctttacttgtggagacaatcaaagaccctctggcatcatggacggaatctaagcctaaattagaaaaggatcctcaaagacgtgcaactaatcctgatcttgatccatcggacacggaaaagctctttcgggaacatgtcaagatgcttcaggaa

SEQ ID NO: 88761 - DNA, 921 bp, Glycine max
  Peptide Sequence Number=SeqID_205539
atgcccggagctgagactcacgatgtggagtggccggcgaagcgcgtgagggacactttcttcagcttcttccaggacaaaaatcacgtcaactggaagtctagccctgtcgtccccttcaatgaccccactcttctcttcgtcaacgctggtatgaaccagttcaagccaatatttttgggaactgcggatcctaacactggcttgagcaagctctctcgtgctttcaacacacagaagtgcattcgagctggtagtaaacacaatgatcttgatgatgtggggaaggatacttaccatcacaccttctttgagatgttgggcaattggtcatttggggattactttaaagtagaagccatcagctgggcgtgggatcttctaaccaaagtttacaaattaccatcagattgcatttatgccacatattttggtggtgatgataagtctggtcttgcccctgatcttgaggctagggatatatggctcaagtttttacctccgggacgtgtacttccttttggctgtaaagacaatttctgggagatgggtgatactggcccttgcggaccttgcactgaaatacattttgacagaattggcaaccgtgatgctgcatcattggttaataacgatgatcctacctgcgtagagatatggaaccttgtctttattcagttcaatagggaggctgatggctctcttaaacctcttcctgcaaagcatgttgatatgggcttgggttttgaacgtttgacctctatacttcaggacaaaatgagcaattatgatacggatgtcttcttgccaatctttgacgttattcagtggcggaatgtatatatgcatggtatggagaggagagaggattgcctaacctatctgtacctgcacttatacatttgcataaagaagttctag

SEQ ID NO: 88762 - DNA, 465 bp, Glycine max
  Peptide Sequence Number=SeqID_205540
atgacatggaacaatccagcatgggtcaccggcatatttcctggtgagttgcagttttctttttctctttccattgccatttcttttctcaaaatgagaaagaagttagtgcactactttgctgtgctccagaagctactgctcattgcaatagcactcaagaagcacatatgtgaaaattattgtttgtcatgccataacaacaagctcctagacgataatgatgcacttcaacattttggtgtgagaaataattctcagaatctcggaggcactcgaagaggagaaagcaccatttttttcatggccttaataggcgctcctgatcaaacaaatcaccatgctgaaagactgaaatccttgttgatacagtctgttctcattacttggattaacaaagtaaggataccaggcaacataacttcaacatttactgttgtttcaacttgcaatctcagccgctag

SEQ ID NO: 88763 - DNA, 1881 bp, Glycine max
  Peptide Sequence Number=SeqID_205541
atggcatacagggttgttgcagatcacatcagaactctttcatttgccattgctgatgggtctcgtcctggtaatgagggtcgtgagtatgttctgagacgtatactccgtcgagctgttcggtatggacgtgaagtgctaaaagctaaagagggttttttcaatgggcttgtaagtattgtggtgaatgtgatgggtgatgttttccctgagctaaaacaacaggaaacacacatacggaatgtaattgaagaggaggaggaaagttttggaagaaccttaattaaggggattgagaaatttgagacagctgttcgacatgttcagggaaagatactgagtggggaggcaagtagaatctgttattttcagagttacttaaaactgatggctgaagaaaaggggttagttgttgatttcaaaggtttcgatagtgctatggaagctgcaagagagagatccagaagtgctcaaacaaagcaagctggtggtgccattgtcatggaggctgatgctacctcagcattgcacaaaaggggcattgtcccaacagatgatagcttcaaatatgcttggttcaaggaccatgagagtgtggtaaaagcaatatatactggttctgagtttgttgatactgttaataccagtgatgatattggggtagttctggaatctacaagcttctatgctgagcaaggtggtcagatttttgatactggatcgcttgagggcttacatgcgtcatttcaagtgcgtaatgttcaagtttatggaggctttgttcttcacattggtaatgggactggtgtctctgttggtgacaaagtagtatgcaaggttgattatggaagacgcgcccttatagcccctaaccatacctgcacgcacatgttaaattttgcccttagggaagtacttggtgatcgtgttgaccagaaaggatctattgttcttcctgaaaaattgaggtttgacttttctcatggcaagcctgttgatgctgacaatttaaggagaattgaatcaattgttaatgagcaaattaaagctgagttcgatgtaagtgcaaaagaggcaactcttgctgaagccaagggtatcaatggtttgcgagctgtttttggggaagtctatcctgatcctgttagagttgtgtcaattggacaaaaagttgaggatctccttgctgacccaaagaatgaaaaatggttatctttttcgtcagagttatgtggaggtacccatatttcaaacacacgagaggcaaaagcttttgcacttttatctgaggagggaattgcaaaaggaatacgcagaataacagctgttacaactgatcgtgcttatgatgcaatgaaagtggcagatgaatttgatcagcaagtagacgatgcggctaagttagaaggaagtttgctagaagagaaagtttcatcattgaaaagcaatattgaaactttatctattcctgctgccaagaaagctgacatcaagaccaagatagcccgacttctggatcaagtaagaaaagcacaaaagctggttgctgaggaaaacaagcgtaaagctttaacgattacagcagagaaggcggaacttgctgcttcaaatgggaaaactttttgcatatctcacgttgatgttggtctggatgtagctgcagttcgtgaggctgttacaaaagtcatggaccagaaaggcttatctgtgatggtttttagcacggatgaatctactaacaaggctgtagtttgtgctggggtgccagagaaaggaggtcaaggtaagctggatgtggcagattggctgagtaatgctttggggcctctaaaagggagatgtggtaaaggaaaaggtggtcttgctacgggtcagaagtag

SEQ ID NO: 88764 - DNA, 1197 bp, Glycine max
  Peptide Sequence Number=SeqID_205542
atgcagaacgtgacgacaataaagtcaatgttgagaagctttgaacttgcatctggtttaaagataaatttcgcaaagagcagttttggggcaataggcaaatctgatcaatggcagaaagcggcggctaaataccttaattgtagattattgtccttaccattcctggtaccttcaaaaataatagccaaactgaaagctattcaacgaagatttctatggggaggagaacatgatcagaggaagattgcttgggtcgactggaagacagtttgtctaccaaaggacaaaggtggattaggcatcaaagatctcaggacctttaacacagcactgttggggaaatggcgatgggatatttttcacaagcaggaagaactgtgggccaaaataatttactcgaagtatggtggatggaggacattggaggaggggagaagtggctgccaagattccctatggtggaaggacctggaccgatggattgctgatgaattgccattaatggagaaatacccaaggctgtatcagatatcatgccaacaaaaacaaaccataatgcagatggggagcaacaagaatactggatgggaatggagaagatctctttttgattgtgaagtagcaatgccagatgcttttattggggatatatcacaacagcaaattcactcacatacagtagatacctggatgtggaaacctgacccacgtgggtattattcaacaaaaagtgggtatgacatgatatggggcggattaatggaggcaaaccagaattctgattttgtggacctatggagtctcaaaattccagccaaagctgcagtgttcgcatggaggttaattagggatagattaccaactaagctaaacctcagaaggagacagtcactgtcctgggttaacatcgcaacaacaatgccacaaaaccctcgggatcactacatgcaacatggaattagggctgctgagggaaagaagtacacaagatggaaatgctggtggattgctttaacatggactatttggcagcataggaataaaataattttccaaaatgcaacttttgatgaaaacaaaatgctggatgatgcagttcttttaatttggacgtggatcaaaaccatggaaaaggactttgcaatacattttaatcaatggtcatcaaatatcaaggatgggtttcgctcttag

SEQ ID NO: 88765 - DNA, 870 bp, Glycine max
  Peptide Sequence Number=SeqID_205543
atgcggtacatcacgctctggttggtgacgtgtactgcctgcaccgccagatcgaggatcaggatgccggcgatcagcgcccacagcgattgtttagccaacgcgatgggtatccatgacagcagcagcagcaccaggccgacggtggtgcagcggcgtgcggcagaacaggctgaagatcgaggccagcagctgcgggtagttcagcccggagtgctgcttatagcgcggcagcgcgcgccacaggatcagcgccatcaggatcatcagcacgctggcgacccagtagatggtgcgccagccgccgaacgacgccagtgcgcccgcgacggtgcgcgccagcaggatgccaagcagcaggccgctcatgatgatgccgacggtcttgccgcgcttttccgggtgagccagcgtggcggccagcggcaccaggatctgcgccaccaccgagaacagcccggtgagcgcggtgccgaggatcatcatcggcagcgtggcggaggtggcggtgatcagcatgcccccggcggccagcagcgtcatgaaaacgatcagcccgcggcgctcgaacatatcgccgagcggcaccagcagcagcaggccggtggcgtaaccgagctgcgcggcggtaacgataaagcctgcctggttgaccgacagattgaagccggtggcgatggtttccagcagcggctgcgcgtaatagttgctggcgaccgccaggccggtagcgatggcgatcagcacgatagatgccatgaacctgaaacagatccgctatgcgctggcggtggcggaggaacagagcttcacccgggcggcgcagcgctgccatacggtgcagtcggcgctcagccaccagatcgctaa

SEQ ID NO: 88766 - DNA, 270 bp, Glycine max
  Peptide Sequence Number=SeqID_205544
atgtcgcgccagacgacgtcgtctgctttcactaaatcgaagaccctcgacaataaatatttggtagttgcactgggttgggctggagtggtgttagggtgcagggatttggagcagatgctgggagatgagattggaaaaggagcttatggtcgagtttacaaaggtttggacctggagaatggagattttgttgccattaaacaagtttctttggagaatattgctcaggaggatctcaacattatcatggaaagcttagagacttag

SEQ ID NO: 88767 - DNA, 249 bp, Glycine max
  Peptide Sequence Number=SeqID_205545
atgaagtttgaggttctcactcagtctcttcctgagatgcttcaattcaaagaagaacaaaatcctatggcaatctcaacaagaacaatcccattcatgatggatgcaatctggaaaatctcacatgttctgcctccagcgggaatagcagcagtatccctgtcaatgggaatagtaccattttcccctagttcttccactctatacagaacaacttctttcctaatactgcatctgcatgagctgtga

SEQ ID NO: 88768 - DNA, 2799 bp, Glycine max
  Peptide Sequence Number=SeqID_205546
atggcatacaacaccacggatcctaaacatgggtttgattgtgtaaaatacattgttcagcaacatccacacggtgttgctgcttggaattgctactacaaggttatctcaagattggaaaaccgagatacaagacattacaaatttgtacgtggtatgcaaggaaagtttgtggattgtgtgcctcctatcctcatttctggacatcagtttaccatatgtagccatcatcaagacgcagcaaggaaataccttgaagcttataaactattgccagagaatcctttggttaatctttgtgttggaacagccttgatcaacttagcattgggtttcagacttcaaaataagcatcaatgtgttgtacaaggtttagcattcctctacaataatatgagaatctgcgagaacagccaggaatccttgtacaacatagctcgggcattccatcatgttggacttgtaactctggcggctttttattatgagaaagttattgctatttgtgagaaagactatccaattccaaaacttcccaatgaaaatcccgatagcatcgaaactcacaaacctggttactgtgaccttcgcagagaggcagcttacaatttgcatttaatctacaaaaaaagtggtgctcttgatcttgctaggcaagttctcaaagatcattgtaccttgacaagagcaccaccgagtctctcacccaagttggaaggcgtcaaagaactcgcccaacttctcgtgacagatttgaaacgtggaatcagcgacaacaaggatgacattgatcaccgaaaacgtgtctttggtgtcaacttcaacacggttggaaggagggatggtacgatggaggcagcatcgtacttgcggttattctcgtcattgttgtctcttccgtcagcaactttaaccaataaacagttccggaagctttctgccaaaagtaaccacataggagtggaagtagtacgaggtgatcgacgtcaaagtatgtcaacctttgacgtggtcgtgggcgacatcgtgtgcttgaagatcggcgatcaggtttcagcagatggggtttttttggaggggcattcgttgaaggcgaatgaatctagcatgaagggggagagtgagcacactggcacaaaggtcactgatggttttgcacgcatgcttgttacttctgtgggaatgaacactgcatggggtgcaatgatgggttccatgaccaaagagattgatgaggagacacctttgcaagtgcgtctcaataagttgacttctgctatttgcaaggttgggttgtcggtggctgcacttgtctttggggtgtctatggcacgttacttctcgggttgcacgagggatgagtttgggaaccgggaattcgttcggagaaggactgagtctgatgatgttgtgaatgcggttgttgggattgttgtggccgcagtgaggattgtggtggtggcgatccctgaagggctgccgcttgctggtgctgctgagatgatattgcgcatgtgctcaacttactatgaccatacagggaaaatcataatcatcgatgatgaagagagggctcaaattgagaacattgtcgagtgcatggcaaccaaaagtttgagatgcattgcctttgcccaaaagaacttattatgcgaaaagcttgaagagacagaactcacattattggggatacttgggttgaaagacccttgtaggccaggagttggagcagcagttgaatcatgcacgaatgctggagtgaagatcaagatgataacaggagataatgtgcacacagcaagggccatagcctttgaatgtggcattcttgatgatgaattggattatgaagatgaagcagcagtggttgaaggctttcaattcagaaatttctcacacgaggaaagaatggaaaagattgacaaaatcagagtcatcgctagatcatctccatttgacaagcttctgatggttcaatgtttgaagcagaagggtcatgtggtggcagtcacaggtgatgacacaaatgatgcacctgctctgaaggaagctgacattggactttccatggaaatacaaggcaccgaagtggcaaaggagagctcagacattgttatccttgacgacgatttctcttctgtggtcactgtactatggtgggggagatgtgtgtacacaaacattcagaagttcattcagtttcagctcacagttaatgttgctgcacttgccatcaactttgtagctgcagtttcttctggtaaagtgcctctttcagctgtccagcttctgtgggtaaacctgataatggatactcttggagctctggccttggccactgagcaacccactagtgatctcatgaaaatgccacctgtgggaagagttgaaccacttataactagagttacgtggaggaacctcattttacaggcagtgtatcaagtgtttgtcttgctggttttacaattccagggaagatcaatctttggtgtcaatgagaaggtgaagaacactatgattttcaatgcttttgtcctctgccaagtcttcaatgagttcaacgcaaggaagctggagaagaagaacatctttgaggggcttggtaaaaataagttgtttatggtaattgtgggcttaactgtagtgcttcagctagtgatggttgagtttctcaagaagtttgccaatactgagagattgacttgggagcaatggggtgtttgtgttgccattggagctttgtcttggacaattggtctgctggtgaagtgtatgccagttgttcgcaacaagtag

SEQ ID NO: 88769 - DNA, 846 bp, Glycine max
  Peptide Sequence Number=SeqID_205547
atgcggctcaaactctcatttcaaatcaagctgtttctgtgcctggtggccttctcctgcctgctgctgacctgcatcggcgcctacacctattaccagctggatgcgcaactgcaccgcgatctcggcgcccgcgcgcaggtgcaggcgcgggaaatcgccctcattccttcgctggtcgatgcggtggaaaacaacgacgccgccagaatcgccgcgctgatgaaaaaaatccgcgccagcagcgacgccagttatatcgtcatcggcgataatcacgcccgccatctttatcattccgaatatgaaggccgcctgggcacaccgatgatcggcggcgataataaagaggtgctggaagggaaaagcattatttccattcgcaagggcggcatcggcgtttcattgcgcagcaaggcgccgatcctggatgaaaataatcgcgtcattggcatcgtttccgtcggctatttgaaatcgcacatcgataatttaaatgccaggacgctgacgcaaattatcggctccatcgtcctgctgctgatcgccctgttcgtcttttcctggctgctgtcgaaaaacctcaagcgccagatgttctggctggagccgaaagagatcgcgctgctggtgcgccagcaaaaagcgctgctggaagccatctatgaaggggtgatcgccatcgatccagagctgcggatcatcaccatcaaccatgcggcgcgcgagctattggatctgcaccaacccgccgccggcttgctgggccggccgatcggcgacgtcattcaggcgcagccgaacttcttcgccgccgcgcagctgggccaggatacgcacgacgag

SEQ ID NO: 88770 - DNA, 3711 bp, Glycine max
  Peptide Sequence Number=SeqID_205548
atgaataaaggcaaaaactgtgctaaaaccttgcttggggaatcgcaatgttctcccaaaaaatgggtgggaaaatgggaaaccatagataacagtggcaaagttttagtacctctgggtcttgtcaaacttgctgattttggtgttgctacaaaattaacagaggctgatgttaacactcattcagttgttggaacaccttactggatggccccagaggttatcgaaatggctggggtttgtgcagcttctgacatttggagtgttggctgtacggttattgaacttctgacatgtgtacctccttattatgatttgcagcctatgccagctcttttccgtattgtccaggatgagcatccaccaattccagatagcctttcacctgatattactgattttttgcttcaatgctttaagaaggatgctagacaaagacctgatgctaaaactctgttgtctcacccctggattcaaaactttagacgtgccctgcagtcttctcttcgtcatagtggaacactaagaaatattgaagatgattctgcagatgcagaagtttctggtggttatcataagagtgcttatgaaaactcttctgtggagaaagaggagtctgcaaaagagcatacaagtgtggctgctgatggcagcaaagctcatgaagacaatgctgcagatgatgttccaccggatcaggttcttaccttagccattcgtgagaagtcatttctacaagctggttctaacagagaagtggttaattccgagtctactggcaatcatgaaatttctaacgctaaagatcttcatgaagttgtgaagaatggagaagttggatctccacaatcaagaggaatggctaacaagtttggaggaaaagacaattctgtaaacaatggcaacaaatcatttgcttttgggccaagaggtcaagataatgatttccttaaggcaatgaagatgccaaccactgtggaagggaatgagctgagtagatttagtgacccgccaggagatgcctacttggatgatttatttcatccattggataaacaacctggagaggttgtagcagaagcgtccacatctacatccacttcacatatgactaaaggttatgcatcggcaattgatggtgggaaaaatgacctggctaaagagttgagagctacaattgctcgaaagcaatgggagaaggaaactgaaattggacaggcaaacaatggtgggaatcttttgcaccgagtgatgataggcgttctaaaagatgaggtgattgatatagatggtttggtcttcgacgaaaaacttcctggagagaacctttttcctttgcaggctgttgagttcagcaaactagtcagttcattaaaaccagaggaatcagaagacgtgattgtttctgcatgtcagaaacttattggtatatttcaccagcgtccagagcagaagattgtttttgttacccagcatggcttacttcctctaacagatttgctagaagttcccaaaacacatattcctgcagtcacaagctttgcagtacctgatcgtcctcgagagattcgtatggaagcggcttattttttacagcagctttgtcagtcaagttctttaacattacaaatgtttatagcttgccgcggaatacctgttttagtgggatttcttgaggctgattatgccaagtacagggagatggttcatctggctattgatggcatgtggcaggtatttaagcttcagcagtcaactcctagaaatgatttttgccgaatagctgctaagaatggaatacttctcaggcttataaatactctttatagcttaaacgagtcaactcgactagcttctagctctgctggggatggattttcagttgatggttcagctcaacgcccacgatctggtatcttggatcccaatcatccttctatcaatcagaatgagacagtgttatcttcagtagatcagcaagaaccccctaaagtgagacatgcagtacctgatcatcacttagaaccttcatcatccaatcctcgaagatcagatgctaactaccctgtggatgttgatagaccccaatcaagcaatgcgacagctgatgaaaagagttcgacccaaacatccagagaatcttcggcaagtgcattgaaagagcgagggaatatggatcgttggaaaactgatccttctcgagcagatgttgaatccagacagccatgtatttctactaaccggacatcaactgataggcttccaaaatctacagaaccatcatcaaatgggttatcagtaacaggagctacgcaccaagagcaagttaggcctcttcttagcttgttggataaagagcccccatctggccgcttttctggacagcttgagtatgtgcgtcagttttcaggattagaaagacatgaaagtgtactccctttgttacatgccactgaaaagaaaacaaatggtgaactagactttttgatggcagaatttgcagatgtttctcaacgtggaagggaaaatggaaattttgactctagtgctagagtttctcataaagtcactcccaagaaattaggggctttgggttccagtgaaggagctgcttccacatctgggattgcatcacagacagcttcaggtgtactgtctggttcaggtgttctaaatgctagaccaggtagtgctacttcgtctggactactttcccacatggtttcatcgctgaatgcagaagttgccagagagtatctggagaaagtggcagatcttcttcttgagtttgcacaggcagacaccactgtgaaatcttatatgtgtagccaaagcttgctcagtcgtcttttccagatgtttaatagggtggagcctcctattttgttgaagatactgaagtgtattaatcatctgtcaaccgatccaaattgcttagaaaatcttcagcgtgctgaagcaataaaatacttgataccaaatcttgaactgaaagaaggatctcttgtatcagagatacatcacgaggtcttgaacgcactattcaatttatgcaagataaataagaggagacaagaacaagcagctgaaaatggaatcattccccatttgatgcaattcatcacatcaaattctcccttgaaacaatatgcattgcctctgctatgtgacatggctcatgcatctcgcaattcaagggagcaattaagggctcatggcggtttggatgtctatttgaatcttcttgaggatgagctttggtctgtgacagcactagactctattgctgtttgtttagcccacgacaatgataataggaaggttgaacaagcactgctgaaaaaggatgcagttcagaagcttgtgaagttcttccagggctgtccagagcaacattttgtacacatattggagccattcttgaaaatcatcacaaaatctgcaaggatcaataccacattggctgttaatggattaacaccacttctcattgcaaggctagatcatcaggatgctatagctcgtcttaatttactcaggctaataaaggccgtttatgagcatcaccctcagcccaagaagttgattgtggagaatgatctacctgaaaaacttcaaaacttgataggggaacggagagatggacaagtgttggttaaacagatggctacttcattacttaaagcactacacataaacaccgttttgtaa

SEQ ID NO: 88771 - DNA, 1443 bp, Glycine max
  Peptide Sequence Number=SeqID_205549
atggatgtgaaaacctctctcccaattgttacaagtgctgctggtgcttatgatgatgatgggcatgctaaaaggactggaaatttatggagtgctgtggctcacatcattactgctgttattggttctggtgttctgtctcttgcatggagtacttcccagttgggatggattggagggccagttgcattgctttgttttgcaattatcacctatgtttcttcatccctcctttctgattgttatagaactcctgatcctgtcactgggaaaagaaattactcatacatggctgctgttagagtcaacctgggcaaaagaaagacatggttggctggtttccttcaatttttgaccttgtatgggactagttgtgcttatgtactcaccacagcaaatagtttgagggcaattttgaaagcaaattgttatcacaaggaaggccatcaagctccttgtggttatggggataatttgtatatggtgatgtttggagttgttcaaattgggatgtcattcataccagatctccataacatggtatgggtttcagttgttgcggcaattatgtcctttacatactccttcattggactaggacttggcatagcaacagttatagttagaaacagagatcagaaggagaaaatgattcataggactgtggttgcacttgcagaaaatggaagaattatggggagcataacaggtataccggctgctaacattgctaacaaattatggttagtcttccaagcacttggtgacattgcctttgcctatccatatgccttgctccttcttgagatacaggacactttagagtctactccaccagaaaacaaaaccatgaaaaaggcctccatggttgcaatcttcatgacaacattcttctacttatgctgtggatgctttggatatgcagcttttggaaatgatacaccagggaacctcttgacagggtttgggttttacgagccttattggcttgttgcctttgcaaatgcttgcattattatacatttggtgggaggatatcagatgtatagtcaaccaatatatactgctgctgatagatggtgctcaagaaaattccccaacagtgtctttgcaaataagttctatagagtgcaagcgcctctattccccggttatgagctaaatctattcaggttctgttttagaacagcctatgtgatttcaaccactggaattgcaatgttatttccttacttcaaccaagttctgggagtgttaggagccataaacttctggccattggctatatatttcccggtagagatgtacttgcaacaaaagaatattggagcttggacaaggaaatggattcttcttaggacatttagctttgcttgctttcttgtgacagtcatgggcctggtggggtcaattcaaggaatcataagtaaaaaacttggctga

SEQ ID NO: 88772 - DNA, 273 bp, Glycine max
  Peptide Sequence Number=SeqID_205550
atgaaagcagacgcttacctcgatggagcagcaccaacagagaagaagaacgcgcaaagtcgaggtgacgaagaagaacgcgcatcaacaatgttgaagaagaatgtgcaacaacaaccacaccgtcgacagttgaagaacgctcagaagaagacgaagatgaacagcagtcacggaaggaagaaggagagaaagagacgtcgcggaaggaagaaggaacgtcttttcgccttaagtgttgggtgcaccagcaataatactgggtgcacctag

SEQ ID NO: 88773 - DNA, 563 bp, Glycine max
  Peptide Sequence Number=SeqID_205551
aagctgaaaaagtggtaggctgggcaaaaaatcattacttgtcatcatgcttgcttccttctattaaaggagaaagattgtacctacctcgtgaaagtctcaagattgaagggccaggaaactatgtcacggaagccttctcaaagcctcaaggcattgtgcggaggaaccttgcaaaggatgagtttgagagcaatttcatttcagctgtagtacctcctggtgaaattggggtgaaatttgatgacataggtgctcttgaagatgtgaaaaaggcacttaatgaactcgttattcttccaatgagaaggccagagcttttctctcgtggaaatctgttgcggccctgtaaaggaattttactttttggtcctcctggcactgggaaaacccttctggccaaggcacttgcaactgaagctggtgcaaattttatcagcataactggttcgacccttacttcaaagtggttcggagatgctgaaaaactaaccaaagctcttttctcatttgccagcaagcttgctcctgtcattgtatttgtcgatgaggtgagcgtctga

SEQ ID NO: 88774 - DNA, 327 bp, Glycine max
  Peptide Sequence Number=SeqID_205552
atggatgctgaaacaagtagtcaatatatgctaacagggcagcctctttctctgaagcatttaactgagggaattaaaggggacaagacatcagaagatgatgaaattaacaagctcttctccaatgttttgagtatacttccacctaaggatgagaatctgctggcaacattcaagaaacaacttgaggaagataagaaaattgtgacttcacgtagtaatttgaatgcattacggaaggttctcgaagaacatcagctatcctgcatggaccttttgcttgtaaatactgatagcatcattttgacaaagcatagaagcacttag

SEQ ID NO: 88775 - DNA, 1344 bp, Glycine max
  Peptide Sequence Number=SeqID_205553
atggaattgatgatgaatgttgttgtgagtgcaggtacagtgtggactgcagtggcacacatagtgacaggagtgatagggtcaggagtgttgtctttggcatggagcattgcacagcttggatggattggagggccactcactattgttttctttgctgccatcactctcctctcttctttccttcttagcaacacatatcgttctccagaccctgaacttggccctcataggagctcctcataccttgatgctgttaatttgcataagggggaagggaatagtcgcttctgtgctgtttttgtgaacgtaagcttatatggttttggaattgcttatgtcattactgctgctatcagcatgagagcaatccaaaaatcaaactgttcccaagacaatgggaatgaagtaacatgtggatttggggatggatatttcatgcttatttttggggctatgcaagttcttctctcacagatacccaacttccataatattcaatggttgtcaattcttgcagcaattatgtcctttgcttatgctttcataggaatggggctttctgtcgggcaagtcacagaaaatggacatgctgagggtagtattgaaggaatccctacttccagtggaattgaaaagttatggctggttgctcaagcacttggtgacatagcattctcctatccattctcagtaattcttattgaaatacaggatactttgaagtcgcctccaccagaaaacgtaaccatgaagagggcctcaacaatatcagtcattgtcacaacatttttctacctctgctgtgggtgttttggatatgcagcctttggtaatgatacaccaggaaaccttttaacagggtttgcactctataaaaaacattggcttgtagactttgccaatgcttgtatagtaattcacctagttggtgcatatcaggtgtatagccagccactttttgccaatgttgagaattggcttcgtttcaagttcccggacagtgaatttgtgaatcgcacatactccttgaaactccctttgctgccagctttcccgctaaattttcttaggctgactttcagaactgcatatgttgcatcaacaactgggattgcaatgatctttccctacttcaatcagattttgggagttttggctggcataatctactatccattatctatatattttccagtggaaatgtacttgagtctgggcaatattgaagcatggacagctaagtgggtcatgcttaggacttttagcattgttggttttctggtgggattgttcactctcgttggatccattgaagggatagtatctgcaaaactcagctga

SEQ ID NO: 88776 - DNA, 561 bp, Glycine max
  Peptide Sequence Number=SeqID_205554
atgtggatttattgcaggcctttaactaaaggtcagagaggagaggtatatgaggttaatggagatcgagttgctgtcatcttggatattaatgaagatagggtcaatgagggcgaggtggagaaccttaatgaggatcatacaaaacccccaatttattggatacatgttaaggacattgagaatgatcttgatgctcaatcacatgattgctacatagcagtggaggctttatgtgaggttttgcatcgcaaacaacctcttattgtctattttccggacagttcacaatggttacataaagctgttcctaagtcacaccgaaatgagttttttcataaggttgaagagatgtttgaccggttatctggccctatagtgttcatttgtgggcaaaacaaaattcagtcaggatcaaaggagaaagaagaattcacaatgatacttccgaactttggacgtgttgctaagctggatgctgtttgggtctcttatagactgactaaagataaagatgatcttatggggacttttatagggactatgcaatttatgttttag

SEQ ID NO: 88777 - DNA, 4131 bp, Glycine max
  Peptide Sequence Number=SeqID_205555
catcttggggaatcagagagggttttctttgttaactcagtgctaaagttaattgaccgtggtcaatacagcaaaaatgagcatctctccgagacagttgctgcagcaacttctatactgtcctatgtagaaccctcattggttctgccatttgtggcatctcggtttcaaatggcccttgagacgatgactgctacccaccaattgaaaattgcagttatgtcagtggcatttgttgggcgttcactattttatacatctgtatcagtttcctccatgaaaccaattgatcttggtggtggtgatgaagcattcattgatcttgtgggggtttcattatccaatgcattacttggcatggatgctaatgaccctccaaaaaccttggctaccatgcaattaattggttccatattttcaaatagtggctggatgagttcttatgccgtctattttccttacttctacacttggaacccagcagtgttttgtctgcaatcatcatcagcaacaggaactttcctggttgacgatggtccatactacttctgtgtgcttgaaattctgtttgggaggctttcacaatcactgtataatcaggctttgaagaaaatttccaagtttgtgaggacaaatattcttcctggtgctgttgcagaggttggactgctttgttgtgcgtgtgttcactcgaacccagaagaagcagttagtcaacttgttgagccaatattactgtctgtgatatcttctttgaaaggaacaccacgcactggatttggaggaggaacttttgatgcttctgcttcatcaaaggttagatccacaatttcaccagctcttgaggcttcaattgactatcaacttaagatattgtcagttggcatcacatatggaggtccagcgctcctccattacaaggatcaattcaaagaagctatcttcttggcttttgactcaccatcttggaaggttaatggggctgctgatcatcttcttcggtcccttctcggaagtcagattcattattatccaatagatcagtataagtgtgttcttagtcaccctgatgctgttgctctagaagaatggattagcacaaaagatttttccactgatgaaaggttgatcccaaagtggcatattccttgtgatgaagaagttcattttgcaaatgagcttttagacattcacttcaagtctgctttggatgatctgttgaaaatatgccagactaaaatccatgctgaccaaggagatgagaaagagcacttgaaagtgactcttttgcgcattgaatcatcgttgcaaggacttttttcttgtttgcccgattttgtcccagactccaggaatggaatggttgaagattcaaaccatatgtttttaattgctggggcaacaggttgtactgttggtagtactgctctgagagaaaaagctactgaggttgtacatgcagcctgcaaatatgtcctggagaaaaaatcagatgacagcatcctgttgatacttattattcgcatcattgatgctttaggaaactatggaagtttggagtatgatgagtggtctagtcacaggcaggcttggaaattagaatctgctgccataatagaaccccccattaatttcattgtgtcatctcattctaaagcaaagaaaagacctaggtgggctcttatcgacaaggcatttatgcacaatacatggaggtcttcgcaagcatcctatcatctttaccgtacaagtgggaatttctgcccatctgatcatgtgactatgttgatggatgatttgttgagtctctctttgcatagctatgaaactgtccgcctgcttgcagggaaatctctagtgaagctgatcaagagatggccatctatgatttcaaaatgtgttatcactcttacccataacttgcaggatctcaatgccaaggaatatgcagtgttgggttcctgttcagtccttgcctcacaaacagttctcaagcatttgacaacggatccaaagtcattctcttcatttatcttggcaattctttcaagttcgcatcatgaatcgttgaaagctcagaaagcaattaatgagctttttgtgaagtacaacattcaattttctggagtatctagaagctttttcaggatctcagacaaagaaaatcatactggtggactggggttttcagatttggtttctcagattggctccatgagttttgattctactggcttgcattggaggtataacttgatggctaatagagtgctgctcctgctggctttggcatctcagaaccatccaaattcatcatctaaaattctgagtgaaactgctggacacttcctgaagaatttgaaaagtcaacttcctcagacaaggatacttgcaatttcagctttgaatacactattaaaagaatcaccatataagctgtctcatggtgagaaatctgctgtacttgaggatttgcaaggccatgtcaaatcatcacttgaaggaactttaactccaacttttcaggaagagggtttcttcaatgagacattgactagtctttctcatgttcatataataactgatagtgaaactgcttcaagaggaggtcagggagattcaagtttccaaagcttagcagacaaatccattactcgtttttattttgaattttcggcttcatggcctcgaacgccaagttggatctcctttttaggaagtgatacattttactcaaattttgctcgtatttttaaacgactagtacaagaatgtggcatgcctgttgtattggctcttaaaggtgcagtagatgagtttacaattgctaaggagaggtctaaacaatgtgtagctgctgaagcattagcgggtgtgcttcattctgatattgatggtctatcaggaacatgggaaagttggctgatgcctcagttgaagaacatcattttagcccaatctgttgaatcagtttcagagtgggcatcttgcatacgatatgcagttaccggtaaaggaaagtatggaacaagagttcctcttttgagacagaaaattctggattctttgatgacacctttacctccaacagtagctaccacaataacagccaagcgatatacttttctggctgctgcacttatagaaatatccccacagaaaatgccagtagcagaagtccagctccacaatacacttctgaaggaagttcttggtaatatgtgccactcatcagcccaagtgagggaggctctaggggttaccctttctatattgtgctctaacattaggctctatcattcaagccgtcatgataatgcacaggatgagagaaacaacgatgttgatagtttgatgaaagatgaaagctgggttcagtttcttacagagcgagcagctgaagcagttgttaacattcagattgctacccaatcagataaagtagtgaatcctgtagatacaaattctcaaaatgggcatctagatggtgattcacaagattgcattaaatggatggaaacgtctgggagatcctcatatctactcgacgtgcttgtggggcttctatatcctgtgatttgcttgcaggctaagataaaatatatcagtggggggcatccttcaccctttgagctagcttctggggttgatttaggcccaaacctacactctaagactctgtttgttctatttgattctattatcattcaagtagggaaggaaacatcaaataaggatttgtcaacattagccaaggtagcatttgaattgctcaagtggatgattgtttgggaacctcaccttcagaaggctgtatctgtgattctttctgctgccaatgattccaactggcgaactagatctgctacattgacatatctgcgcacattcatgtacagagaacatgctgcagcagttttagcaggcttaatgaagggtggagatgaagatcttgctagagatttccgtgatagagcttatagggaggcaaatattgtacagaagagaagaaagtcgagggattgcatagggtataacgaacttgcatatgaggcaacaagtgtgagaactgggaagcattgtggtaaggttaaaggctgtgtgggatacaagggaagagggggggaatga

SEQ ID NO: 88778 - DNA, 2286 bp, Glycine max
  Peptide Sequence Number=SeqID_205556
atgggcaagtcaagcaagaaatcagctctcaaggtcgacgctgttccagctgtggttccgccatccaagtctgccaagaagggaggcaagagacaagctcaagatgaaattgagaagcaattgagtgccaaaaaacagaagataaatgaggttgctcagaaacaaaaggaggcaaaggtgcaaaagaaggaaagtagttcagatgattcttcttcagaatctgaagatgagaaacctgcacccaaatctgctgttctttcaaaaaagatacctgctaagaatggtgctgcccctccaaagaaaggcaagctcgcctccagttcttctgaagatgactcctctgatgaggatggtgtgcgtgcaaagaagccacagaaaatggttgctgagaaacaaaagaatggagcaactgtgcaaaagaaaaaggtggaaagtagttcagatgattcttcttcagaatctgaagctgagaaacctgcagtaaaagctactgtaccttcaaaaaagacacctactaaaaatggcaatttaagtaccccagcaaagaaaggcaaggcagctagcagctccagttcttctgattcatctgaagatgactcttctgatgaggatgaagtggctacaaaaaagcaaacaaaagaagtgaaagtgcaaaagggtaaggaggaaagtagttcagatgattcttcatccgaatctgaagatgagaaacccgcagcaaaagttgctgttcctccaaaaaatcaatctgccaaaaatggtactctaagtactccagctgagaaaggcaagccagctgccagttcaagctcatctgaatcatctgatgatgactctgatgaggatgaagctccaaaatccaaggtggcccctgcagcaggcaagaatgtacctgcttctacaaagataactcagccaagtgaaagctctgagtctgattctgatagcagctctgatgaggacaaaaataagaaaaaacctgcaactgctaagctgcctgcattgtcagttgctccagctttgaaagtggaaagctcagatgatgaatcaagtgaaagctctgatgaagacaatgatgcaaaacccgccgtaactgatgtgtcaaagccttctgctcttgcaaagaagaaggttgacagctctgattctgatgatagcagctctgatgaagataaggggaagatggatattgatgatgatagttctgatgaaagtgaagagccacaaaagaaaaagactgtgaaaaatccaaaagaaagcagtgatagttccgaagaagacagtgaggatgaaagtgaggaggaaccctccaaaactcctcagaaaagagacagggatgtggagatggttgatgctgcctcgtctggaaagaaagcggtagatgactgctatcctcttttgtttcctttcctgcttttattaccagtgcctaagaccccagttacacccaaagaagaaactggcgcttcaaagacactatttgttgggaacttgccatttagtgttgaacgagctgacgtggaagatttcttcaaggatgctggagaagttgttgatgttcgatttgctacagatgatactgggaagtttaaaggatttggacatgttgagtttgcaacagcagcggctgctcaaaaggcccttggattgaatggacaacaattgtttaatcgtgaactccgacttgatttagctcgggaaaggggtgcatatacccccaacagcagcaactggaacaactcatcccagaaaagtggaagaggccagtctcaaacagtatttgtaaggggtttcgatacatcccttggagaagatgagatacgagggagtttgcaagaacattttggatcttgtggggacattaccagggtgtcgattcctaaagattatgagtctggtgctgtcaaggggtttgcttacgtagacttcagtgacgttgatagcatgggcaaagctctagaactccatgaaactgaacttggaggttataccttaacagtggatgaagccaaacctagagataatcagggttctggtggtagaggtgccggtggaaggagtggtggcggtcgatttggtggtaggagtggtggtggtggtggtggtcgatttggtggaagaggtggtggcggtcgatttggtggaagtggtggtggtggtcgatttggtggaagtggtggtggccgatttggtggaagaggtggcggtggaaggggtcgtggaaatagacccaaccttgctgcggaaggcacagggaaaaagaccaaatttgctgatgacgagtag

SEQ ID NO: 88779 - DNA, 1247 bp, Glycine max
  Peptide Sequence Number=SeqID_205557
atggcgtgtttatatggtggaatttcgtccttctgccattttccgccatcaaccattgataacactgattacttttggttccattctttatgttcaaatccatcgaaatacttctttaggccaagattctctgatcaacgatattttcaatctttgtcccctaagaccactgtggaagaatatgcttcacatggaaggatcatcagaaaacatcttttaggcttagatttatgtaggcatacttcatctagaaatagtttcactgttccggaccgaaggcctagtttatgtcttaacagtactcagttacgtgcctatagttctgaaagtgatggaagaaatgcaagtgaggataaacatgtaaatgttaatgatggagctaactttgataaaggacagaaacaacaagagaagtttgggaaagatgtcaagtacagcaatgcacatgcacgacttggagaacaggaacaagaggaatggcttaataatgagaagctttctatagaaagtaaaaggagagaatcaccatttttgacaacaagggataagtttaaaaaagagtttatgagaagaattattccttgggagaagataaacatttcctgggacacatttccttatcacattcatgagaataccaaaaatcttctggtggaatgtgctgcttcccatttgagacataataagcttgcttcatcttttggcagtcgcctcacatcttcaagtgggagaatattgcttcagagcattcctggaactgagctgtatcgtgagagattggttagggctcttgcacaagatttacaagttcctctgttagtgcttgataacagcattcttgctccttatgatattgatgatgatttatcatcagattacgagtctgacgaggataatgcagagtctggggaggagggttctttggaatcagagaatgaggatgataatgatgctacaaatgaagaagagtgggctagcagtaccgagaccaagtcagatgcaagtgataatgaagatgcaatagcggctgctgaagcacaccttaagaaggttaaagcagctgttattcggaaacttgttccttacaatgttggagaatttgaaaagatagtgtctggtgaatctgagaattctgagtcatctaagtctaatgatgccaaatcttctgatcaatctggatgccagctaagaaaaggtgaccgtgtgaagtacattgggccatctgttaaagttagagacgaggatag

SEQ ID NO: 88780 - DNA, 198 bp, Glycine max
  Peptide Sequence Number=SeqID_205558
atggataagagcttgaaggaaggagaagatgagtggagggagacggagagaaagagcacgaaattttacgcctcaaatgagctatggcttagcccactaatccaatatcatgtccaagattctccactaagtgtgcttaggtgccatgaggcatgtaaaacatggaggacatgcacaaagtgtgattatataatgtga

SEQ ID NO: 88781 - DNA, 231 bp, Glycine max
  Peptide Sequence Number=SeqID_205559
atgaaagagtgggagaaagcaaaaaaagaaagaaaaattctcgatcaaggatcggaagaaaacaaaagaaatatgcagaaaggtctttggaccagacaatatctgaacaatacagaattgtcaccaaagcatgttcgcattttagtgaagaaaacgccgagacaatttagtctcacagttagcaagaactacgtaggtctgagttcctcatcacaaattgaggatacgtag

SEQ ID NO: 88782 - DNA, 645 bp, Glycine max
  Peptide Sequence Number=SeqID_205560
atgttggtgaatgagcaggaagctagggagcaattctgctcacaaatcgggagattcactgatattgaaaaggaaaccagcatttgtatcaaccggtgtgttgacttgggtagaactgctctctacatagcggcagaggatgattccctcgtgtcacattcatcagttccacttcccgtggatgatttcattacgagattagatgatctttcaatggactactgtccacactacagccctgaatatgattcatcgcctgagaagttcttagagagcatagagagatttctatatattcacaagggtttcaggagagccaatgccaatgcattggaaccacgggcactttatctccactcggttttgacccatcgttcaggatcagctgcaatgttatcacttatatactcagaaattctgaaaatgcttcggttgtggagccttttgtattttgatgctgaaattttcttccctcatgatgctcttacccttcccacgggatatcataagcagaaaagcaaggagtcagaccaagctcacataatgacttcaggaaacctattagttgagataattacagaaggaataaatcctactgccgcagagcctagctcctacagaaaggcaactgctccctgcccataa

SEQ ID NO: 88783 - DNA, 270 bp, Glycine max
  Peptide Sequence Number=SeqID_205561
atggcagcagcgggacaggcaggagaagaaaaacttctcagtgcataccgccatttctcctggcgggacaggctgagtaggagtgagaagaaaaacttctcaggcatatcgccatttctcctggcgggacatgcctacgtgggcagtcccgcctttggagctggcgagataggggtgagtcccgcctttggagctggcaggatagggatatttctctctcctattacgtttccattacaaattggaaaatcaaatctcatttcacagtga

SEQ ID NO: 88784 - DNA, 546 bp, Glycine max
  Peptide Sequence Number=SeqID_205562
atggctgcatactttaaaacctactcctaccccgtgatgatcttaagtgatctgaagcatgcattctggccttttcaacatgatcacaccaaaactttattcttaagggcggcaactgctgctaactgtgttgatagatctgattttgttggagaaagtggctcacaaattgcatcagctaaggctgctcaacataggctagatcgaggtgtttggaccagtgtgcgttttggggacatgaggcgatctttgtctgcatgtgaacgtcttatcctgctgaaaaatgatgcaaatgagtttagagattacagcattcttctctatcattgtggattatatgagcagtcactggaatacctgacgaagtaccgggatctgaagaactcatctaggcaagagtcatcatcatcaaactctctgagcagcttggaagaagatgccgtggataacctgatgatgcgcttgaatctcgtcctgatggagcaaggatggagtcggccatcttatgccagaaattttcttggtaataactctgaaccatggtag

SEQ ID NO: 88785 - DNA, 2538 bp, Glycine max
  Peptide Sequence Number=SeqID_205563
atggaagcaaaagctgctacactggagacggaagtcgctggcctcaggacggcgaagcacgcaatgcaactcacagcagaggagaatcatgagaagctagtagtgttgttgtccaaaaacaacagtgattcgaatggagagagttccccaatgaagttgtctgcgatcttacatggggacaccttggacgaattccgaaaatcagtgaagaaagtagagctaccgatgtttgccgcgaggatccagccgggcattgatgagggtgacgatttagaaaggctggccgttatccgccaagacggcatggtggacaagtacattttggagtttgagacgctcactgctcaggagtcacgattgcctaatgaccagttttttgggtacttcgtgcacggattgaaggatgggatcagagggcgtgtgcgtagcctacacactttgggaccacttttccaatcaaggatgatgaaatcaggcaatagcagtggagttagagcgtggatggaatggacctcacgacccagtgcgaagcagtgttggggcctgtttcttccttctgcaagtccttcttgctatcagactgggtcggggatctgggtccggttggtcaatttagaaccaaccgcaaggggaacacctggaataggtttagacccgaatctcagggcgaccaacactgtgtggggcccagggacaaggtgtggaggtccatttcaccctaaccagcaatgccccgatcaacagatgagggtgatgctggtggaggatgaagacgaagaggaaggtgaggcgaatgcaatggttgaagcaaaacaccaggacggtgaatgtagcatgttgttcttgggaacaactatggtggtgaacgagcagaaaccccaaacactgaaggtaagggctcacatcaatggagtccatgtcttagtcttggtgaacagtggggcaacccacaatttcatttctaggaagctggtgtttaaggaacctcgtgggttgccacctaaaacgagcaaggaaaatgccattaatttgttggaagaagcaggaccagtgaatgtgaggtcatacaggtatcctcaccaccataagaatgaaattgagaagccggacaactcatggcacatgtgtttcggttacagggttctcaacaaagtgatggtaccagataaatttccaatccccatcattgaggagttgttggatgagctgcatggggcattgttcttctccaaacttgacctcaaatccggtcatcatcaggccctctacgagtacatgctaatgccttttggtatcatgaatgctccctctaaatttcggtctttaatgaatgaaattttcctccccatgttgagaaggacaatgctagcattttttgatgatatactagtgtatatttctagttgggaggttgagtacttgggacgtataatttccagcaaaggtgtggcggtggaccctgctaaggtgaaaagtgtcatggagtggcctgagcctaagaatgtcaaaggggtgcaagggttccttggtttgactgggtattataggaagtttataagagactatgggcagagagctaaacctcttactgaattgacaaagagagaaggggccattcttactcaaaacggtagacctatagcctatttcagcaaggcactagatgaaaggagcttggctaagtcagcttatgtgaaagagctgatggctgttgctctagccatccaacactggccatcctacttgttggggaggagtgatgtgaagttgttgtgcatcatctctgacctccaacagggtaagaacactagacctggattcgtgtataaacatgatacactgttttatgaaggatggttagtgttgtcatctacctcagcttgcattcctaagatgctcaaggaaagtgtacagaaatttgtgatggcatgtgatgtttgtcaatgccagaagtacttagctgctgctccaggaggattgtctaaatatggccatttcatccctttgaaccacccttactcggcgcagatgtttgctgaaagatttatccgggaggtggagttgtttaagcttcaaggcactcagttgaagatgagcacggcatattatccccaaatggatggtcgtacagaggttgttaaccgttgtgaggagtcatttcttaggtgctttgtggctgatcagcccaagatgaagccaccagtgttgagtagatttctgccatgtgaagtgagggtagaagcagttcgaagggagctgctggactgggatgaggccatcaaacagttaaaatatcacttacaacgggctcagaatcgcatgaaggaccaagctgacagaaagaggattgataggcagtttgaagtgggggaatgggttttcttgaagcttcacccacatggtcagtcaactgtaggagcccgcattaatcctccacgatattatggccttttaaggtactgcagagggttggggctgtatcttataaattatagcagtgttgtcaatagtggattgtggaaaattgcgagaagctga

SEQ ID NO: 88786 - DNA, 204 bp, Glycine max
  Peptide Sequence Number=SeqID_205564
atgttgaggtttttaaataagaaacccttttctctgtcttgcgagccactaacccacactctctctcaaaacgccatatctctcttgaaacccacttcgccactgagccttgagccacttcactggccttttcctccaaatggtgttgcagatgtagactttggggatttgagagagtttgagaaaggagagtttggaggatga

SEQ ID NO: 88787 - DNA, 216 bp, Glycine max
  Peptide Sequence Number=SeqID_205565
atggaagaagccacttgggaggaagaattcaacatcaagagtcaattccctcacttgagacttgaggacaagtctcattttgaagaaggaggtattgatagaaacgggaatatgggccagtacacagatggcaggcccaaggtttggatggtgtatgttaggaggtatagaggtaagaagagtaatggtggggtggcaaatgagataacagaatga

SEQ ID NO: 88788 - DNA, 372 bp, Glycine max
  Peptide Sequence Number=SeqID_205566
atgcggaacttttggatggttttccaaaccattggacaagtagccctcataactatggaggagcaggccacaaagaagagtatggccccatccaagtgtgaaagggtttggcttgttgctgagaaagagaagaagaaaaatacccaagagaagttaaccaccttagaggtacaattgacctcggaaactaatgaggtggataaatttaaaggagaactaaatgtggcaaacactgaatcggcactgcaatttgtaaaagggtttaaagcggaaataaagcaagtgaaagtcattgttagggttgttaattttgaagaagttggccctttcaaagaggttgctgatggaaagatcgtggatgtcatcgagtag

SEQ ID NO: 88789 - DNA, 468 bp, Glycine max
  Peptide Sequence Number=SeqID_205567
atggcagcaacatcattttctggcatgcaatttgcaatgtcaagatcatgcattcctgcatcacaaaagattgcagatgctggtgccgtggttcttggcggcaagtccaagattggatcgtggaataaacttgcaagtgcatgtcatattgcatcagtgcaacctttcaggcggggcttcacttcatcgtccataaaatctgttaaaagtgacacaaaggccttgtttgagttcagtgcacaaagtgcagactcaggattgtcaattgatctgaaaggtaaaagggcttttattgctggtgttgctgatgacaatggatatggatgggcaattgcaaaagctcttgctgcagcaggagctgagatccttgttggcacatgggtacctgccctgaatatttttgagtccagcctacggcgtggaaagtttgacatatcacgcatgtatgacattaaatactgctgctga

SEQ ID NO: 88790 - DNA, 1530 bp, Glycine max
  Peptide Sequence Number=SeqID_205568
atgtccatctctctacccgtttccatggcaaccacaatccattccttaccctattcacttctcaaactcaaaccaccctccctcaccccatctctatttcgccgcacgctctttcccaattcaactctcaacgccgcccctaaacgcaccgtttcgtccaccactttctcactgacgctcactaacggaacctgcaaaaccagacacgttgccgccaaatcatccgaagccgacaccggaaacacttccacctcgctaacccaaaccgtgtttggggtgcttcatttggcggtgtccctgggcctcattctcgcggtggacaagtttctgaagcaagcgtttgtggctgccgcgatcaagttcccgagcgcgttgtttgggatgttctgcatattctcggttctgattatcctcgactccaccgtgcccgccgccgccacggcgttcgtgagcttcttcgagcccgcgtttatgttcatacagagatggctccctctgttctatgttccctctctcgttgtcttgcctcttgctgtcaaagatattcccgctgcctctggagccaaaattggcctcattttagttggaggatggctggctacactctgtgttgctggttacacggctatcgcagttagaaaagctgtgaaaacagaattggtagatgctgagcctatgggaaagcctgctccattttcttctcttgaagtgtggacttggactgctgttctccttatatcatttgtatctgcattattttaccctacagcactgggtacaagtgccagaacatgccttccatttttgcttgcagccacagtgttaggctacatggttggctcggggttgccatcaaatgtgaagaaggtcttccatccgataatttgctgtgctttatcagcagatctgacagcatttgcttttgggtatttttccaagtcaggacttgaacctgtgctaggatattaccttacaaaggcatcatcaaatcctggagctggtgacattttaatgggatttttaggatctgttattctctcattttccttctctatgtttaagcaaagaaagcttgtgaaaagacatgcagccgagattttcacctctgtcatcatctcaacagtgttctcactgtactcaacagccttagttggacggcttgttcaattagaaccatctttaactgtgtccattctacccagatgtatcacagtggcattggccctcagcattgtatccttatttgacggagccaattcatctctcacagcagctgtggttgtattaaccggtctggttggagcaaattttgtgcaagcaacccttgataaactcagctttcgtgatccaattgctcggggaatagcaactgcttctagtgcccacgggcttggaacagcagctttgtctgccaaggaacccgaggctctcccattttgtgccattgcttatgctctgaatggtatatttggatccattctttgctcgattcctgctgttagacaaagtttgcttgcaattgttggctga

SEQ ID NO: 88791 - DNA, 285 bp, Glycine max
  Peptide Sequence Number=SeqID_205569
atgcaaaagagggacaaaggccaaatcggtagagaggggcaaaagaggtggggggaagaaagggacagaggaggaagagggagggggaagggaaaaagagaaggggtggaggaggtgggggtgaggggggaagaaagaatagagaaggaggacgatgaaaggggaggggaagagaagcgagaaaagacgaaaaaaggatatgaaggggcggaggaggatacttgcaaacaagacattatatgcatacaagaggagttaatcaataacttcatgcagacttggtga

SEQ ID NO: 88792 - DNA, 531 bp, Glycine max
  Peptide Sequence Number=SeqID_205570
atgtggttggtgagagaagcgacgaagatcattccacttgaaggccctatggggggtcgtcgtagtaagacggggcgaaacgtgattccagggcctggtcagtgtggtggcgaagggggagggataggtgcaagagaagagtgtggggaggatgggatggtagtgatggctacgagtttgaccctgggtaaggcaggctacggcctccttgaggcagtcaatggtcacctgaagagtgttgtgaatgtaaaggagttggggaaattattggataacatttacattagtaacatcaaactaaatgtgaatatccctaaacacttgaaatggagaagaacagttgaacagggaccacaaagacattacaaggagattaataacaaagcaaaccataagggaaagggaaatagtggtaataactacagggacagagaacaggtgcccaaacaactagggtcatatgcacaaacatttacgggggttgtgaacccaaatcgacctggtcggttggactggttcgatagtgacaag

SEQ ID NO: 88793 - DNA, 426 bp, Glycine max
  Peptide Sequence Number=SeqID_205571
atgcatcgggggattaaagccaaccccgatcgatgctcaatggtaatcaacatgagaagtctgagtaatgtgacgaaagtccaacaactttatgggaggatcaactccctttccatattcctctcaaagttagatgggccctcccactctttcattgcccatgaaaaagctagaggttttcatggatggaagagtcattgtcagtccggtcttagtgcaagagatgagggtagaagaaaatctaatatatttagtgagtcatgtcctgcaagaccccgagtcgtggtaccagaagttagaaaagatggccttggtggtattgatcacaaccaaaaaattgagacactacttcctgagctttttgatcatcgtctggatggatcaacctattcaaaaaattctacaaaaatcaaacttggctggtag

SEQ ID NO: 88794 - DNA, 231 bp, Glycine max
  Peptide Sequence Number=SeqID_205572
atgtcgaaccatcaaagggttgcatctttgggattctggctaattaggcaagtttgtgaagtgctgatttttagcttctcgctaagccaatctgccggcttagcgagccatccgctgagcgcatcactcttgcgactgagcgcgaggaagaatctggaaaaggataagttgtacacacgcgctaagcgagggctcatccagctaagcacaccacttgcatgtagccgctaa

SEQ ID NO: 88795 - DNA, 522 bp, Glycine max
  Peptide Sequence Number=SeqID_205573
atggcaaggaaaagagcaatggagaaaaaggagatcgggtcaacttccgaatcaggtgccaaacctttgtggggagaatggaaaggacacgatcaagggaggtataggagggaaaaagagattcttgaccccacaccgttgcccgtcccaagggaacagactttgagagagatagagtacctcatcaagaagggacctttggcgaattatgctaggaaggaaaaggaccaacaggatgacatgagttgggacataaaagagaaaagagatccacccccaccaccgaacactaggaataccactacacccacccaccaacaggtgatgccatttggattaaagaacacaggcacaacctaccagcggcttatggacaaagttttagccaaactcatgggaaacactatcaaagcctatgtcgacgacatagttgttaaaacttcaaatgccattgagcattgtgtcgacctccaatgcgttttcaacaccctctgtcaatatcagctaaagctaaatacataa

SEQ ID NO: 88796 - DNA, 684 bp, Glycine max
  Peptide Sequence Number=SeqID_205574
atgttttgctgtattacagatgaaccatctcaaaatggcagtccagtacatgctcctcaaaatggggtacataatagatctcagacagttgttaatcaaactatgcctatcttacctatatcttccacaagtgctagtggagcagttcctggtcccacaactaatttaaatataggaatggattattggggcacaccaacttcatccaccattcctgcactgcatggaaaggttccttctgctgcagttgctggagggatgattgctgctggatcacgagatggcgttcagccacaagtttggctgcaggacgaaagagagcttaaaagacaaagacggaaacagtctaatcgggagtctgcacgcagatccaggttacggaagcaggtcataattgtcatatttcaaatccctttttttgcgctttgtactcaggccgaatgtgatgaactagctcagcgtgctgaagctttgaaagaagaaaatgccagtctccgatcagaagtgagccggatcaggagtgagtatgagcagctacgttctgagaatgctgccctcaaggatagacttggggagatacctggtgtcacgacacctgggaaggaggatcttaggtctggccagaatgatcagcatgtagggtgtgaatacttacttggtcataccttctctgctacttcgtaa

SEQ ID NO: 88797 - DNA, 198 bp, Glycine max
  Peptide Sequence Number=SeqID_205575
atgccggatcatctaaatggacggttcagcctttactttagtgaccaagctgggggtatattccccccctcccaatctttttgcctgaccaagcctaaaactacattacttttctattctccagaagttgctgaatctgttaaggaagactttggcagtatagatatccttgtgcactcacttgccaatggaccagag

SEQ ID NO: 88798 - DNA, 3024 bp, Glycine max
  Peptide Sequence Number=SeqID_205576
atgtacatcttctggagggacgaatccaagtttatcgatgatcttgttagcaggattttcattaaggtgtctcctaaagatttatctaggaatgagcatatagttggatgggagtatcgagttgaagaattaaagtcacttctagaacttgagtctcataatatcactaattgtctgctagggattcatggaaccggtggaattggcaaaaccacacttgtcaaagctttgtatgactccatttacaaacaatttcagggttcgtgttttctctccaactttagagaaaattcaagtcaaattcagggcataaaacatctgcaagaagggcatctatcagagatacttgagggaagcaaaatcctgttgaaaaatattgaaaaaggaataggaacaataacaagtagacttcgtctcaaaagagttgttatagttgtcgatgatgttgatgacattgaagagttaaaaaagttggctgaggaacttgatcggtttggtcctgggagcaggatcatcataacaacgagaaataaatatttgctagatgttggtcaggtcgaaaaaaaatatgaagtgaagatgctaaacgaccaagagtctttggagctcttttgccagagtgcctttagaaagagttgtcctgaaacaaactatgaagacctgtccaatcgtgcaataaggtgttgcaaaggccttccattggccttaaaagtactaggttctcatatggttggaaaagatttgggtggatggaaggatgcattggatagatatggaaagagtcaacatgaaggtgttcaaaaagttctaagaataagctatgatagcttgcccttcaatgagaagaatatttttcttgacattgcatgcttcttcaacggatggaaattggaatatgtaaaaagtgtactggatgcatgtgacttcagctcaggtgatggtattacaacattagttaataaatcacttttaactgttgacaacgagtgcttggggatgcatgacctaatacaagaaatgggtagagagattgttaaggaggaagcaggtgatgtagttggtgaatgcagcagattatggcatcatgaagatgtttttcaagtactagttaatgatactggaagtagcaaaattcagggaataatgcttgatccccctctaagagaagaaattgaatgtactgatattgtatttaagaagatgaagaatcttaggattctcattgttcgccaaacaatattttcatgtgagccttgttatctcccaaataacttaagggtactagaatggacagagtacccttcacagtctttcccgtcagatttttatcccagtaaacttgtgaggttcaatttatctggaagcaatctactcgtactggaaaatccatttcagagatttgagcatttgacttacatggaaatctcccattgtcgtacggttgttgaatttcctgatgtctctcgggccaagaatttaagagaattaagacttgatagatgccagaaactggttagcattcataaatcagttggacgtcttgctaaccttgtttttctaagtgctacacactgcaatcaactccaaagttttgttccaacaatctatttgccatctctcgaatacctttcctttggctattgctcaagactcgcacacttcccagagattgagagaacaatggataagccattaaggattcaaatgttatatacagctatccaggagcttccagaatccattaagaaacttactgggcttaactatcttcacattgaaggttgtaagggactccaacatttaccaagtagcttatttgtgttgccaaattttgtcacattaagaattggaggttgttatctacttcgagagtcatttagaaggttcgaaggaagccattcagcttgcccaaaactagagacattacacttcggtatggctgatctatcagacgaagatattcacgcgattatttacaattttccaaacttgaaacacttagatgtatcgttcaaccattttgtgtctctcccagcacacattaaacaatctactaagttgacaagtcttgacgtgagttattgtgataagcttcaagaaattccagaacttccatcaactgttcagaaagtatatgcaagcgaatgcaactccttaactcccgaaacatcaaacatcttatggtctcaggtgcgtaaagagattaggggattagaagtgaggatgccgaaaagggagattccagaatggttcgactatgttaatgagggagggtatccagttttcaaggctcgtgggaagttccctgcagttgctttagcgtttgtattcggggacgtgaaggcccttccttatctctcgtcgatgggagttcacttgcacttgttcattgagggtgaacacagactgtgcgatagattcatagtggtcaagaatcaagcgttgttgtgtgacatacgagttttgttcagtttcgagaagtgggaggatgtaggtgttggaattggtaatgattggaagaccatacaggttttctgtgaaacaggctgcaactctctacgttcatggggagtttatgtgtacaggcatgagactaacatggaggatatccaattcttgagtcaacattctatttcctctttggtgaggagtcttcacgaagaacgtaagaaatcagaccaaagtttgaaagggcgagagatgtttcatttgcaaatgagaaataatgaagagatgttttattgcatgcataagcaaagaaggcgagagttgctgctaatctcagaaaaaacatcaaggagggctatggctccaagagagggggaaggtagttcagggttgaacatcgatgacaaggaggacaaggaggctgattcaatgttggagttgttagcagagattacaagtgatgatggagaagagactcaagaagctggtccttcaagcgaacaacgatatgaaggacttctggatgaagattcaagatcagcatgcaggtctggaaaaaagctcagaagatgttga

SEQ ID NO: 88799 - DNA, 2052 bp, Glycine max
  Peptide Sequence Number=SeqID_205577
atgcacgaggctaaagaaaataggacaaataaactttatgcacgatcaacggttcaaactgatgcggcatatctcgagcttcatagaggcgcatcacgatatcaccgcccttcaactcttgtgcggttagggggaagtgcaccctctggcttcaactatggtgatgctcttgataagagtttgatgttctttgaagcacagaggtctggtaagttaccactgccgcagcgagtcaaatggcgtggtgattctggtctccaagatggatttcaacaaggagtagacctggtgggtgggtactatgatgcaggagatcatgtgaaatttgggttgccaatggcctacagtgtcacaatgcttgcatggggggccattgagttcaacaaggaaatcgctgacttgaaccaaatgggacaggcattatgggcaattaaatggggaactgactactttatcaaagctcacactcagcctaatgttctttggggacaggttatcctaacaaaaccagacttaaccatacatggctcttcaaaagtattattactctggttgaacgttaagcatgcttatggtaatgtgggagatggagtttctgatcattactgctgggagcgtgctgaagacatgacaacttcaagaggtgcctacaaaattgatgaacaacaccctggctcagatctggcaggtgaaactgcagctgcattggctgctgcagctatagctttcaggccctacaactcttcttactctaatctcctgctagttcatgcaaaacagctcttcacatttgcagataggttcagaggtctctatgatgactccatatcaagtgctcagcaattctatacttcttccggttactcggatgaattgttgtgggctgccacttggctgcaccaagcaaccggtgatgaatactacataaagtatgtagtggacaatgctatgtatatgggaggaactggctgggcagtaaaagagttttcttgggacaacaaatatgctggtgtgcagatcctcctatcaaaggtgttactagaaggaaaggctggtgcttacgctgccacactaaagcaataccaggccaaggcagaatattttacctgcgcttgcttgcaaaagaatgatggttacaatgtccaaaaaacaccaggtggcttactatacgtgcgtgattggaacaacatgcagtatgtttcttctgctgcattccttttagctgtttactctaattacctatcagcaacaaaatcacagctcaactgtccagatggacaaactcagcctcaggagctcctcaattttgtcaagtcacaggctgactatatccttggtaaaaaccctgcggatgtgagctacttggtaggatatggagcaaaatatcctcttcatgttcaccacagaggtgcttccattgcttcaatctttgctctacactatgaggttggctgcacccaaggatttgagacgtggtataaccgtgctgagccaaatcctaatgtcatctgcggtggcctcgtgggtggtccagataaaaatgatgacttctctgatgaaagatccaattatgaacaaactgagcctacaatttcaggttctgctcctcttgtaggcatcttcgctaaactgcagagtttgtatggtaatcataatataggtgaaggttacaaccataatgaatcaccagtgccccagcaaaaaacaccaagtacaaatccagggaaagcaacagtgtccaagacatcatcagaatcagaaggtgccgcagttgaattccttcactcgataagtagctcatggactgttggaggtgcaacttattaccgtcacagggtgataatcaagaacacttcttcaaagccaatctcagatcttaagttggtgattaaggatctctcagggtctttatggggtctctctccaacagaagaaaaggacacctatgaacttcctcaatggcacaaggtcttgaatcctggctccgaaagtatatttgtatatgttcaaggcggaccccaggctaaagtctcgattaaaagcttacattga

SEQ ID NO: 88800 - DNA, 477 bp, Glycine max
  Peptide Sequence Number=SeqID_205578
atgggtggatcttcaatatctctgacatacattgcttcagaaaggatcattcctggatatggtggtggtatgagttctgcaaaagctgcactggagagtgatacacgagttcttgcttttgaagcaggaagaaagcgcaaaattagagtcaatactatatccgctggtccactgagaagtcgagctgcaaaagctattggatttattgatatgatgattgattactcatcagccaatgcacctctaacagaaagaagtattagcaggttccattttcaatctgtgattatttgcaccactgagttgatattttgtcttgcagaggaggtgggctacacagctgccttcttagcatcacctttggcatctgctatcactggtactgttctatatgttgacaatggtctgaatgctatgggtgttggagttgacagtccaatatttaaagatcttaacattcccaaggaccagcattaa

SEQ ID NO: 88801 - DNA, 261 bp, Glycine max
  Peptide Sequence Number=SeqID_205579
atgcccggaaatacaaggctaaaaccctataccgctagaatgaccaaatacaaggccaaaaagaaggcaaaacctattctaatatttacaaagaagagtggactcaaacttggctcatgggctcagaaatctaccctgagccactctagcctaattctcttggagtcttctatccaatacccttggaggttaggattgcatcaatatggcgctctcaccaaccatggatatggctccactctagtcaagaatgccaggtga

SEQ ID NO: 88802 - DNA, 276 bp, Glycine max
  Peptide Sequence Number=SeqID_205580
atgccaactccctcgttcttcattaatgccatctggacgcagtgggagcatgatgatacgcttcatgtggattgcttctatggtttcctccactattgtagtgcgccagtgctagaggtaccacctagggtagacttggtggatcttgtgtctaaggatgaaggagaagatttggaggaggatagatctattaaggaggatttgtctatagatgagaaggaccctatcgcgaagctggagttgaaggaggtggaatcttttgatgattcttactag

SEQ ID NO: 88803 - DNA, 1569 bp, Glycine max
  Peptide Sequence Number=SeqID_205581
atggagaaggaggacgagacaactcatgaggatgattggatcaagggagttgagatgaattctatcgatcataagattacatccaaggagcaacaacactacaccgttttgagtgaatccgacatcaagcgacatcaagatgcagacattaaacaggtttcatgtgttttattgatatcaatagtgttttcttgtcttttgctcgtccaccacgagtggagtgtgctcaaagtgcaggaagtatggttcgatgatgaagaaagagttcgcaaagccgtagggttactaaagcagcataagcctcgggtaggttttcccaactcaaaaaccctcacttgtgagatatgtctcgatgttgttttatgcgataaggttagatcagctagttgtgatcatctatattgcattgattgttggaagaagtatgtggatacaagcatcaacgacggccctaataagtgcttgaaacttaggtgccctaaacccttttgtgatgcagctgtgggtggagacatgattcgtgaacttgcaagtgagtcacagcggaacaagtatgatcagtttttgtttcgatcttatgtggaaaacaacaagaaggtaaagtggtgtcctgccccagattgtgggtatgctgtgagttatgaagcagatggtgtgagatccaattcagatgttacttgtctttgttatcactccttttgttggagttgtggggaagaagctcatagccctgtggattgtgaaatcgcgaaacactggatcatgaagaatgattatgaatcctctgagaattctgcttggattcttgctaataccaaaccatgtcctaagtgcaagaaacctattgagaaaattgatgggtatgtgcatatggagtgcatgtgtgggttccagttttgctggttatgtcttcgcaaatggtccaattgttgttataactgcatccattttccttacaaggatatttacaagaaggaagtgaagagaaatatggtgagtgattatttggatgattgcactcattattttgagtcttggactagaacaaatttgataagaaaagatgcacttaatcatttaaagcacctgatgaatggtgggcatacaaagcgattgagtatgttatatcaaaggtcagaagatgattttgagttcatagaggcggcgtggcaacaagtgattgaatgtataagagtgctcaaatggatctatacatatagattctatcttcctaaaagcgaacaagctaaaatagaatttcttgggtactcacaacgcgaggctaaaactgttttggaaacgctttgttattgcacagacaaggaattgagcgagtttcttcatgctagtgagccaaaaaatacatttgatgatttccgattgaagttaatgaaacttaccaatgtcagtaagacatattttgagaatctagtgagagccttagagaatgggctaactaatgtccaagtgaaaaagtatggagtcagtggactaaaaagaaggctaagggagataggggagagctcaactggaatgaaaaagagaaacaggaatatcaaccttaattaa

SEQ ID NO: 88804 - DNA, 442 bp, Glycine max
  Peptide Sequence Number=SeqID_205582
atgtcatctcctgcttcatcccctccaacgctaggctacattcagcatccaatttccaaattggacaagttagctggcatcgcaatcaagtatggtgttgaggaagtcctccgagcagaagctctctccccagccatgagctgtttgcgaaaaaatggttcattattctaccggaaatcaccaatgtcccctcaaaatcttagtcgtcacaaaaaatctcatagtttggctaacggaactttggatgatattatggcagcaagagaagccaggaaaagtgactcagataaatggaatggtacacttatccggaggagttataaatctgaagctaagcttcagcgtattccagaattgctcttgaagcaggataataattgtaatggtggcttttcattttcaccaagatcagcaaatggactagctcagaggcagaaatctg

SEQ ID NO: 88805 - DNA, 1305 bp, Glycine max
  Peptide Sequence Number=SeqID_205583
ctgcctgggtttttatcttcacatgcatttgaagaagatgaagatgaatatgaagatgctataccaatcaattcgtgtaaggaaacatgtgatgcgtctccagcagatcccccacatacccttggagaatcagaaacttctactgttaccccaaatgacaagcgccattgtatcttaaaggatgtggatggtgagctggagatggaagatgtttcaggtcacccaaaggatgaaagacccatattttttgacagttatgatgaaattgatttgcaacatcaggactcagataggaatttagatccaacttcaaacatttcagaagagatgtcagctactccagagggttctcctcctatgccacttgattcacctcccccacccccacctttgccttcatcacctccgccacctcctcctccattatctccatctccccccccacctcccccacccccaatgttgcaacccccgtttcctcctttaccaccttcagcccctcaggtgtcattggttcctcaatcgtctggaccagctcggccacttctctcccagtcattaatgccacctcagtcatcacatcagtcttccccacagttgggttatcagcagagtgtacctcatgactttagtggcactactaatggtaaccaaatagttccaatggttgggaattcttttcccggaggtcacaataatgcagttgtcaagaatgaagtatttccacagccaactgcttatgctccaaccgcaggctgcagctcccaggaaccttctggttttaacccttcaaggcaattagaatacggacagaatgacatgtacctaaatgctcaagttcctcaacctaaccatcaatttcagcagggtaatcccccatttgctcagaggcacgcacatcctgccccaccccaaaatccaccaaatctatactcatattcaaatcctacagttcagcagcatcttccacattcattccatcctcccttccctttaccatcccttccagatggccgaagacaatttgttgctgatgagcaatggagagtgtcatcaagtgaatttaaaacaaacaatcaacatggtgtatggagagggagaaatccttcttcatgtcctggtccaccctatgggcaagaaggccattttcggccgtcacttgaaaggccgccagtaagcactgtaggttttcagcgaccaatttcaggcaacctacctgttgctccaatagcaggacatggtgtacctcagatgatgccctgtaggccagacattcctgctgttaatagttggagacccacttga

SEQ ID NO: 88806 - DNA, 395 bp, Glycine max
  Peptide Sequence Number=SeqID_205584
gcgggtacggaaatgagtatgggacagacgagtttgggaggatacccacgggtacgaatttcattgtcatgcctaataacactaatggtaatgataacatcaatgctcacaatcttgacagtggtgatggtggtaacaacgatgacaatgatgatgataactatagtattggtgatagtggtggtggtcgtgtcgatgatggtggttgtggcgacaatgatagtagtggtgatgcttatgaaggtaatagcaacggcgatggtagtggtggtaataatagcaacgacgatggtggtggtgataataatagcaatgacatcaatgatgatagagatgatagtaatagtgatggcaatataggtggaggtagtggtagtgatagtagttgttattaa

SEQ ID NO: 88807 - DNA, 207 bp, Glycine max
  Peptide Sequence Number=SeqID_205585
atggggacaaatcaaactggcaaaaggttttatcaagtcaagattaagggcctagatgccaccagcattaaggagttggggcagttgatgggacctctccaaatgcaagccttccgcaaagcgaaaccgtatcttttctctgggtttcttccctccttgagcaagattgcagttgctgtcagggattcggcgagaggattggaccgc

SEQ ID NO: 88808 - DNA, 912 bp, Glycine max
  Peptide Sequence Number=SeqID_205586
atgaagcatcttattgcggctgccctggcgaaaaggaaacaagctcattcgcaatgtcttccttctggctttcccaatgttcaggatgggactcctagcccctccgcagttcagccatatctgcctgtctcgagcaattttgtgcaggcagatatacagggagtttatgagcacacaacattggcttctccaccaactaaagagcttcactcttcttctcgtaatcaacttgatgctgatgacattgaggagaggagagttggttcagtgcaaaggggtctaggaggctcgctgagtggtggtactgaggctgctgttgctcgtgaagcttttgaaggaatgatagaaacattgtcaaggaccaaggaaagcattggccgtgcaactcgtcttgccattgattgtgccaagtatggcattgccaacgaggttgttgaacttctcatccgaaagctggaaactgaaactagttttcatcgcaaagtagatttgttttttcttgttgattccatcacccagtgctcacataatcaaaaaggagcctcctacattcctactgttcaggcagcgttgccacgtcttcttggtgctgctgctccccctggagcaagtgcccgtgaaaatcgtcgtcagtgtctcaaggttttgaggctgtggcttgagaggaaaatttttcctgaatcagttcttcgccattacatggatgatattggagtttcaaatgatgatatgacagttagcttttctctcagacgtccatctcgagcagagcgatctgtggacgacccaattagagaaatggaaggcatgcttgttgatgagtatggaagcatatttatccttacttttataattactgaatcccgaatgtgcttgatggaagggtgcagtcataaccaagatagtttgtaa

SEQ ID NO: 88809 - DNA, 2721 bp, Glycine max
  Peptide Sequence Number=SeqID_205587
atgtttttcattatgaattttagtgacatcaggttccataaaagcaatcaattaagcaaaagtaacttgtatgtaccatcttttattccacctccaatggcaaccaaagggaaagaatctgaaaggaaaaaagaggaggaaaagccaaaggagaaagagaaagggaagtcaagaaacattgatcattttatggaggagctaaagcatgagcaagagatgagggagaggcgaaatcaagaacgtgaacattggcgtgacgggcgtcatacagaacattctatttccagtcgctttgacgagctgcctgatgactttgacccaagtggaaaacttccaggatcatttgatgatggtgatcctcaaactacaaatctttatgttggaaatctctcacccaaggttgatgaaaattttcttctccgtacttttggaagatttggacctattgctagtgtgaagattatgtggccaagaacagaggaggagagaaggcggcaaagaaactgtggctttgtagctttcatgaacagagctgatggacaggcagcgaaagatgaaatgcaaggagttgtggtttatgaatatgaattgaaaattggatggggaaaatccgttgccctcccatcacaagcactacctgcacctccaccagggcatatggccatcaggagtaaggagggtagtactgtgatcttgtctggtccttcaggtccaccagtaacaactgttcctaatcagaattctgaactggttctaactcctaatgttcctgatataatggttacaccccctgaggatgaccatttaaggcatgtaattgatacaatggctttgtatgtcctggatggaggatgtgcttttgaacaagctattatggagaggggtcgtggcaatcctcttttcaatttcttgtttgttcttggctcaaaggaacatacctactacgtttggagactctactcatttgcccagggtgatactcttcaaagatggaggactgaaccttttatcatgataacgggtagtggaagatggattcctcccccattaccaatgtcaaaaagtccagaacatgaaaaggagcctggtcccacacatgctggaggaagaagcaggcgagtagagcctgaaagaacactgactgatgcacagagggatgaatttgaggatatgctgcgtgctttaacattagagaggagccagataaaagaggctatgggattttctttagataatgccgatgctgctggcgaggtagttgaagttttgactgaatccttgacacttaaagaaacccctattccaactaaaattgcaaggcttatgcttgtctctgatattcttcataatagtagtgctccagtaagaaatgcatcagcatatcgcaccaagtttgaagcaacattgccagacataatggaaagttttaatgacttgtatcgtagcataatgggacggattactgctgaggccctaaaggaacgagtgctgaaagttttacaagtttgggccgactggtttctcttttcagatgcttatgtgaatggattaagagccactttccttcgacctgggaactctggtgtaattccattccattccatatgtggtgatgcgccagagattgagcagaagaccgcttccgaagatatggttgttggtggcaagaccaaccaagatgctgcattggcaatgggtcgaggggctgcaatgaaggagctaatgagtcttcctcttgctgagctggaaagacggtgtcgacacaatggattgtcacttgttggtggaagagaaatgatggttgcacggttgctaagtcttgaagaggcagaaaagcagaaaggttttgaactagatgatgaattgaaatatgcccacaatcaagtgagttctgggaaatattcaagtaatcaacgagaaacaagtgcagagctggacccagtaggactgtctgcatggaaccactatggggatgaagatatacagtcacagggcagaagttctgtacctttagccccaacccttcctattccacagcctaaacttaaagctttcacaaaaaaggagaagaatgatccagttctgccagcctctaaatgggctcgggaggatgatgagagtgatgatgaacaaagaagtggaaaaaatctcggcttaagctactcatcttctggtagtgagaacgtggatgatggtcttgttaaagctgatgaatcagagtctgcagctgatagaagtttttcagctcatgctgacagtggaatgaatgaagagcagaggcaaaagctgagacgcttggaggttgctttaattgaatacggtgagtctcttgaagagaggggaattaaaaatttggaggaaattgagaagaaagttcagttgcataggaaacggctgcaagtggagtatgggttatcagattctggtgaagatggtcaaggcaatagaagaacttcagagaggagggataggcatgatgtttcaaggaaacggcaccgaagccgtagtccaagtagtagtccacagccaacattatctggcaaagacagagatagagaacacgatttagaaagggatcgagacagacaaagagatagaagtcatgatttcgatagtgaaagaggaagggaccggcacagggagaagagtggaagcagagagagagatgatcatgataaggacagaagcagggatagggacaggagaagacgagccaaataa

SEQ ID NO: 88810 - DNA, 264 bp, Glycine max
  Peptide Sequence Number=SeqID_205588
atggcatctttgcaagacgcaccctctcattccaaaactcatgtttccactacctttgcgcaaccgattagtctcaagcttgatacaaagaattttctcttgtggaaacaacaggtcaaagaaacatcacttatgtctgtcattgggtatctattcccattttttcttggaagggttgaaccaaaggttgaggcagtaatgaaggaagaaacaacagtggcagatttgatagtgaaaaggaatcaagaagagaagaccagataa

SEQ ID NO: 88811 - DNA, 2115 bp, Glycine max
  Peptide Sequence Number=SeqID_205589
atggctcccgggcgtcgacgcggagcgaacaaggcgaaggccaatggccacttgagtttgggcgatcttgtgctcgctaaggtcaagggcttccccgcttggcctgctaaggctcccctactaccttccatggtccttgagtgtatccaaaaagaagaggacagagaagtcatatatgatattcccaatgaattagacgatcagtatatggaattgaatcttttcaaagcttttgttgccccagcagatattcaggcatttaccggtgaggctaaaaataagttgtctgctcgtcttcaaggcaagacaaagtactttgcccaagctgtgaaggaaatatctgcagcatttgatgtgatgcagaaacagaaggctagtggtttggcagatgacaccgatgattctcatattggttcagaggctccttctaatgatggggtagtaggtaaccaaaaggatgctgctgatgctgtggtatcaaatatagaaaaaaataatattgatatggataatgtttgctctaatttggagcactatacacagagaataggagaaaatgacagccaagatgaaaagctctctgtatctaaccatccaaatgaaagttcttctgtttcatcacccatgataaaaaacaaattagccattggttcagagacaaagaagaatgctaacaaatctagttttaaaggtgctagtaatgttaatgattttggccaagatgataatgggcatagtgatttaaccaatggaactaagccaagaaagcttgataatggctcaaggaaaaaaagtgaagctgcaggtggtagtaatagaaatggtggatcatctactggaaaatttatgaaggagggaaattgtactggccgtggtgatctttctaggtctggagagacattgaaagctgggaagaaaaggaaaaatacattttctgttaaattagattctccggatactcttaaatcaagcgataatggtactactggggaaaaagatagcaacctgatgaaagtgaaaacaagtcatgaggtaaaaaatgagctgcaggagatctcatttgattctgaggatgctgatggtaaaagttctagtatgaggaagaagacccaacttcatgcaaagcataatgtaggaggagcaaatgaatctttacatgctaccaagaagttgaagcgtatggatgccaaagatgattcaactttagggtatacttcaaaggttctgaaaagagcttcgcctggctctactgttattgaagacaaaccatttaaaaaattagaatctaagaagtctacaccaaatttgaaaacagaaaaaagcttgccatcaaggagtcaaactgggggtgcaggttctgatgattttgtccatgagttgctacctggaactaaacatcatagccaggttcagcaaattatgcctgattctgccggcattgcttctgatgaaaagaacgaaagaagttctcttagaccaaaaggtgatacaaataatgttgtgataaaacaactagagaggaaacgtagagctgtttgcctttttgatgacgatgacgacgatgaacctaaaactcctgttcacggaggagctgcaaaaaatatgaaatcgtcttctgtttcagagttcaagaagagcaacaatgtacactcagagaagtctgatgttgttcagatggctcaaaaaaattctagtgaacttgaggacacccatctgaaagagccatcttctcaattacatgatgaccatttgtctattcagcagcccctaaaagagaaagatgacgaagtaattcctgtgcatgttcctcacagtcctgaaaaattagattcgaagcagtttccctccaatgtagcaaaattaagctctgtctctccactaaaatcacctctgttggtacctgcaactaagtcaaatgctgagcggaataaagcttcgaaactgtcgcttaaaatttccagtaatgctactcaaaagagagcagatcacgggccttcaaagtcttcacataaccttagctcttctcagaatcaagttgtgactcataaaaagaagcttgcattgtctgcagaaatttttaaaactactccggaaacattgcctcaggcagttgaa

SEQ ID NO: 88812 - DNA, 345 bp, Glycine max
  Peptide Sequence Number=SeqID_205590
atgggtacctgcggagatggcgccaccgggggaattgaggtacatgttgatgggtttggaagggttttcggattcgaggaagaggagctgcgcaacgacgacgtgagcggtgtcgtcggagatgggcccgttgatgcagataatgcgctccttcagaaggcgcgagaagatgtcgtatgccctctcacctcgggaagagtgctctatcaccattgggatcagactgtaggagcgactgcattcagtgttccttccatggaacaacagattcctcgcaaacgctttcacaacgcctctcatggctcgcaatacaacgcaggattggggattttcgttttgctttga

SEQ ID NO: 88813 - DNA, 267 bp, Glycine max
  Peptide Sequence Number=SeqID_205591
atgcagaaactagaggaagttggaagctctgtcaaggctcggataaagaagataatgcaagctgatgaggatgttggaaagatagcactcgctgtgcctgttttagtttgctgctggttgtttgtttgtcatatacatgttgttgacattgctcttgaatgcattacagctaaagctctagaactatttttgcaagatctttgtgaccgcacttatgaaataactcttcaaagaggagcaaagaccatgaattcattgcatttgtaa

SEQ ID NO: 88814 - DNA, 279 bp, Glycine max
  Peptide Sequence Number=SeqID_205592
atggaaggggaagaggatgagagtttgttgttgtcgttgatgcttttggtttcggacagtaatctgagaactgcaaaggaggaacaggaacgcctttctcccacgtcatggaaccattgcgggaaagcccttcaccttagacccgccgaagcccatgttagtgacctgagatcaaagagttatcgttgtccatgcgggagaacatgcttcactgtcgcactcgcttatcatcacaatgtcaccataatgaacgaagaagttgttgtggtttgcttttaa

SEQ ID NO: 88815 - DNA, 774 bp, Glycine max
  Peptide Sequence Number=SeqID_205593
aggagccaactgaggtaattagagggactcaatctgatcctagtcgtgaggatgtaaaagctgaggaggctggcaagtctacagaaaccagttcaagctatgatccagatgaaactgagaagttgaacaaaactcaggtagctgatacaattattgaaaatgtggaaactctggaagtaaatccagaggttcattcatgtgatgtgcaggatgatacaattctagcaagtaatgcttcatttcaacatcaagagagatatgaagaaacagaccctgttcaggagacaaacgatttccatgagaaacatgatgcaggtgagacttcttccttcattcaaattgcccttgaagtcaatggggcattcaaacaaatgccaaatatatttgaaactgagaccaccgaaggtaatgctacaagtattggtgacactgacataaatgatgggcaaaatcaagatcagtgctgggaaaagtcagaaaatgactgcaatctggaaatgcttgttgaagacataactcctgagtctgcagaaatctgcaaggatgcattggagacgagggttgcattaaatgaagaggtagatgagaatcagtctaattcttctaatgaggaaaatttgtttgacaatgaacacaatatagaagaatctcagataccttgtacatcagattggaaatcaagtcctttcaaagaagaggaggttgaatcaagtcatagcaatctaagggagagtaatcaagcatctgtaacaatggaagataaggaagcaaatg

SEQ ID NO: 88816 - DNA, 156 bp, Glycine max
  Peptide Sequence Number=SeqID_205594
atgaaaaatgattttatgaaggttttgcccatctttcttatgggttgcaagtacaaagtgggggctaaattgcttgcaaataggttgaagaatgtactccctaaggtaattgatgatcaccaaagtgcatttctagtcgagaggagtttattataa

SEQ ID NO: 88817 - DNA, 726 bp, Glycine max
  Peptide Sequence Number=SeqID_205595
atggaggagaaggcggaagctctggcaagccaagaagacactattggtgtttgggattgtacttttccaaatgtggacgggttagtgggtctagcgacgatcgatgcttttcttgcttatcatcactgcaaggaaagcccggtcattgctgtgttggctaacacatatgatacacttgacctgagatgtgagaagagcagcgtgaagattgtctgttgcacgcccgctctttatgtgtggtcatcgcacgtgcgccaaaaagggaaaggcaaactgggaggaactcttggcaagtatgggttcccaaatgtccccttgatgggaacaatgggtggtatcaattataatcccatgcttgctataagacaattaggatatcctatgagagtggaacaaaaggatagggagcttaggggaagcagcaacggtgtcgtcggctgctatcataagtggctgaaggctaggatgcaagagataacttggctcccaaatctaaaaggtccaagtggggaagaagttgaagtccctgaggagagcgaggaagtgcaagccttgaaagcggaacttgaaaggacgcaagtggtcaaggaaaagttcaagatgatagccatcagggtcaagaaaaggtgtgatgagcttagggatgtcaaaatggccatggccgaagcgttagagcgagaaacaaagagggctcgaaaagaagaatggggccaaaacaagttctga

SEQ ID NO: 88818 - DNA, 483 bp, Glycine max
  Peptide Sequence Number=SeqID_205596
atgcaacaacaagaagatccaatgattacaatacatcaagaattcatatggtcttttagtaaacacgaagatggaatcctttctatggaggctgaggatgatgatgacaacaatgaggttcttgcaagatccccatctgctccaaatgtaaacatcccccagcacatgcctgatttgaacctagatgaaattgaccaacatgaagaatacaatcatttcttcaaccgtgaaagtattccaacaaagcctaaaggaatactatgggttgggatgcaattcatgataaaagatgaatatacatttgcaatccaagagtttggcataaaggaaaatgttggatacaagacagacaagttagaccaatcacaattaactgtgtattgtcccaatgggtgtgattggtattgtagagttcacttttcaaagaaggctaagatatgggagataaaaaatactagaaggatttacatcttccaagtgtaa

SEQ ID NO: 88819 - DNA, 300 bp, Glycine max
  Peptide Sequence Number=SeqID_205597
atggcaaaacaaaggaaactcaagcaagtgtatggaaactgggaggaatcatacaaacagttacgcagatgtcccctagccatgaatgattctcttcctagaacaatcatagattgtcatacgcgaccaaccattgaaagaggtcgtctagttccagaaaaccgaagaaatccatgtggtcttccaaaaacaagccgcatatacaccaagatggatgtaagagaaaggggtcagccaaaaagatgtagtatatgtcgaactgttggtcattccaaaaacaagtgtcctaatagaccatga

SEQ ID NO: 88820 - DNA, 282 bp, Glycine max
  Peptide Sequence Number=SeqID_205598
atggcctcatcatcggtcaaatgcagcataggcatgcctgctggtgatccttgtggggtgcttagctctagcactggtgtagatactggtgatgcctatggactggcctccgcaatcattggatctgcctctggatcagtttctggtacaaatgactctgggggagtgcactctccagatctggttgagcctcctaagctgcggatgcctcacctcctccatgagaagaaggctgaactcctagctaggccacctacacagaaaactcctccatgctcataa

SEQ ID NO: 88821 - DNA, 942 bp, Glycine max
  Peptide Sequence Number=SeqID_205599
atgcagcaaacactaactcatcaaactcgggattttcttgcacctactatggcaaagacaatcacaccattgatagaggaggaagaggcaatcaaagcaattctggcaaagggaactcaagaggaaaaacaaaacaagatttgtacacattgtggtcttaataaccacactattgatgagtgttacaggaagcatggttatccacctagacataggttctataagtctcaaagctcaaacatcaatagtgtcaatgctatgaaagaagaaagtgatacctcaactctaaatcgaaatcaagatgcccagagtgaagatgatatgcaaaacctacagaggattggtatagttgcgatggaggaaggagtttacaaactcaagatgtctcctatcaagcttgagtacaatcctgattcaatttgtcctattatctctagtgttgagacacggtcacatttaaagagttttattgctaatgttgaaagcaccctggaaaccaacagaaggaaacttgacccaagaactgcaacttctgtctttttaggtttcaaaccaaatacaaaaggatttgttactttcaatctcaaaaccataagtatttttgtttctagaaatgtgatttctatgaagactattttccattcactgatcaggaacagcctactcaaacaactagaaaatttgttagacaaatacataggccaagcaaatataggaatttctatatctcatacccatcctcaactattgccagtcactctacagagattaaagcattggaacttaataatacttggattctcactgattttgatgcaatcctaccccccaagaccattggatagaagactccaagaagattgggctagagatgcaggagaaggccgccctagggttctcataggccttaaggtggattttgggtccatgggctcagtatga

SEQ ID NO: 88822 - DNA, 201 bp, Glycine max
  Peptide Sequence Number=SeqID_205600
atgtcaaggaatagcattcctatctataatattcttaggaaagtgattctcgaaatgcaatgtttacccccacttggttgcacaacaattgatatcagagccaatgattctccacttggttgcacaacaattgatatcagagccaatggttctccacttggttgcacaacaattggtatcagagccaatggtttgacttga

SEQ ID NO: 88823 - DNA, 174 bp, Glycine max
  Peptide Sequence Number=SeqID_205601
atgtggttgtgcagtggcaacatcacgattcgagagagtgaggtgcgaaagagaggggcccaaagagtggacacaaagtgtcattgcctagagggctgcgacgcattggacaagtggtggtgtaatgcggtgatgcggtggcgcaatgatggtgacaatgatttgagggttcaa

SEQ ID NO: 88824 - DNA, 514 bp, Glycine max
  Peptide Sequence Number=SeqID_205602
caaaagcaaaggtgaaaggaaagatattgagttggtagaggaggaagagccacagattggtgctgattgttctagtgcaacctctaataaatctgagatttataaggaggaagcagcgaatgcagcacataagcataaaccaaagagggtagagagtgtcaatgctgatgcagaagcctttgatgatcactggaaagttcagattggccatcaaagtgtgtcattgaagaataagacaggagattcaactgtgctgaagataggagattcgactaaagttgtgataaaacaagacatgaagggaggagagcatagatatgggtttaacaacaataaacgtgagaagccagagaaggtaagggtggtggatgatgaaactggcaacaaacatgagctgtttgaagtcctaaggatgccatctagatgtgtatttttcaagttcttcatgtcattccttcatcattcaacgtcttcatgtcattccttccccgagagtttgaagtactattcttaa

SEQ ID NO: 88825 - DNA, 241 bp, Glycine max
  Peptide Sequence Number=SeqID_205603
acttcattccagaatttggacatttcttctatctggatgtaacccttggctcgttcgtgcggctcatccatgctaccagactggccaaggcagccaaggtcatgcaatgagacctactggtggcgtactgaacactgaatcgttcgatgagggtgtcgaagctatctatggatcttggtgggagtccaccataccatgtcaatgttgctccctcgagggatatagggaagacacgacatag

SEQ ID NO: 88826 - DNA, 435 bp, Glycine max
  Peptide Sequence Number=SeqID_205604
atggcaactaagacaagttatatgcttgtgaacactagtatttcatccgcatctacccttgggaaacaagcaagcatgaatgaatatgtggatcatatggcacctttaccgaaggggttcaagattccatatttcactaccttctctgatgaggatggaaaatcaaccatgcggctctcatactttggcacttcacttaactcctcgttggtcagaaccttccaccagccagaactctccataggtatcccttttcgagacttcgataatgagctctacctgtttctagaatcaatgattgtccctatgaaccaacatgagacttttcaacgtgttttgtcctcactcacatgctttctgggaaacttcccagaaggtcactcatcccataactactccaagccaagcacacttaactgtggagttcttaagtga

SEQ ID NO: 88827 - DNA, 126 bp, Glycine max
  Peptide Sequence Number=SeqID_205605
atggagaggctttggctttctatgttgttagagccaaagctatgggccttcgtatattcttcctcagagagggcacatagcaaagcgtttcgagctttagagttcaacatgaacctttgtctttga

SEQ ID NO: 88828 - DNA, 1251 bp, Glycine max
  Peptide Sequence Number=SeqID_205606
atggttgtttgtgatggagggtcaaggctaagtgtttgggtttggttaggggttggaagagtgggtggagcacttattggtggaggaggttgcataggtggaagtggcattggagtagtagtaacactgaataaatgcatttgggcttgttgtaaattaagaatgagagattcaccaaggaacaaagttgattcaattgcatctttagatgatgcttcatgtgaggttgattcagttggagcctcatccatcttagcttttggttgcataacgactatgaatagagtcgactctaccattttaaatgcttcagtagttgcatcaattgcgcttcaggaagccgtcctcaaggttcttcacaaagcaagcatttacgtcatcaaagtggaagtcttgggtagactctatcaagccatgccaattcatctgctgatgcggagtccaaagggatatgcagttgtcggtgcagagcccaagtgtgcacctccttggaaaatagtgcttgaggagtggaatggtcctttgagagcacaggagatagacaaggggcatccagagccactatggcatctgggggcagagcaacatattcagcaaaaagagtatggacatactcgtaccacgtccattgagggtctccagcttcttctccatgtggatccaagcactggaaacttggatgtgttgattggagaaagaggcttcttggtcgttactggtggtggactggatggatgtggactgggagttggagttgcctcattattagatgaactggagccgtcagagcatgggatcttgatgggttcctttggtgttgaggacttgcatccaactcttgttcaaaccactgaagtgttgttgtctggaaataaaagttcccttgctgatgatggagagcttggagtcttcgtccagtttttcaaagacatggaatacctggtgttcctagagaagtttgttgatgagggtggcatagtggatgtcatccactcctcccaaggtcttcatgttcatgagtatgttaatgtagattgggtgtggaagttgtgggtcattgaaataaccgtggattctgcaaagaagcaaaatgtgttgtatgttgagaccaagaccttccaacatattaatgtaaaagtagtgttcaatgtgaacagtaggttctccataaatttggatggtagcggtgtctgtgatgataatggtggtggtaagggcagtgttttcactggagttagacatggtgagtag

SEQ ID NO: 88829 - DNA, 423 bp, Glycine max
  Peptide Sequence Number=SeqID_205607
atggaagataagaactgggtaaaatccatgcaagaggaacttgaacaattccagaagaatgacatatggaatcttgtagaactaccacaaggaaagaaagcaatgggtgctaagtgggtgttcagaaacaagttggacgcggcaggtaagataaaacaaaccaacaatgaaatctatatccatcaaaccaagtatgtcaaagaacttatcaagacgttcaagttggaagatgcaaaagaaatgaagactcatatgcatctaatgacatgtcttggattggatgaggaatccaacaaagtggacaactctcaatacaaagctatgattggatctttactatatctaactgcatccagacctgactattgtttagtgttggactatgtgccagatttcaacaagacccaagggaagttcacttaa

SEQ ID NO: 88830 - DNA, 348 bp, Glycine max
  Peptide Sequence Number=SeqID_205608
atgtatgttgtgtatgtacatgggggtgcagtgaccatgatggatatccctggtggggaaaatagagtgtttctcatgaggggaaatacttgtacttgggggcatgtcgctcggtttggcactcccttgagactcaagctggtcaccattggagggggggagggggaagttgtttgtgcatggcagggtgaccttgacacttactacctagttttcataagaaagagtgtggcgtggacacgcttaggctatttcgtgacgaatggtaccacattgcatttgagggttgaggtcaggtgcaaggttatcaaacttgagagtttacgtagactcgtgagagtttcatag

SEQ ID NO: 88831 - DNA, 780 bp, Glycine max
  Peptide Sequence Number=SeqID_205609
atggaggccattgtaatggagagaggactgctatcaaggttctccaatctggtttttattggcctacgttgtgcaaagatgctcataattacgtctagaggtgtgacaaatgtcaaagaacaggtggaagcagtagcggtacaacatgtagatgcaaaaaccgttattcgcttcctaaaaaagaatattttctcaaattttggcacacccaggaccaatgggcaagctgaagtttctaacagggaagttaagaaaattctagaaaatatagttgctcaatcaaggaaggattggtccctaaagctagatgaagctttgtgggcatacagaacagcatacaaatcccccacaggacttactcctttccagttggtctatggaaaatcttgtcacctacctattgagttggaacataaagctttttgggcattaaagtttctgaacttcaactcaaatacaattggtaaacataggaagctccaactccatgaattggaggaactgagggttcaagcttatgagaattccaagctttataagcaaaaagtaaaaatctatcatgacaaaaagctatcaaaaaggaattttcagcctgatcaacagctgaaatccaagtggtctagaccattcatcaccaaagaagttatgccacatggagcaatgatatcggaggacccaaccaccaaaaagacatggaccgtgaatggcagtagaatcaaacactacctaggtggagatttcgagaagataatcattgttgtccagctgcaagaggcttga

SEQ ID NO: 88832 - DNA, 532 bp, Glycine max
  Peptide Sequence Number=SeqID_205610
aggactacaggtcctcaccttcagaggactgcacgtcctcactttcagaggactacacgtcctcgccttcagagggctacatgccctcacctccagagggcaagacgccctcacttttagaggactacacgtcctcgccataagaggactgcacgccctcacctttagaggactacaagtcctcgccttcaaagagctacacgccctcgcctttagaggactacacgtcttcgccatcagagaactacacgtcctcgcctttagagggctagacgtccccaacttcagagggctacacgccctcgccttcagaggactacacgtcctcgccttcaaagagctacacgctctcactctcagaggactacatctcctcgacttcagagggctacatgtcctcgccttcagagaactacacgtcctcgcgttcagagagcgacacgtcttcgccttcagagggcttcacgccctcgccttcagaggactacacgccctcaccttcagagggctacacgtcctcgtcttcagatga

SEQ ID NO: 88833 - DNA, 450 bp, Glycine max
  Peptide Sequence Number=SeqID_205611
atggaattattgagattacaccaacatgaagaaaatgacaagaaaaagaaaggaattgctcttaaagcatcatcctcaattcaagaagaaagtgatcaggaaaatgatccagatgatgatgataatctaagtctttttgtaaaaagattcaacaagtttcttaaagtaagaggaaatcataggcgacccaattttaaatcaaagagaaggacagaaacttcatcttctagtttgaaatgctttgaatgcaatcaacctggacatctgagggttgattgtcccatcttcaagaaaaagatggagaaatatgaaaagaaaaatcttagtgaaaagaaactgaagaaagcatacatcacatgggatgaaaacgatatggaatcttctgaagattcagaaaatgaagagataaatctctgccttatggctaaaagttatgaaagtgatgaagag

SEQ ID NO: 88834 - DNA, 285 bp, Glycine max
  Peptide Sequence Number=SeqID_205612
atgacgacaatagtgtggagaacgcccaaggtggaggttgaagacgacataaggaatagagaagatgctttgaatgcactattttggagtagttatatgtgcaagggaatcatggttgggcgacctaacaacaccactgctgaacttctagctcatatgactcaagtgctagagaccttagtgcaagaccgtgatgttgaacaaatcgagtatcgggggtttcctactttcactaagcacaatccacccaagtttgaaggcaactttgatccagaaggagcctag

SEQ ID NO: 88835 - DNA, 588 bp, Glycine max
  Peptide Sequence Number=SeqID_205613
atggacaacgacgccaagaggctttacgcaaggtgtcgtccttggagatggaggtggccaaatgaagggatattgctcacgcggtttggagacaggagcgccctaaggttggacgatcatgaactgtccgcacgctacaagggcttccaggaaaagaaaaaagacttgactaacaatgtggaaggcattgcagtggagaggggcaagcttaccaaggttgttgttgatttagaggttcggctaaaggagttggagtccaggttgaaggagtccgagctgcgggcgaccaaggagatggaggccatcaaggagcttgaagaggagttgacaatgtacaagaaagaggccaagttcttcgccaaggatcttgaattgggtcttttttaccctttcaaggacatgaatgacggtttttttcttgatgaagaagaaattgttgtggaggaggaggctgctgatgaggggcggggtgctgaggagcgaggcgatgatgcccaacctggaccttcaacttcggtcgtcataattgttgtgagtgaggagaccaaggggtgccttgggttttgtaaaagtgttcaccaagggtag

SEQ ID NO: 88836 - DNA, 336 bp, Glycine max
  Peptide Sequence Number=SeqID_205614
atgtgcaaggccggggagaaaactttagacctcgatatcattggccacctagtgatgagcaatgagaaaggtcaagaagtcctagttgcaagagggtttgccaatggaggtccctcaaataatgctcggaaaagacatgcaagagaagtcttgactgctgcacatggcagaagaaattatgagtccatcaaaatagtgcctcctcgattgatctttgatgacaaagacatagacatgtcgatcattcgaaatcatgatgatcccctattagtgaaggcttttataaacaacaaggaggaatctcagaatcttatagctgaagttgctctcctataa

SEQ ID NO: 88837 - DNA, 621 bp, Glycine max
  Peptide Sequence Number=SeqID_205615
atgagagaactccacgaattaatttgcggtctccatatagggggacattcccttgcaacaaaggtgctgcatgctggctattactggccaacactcaagacaaacacctttgacttcacaaagagatgcagacgatgccaagagtttgtagacattctacgcacccctcttgacaatcttcatagtctgagctccccttggcccttttccatatgggtaatggatatactggaaccactgcccaaggccccaggagtagtcaaatatttattggtcgtcattgactacttcactaagtgggtagaagtaagaccactatgggaaattatggcaagtgaggtggagaagttcacctggaaacacctcatatgcagaaaacatgagggtagagctcaagacaatagacgaagtctaagacatggccaagatcagggaagaagataccaaactatgagcatcaagaagatacaatacaaaggttcaaccataagcctttcaacctggcgacctcgtatggcgagtctaaggcgaagccaaaaaagatccccgagcgagaaagcttggtcccaactaggaaggctgattcagggtcatagcaagcctagacaacgaagcatataa

SEQ ID NO: 88838 - DNA, 210 bp, Glycine max
  Peptide Sequence Number=SeqID_205616
atgtcctttgaaaacgagaaagccgctacaaataaagtaaagcgcggcaaatggaaagcggataaagataacgtctcgctcatgcttttcgctgaggtttcaagctgccaccatgagttcaaccgccatttcccggcttatccacccctttgtcaaagaccgtttcctgcacgtgctgttgctggccggcgcagcgatgttcgcctttga

SEQ ID NO: 88839 - DNA, 1032 bp, Glycine max
  Peptide Sequence Number=SeqID_205617
atggcttccctgttcgccaaaggggcgttgctcagcgccttatgcgccctgctcgccgcctgcgacgatgccgcctcccgcccgcaaatcgatatcgacggcaagaccatgggcaccttctacagcgttaaagtcagcggtgacgtcgcgatcggcaagcaagaactgcagcggcagatcgacgcggtgctcgaacgggccaacgacgatatctccacctaccgcgccgactcggtgctgtcgcaatttaaccgcagcgccggcctcgaaccgcagccgatcccgcgtggcatggcagacatcgtgctgatggcccagcgcatcggccgcgataccggcggcgccatggacatcaccgtcggcccactggtgaacctgtgggggttcggccccgacaagcacccggtcaaagtgccggaacaggcgcagatcgacgcggcgaagcagcgcaccggcctgcagcacctgaagcttatcagcgacaatcgcggggagtggctgcaaaaagatctgccggatatgtacgtcgatctctcgacgctgggcgaaggctacggcgccgatgaactggtgcgcctgatgaaccgcaacggcattaccaactacctggtgtcggtcggcggcgcggtctcttcacgcggcgtcaacggccagggcaaaccctggcgggtggcgatccaaaagccgaccgaccgtgaaaatgcggtgcaggcgctggtggatctgcacggttacggcatcagcaccgccggaagctaccgcaactacttcgaacaaaacggccagcgctactcccatgtcatcgatccgaccaccggcaggccgatcaaccaccgcctggtttccgccacggtgatcgcccccaccgcgctcgaggccgacggctgggataccggcctgatggtgctgggcacggagaaagcgttgaaacttgccgaagagaaagggctggcggtctacctgatcagcaaaaccgacgacggtttcagcgccgtgatgacgccgcagttcaaggcgtttttggtgcagtga

SEQ ID NO: 88840 - DNA, 183 bp, Glycine max
  Peptide Sequence Number=SeqID_205618
atggagggaggagagagaagagagaaacacatgaaaacagtgaccgagagagggagatgttgcaataatcgtgaacatggaaggcctgccaaagtgagtttgaatccagtgagtcaacctgctcaccacgggtccggactgggctcaccacaggttgacccacttaacccacaaaaattataa

SEQ ID NO: 88841 - DNA, 242 bp, Glycine max
  Peptide Sequence Number=SeqID_205619
ggatttcctgtctgttgtatctctcgttacaatctttcaaagaaatgaacgtggatttgaggcttttagtcctcacgggcaggatcaccttgggctaccttctggagtggagacaaaacacgaacggcagaaaccaatcaaggcacttaaggatgaacgcaagcggggatggggtcacgaccgaccgatcgttgctcttctctgtgcgaagcaagcagggaatgtcgctgcaaggcagcccc

SEQ ID NO: 88842 - DNA, 261 bp, Glycine max
  Peptide Sequence Number=SeqID_205620
atgagtaccttcctcatgtggagtttgcttataataggggggttcaaagaactaccaggtgtagatgattcagatgatgagaggtctacagatttgaggacaaatcctcttcaagagggaggggatgatgcaatcctatcaaggaggggacccatcaccagagctatggctaggagactccaagaagattgggccaaagatgcaagagaagaccctagggttctaatgaactttagcgtagattttgggcccatgggttaa

SEQ ID NO: 88843 - DNA, 447 bp, Glycine max
  Peptide Sequence Number=SeqID_205621
atgaaaggaggaaagtccaagattgaatataagagagctgatcccaaacttgctgtcaataagaagggagccaccaccaaggccaggaaacccattggcaaggggaaggcaatgaaagttcctaacaagccaaagaggcctctgagtgctttctacactagatgcccttatctaatgaaacatttagttcattcagaagatagctttgactccttcttgtctttgattatccatttagataaatcaaaatcaggaagtggcacaaatactaagaaggaaccaccagttccaaaggatggcccaatggcccatattgctgcacaaacatttacatttcgagagcttgtagttgctccaaagaattttaggctagaatgtttattaggcgaaggaggtttcgagcgtgtttacaaaggtcgccttgagagcacagggtggttgctgtaa

SEQ ID NO: 88844 - DNA, 216 bp, Glycine max
  Peptide Sequence Number=SeqID_205622
atggagcatacaagctacaagaacaagatggacagacgcgttcctggtcgcttctccaaaggctcgcaaacccaaggtccacccttggtgagtctcgcttctccaaaggctcgtcaaacccaaggtccacccttggtgagtctcacttctccaaaggctcgtcaaattgaaggtctatccttggaacatagaaaacctaaggtttgccattggtaa

SEQ ID NO: 88845 - DNA, 576 bp, Glycine max
  Peptide Sequence Number=SeqID_205623
atgtcgcgaaacttcacggatagcttaacgatgggtgtcaagttcctcgaagcggtcgagcgaaggttgtatgacatcaaacaatggtccccggacgaaattaggaggaaccgtgacgacgttggggtgttaggccgtaagaagtcaaagggccctctcagccttcgcgctatgaagcagattgctgggttgatgtccagttcgggtcgcccctttgctactgattcacagagtcctccttcaactccattggccgtccaagctactgttgcttctcctactcctccaactccttattccctacttgttcaggaggtttctgtcctcctacctactgcagttatagcatcggttcctttggccgctcctattgtggctcctgcttccaccactgttacgcctttgctcagcgcttgtgtgatgaccacgagtgctccaaagatctcgcctccttcttcttcagcttcaccaattaccatctcaactattttggcatcggtgttgccttcctcctattctcgcccaattgttttcctagatcacgtttatccttctcgtgatattgattcaacgtag

SEQ ID NO: 88846 - DNA, 366 bp, Glycine max
  Peptide Sequence Number=SeqID_205624
atgagcaaagagagaacaacaacagtccatatggccatcggcgatggccaagtctcaaccttctcatcatcctttccatcaaggcagaccacaccctctacgtcgcctccatccttctctccagctacctcccccatatcaagtcatggaccttcgtcatcacacgctctgactcctccccgtcaagctcaaactcttcacaggctcttaaacaaccacatggttgtcacatcgcttggaaggaaaaagaaaaataaggagagaaagaaaggaatggatcattggaaatatccttttaaggtggtcggcagtgttccaagaggaggagaaggaaagaaagagcataggggaagaaagaagggataa

SEQ ID NO: 88847 - DNA, 944 bp, Glycine max
  Peptide Sequence Number=SeqID_205625
atggaacagggtcaatgttggacaaagaagaagaagtactctttgaacagcactagtcttggttcaccaacaaacccttcctatggtgactcatgggaagaacaagcttttgcagaagatgcagctaattctcttggtggctgcatatggcctccaagatcatactcttgtagcttttgcagaagagagttcaggtcagcacaggctctaggtggccacatgaatgttcatagaagggatagagcaagactaaagcaacaaccctctagcccccacaatgaaattctatgccgtcatgaccttgaaactcagctccataataagccagttcatcaaagttcttttgcttctttgggtggttacctatacccctctcctgtttgtggattggcttataaaaaaactaaccctaattctgatcctgattttgttgcttcaccttcttcatcaccctcactttccaaggccttattggctccatcagtgaatattggtaccttcagagaggaaaccatgattccactttatgattcctctattctccacgagatttctcctgcgagtaataattcttctgaatcatggccaaattcagctgaagatcatagattatattcatgtaagttctaccctcaagctgatacaaagaaagcctccaaggaaataatggattctagatatagggataataaggggaataatgatgatattgatggggatatgagcttgaattcagttgtgtatagaacatacccatctttgcagtttgagagtactaaagagccagatcatatcagttgcaagaaaaggaaaacagatgcttcctcaactctattttcctcacagtcaagctcagttgataggcatcacgtgaaaccaaagatgtttgagtttagccctagctcaatagaagagctagatctggagttaaggcttggtaacag

SEQ ID NO: 88848 - DNA, 396 bp, Glycine max
  Peptide Sequence Number=SeqID_205626
atgaatccacgaaaacaatgcaaacaaaaacgaacgcaaaacaaccacaaacctaactggcaagcgcgaagactcacaatcagcgacaaagggaatgcagtcgaggaaagagcaaagtgcgagcagttaaaaaatgctacaaatcgcaaaaatgctaaacttccatccggtgcggtccgtctcattgcatctcaaatgaactcctttatccaacggttcagaaaactcttgcaccgtacaacacttactcaattaacgcttgctagcagtcgtcatgtttctgttagctgctttacatccatcaaacagaatatggagtttctttcaggactaaaaaagcgtgaaccgagcgaaatatatagctatagctatgacatagatagtttgggaaattaa

SEQ ID NO: 88849 - DNA, 528 bp, Glycine max
  Peptide Sequence Number=SeqID_205627
atgagcaccacatcttcaaccgcatcaactgagatgaaaaatggcatcatccgaccaccactgatcatccaatttatcactgccttcaacaatgacaagaataccatacaacttccagcgttctatcatacacaatgggcaccaaactatcctgagtttgttcatctcagatataatggagccatttatgaaatacgagtcagacaacacaaagacaaagtgtatttagcagatggactccaaaacttccggaaagatttgaaaatctatgagtcaaccagcatcaacttttttgcatgtgaccatcactctgtttttgacatacatttcataccaccactggagcggcaaacttgcggcaggcagaggcattcatccagaaagcacatctggactcttcaacttactcaggaaatgttggatgatcctgaacccctgaaactcccacattgtacagaagttcctcttaaagcttgcggtaaccacatgacagtcttaaggcgacatggccccccactgcaatggaaa

SEQ ID NO: 88850 - DNA, 192 bp, Glycine max
  Peptide Sequence Number=SeqID_205628
atgcacgaaacacaatgtggaccactacgggtacatagaatgaatcgaaaagcttggttcgaggggaggtggttgccgcctagctcgcccaggcgagcagggttgcttcctccagaagcaaccgccttctggaggaatattctggagggcccaagtgggcctgggtgctatttgcacccccatttttactaa

SEQ ID NO: 88851 - DNA, 1455 bp, Glycine max
  Peptide Sequence Number=SeqID_205629
atggctgcccagcagcgtttcggtgcggcgcagcaggtcgtcggcctgctcgccgaaggcctggcggatctgctcggccagttcgcattgctcgtcgctttcgtccgcggtggtttcttcggtggcatcggcgctgtccgccttgtccatgccgaccatgcggaatacgttgcggaaggtctgcgagacgaactggcgatgcgccgccagcgtggtttcgaaatcctgcgcgctcatgccgagggcggcggccaatccggcgcgcagcgccgggtcgcccggcaggagatgggtctgttcgtcttcccggtattgcagcgcgtgttcggtgcggcgcaggaaccggtaggcatcctccaggcggcgcgcgtcttgcgccggaaccaggccggcgacgcattcggcgtgcagggcgggcaacagtccgcgttgttgcagtgccggcatgcggccgccgcggatcaactgcgccagttgcaccacgaattcgatttcgcggatgccgccatcgcccagcttgatattgttggcgctgtcgatgccgttgcgggcggaagcccgccgctgccagtcctggcggatgcgctcgcgcagggcgcgcagggcggccaaggcgtcgaagtcgaaatacttgcggtagacgaagggcacgcgcaggctttccagctgacgggcctgggcggcgctgtcgctgccctcgaacgcctgcgccggcatcaggcgcgccttgagccatgcgtagcgttcccattcgcggccctggccgatcagatagtgctccagcgcgtccaggctccaggccagcgggccggcgtcgccgtcgggacgcaggcgcaggtcggtgcggaacacctggccgttggcgtcgacctcggacagcaccggcatcatgcggcgggtcaggcggccatagaactcgtggtggctgatgcggcgcgggccatcggtgtcgccttcctcgccgtacagcatgatcaggtcgatgtcggaggacacgttcagttcggcgccgcccagcttgcccatgcccacgatcagcatttcctggggcaggccggtggccgggtcgcgcggcaccccgtgcacctcggccaattcggcggccacgctgcgataggcggcggccaccgcggcatccgccagcgccgtcatcgcgcccaccacttcctcgagcggcgcctggccggccaggtcgcgcacgatcagcgtgctgaagacccgctcgcgcaatttgcgcagcacctggcggcacaattccaccggcaggatgtccggcgcgccggggccggccagctcggcctgccagtgcgccagccgttcccgcccacgcggccaggtccggatgggcatcgagacggcggcgcaggtggccggaccaggcaagggcgggggcgaacagggcgggcatggacatggcgatcggacgggagacgaatggacgcgtttcaggtataa

SEQ ID NO: 88852 - DNA, 1251 bp, Glycine max
  Peptide Sequence Number=SeqID_205630
atggatcgcgttcatggcgccgcgcaccagcgtgccgcgcatgtcgacgctacccgccgcgctcttgccttccctgcgccactgcccctgcaggcgcacatccagatcgtcattggcgatccgcagttgggccacgtcgatgaaccagtcgtgttcgctggttcccttgatgcgggcgtccagcgccacctcgtcggctcccagctcgggttgttcgaatatgcccggcagcgccacgcgcaattgctcggcatggccaatgaccgacaggttggccgcgccggaactgcgggccagcggcacgcgctcgccgtcgatgaaatcgcccggcacgccctcgatgcggacttgcgcatagccggcgcgcaccgcggtcgcaccaggcgccgccgaccagtccaccccgcgcgtcgccacgtcggccgtgagcgtggtgaacttgccatgatcgagctgcagccaggcgcgggtgctgatgcgtcccttgatcggcggcggcgacagccagggcgcccaggccaggggttcggcgtcatccagcgcggcgtagagctgcccgctccagttggccgggctggcggcattggccgagaacaggctgcgattgaattctccgcgcaggtccactttgcgcgccaacaccggatcgccgtcggcgcgcagcacgaagcgatgcgacaagctgccattgcgcaccagcagatcgacattgttcagcaccagatccggcgcctggcgcaattcgtcctgccagcggatccgggcgccacggatctgcacctcgcgctgcccggtcagccagcgcagcgccggatgattcaggtccgactggtgatcgctggcattcaggtcgatgccctgccccgccacccacaggcggttggcggcgtcgcggcgcaaggtgaggtccggctgctccacccgcaggcgcagcaacgtgggcgacagggtgaacaggctgcgccaggccagcaccgccgacaccgaaggcaggctcaggaccggctccggcacgtcgtcatagacttgcaccgcgctgagttcgagcttggggttcaggccctgccaatccgcccggatggccccgatcgcgacgcgtgcgcccagcgcctggctggcgtaggcttcgatctgggggcgccattggtccacgcgcggcaagacccaatagcgcacgcccaggagcccgatggccacgacgccgtacacggtcagcgccacccagaacaggcagcagaacactttctttga

SEQ ID NO: 88853 - DNA, 692 bp, Glycine max
  Peptide Sequence Number=SeqID_205631
atgaaaggccgatcattattctcttgactcatgctaggattaaggaagcacagggatcatatccggcatccatcagtaattctttcaaggcgtctaaactcatgatcaatgacctcgtgctggaaattcaagaatttagagagagaaaatctaatgtcagtttcttcaaacaggagtttgtttgtgttactgtctccaagattacaactatagtgatggacaactattcatggtgttatctggcttggggtcaatgttataaaaaagctgacatgcaaactgtgccgttcacatgtctgtgtggcaaagagaatgatcaacctgtactaaggtatcgggttgaggtgatggttaatcacaagggtgaacaaaccaaatttttgatctgggatcgtgaaagtgcacagttaattggtcagtcagcggatgaagtcaacaggctcaaaatagaagatagggatgttgatttaaatgcctctcctcaagcactagataagctattgggttgtttccttgcattcaaagtgaaggtgcaaccaaggttcgggaattttgttgttcttaaatattcagatgaatcagacttaatcaatgttgtgctagatatgattctcgatagtgagccatgttgcaagatcgagaattcaatacttgagtcgaccgatcctacagagcttgaatctatgagctaa

SEQ ID NO: 88854 - DNA, 135 bp, Glycine max
  Peptide Sequence Number=SeqID_205632
atggagatgagaaaccaaccttgtatgaagaaaatgtgcgatctgaatcaagagagaacggaggtcgtagtcattgtgagagtatgcaatctgaacgaggacaggcatggctataagaagctaccacgaaggtga

SEQ ID NO: 88855 - DNA, 390 bp, Glycine max
  Peptide Sequence Number=SeqID_205633
atgatggaaccgagttatggttcaaccccgagcgcactaactggctcaccaagcagggcgagtacatcaagacctagccctccgctggttcatcctctagcaaggctagcttttttggttcaaggaatcctccgtcatgtgctcatcttgtccacacggcatcatccccattgccacgtgtctcaatcaaaggcacggaagacatcctcaataagccaaatgccttcgagctctccacgcgctctgacaccatgtacttcatcgtcgattccgagaaggagaaggaggattgggtcaactctattggacgttccattgtccagcactccagattctgagatcgtcgattattataacaacaactcggccaagcgttatgggctactatga

SEQ ID NO: 88856 - DNA, 449 bp, Glycine max
  Peptide Sequence Number=SeqID_205634
atggctccgacaatgatccggaaggtgattgaggtggtgaaggaccagaccagcatacgaatagtcaaggtcgcgagcaacatggcgtcggagatggaggtcacgattgtgaaggcgatgagccacgaagatgaccctgtcagtgacaagtacataagaaagatcttgaacctcatgtctcactcgtgcggctacatccacacatgtgtcaccgccatgtccaagcgattgggtaagatgcgcgaatggattgtgtcgctcaaggcactgatgctcgtgaacaagctcatgaacgagggtccaccattcttccaacaagagatcctctacgccacccgtaagggaaccaagctcctcaacatgtctgatttcagagatgagaggcttgaattgatgttgttcgatagaaaaagcatagtcgccgccgtcaatggtggcagtgatgatag

SEQ ID NO: 88857 - DNA, 2280 bp, Glycine max
  Peptide Sequence Number=SeqID_205635
atgagaaaagagtgtcatcctttgttaaggggagggagaggagataacaaatataaacatggattttctacggctgagatggagtcactgacaagcatatgtgaagttgtgttgcctcctttgcctatggatgctctgaagatcagaaaggaagaccatgatgatgatgattctagcaataagagtcttcagtccttcttggatatttctgcttctcgctatccaatccctcatgagcctggcaactacttattactgtccttgtatgttgccgagatgataactaagagaagtttaattgaaacagtaatactgattagagtggttttatggctgctggcaacaaggttgggcaccttgttgctctgtggtttcctctgtcttggtgaaaattggccctatatcaacaagttctcaaacatatctttggagaaaagagaaaagattatgcagaagtggttgaagcataggttcctcacacccattagactgacctttgcttgcatcaaagtcttgtgcctctttgtttttttctcttgggttgatgaaaatggtgataacccagcatggaaagccattggatatgaggtacctgctgatgagaaaatgaccaacacctccaacactaggccccttgaaaaggggattatagaaaccatgaatgaatctgactccactcttcaacagtctcttgccaataaaggcctcaatgttacactagactccaaaagcaacatcctcaaagtcaaatgtgatgcactagttgttggttcaggttgtggtggaggagttgcagctgctgttctttcaagtgctggtcacaaggtggttgttcttgagaaaggaaactattttactcctcaggattattcatctctagaaggaccttccatgaatcaactatatgaaactggagggatccttgcttctgtggactcaagagtactagttttggcaggatcaacagtgggaggtggctctgctgttaattggtcagcatgcattaaaaccccacacaaggtgttaaaagagtggtctgagagccacaagcttcccttcttttcaagccaagaatatctctctgcaatggaaaatgtgtgtgaaaggattggtgtcacagaaaactgttcacaagagggattccaaaaccaagtgctgagaaaagggtgtcaaaatcttggcctcaaagttgactatgtgccaagaaactcttcagggaatcactactgctcatgtggttatggctgtcctaaaggagagaaacaagggactcaagatacgtggcttgcagatgcagttgaaagagatgcagtaataataacaggatgcaaagctgagaggttcttgttggaaagtaacaggagtggaaatggcagaaagaagaaatgtttaggagtgacggcaaaaacattaaacagcagaatcacaatgaagctacaaattgaggccaaagtgacaatttctgctggtggagcacttttgacaccccctttgttaatctctagtggactaaaaaacaagaacattggtaaaaaccttcatctccaccctgtgctaatgacatggggatacttcccagaatcaaatgattcagaattcaaaggcaaagtctatgagggaggtataataacatcagtccataaagtgccatcaccagactccaattcagattcaagggccataattgaaacccctttgctaggaccagcatcctttgcagcactgtgtccttgggaatcaggacaagacttcaaagaaagaatgctgaattaccctagaacttcacatttgatcacaataataagagacatggcttgtggacaggtaacaacagaaggaaggatcagctacaagctgaatgaagttgacaaggagaacatgaaggctggcttgaaacaagcactgaggattcttatagctgcaggagcagttgaggtaggaacacacagaagtgatggtcaaagacttaagtgtgatggcattggtgaaaatgaagtgcaagagtttttggacagtgtatgtccaatggagggggcactttcaccaggtgagaaatggaacatatatagttctgcacatcaaatggggagctgcagaatgggggtcagtgaaaaagaaggtgcagttgatgaaaatggggagacatgggaggctgaagggttgtttgtttgtgatgctagtgtgcttccaagtgctgttggtgtcaatcccatgatcacagttcaatcaactgcatactgcatctctaatagaatagtagattatcttagaagggattaa

SEQ ID NO: 88858 - DNA, 1290 bp, Glycine max
  Peptide Sequence Number=SeqID_205636
atgtgggtcgaaagacatgaaaacatttgcgtcaaagcaaaggccagtgccacgcctaacagggcatcaagggaaaccaagactctaggccaggaactagcaggtcatcgtcatgtgtctggctcaaacgttaaagaagtgctactgggaggcaacctagtatcctttgagtttatgcttattaattattcagctattttttctgaggttacagtcgaccccaagccaccatttttgtgcttttgcttccattttggtactcttgttcactccccacaagtgatggctccgaagaagctcaccacaaagaggcctagaaaggacacccttggggaaggctcctgtgccatccaggattttgatattcaccgattccggagcgccgagcaccaacagcgtttcgaggccatcaaaggatggcgacggactcagctcatatcacctatggctaagttcaatcccgaaatagtcatggaattctacaccaacgactggcccaccgaagaaggtatccgtgacatgcactcgtgggtaaggggccaatgggttccttttgacacagatgccatcaaccagttcttggaccacccgctgatcctagaagagggtcagcaatacgagtataggcagtggagggaccaggctaacggattcaacgaggaggccatcgcccaattgctgtgtacaccagggcaggatttcgctcgaactgccgcagggaggcgggtgcggatcatgtgcacgagcatgaccaccctgacccagatgtggatgacgttgctgctcaacaatgtcctccctagtgaccataactctaaccttcccctgccgaagtatcaactagtgtatgccatccttgcagggattagcgttcatgtggctcagctgatcgtagacgccatttatatttttgcaggtatggctcccacgagatatcccttggacccggagaagtccaacagggccctggggtttccggccctcatcacgggcctcttccagttctacggagtgcccgttacacctagcaaggcagcagacgcaccaccaccacctcggtcggccgcttcagctaggccactgagcgaggagcattacctacatcatgtggtccgccagcaagcggccaaccaccatggacaggtgcagttacacgagtgcctctaccacctcatcctcagccagcagggagtaggacccgcaggggcccccgaagttgaggatgaggcccaagaagatgaggacatggctgacctgtttgacctcttggcaggaggcggggccatgtga

SEQ ID NO: 88859 - DNA, 237 bp, Glycine max
  Peptide Sequence Number=SeqID_205637
atgggagttagagttagtggtcacaaattaatgagggaattcaattgctttcatagctcctttcagttatgcctattcagccttgcaaaggtatcccattatttggtcccccctggaattggtaaaacaatgcttgcaaagaaaatgttaactttttacgatggtgcaaaaaccatcgttgcaagtgcattgccatattacgacatcggctttaaaggcgattcaaaaccatcgtga

SEQ ID NO: 88860 - DNA, 621 bp, Glycine max
  Peptide Sequence Number=SeqID_205638
atgaagataattgaggaaagcatgttaatccaagatagaatcgcacttagcgcgagtcacgtgctaagcacaaggattaccaccattctcgctaagcgcaacaagcgcgctcagtgcaaaggctgtggagcaaaaatatggttgcacttgttcaatggaaatagcttgcgaacatgggaagaggtggtggagaagttcttgaagaagtattttttagagtccaagactattgaagggaaggttgttcctaacagaatgactcttcaacttgtggatcgctcccttatcataccatatggtgtagttgaagatgtcctgaccattcatgcttactacaaaatgtgttgtgggcataggaaatggcgacttagagataagtgtggaggactagaaagccatcttcaactttctgtgtttctagaagaagatgaagtcaagccagttgcaaatctagcagaccctttaagtgtcttcccggagccaaggtggggtagggcccgagccactctagacgatccacctacggtgatccctcctctagctacaaccgacaagccttctccctcttcctctcagccggagcagctcctccccatgctacaaagcctccaccatggctag

SEQ ID NO: 88861 - DNA, 732 bp, Glycine max
  Peptide Sequence Number=SeqID_205639
atgttactcgaaatcaatcatgtcaccaaggattacgccaatcaccgtgcattggacgatgtttccattcagattccaaaaggaaagatttttggcttattgggaccaaacggagctggtaaaacatccctgatccgaattatcaaccagattacagccccagattcgggtgaaatctggtttaatggcgaaactttgggaccacagcatattgcacagattggctatttacccgaagaacggggtttatacaagaaaatgaaaatcggtgaccaaatgctctatctcgcccagctcaaagggctttccaagaaagaagcgctactacgcatccacgactggtgcgagcgcctcgatattttatcctggtgggataagaaaatagaagatctcagtaaaggcatgcagcagaaagtacaatttgtcgctacagtcattcaccagccacagttaatcatcctggatgaacctttttccggatttgaccccgtcaatgccaatatcatcaaagaacagattctccggttgaaccaggaaggtgcaaccattatcttttctacacaccgtatggagactgttgaagaactttgcgacaacatcgcactcatcaaccgatcaaaaaaaatattggacggttcgctcaatcaattgatcgagatcgttccttccatgtcagatatcttcattcagaaagttactcaagtctcacctctatctcaaaaccatgcataa

SEQ ID NO: 88862 - DNA, 265 bp, Glycine max
  Peptide Sequence Number=SeqID_205640
atgcaacgcgtattgagaggaggcgctatgagcaaagtcaggtttaaacgcagtgaattaccgccgctcaccgacaagcaacaggcggagctggatgctttgagccggaaacaggacagcgacatccagtgtgatgatattgcgccgttagacgacagtttctggcaggctgccgaacgggggcgtttttaccgcccggtaaaaacccaggcttcgatcagaatcgatgcggatattcttgagtggttaaaggcgcctggcaaag

SEQ ID NO: 88863 - DNA, 432 bp, Glycine max
  Peptide Sequence Number=SeqID_205641
atgggttttggaggcaaattgttagtatggatgtgcaatttgttgcaatcttcatctatatttggtcttgtcaatggaagtcccacagaggaatttttagctcaaaaaggtcttcgccaaggagacctactagcaccttttctcttcttggtggtggcagaaggtttatgtagattggtgagagaagccaaagctagaggacctttccccatcattgacatagggaatgggaacttaaaaattccatttctccaatttgggacgatgccattttttcttcttcaaagaggacatgatggaaaccatcaccttaaaaatcttgcaaaggtcttgaattgcactgtcatgacggtttcctttgcttacatggtcctaccagtaggggtgatgcttggaagattagtacatggcaaccaattactgacaagatga

SEQ ID NO: 88864 - DNA, 255 bp, Glycine max
  Peptide Sequence Number=SeqID_205642
atgttacacctttccaacccgaaaaagaagtcattatcactacatggtggtgccctcattagtgttgcatatttggccgttatagtaaacacaaacatatgcagttgggtgacacatagtgatcttcattgtgcagtcacatgcactggtaaatggcatgtgagtctgaccagcacatggcctcgagatgcaataagggtcagtgtggcattcactatgcagtcacatgcattggtaatttgcatgcaagcctga

SEQ ID NO: 88865 - DNA, 162 bp, Glycine max
  Peptide Sequence Number=SeqID_205643
atgtcgtgtttatgtttgcgtctacttagggtgctgttttggcacttaaagcacatgcaaggcgccaatggtggtggcgcaatccggcaagctgtgacatgtgaccttggtgtcgccagcgagagtggcgacttagcttttatgttggtgtcgccatcttag

SEQ ID NO: 88866 - DNA, 429 bp, Glycine max
  Peptide Sequence Number=SeqID_205644
atggagaggaaaattgtctactttgatcaccaacaccaaactaggatttgggtctctcttggagaagaagaagagaagagaaagagtttcccttgcaaatggaaaatcttaatagtgaggattaagaaagggtttatgaggaaaattgccctaaccagtgcacttttgaaaacttattccccaaatggggttgttttaaaacttattgcacagggagggagaggcgccattggtgcttgcgcgttgcaggttgcaagggaaaaaaatttggccgttataaatggtgcatcctccactccagtgctccttcactcctcttacttcctctttcatcgtccttcttgcttgcttcttgagctagcttccttgcttccatcctttgcttgttcgtccttcctacttggcttcgttgctgttgctaattggtaa

SEQ ID NO: 88867 - DNA, 645 bp, Glycine max
  Peptide Sequence Number=SeqID_205645
atggaagccaagtctatcgctgaggtttacaaggaggttgctgcacttttccaggaccatgtggatcttcttagggagtttactcattttcttcctgatacttcaggaacagccaacaattctctccttcacgataggacaacaattaggcaaatgcatgttgaaaagttggtcactaagctgacacttaacctatctttacgccagaaagaaaggaacatagcttcacatggtgatcgtgatctcggtgctgaccatcctgatccagaacttgacagatgtttgattagggctgataaggatcagaggaggcgtgatgagaaggaaaaggacagtagagattatgatcatgatggtatatctcacaagcggaaatctggttgtagggctgaagactctggagctgaaccattgcatgatactgatgaaaattttggcatgcaccgtatttcatatgcttgtgaggacaaaagttctttgaaaagtatgtatagtccagtgcttggttaccttgacaaagtgaaggataaattacgaaatcctgaggattaccaggaatttttgaagtgcctaaatatctacagcaaggaaataattgcccgacacgagttgcaatcattggtatggtttatacatttaatttaa

SEQ ID NO: 88868 - DNA, 168 bp, Glycine max
  Peptide Sequence Number=SeqID_205646
atgacgagtggcggtggtcagaaactaaccacaaatgatgccttggcatatctcagggcagtaaaggacatttttcaagataagagggaaaagtatgatgactttctggaagtcatgaaggatttcaaggctcaaaggtgtcatagcaagagtgaaggagctgtttaa

SEQ ID NO: 88869 - DNA, 120 bp, Glycine max
  Peptide Sequence Number=SeqID_205647
atgacacatggccgaccaataggcgaccaagtccaaggccaaaggacgcacctagttgctcatgatcctgggaatttaaataaaacaagcgcaagctcggaaggtagcaagataccttag

SEQ ID NO: 88870 - DNA, 510 bp, Glycine max
  Peptide Sequence Number=SeqID_205648
atgtttctgaaaatcaagattggaatgctcgtttatttgcccaggattggtttcgagaatcacaagaggggttcaacaaatcagacttgccaagtcaatgcacttatagatataaggtgtacattgaaggttctgcttggtcagcacatcaaattggcaaggtgcatggccagtgatttcattcaagaagaggtaaagatggactacgtgtacgactacatttttcatctcctgaattcatatgctaaactcttcagatacaaaccctccataagtgctaatgctacagaactatgtgtggagtcaatggtttgtggagcagaaggatcagtaaagaaatttatgatggaatcattggtcaaggttcctgcaaataccgacccttgcaccatgcctgccccttttgatcctccaactttgtattcaacattacagagaaaggaaagctcaattcaacaagttgaatcatttgagaaaagttgttgggataatcaaaccataacatcttaa

SEQ ID NO: 88871 - DNA, 156 bp, Glycine max
  Peptide Sequence Number=SeqID_205649
atgcctaaaattattacacataaatggaagtttggtaacctattggaggctcccaacacacttccaatgaaaagcctttttgttacaaaacttgaaagcaatgaagtgcttcttagtccaatagctcttaaggtggtttggccccttgcttcttga

SEQ ID NO: 88872 - DNA, 1139 bp, Glycine max
  Peptide Sequence Number=SeqID_205650
atgcacgatttcttggttgaaaacaaggacgtcaatcttggcgatgtcgcctacacgctacaggtgggccgccagccgtttgcgcacagcacggtcgtcgtagggcaggatcgtgaaacgttactggagaaattgaaccagccgtccgccaatatttcaacgttgacgaaaggcgataaggccgtggtgtttatgttccccggccagggcaaccaatacatcaatatggcccgtgagctgtacgccacttacccgaaattccgcgaagtgatggatcgctgctgtcgctatttggacccgatcttgggcgtaaatttattgtcgataattttccaaggcgacgaaggattaagaaaaaaccgtattaatgaaacccagtttacgcagcctgcgctatttattgtcgaatacagtctggcgcaattatggatgtcgtgggggatcaaacccgatgccatgataggccacagcgttggcgaatatgtcgcagcgtgtattgccggcgtgttctccctggaagatgcgctgcgcgcggtggcgttacgcggcaaactggtacaagcgctgccggctggcgcaatgcttgccgtgctgatggatgaagagtcgctgcgtcagcggttacagggcgacaaattggagattgccgccgtcaattacccggggctctgcgtggtcgccggcgatttggatgagattgaggtatttcaacggcagcttgaagacaacaatgtgttttgcaagcatctggatacctcccatggcttccattcatacatgatggaaccggcattgccagcttttaaagaggtcatcgacggcattgaattgcacgccccaaaaatcccattcgtctctacggtgagtggcgattggataaccgatgcgctagctactgacagcgattattgggtgagacatgtgcgcaatccagtgctgttctctcacgcattcaaaacgttgatgtctgaagaacatcagcattatatcttcctggaagtggggccaggccgttctcttgaatcggccgcgaagcagcatttcaaggcggatgaaagcgcgttgatttactcttcgctgcctaccgcgaaggatgtggaattgacgggagaatatttacttacctcgctgggatgcct

SEQ ID NO: 88873 - DNA, 213 bp, Glycine max
  Peptide Sequence Number=SeqID_205651
atggcggctaagtccaccaaaccgtccacgttcggaaagaggacaaccccaaaaatcaataaagctagtatatccgcaaacgggccccacttctcttggctcgccatatcccttgccttgccttccaagtatttccgagctgcaatcttgctcaaggaaggaagaaagccggagaaaaaatacggttttctcccccccaagagggcatcctag

SEQ ID NO: 88874 - DNA, 324 bp, Glycine max
  Peptide Sequence Number=SeqID_205652
atgctgatagcggcaattgtaaccgcattggcttccattatcttcttcatgctcatcatggccttcatcattgtggccattttctctttcatggtctccatatcggccttcaccttctcttgcacctcctctgctttacccattactctagctctagcacagattttcaacatggtccatgacatcttcgtcaaggtgaaactggaagtaacagggacatcgacagccctaaatgtgtttggcagtagacgaagcagcgatgtaacccgatccatcttttgccccaattttttgcaagatggttacttccatacttcaacttga

SEQ ID NO: 88875 - DNA, 243 bp, Glycine max
  Peptide Sequence Number=SeqID_205653
atgtctggacctgagcgtaaggctagctttgagcactctaatatcttcaaagtaacagcaccggaggcacgacccggccagttaaggacaggagcgcatcgccggcagaagggacgagccgaccggtgcacaccggaggcggaccgatcgacccaacccaaggattgggtaatttgcgcgcctgctgccttccttggatgtggtagccgtttctcaggctccctctccggaatcgaaccctaa

SEQ ID NO: 88876 - DNA, 465 bp, Glycine max
  Peptide Sequence Number=SeqID_205654
atggataactcagaatctctttttcactctgaaaattataatggacatctgctgcatcagccattcatagatgcaggtcagcaatatttttttcaatctctacaattgaaaaatgatggtgatgcttacacagtgttaatgtgcaatgagcaatactcgtgtgttgatcctgtagaattattatgtaacatcaatagaatactagatggtatactcaacctgcttcaatctactattactcctactcatgatgcaattttgtattacaaagggaagtggaacataccacgccaaggtgggtttttgggttactccttcactagaacaaatccaataagatttgacatttcttccggatgtagcatggacaaactcaaggatatactcaagcaagatgcacctatgggggttttcccctatggaattcacgaatcacaggtggtcaaacgattgttctttcgataa

SEQ ID NO: 88877 - DNA, 841 bp, Glycine max
  Peptide Sequence Number=SeqID_205655
gatccccgacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagtaccaaggaagtgtttggaggaaagggaaaaggccttggcaaatcaaggcgaatgggctttcttttattgacatcttggcacttttgatctttagagttgtcctctttccaaatatggaagggttagtggacctagcagcgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcacacctttttctccaagaaggtaggcccgtctatccgctacaaggtcaccgctcgtgcgtcgaaaaaggaaaggcgaattgggaccaactcttggctagcatggaggggcgtctattaattggttccctcgctagaaggaaggaagaatcaggattctatcttcatgcgaaggataagtgccatcagacgaaagcatcacgcctttcatcgcacggggtttcagtgaccacaacgcgagggtactccaaggagttcgcaaggcatgggatgcggcgtgaagaaaggacagatagcttaggggaagcagtaatgggagcatcggcggctatcataagtggctga

SEQ ID NO: 88878 - DNA, 168 bp, Glycine max
  Peptide Sequence Number=SeqID_205656
gggcactaccagtcgcgcccacgcgctgggcactaccagtcgcgcccagcagcagggcgctaccagacgcgcccgcgtcaggggcgctaccctgctgctgtctcgtgcgtcgcgctgtgtcacgtgtcgcgtgctccatggaagcgccttcctgggggcgctttgtaa

SEQ ID NO: 88879 - DNA, 780 bp, Glycine max
  Peptide Sequence Number=SeqID_205657
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccactgggaggaaggaagccgtatcttttctctgggttctatccctccacgacaagagttgccaagtcagagtaccaaggaagtgtttggaggaaagggcaaaggccttggaaaatcaaggcgaatggatgtccaaatgttcccttgatgggaacaagggaggaaggaagaatcaggattctatcttcatgcgaaggatgtccaaatgttcccttgatgggaacaagggtgaccacaacacgagggtactccaaggagttcgcaaggcatgggatgcagcgtgaagaaaggacagagagcttaggggaagcaactgtgagagacgatgaggttaaagcttcggaagaaagtgatgaggtacaagccctaaaggcagagcttgaaagagcctgggtagtcgaagagaagttcaaggtagcaatagtgagctcaagctccgaagaggtgaaaggaatcatcacgggtcaagggcatgatcttgaaaggacgagctaa

SEQ ID NO: 88880 - DNA, 222 bp, Glycine max
  Peptide Sequence Number=SeqID_205658
atggtcaaactacccatcatatctcctaaacacccaatacccatgaaatcatgtgagaaagaagtctacccaaacatgaaatttgaagttccacaacgtagaggtgcgcttcacgactccgaaaattgcttcctttcgcgatttggagcagaaatggtgtgcaaaggttggagctttgatggagcttcaatggtgaggaagatgaagggaatagcaacgtga

SEQ ID NO: 88881 - DNA, 231 bp, Glycine max
  Peptide Sequence Number=SeqID_205659
atggtcataagttttcactcggatgtccgattcaggattgaggcccatgatatatcgagaggctcaaaattgaaaaatggtagttctcaagaaattcaaatcgtgataacatttcactcagatgttcgattcaggcacataatatatcgagacgctccaaatgaacacgaaggctctggtccaattcagacagccgtaacttttgacatggattacaattgtggccgatga

SEQ ID NO: 88882 - DNA, 183 bp, Glycine max
  Peptide Sequence Number=SeqID_205660
atgcggatgagcgccactcgatgtttccatttgcctgcatgcctttggtattgtggggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 88883 - DNA, 222 bp, Glycine max
  Peptide Sequence Number=SeqID_205661
atgaagcaggctggcgtcggcgaggcgattattgatggcgtcggtgtgggtatcggtggaatacaaatgctgggacatgacctgcagggcaaccggcttgtcaccccgttagctattgaggcgaaggggagccgctacgtggcgttaattgcgcctgacgtggataaatcatcctcgctaaaccgcttcgtcgcatggctggaacgggaagcatccgcttaa

SEQ ID NO: 88884 - DNA, 783 bp, Glycine max
  Peptide Sequence Number=SeqID_205662
ctgctggcggtgatccccggctggagcctgtatcaggacaagcaggtcagcttctcggcgggctgcatcaaagagaaccgtctcaccgcgccgctcggttcggcctccaccaacgattactacgcgcgcgccgaacagcagcgtcatttctggcgtgactggcacgatggccagcagtgggatcgcgtgcagagcgaactgctgcaacgttaccaggcgcagtttggtgagtcggtaaaatattacgccatcgatcagggcaactggccgccgatggcgatttcgcagcactggcataacggcgtgtggtatttcttcacgctcggcatgagtatccggccgatgccgcaggtggattacctgtttgacgagctggcaccgcagtaccggcgtgtagagctggcgatggcggtggatggcgaagtgatgaccgaggccaacgcggtgcagatggccagcgcgctggcggagtttgctcatctgccgtgggcgcggctgacgtggattggcgaagggcacacgctggcgtcggaagttgcgccggtcggctttgaaagcttcctgctggccaacgggctggcgggcgaaaacgcgcaactgcggttgccgaagcgcgacggcgatcggccaaatctgctgtgggcgacgccgatcaccgaagccgagcggctgtttgcccaggcggacgatcgcggcggccagcagctgctgcagcgtttgctggcgcagggcagcgatcatgtgttccgtccgcgccaggaagtggtggagtccgcaccgtag

SEQ ID NO: 88885 - DNA, 360 bp, Glycine max
  Peptide Sequence Number=SeqID_205663
atgttttctaaaatcttatcacccttaccgacgattgaaaaagcttttaatggaagtcaagagcatgaaagtgcgtcgataccgttaactagtcagcaagttcttgagcaggttgaggacatcaatacgatatttggaaagacccaaaagaaggaaaaaagtaaaacttgcatatggaagaagaggtcgatatcgtttgatctttcatattggttcgatctagatgttaaacattgtattgatgttatgcatgtggagaaaaatgtgtgtgataatgtcatcagcgtgcttcttaaaattcaacgcaagacaaagtatggtttgaatacctgtcaagatctagttgagatgggtatatga

SEQ ID NO: 88886 - DNA, 918 bp, Glycine max
  Peptide Sequence Number=SeqID_205664
atgggcgatgtcggtggtgccgccgccgatatcgacgatcaccgcctggtgccgctcgcggctttcggcgtggtaatgcatggccgccgcggccggttcctcgaggaaatcgatctggtcgaagccggcctgggtggcggcctcgcgcaggatgtccagcgcctggtcgttgccggccgcaccgatcgaactgcggaactgcaccggacggccaagcagggccgagcgcaacggttggccgagctgggcgctggcggtcaggcggatgtgttcgagaatgtgcgcggcgataccggtgatggtctgcttcgcacgcgggtgcaggttgtagcccagcatcgacttcgggctctgcaccaggttgccttcgtgttcctcgaaataggcttccagcgcgtcatcgccgtagaccgcgttctgcagcaggtcgctggcgctgcgttccttgccggcgcgggcttccatccattcccggcgcagcgcgcgcagggcttcgcggcgcagtgcctgtggcgtgcgttcctggccggcggcacgggctgcgcgcgcggcgctgtcgatcatctgctgcagctggtgttcctggccgtcatcgagctggaagtcgtccggatcgggcaccacgccggggaaatacacgctggtgcggaactgctcggcatcgccgaagcggatcggcagcagttttccctcatgcacgatggcggcggcggagttgctggtaccgaagtcgatgccgaggcgcatggggagttccgggggcgatcaggggccgcgcactctgttgcagttcgccgccgactgcaagttccagcgggcgtgctgttctggtccgggtccagtgggcagcccggagcccgcccggaaaagggccggggaagccggccggttacaatggcggctgttgattcactttga

SEQ ID NO: 88887 - DNA, 183 bp, Glycine max
  Peptide Sequence Number=SeqID_205665
atggcggaaatgcggtgttgggctgatccaacccaaccctacccgataacatattgcaaaagtgcagcacacaatagggagaacgcccagaacacagcacgcacaaaacacagcacacaacggcgaccagcagcgataaatggcagtgacacccgcacccgcacgcgaccagcagcacaatga

SEQ ID NO: 88888 - DNA, 783 bp, Glycine max
  Peptide Sequence Number=SeqID_205666
atgagggcaaagatattagagaatatcataatcatgtctagactcttacgatctttttctcgcatctcttttcgctcaaactcctcctcatcatcttcttcaagaaactctaatctattaaatgatcaagacaaccagacccaagaggtcgccccaaaacacaatctcttcgatgaggaagtccgattcaaagatatcaatcaaaacatggatgactggaacattccagaaatccctcaggatcaactctacgttcctgaaacaataaaagacaaacacaactttgattacataatcaaaacagtagaaaacaatattcctctaggacaagatgtaggggaagaatttcatttactttcaaaaaattcaatttatgaacatagccgtaagtataaatatctacacatcggttgtgtacaagtagccatcaagcccttaattgatatgggcatagatgcagcagttttaatgtgtctaagagacattaggcataatcaatttgaagactccctaattggaacagtcgaaaccagcctaggacaaggtccaatatattttaactgttatccaaacaaaacagtgagtctgatggacagaaacattcttgactctctgttcttaaatatccactttcatggccttgacatgaaagaaggatcaatcccagcagccttaatatataggatccagtataagatcatgaatacttgtgcatctagagtcctgttaaaacctcaaaaaggagaaacaactttgtttatcactgatatgatgaaggctaac

SEQ ID NO: 88889 - DNA, 334 bp, Glycine max
  Peptide Sequence Number=SeqID_205667
aatttgctaagcgcaaccttcagtggctaagcgcgaggaagcatccagaagaagatgagttgtcaagtttgctaagcgcaccactccagatatgcgctaagcgcacgagcacgaacaaggccacctatttaagcttgaaatcagatttgcaaggggagtttggcacttttcttgagaagctctgcatgcacaaaggttctagagagagaaagcctagaggcgaaggagacatcctcaccacttgtgtttttgcagtctttcatcttgttcttctctttgttgtaaaggaggtttctggactatggaaagctaaatcctctgttggatcttccct

SEQ ID NO: 88890 - DNA, 420 bp, Glycine max
  Peptide Sequence Number=SeqID_205668
atggaggccatgaaagaccaaatgaccaccatgatggaggctatgatgagtatgagaaaaatgatggaggtcaacacgactgcagtcactgccacaagtactgccactgaggtggactcgactcacccagtcctggatatggtaggtcagggaggtgaagcgttgggaagtacgggtggcccccattttgtgcaagtccagagcaagcatccctttctaccatatggcttgcctcccaactatgcatcaccaaatgttgcacacacgctcgataagaatgtcaacaactctgctcccatacacctgccaaacaccttggggtcccttagtatcgcccacaaccacaactacaacccttatattttgtggtgggaagactacctcctgtcatggtggaaagggaaaaattcaatgatatag

SEQ ID NO: 88891 - DNA, 327 bp, Glycine max
  Peptide Sequence Number=SeqID_205669
atggagaacgagcaatttccgattgaacagacttggagatcaactcaggagcacaggtcacttgagcaaacaaccgatgaattatattcacattccagtgaaaggtcatacaatgctcaatggaatgccctagaaatcccccatgataagcacatgttgcattcgagttgtatcctcgggaaaatggaggcaggctttgtggctgatttaggggtggcctttgtggatgattgggtgttcttggctgatagggtggtgggtaatgagaatggctggtattggttgagtattgatattgttgagctggtgggaaatatggccatgtag

SEQ ID NO: 88892 - DNA, 756 bp, Glycine max
  Peptide Sequence Number=SeqID_205670
ggaggtcacgttcctttgcaatcatcttgtgaagactttagagcatggtctgatagttgcatgctaactcatctgccaacttatgacgctcaatacacatggactaatggcaggagaggttcttcttgtattgacatgcgtcttgatagatctattggcaatgacgagtgccttgcttttttgcaatctatagcctattgtaccttaaccaaattacactttgatcatcatcggctgctggcgtgttgtctcggaggtttggcagcaacagttttttggatgtcctatctcggttcttggcagaggttaaaagctttgaagttagctcaaaaatcatggaatcatacagtttttggtgatgtccacaataatctcaataaggtcctggtagatgttgattccattcagcgtttgattgagtccaacccagatgatgacgcattaagagaccaagagattaatgctcaaatgggggtggttcaattctttaacagtggtcatatctttcccaactggaattctaatcttgttgtcttgatacccaaggtgtcagattgtttatgcactgcatctgaggctgtcaatatgcttcgttataaggcttttcgtggtaatctcatgatgaagtttgatgatgttcttagttggggaatctctttgctagttaaaaagggtgttcttcagccattaacaggccccaaggggactcaaactccaagctattctttatttgcagatgacataacggtttattga

SEQ ID NO: 88893 - DNA, 579 bp, Glycine max
  Peptide Sequence Number=SeqID_205671
atggcaaattggttgcgcattcctcaatctttgcagcaattatatccgactttgatgaatgaaattcagcaggtagttattcccatctcgcagctggaagaccaaattgtgtggtgtcctgcgacttcaggcatggtgacagtctctagatgtgattattgtaaagctcatttagaatcttctgagcatctcttcttgacttgtccttttgcaaagcacatttggcaatggctaagtcagacttttcgtaaacctcctgatctttcttcacctaaggatcttattgcttcgatctctcattccataagtaggcaagctcagaacgtgatgatttcagctattataaaatccctgtgctttttgtggagaacccaaaatcttgctcgatttcataatggcagcagatctatgcagtttaatatctccctcatttatgatgaagggaatgtatgtgttgatagattagccaatctcgatttaactgtatctggttttaattggcggaactcaatccctattgtaattaaagaacaattctatagggatagactaggacttcctagttataagtttgattag

SEQ ID NO: 88894 - DNA, 720 bp, Glycine max
  Peptide Sequence Number=SeqID_205672
atggcagggtttgccaccatgaaaggtgttggaaactatggtgcggtgaatggaagtaatggtgaacttagtccatgcattaacagattgaagaaccaggttagcttctcaccaagaaatgcttcttccctgggaatgttgtcgcagatctctgaattagggagtgaagacattgaggcaactagtcctgatgatgatactaaacatggaggtaatgatactcaacattatggccccggattcccctttggttcttggaatgatactccacaactctcagaaaatatcagtggcttgaaaagagggagaagtggcaatgaaaagatgttttctgatgttcagaatggagagctagcaaaccaagttaatatgttatcacatcacttgagtttaccaaaaacttcagcagagatgattactatggagaagttgcttcagttccctgattctgttccttgtaaaatcagagcaaagcgaggctgtgctactcatcctcgaagcattgctgaaagggtgagaagaactcggatcagtgaaagaatgaggaaattacaagagcttgtcccacacatggataagcaaaccaacacagcagacatgttggacttggctgttgaatacattaaagatcttcagaaacaattcaagactctaagtgaaaaaagggcaaactgcaagtgtataagcatgccaaaggcagatacaaatcaaattgcttga

SEQ ID NO: 88895 - DNA, 330 bp, Glycine max
  Peptide Sequence Number=SeqID_205673
atggtgggggcctatggcttgggagacctaagtccgcagcaagtagggtatacgcccacacttggggggcaaagtagctatatgccttcctatgagccgccacatacacatacaattgccttaacggttggtagacaagttcatactacccctagtatgggaaactctggtcctacatggacggatgctaggacaactgctcctacaactattgatcccaatgtaatagccgacgtaattcagaagtattttggggtgcaattgaagcctattgtcaaacctatgtacaagaagccataccctaaatgggtccacaaaatgacaccttaa

SEQ ID NO: 88896 - DNA, 255 bp, Glycine max
  Peptide Sequence Number=SeqID_205674
atgcttccatttgatttccggtgtgtcacggaaacttacggattgtgcatcaatatatttttttggttttccggcatgtcctggaatttcacaaattgcctaatgatgggtgccaagcacctcacaaggaccaaagaaaggtcgcatgtcatcaagcaaaggtccccggacgaaattaggaggaaaatgcaaggatcatgcatgcaaacttgtgaaaatagaatgtatgcagttggcagaacaacaacatgctaa

SEQ ID NO: 88897 - DNA, 453 bp, Glycine max
  Peptide Sequence Number=SeqID_205675
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaaagacacatgaaattccccaccacaatctagccgacttcgagccttggctcgaatatgccactgaagggcaagtagttggtggtataccccttgaaaacacttcggaaggccctcagtatcacccccaaccacaaccctcatgttccacagcggttaaaaaccctcatgactatggcaggaatgggaaaggtggatcatctaaaggaaaggctcagggccattga

SEQ ID NO: 88898 - DNA, 330 bp, Glycine max
  Peptide Sequence Number=SeqID_205676
atggattggttttttcggatattgcacccattcgtcacgcggaccgaggagactgctgcgccgagacatccgcctccccttcatcataaggagttcgtcaagccacccatccccgaggtttcagtcgcgaccgatctccctacgcattcagtggttcactgcgaaggatgtcaggggatggctcaagatttaggagcgattgttgaggatttggagcgggtcatcaacctcaggatggtcactgagggcactgacttacatgacatcatgactcgttgtctgaggagagctagaggtgacaccgcagatggaagtcttaggccgcgctag

SEQ ID NO: 88899 - DNA, 237 bp, Glycine max
  Peptide Sequence Number=SeqID_205677
atgtgtgttccatcgactctgccttcttcgtcttcaacagcttctatggccgacattgctataatgacaaggttcctcttgctcagacgtccgactgattggggccccattttggaggactacactagtgatgacaacgaggaggaggatccttctgaggatttaagcaatgtaaaggagtcatcaggaatcaaggaggacccatctgaggattcttcttttttccttgaggcatag

SEQ ID NO: 88900 - DNA, 429 bp, Glycine max
  Peptide Sequence Number=SeqID_205678
atggcaattcacattgaggcaatccctggtgttgaggaacagacaatgaacgagaatgaaagaaatgttgccaaaaagaagcgttcaaagtatataaattttcctattgattccttgggaatatctaaacttgaaaacaagataaagtgtatcctattggggaaaaaaaacaagaatgctcagtacaagtatgacgaaggtgccaccttgattgttgatcataaggaggataggtttcatccaacaatagaagtctctaatccaacgtgggactactctgttgatgaacctcatcaacctttagaaaaacttcattcttttcctgaagcaccttctcttggaagtatacaaattggaaaaggcctatatccttggagaatgctaaagggaagggtcatcttatccatattagaaaatgatatgtgttag

SEQ ID NO: 88901 - DNA, 195 bp, Glycine max
  Peptide Sequence Number=SeqID_205679
atgaggcttcactatcatcaagcgagtcggagacccagcaagaccacacatcaacctccacttcctatgtctccattgacccaagatggcgtggcgagattcaagggtgcatcttccaaagaagtaaaacgtgcgggagttgccaccaacgtttattcgaggaaaacgttagaaaaactgaaaaggggtctgtga

SEQ ID NO: 88902 - DNA, 651 bp, Glycine max
  Peptide Sequence Number=SeqID_205680
atgaagaaaacaacaaagcaggcacaaccacaagaacactttcaaacaagaaactctgatcaagcaactcacattcaacaatggacccaagaaaccaaccaaagcctccaaggagaacattgggagactatgccatgtgtggatcatgaggatccatatactcatctatctactttctgtgaactgtgtggcacaatgggcattcttgaaggtgaagaggaggctttgtattttagactattcatattctctttaacagggaaagccaaagcatggctacaatctcatcctaatcaaagtttgatgagctggagcgtagtggaagaaaaattcttgaacagatttttccctccatccaggaatatcagtgcaaagtatgatatttctacattcgggcaaggaccggaagaacctttttgtgaagcctgggagcgattcaaatcattgttgataaaatgtcttaatcatggttttgaagatgttgcccaactaagcatattttgcaatagtctaaggcctgaaactaagatgattatggatgtagttgttggtagaacaatgatgtctgtagatgctgaacaagccacaaggataattgatgcttttgcttcaacggatcacctagctcaacataatagacagttagtgtag

SEQ ID NO: 88903 - DNA, 309 bp, Glycine max
  Peptide Sequence Number=SeqID_205681
atgtcggatatttttagatgtgatttttgtggtggtgaccatccaaatggtcaatgttctctccaagaggaggttaactacatgaccaatcaaggaagactaggcaatttcaattttcagcaaacactcaatcaaatcctaaggagcactacaaggcaattactacaagtggaaggatttttgggaaaggtgttgatgattaatgggctacaaaggaataagtggttggaggcaagttggatgtgggtcttccttatccttatgtgcaaacaaggaaagacaattttctggcttcacggaaatctctaa

SEQ ID NO: 88904 - DNA, 723 bp, Glycine max
  Peptide Sequence Number=SeqID_205682
atgaagatgaacatgaacttaggatcacttatttctagtcagatttcactcattgctcagtctaattcctcgcagcttggattttcaaccctaattactaccttgtttaaggccggaggagtcacctcagattctcttaccttcgagtcactcaactcagccactaatttggcctatattaagaaaaattgctggaacctggatgaaccttcggtcacttttccagggacccaaaaatccagggctagaagatctgaggccccatctacattagctgcccctgctccccctacattagctccatctacttctgctgttccttcaccatcagcagctccagttcttccaggtccctccactcagagctcagagccattcatgtctatgctacagagcctgcatcagggccagctcctgatcatgcagagtttgcaggatatggagcctcagccagaccaggaggatgatattctagaggcctcagagccaactccacttgagcctttcatttttgagactgatccagtagcagctaccccacaagtgacaccagagccttccactatagtattggacatgtcttcttctcagcctgagtcatctgcaccagtaccagacttgcctctttctcaagattcaccatcaggcactactgcactggacctgaatgagcatgccatggactctgcacaggatcatgatttttatttccatgctttttaa

SEQ ID NO: 88905 - DNA, 495 bp, Glycine max
  Peptide Sequence Number=SeqID_205683
atggctagccccaatagtattgttcaagggtctcttccggtctttgatggcaagttatttgataaccggcggatcaaaatgtttgcgatttttggcttccaagatgtggcagaaatattcaataaaatctctaaagccaccacgtcaaaggaagcatgggatattctagagaaaacatatgaagatggagaacagaataagaagattaagctacagacactaagaaggaaatatgaacttctcaccatggaggacaaagaatccgtagcagattactttgacagaattcaagaattggtcaacgcaatgagggcctgcaaggagataatctcatatcaacaagtggtagacaaaatattgagaacttttccaccacgatttcatcatgtagttgttgcaattgaggaatcaaaggacttagacataatgcagattgaagaattgcaacactctcttgaggcgcataagatgaggattgataactgcgaaatctaa

SEQ ID NO: 88906 - DNA, 783 bp, Glycine max
  Peptide Sequence Number=SeqID_205684
atgggtaaagagcatgcacttgtgataagcaatcacagaagtgatattgattggcttgttggatgggtttcagctcagcgttcaggttgtcttggcagcactctagctgtgatgaagaaatcttcaaagtttctgccggtcattggctggtcaatgtggttttctgagtatctttttctggagagaagttgggccaaggatgaaagcacattaaagtcaggcatccagcgactgagtgatttccctcttcccttttggctagctctctttgtagaaggaacgcgttttacacaggccaaactattagctgctcaggaatatgccacttccactggattgcctgttcctagaaatgttttgattccaagaactaagggttttgtttctgcagtaagtcatatgcgctcatttgttcctgccatttatgatgtaacagtagccatccctaagagttcccctgctcctacaatgctaagactcttcaagggacaaccttcagtgatttgcagatccaggaaattgattctaacaagggcagcatgtagatcgttacctgattgggctaaagagcaagaagggaggtttacagatggatttgaggactgtagaagtttcactagtgtgtctatttgttcctttgtgaatgaaaggtctccaggagaagattgctggccttggacttcacttatggctgtagaattttatgggttttttacttctccagcaagatgcccaagctttcctttttcttccactaccagcttcacagtttgtgcttactag

SEQ ID NO: 88907 - DNA, 174 bp, Glycine max
  Peptide Sequence Number=SeqID_205685
atggtgttggtgttgaaagagcagtgggaagcgaaagcagcgaggcgaaggagggacctggagaggagggaagaggagaggaagcgcttcgcaatgagagaggacgccattgaattgagattgcaaaagtgggttaaaaatcgtgaaccgtttgacgtgtctctcagacgttga

SEQ ID NO: 88908 - DNA, 220 bp, Glycine max
  Peptide Sequence Number=SeqID_205686
aattgcactaagcagtcactccgcatggctccaactcgaaggtggaggacacatgatcgaaaacgcatctcatggggctccgaaaaaggcaatcactacgcatggctccaaactcgaaggtggaggacacatgaacgaaaacgcaactcatagggctccgaaaagattgagaatggagaattgcgctaagcagtcacttcgcatggctccaaactcgaag

SEQ ID NO: 88909 - DNA, 378 bp, Glycine max
  Peptide Sequence Number=SeqID_205687
atggattggcaagttcttatttggaaggctgcaaccttcttaaccgctgcagtctccactcctgctaatagtttagcacactctttgttgttactgtggggtcctgaagcacagggagattttaccccgttgtctggttggttctttgctcctagttttggtgtagcagctatatttcgattcatcctctttttccaagggtttcataattggacattaaacccatttcatatgatgggagttgctggtgtctccggcgcggcactactatgcgctattcatggtgccaccgtagaaaatactttatttgaagatggtgatggcgcaaatacattccgtgcttttaacccaacccaagctgaagaaacttattcaatg

SEQ ID NO: 88910 - DNA, 216 bp, Glycine max
  Peptide Sequence Number=SeqID_205688
atgaacaccgaagatattaacaattatatgcagtgtgctctttttgagaaaacaagaaataaagttatagtgaacctatcaactgttaacttcagtgcagtaggattaattgagaagttgaataatgatttgcataagaatgtaagacatgatcctactttgactgtagagatggaacaagattatgaaagtgaagaattagacagccatatataa

SEQ ID NO: 88911 - DNA, 384 bp, Glycine max
  Peptide Sequence Number=SeqID_205689
atggcagcggaatggagaaggaagagagagaggagacgcctcttcaaggagaagatgagtctagaagaagctcaccaccataggaggccatggataagagcttggaggaagaaggagatgaatgaagggagggggagagaagagcatgaaattttgtgctctaaaagagctctgaaatctgaatctaatatttacaaagataactggacccaaccttggcccgtgggctcagaaatctaccatgaggttcatgagaaccctagggccttcttcagcagctctagcctaatcctcttggagcctcttgctcatggctctagtgactggtcccttcctagggaggattgcatcagatatactttggccttaatgggcattggttga

SEQ ID NO: 88912 - DNA, 303 bp, Glycine max
  Peptide Sequence Number=SeqID_205690
atggggtgtacccatgggccagaaatctaccctaaggctcataagaaccctagggccttctcttgcatctctggcccaatctacttggagttttctatccaatgcccttgcggggtaggattgcatcatagaggttgtactgttgtttctattttcccactttgtaaccattctaaaggccgtatggctcacttcatgattgagttcaccattctaaaggtgtttgtagtggatatccacccttataagcccttcctggtcaagtgggttaactggttccctccaattttgtgtgacacttag

SEQ ID NO: 88913 - DNA, 204 bp, Glycine max
  Peptide Sequence Number=SeqID_205691
atgaagtatagaagcctgctacagaaggatatgataaagcccatgctgttgagattgaagctaccaaggttgcagatgaagctgctaagttctgagcaacacaacaagcaagaagagatacctaaagtgtccccaacagtgtccaatgttgccaaggatgatgaggttattccaactggtccatctgagcttgcatccaagtag

SEQ ID NO: 88914 - DNA, 480 bp, Glycine max
  Peptide Sequence Number=SeqID_205692
atggttgaacttacacttcctggagattctacagctgaagttgctaaggttagggcagggagccaatctgccccactttttgctgataataaaccagatacaagtgaaaaacggagacaaatgcacccatctttatcacggaagttcagttcatatgtgctacccacaccagttcatgaatttcctaggcctctaaccagcttcccctccaattcaaggcttttaggtctagtgggtcattctagtccattggtgtctagaggtcaaaaggtttccactgcaaataatttggttgcatcaagtgcagcatctccactgccaatgccacctcagcccatggctcttagtttctccataccttctagtggcacaagagtggcagcattgcatatgccaagaacactagaatcctctcttgatttcactttgaattgtcttagtttggataaggataaaatggagatgaggattaggacctaa

SEQ ID NO: 88915 - DNA, 336 bp, Glycine max
  Peptide Sequence Number=SeqID_205693
atggagcctcatggggatcattgtagtaagaaggagcgtagtgagattccctggcttgcaacatggtcagccacgatctcaagagtctattgtgcaacatccattggtaccataagagagctaggtcctgtcagtcaaacctcggaacgtctaatttcatgtgtgctcggtgaggcagtgaaaggggtgaaaagttgttggggtgattttggggataatggggtgggaggtctgaccttgggtaaggcagtttacggcctccttgaggcagtcggtggtggtttgccaagtgttatgttccaccatgacggtggcaagtcagaccaaaatgatagg

SEQ ID NO: 88916 - DNA, 684 bp, Glycine max
  Peptide Sequence Number=SeqID_205694
atgaatgtggggtacctcatctcccaccagatgtccctcatagcacagcatgacacatccagactaggattccctgccttgatcatagctttatgtaagactaggggagttcagccagattcgaggtccctagagagcctgagtcctgccattaatttggcatatattaagaagaactgttggaatcttgatgatccaacagtaactttcagaggacccaggaaggccaggggtaagagatctgaggccccttccacttcagcaccatcagaggcaccaacaccttcttcttctctagtacccccctcttcatccactcagattctagttattcctccaacacctctacagatgccactcccagctccatcatctacaagaccattagactttttaattactccgcagatgcttcactccatgatgcagagagaccagccctcttcttctggagggggtggagcctctgcagccgatgagcttgatactgaggagccactagcaccagcacatgtagaggaagagactactccagatcagactccacagccatgtccagcccctgcacatatacctgaggatgctgcaccagttgcggagtctgagcagcttatacaggattcatcagcagctccaacactggatttgaatgaagaccagccacaggaggagaaagacgtttaa

SEQ ID NO: 88917 - DNA, 153 bp, Glycine max
  Peptide Sequence Number=SeqID_205695
atggcagggcagaactggaagaaggttatgttgatgggtttggaaggcgtccagttgaatgaaggcttgtggaagaagatggtaaggatgcacaaaactggtgtgttcgagagtcacatgctcgatcagtttaacttgtccaatggccgatga

SEQ ID NO: 88918 - DNA, 367 bp, Glycine max
  Peptide Sequence Number=SeqID_205696
ggacctagataagctagtccaactttgtataagagtggagcaacaacttaaaagaaagccttcttcaaaatcttatggctctcactcttatctaaggaaggaccaagcccatggaattttgggggatagtagcatagacatcgccattgtgaaggagttttacgccaacctttatgacctcaaggataaatcacctaagcaggtgagggtgagaggtcacttagtgaagtttgatgaggatactttaaacacatttctgaagaccccaataattttggaagagggggatgtagaagcaaagcttcatggtgaatcaaaggtgattcaaaggtgttttgatgataacaatgatgataacaaaagatga

SEQ ID NO: 88919 - DNA, 727 bp, Glycine max
  Peptide Sequence Number=SeqID_205697
actaggcatttatgagcccgttgaacataataaccctgcactctctcccaactacgaatctcctgtctacgaggctgaagaggaggaggatgatgaaatcccgaaggaacttgctcggttattggaatatgaaaagaaaaccattcggcctcatgaggaggtagtagaggtgattaacttgggaaccgaggaagataagaaggaagtcaagattggggcatcgcttgaggcaactgtcaaacgaagggtgattgaattactcaaagaatacgtcgatgtgttcgcatggtcgtaccaagatatgcccggcttggatccccgtattgtggagcaccgtttgcctttgaagcccgaatgcccaccagtcaaacagaaactgagaagaactcgccctgacatggctctcaagatcaaagaggaagtacagaagcagatcgatgcaggttttcttgtcacatcagagtatccccaatggttagccaacatagtgcctgttccaaagagggacggcaaggtcaggatgtgcgttgactaccgggatttgaacaaggctagtccgaaagatgactttcctctacctcacatcgatgtattggttgacagcgctgcaaagtccaaggtcttctccttcatggacggtttctctgggtacaatcagatcaagatggcagttgaagatagagaaaagacatctttcaacacgccttggggcaccttttgttacagg

SEQ ID NO: 88920 - DNA, 239 bp, Glycine max
  Peptide Sequence Number=SeqID_205698
atggcggcagctagacatccaacgccgaaacgtgatccctccaccagcgagcgcggtccggatcaccagatgcagatcgattgtcgtgatttgcggctcgaccgcaaccccgaatatgctcaactgggccctcgtgggccactcacggcgtatgcacgtagcgagcctgcaattccggttttgatgaaggcttcgaacatcgtcttcgcatcttcaaggaccgaaacctgcgtcgagag

SEQ ID NO: 88921 - DNA, 426 bp, Glycine max
  Peptide Sequence Number=SeqID_205699
atgcccgcccttggcggtgccagcgcggatccactacgctttctcgattttctcatcagggaacccgtaaggacaatattgctccaccgaagcggcatcccagtcgttgtccccgatccaactcgatatgcggtccacaagctcatcgtcgccagccgccgccacactgacgggcaggggtcagcgaagcgtgagaaagaccttcgccaagccgcgctgctttttgaggcactgcagcagacaaggcgatccgccgacttggccctcgtctacaacgaagcatgggagcgtgggccggcgtggcaagaagctatccgcgttggggcggggatgctgccggaaccagacgcggaccggctcaaagcggtcctaatcgacggcgcaaagaaaaaccgcgaagatgttgaacttccgtttggcgaatag

SEQ ID NO: 88922 - DNA, 861 bp, Glycine max
  Peptide Sequence Number=SeqID_205700
atgcccggacagtcgggtcgagcaactgcacggcgcgccgttctaccgcgatgtggcacgccgcgccgagcaggcgtgcctggacttcgtgttccggccggatgccttgttcctggacgtgccggcgctgacgcgcgggccgggcttcagcagcctggatccgacgctgctgatggcggcgctggcgcaggatacgcggcatatcggcctggtgacgacagccgcgacctcgttcaatccgccctacgtggtggcgcgccagctgcaatcgctggactggatcaacgaaggacgcacgggttggaacatcgtcaccgcgttggacggcagccggaatttcggcgatgcaccaatgccgccttcggcgcagcgctatcgcaaggcgctcgagttcaccgaagtcttgcgcgcgttatggcgcagttatccgcaggaggcggtgctggcggaccgcgagtccgggcagtacgcggatgtcacgcgtatcgcgccgatcgcgcatcgcggcgagtatttcagcgtccagggagccctgaatgtgcctggtcgcgcccacggccgcattcccctgttccaggcgggcgcgtccgattgggggcgcgacttcgccgcccgcgtggcggatgcggtgttcgccgctacgcccgatatcgaatgcggcgtggcgttgcgccgggacttgcggcagcgggcgctcgaccatggccgcgagcccgcggccatacgggtgctgccggggttgagcctgtatctggcggcgtcgcgggcccaggcccgggatttgcatcgcgcggcccacgcggaccaagaccgggcacgccagcgcctgttctttttaatggcgctgggcctggatcttga

SEQ ID NO: 88923 - DNA, 165 bp, Glycine max
  Peptide Sequence Number=SeqID_205701
ccccgtcgtgccccggaccctgtcgcaccacgaggcgctgtcggcgagtctggttgtttgggaaatgcagccccaatcgggcgggaagcggatgggggccggcgatgtgtcccggtcggatgtggaacggtgagagccggtccgccgatcgactcgggacattga

SEQ ID NO: 88924 - DNA, 231 bp, Glycine max
  Peptide Sequence Number=SeqID_205702
atgcccggggaaaaagacagcgttggcgattctctggatatcacccttgtcgccttgttccaaaaacaaacacggtatccttctggtatttcgctaaccccacagtgcaacccattacatgaaccgaccagatgggatggatccgaggcagacatttttcatcagttgaaggtgttccaaatcgtccgtcgcaacatgaagaaaattattaaaattgtagtagcatcatga

SEQ ID NO: 88925 - DNA, 372 bp, Glycine max
  Peptide Sequence Number=SeqID_205703
atggctacagccaagtgggcactcaagcatcccgtttatggcattgtgatactacggttgggaatttacacaaacagacccaacgtttccaagttatgttctttcatcaattcaatgaattcatccattcttatctcggacgacgttcctaaatggcaaaattctacgcgattttggaataaaacaaaagatagcatacaaatgataaatgatggaacatacgaatttggggatcccacggtcatgtggctccgcatgcccccggactcttgggtcatggtaacaaaaggtggggtggtcgacaaaagcagagcttttgctcctacgtatcctcaatttgtgataaggaacttagacctacgtagttcttga

SEQ ID NO: 88926 - DNA, 306 bp, Glycine max
  Peptide Sequence Number=SeqID_205704
atggctaaaccaagcagccccgcaaacttggcatcagccatcatttgtttctttgcctcaaagaagttcccccatagactaaaagcatcaccgggaaggtttgcaaggcaaaacccttcaccacacccttccgtcatggtccatgttcatggatttttcaaagtgctgacgattggttcctgtgttgcctacctaccaaacggtattcgtgtggctagtcagacccattccatccaggcctctttgttggggacgctggaggatttcaaagtcccacacgtgaaccacgttagtcgtccatcataa

SEQ ID NO: 88927 - DNA, 366 bp, Glycine max
  Peptide Sequence Number=SeqID_205705
atggagatactaggtagctcaagtggcacctccaatgacggagaaagagatgatcacaatgatagtagacacattaccaatgttttgcaatggaaaaatggtgggttacacaccttcaaactttgtggatttggtcttcaccaacgaaaggatcgaagtgggtctgaaaagaggcaaaatgcgaaaactgaggcaaatgaagaagatgagggagaaacccttgctgtgactgccattcctacacgaccaaatttcccatcagcccaacaatatcattactcagccaataactgtccctctcacccaatcatcgacaaaggcatccccaaagaagcaacaaggcatgtctgcttaccacatgcctaa

SEQ ID NO: 88928 - DNA, 591 bp, Glycine max
  Peptide Sequence Number=SeqID_205706
atgaaggccgacttggaggccatgaaagagcaaatggccacaatggtggaggccatgatgagcatgaagaagataatggaagccaatgcggttacagttgccgctactagcactgttgctaaggtgaacctgatgcccccatctgacctcaaccaaatgaatcatccaacctcagatatgcacgccttcccaccatatggctcgactcccaaggaggatgtcaataactccgctcccatactcattgaaagccaacaacctcaatctgatcagacacatgtctctcaaaccatgggggagacacatgaaatgccccaccacaatctagcggactttgagccttgcctcggatatgccactgaaggggaaggagttggtggtatacccatgtcaaacactttggagggccctcagtttcgcccacgaccacaacccttgcattttgcggtgggaagagcccctcctgctatggctgaaaagggaaagttggatcatatagaggaaaggatcaaggacattgaaggaggcgaagattatgcctttgataacctagaagagttgttcctagtacccaaacatggtcattcctaa

SEQ ID NO: 88929 - DNA, 173 bp, Glycine max
  Peptide Sequence Number=SeqID_205707
atgcatatccaagaggtgaactctagaggtgttggcggtgtgtctattgcccgctaccggccatcccaatgctactgtggtatctcgccctgcgcctgcctgggggcgcagtattttcttgatgaaagctcgattagtaaggggcctgatggccctttgatggaagtgacaag

SEQ ID NO: 88930 - DNA, 501 bp, Glycine max
  Peptide Sequence Number=SeqID_205708
atgctttactctactaccttaattctggccggactttcctgtatctctagccacgcggtatccactgacacgcaccatgatgtccctgccgactttgctaatgcaacctcgactcaaggcgatgagtttggatctgcaactacctacaccgcgtactctgctactcctttggtcaagactccagccggctatggccctgaatcgtctggaacacagacagcatcaaccatgaactcattcgagtggctagaaagcactgccaccatgacttccacggctgctgacaatctgacaccctactccaactatcctgccgagtatcctgtttcttctactgacgtgaaatttgaaactgagttcaagtcagttgctacctatactgcttcggatctacaaacaacatctactttcagcgctcctgaaccaacatcaagcttatcgataccgtcgacctcgagggggggcccggtaccagcttttgttccctttagtgagggttaa

SEQ ID NO: 88931 - DNA, 216 bp, Glycine max
  Peptide Sequence Number=SeqID_205709
atggcagggctgagactctccaaagatatggaatttgatgtgactcctctagctttacacaaagttgtgattaaggctggaatgttgggcaatgatagaaatctggtgggagatgagtgtgatgtcagaagggtggaaggtagggaccaagttggagtaagaaagaacactccaagtatgagcgagtgtggtcatgttcttcctgaggatctttag

SEQ ID NO: 88932 - DNA, 240 bp, Glycine max
  Peptide Sequence Number=SeqID_205710
atggcatcaaagaatagaaaggcacttgccacaccttcccaggtccaatatgaccgatccaggttcacttctcctaagacctgggaaaggtacactgatattgtggtgagggtgagaggccatttggtgaagtttgatgaggacacgttgaataccttcttgaagacccctgtaatcatcgaggatggggagacattatcagcttactctagatttgcactcttgaggcctgatccttaa

SEQ ID NO: 88933 - DNA, 1086 bp, Glycine max
  Peptide Sequence Number=SeqID_205711
atggagtggtctttctccatatccgtggtgctgtttcttacccttctcattcaaatacatggaagtggttatcttgatcacaagcaagcaagaggctttgtagagaattatggttgtaatttgttccaaggaagctgggtttatgatgattcataccctctttatgaaacctctcaatgtccctttatagagagggaatttgattgtcaaaacaatggtagaccagataagttttatctcaagtatagatggcagcccgtagggtgtaacttaacaagattcaatggtgaagatttcctaacaagacttagagggaagagtatcatgtttgtgggagactctttgggtttgaaccaatggcaatcactcacttgcatgcttcacatagctgtgccacaagccccatacagcttagcaaggaatggagatgtctccattttcacctttccgacctatgatgttaaggtaatgttgtcgcgcaatgcattacttgtggacattgttggtgagagtatcggtcgagtattgaaactagattcaattcaagctggccaaacgtggaaaggaatagatgtaatgatatttgactcttggcattggtggattcacacaggaagaaaacaaccatgggatttgattcaagtagggaatcgtacatatagagacatggatcgcttgggttcatatgagattgcattgaatacatgggccaaatgggttgattacaatattgatcctacccgaacaagggtgttcttccaaggagtctctccagatcatcaaaatccagcgcaatggggtgagccaagagcaaacttatgtgaagggaaaactaggccaatattgggattcaggtacccaggaggaccactcccagcagagttggtattggagaaagtgctaagagccatgcaaaagcctgtgtatttgccggacattactaccctatcccaactaaggatagatggccacccgtctgtttatggctctggagggcatttggacccggattgtagccactggtgcctagctggtgttcctgatacttggaatgagcttcagtatgctagtctcgttaaaaattaa

SEQ ID NO: 88934 - DNA, 318 bp, Glycine max
  Peptide Sequence Number=SeqID_205712
atggatgaagaccagtggatgtatgatagtatcatgtctgaagaagttgaaatgaatgttgaaaatgaggaagatgctgacattaaagttgattgttttgatgcctttaatacttttgaggtatttgtgcaatttgttgttgttgacatcaataccgatgttcgaggaagagtctcatttctgttgatagcttgtgaaaggagtgaggagtataggcctaagaaacataatttggtaagaacatgcactgacagtagaaaatgtggatgcctgtttaagttgcgtgcgaagccagtttcaggaggagacgactggatg

SEQ ID NO: 88935 - DNA, 291 bp, Glycine max
  Peptide Sequence Number=SeqID_205713
atgacggagaaagagatgatcacaataatagtagacacattaccagtgttttactatgaaaaaatggtggggtatgcaccttcaagctttgcagatttggtcttcgctagcgaaatgatcaatgtgggtctgaaaagaggcaaatctgatcatcatgctttgggtgagaatgagggagaaacccatgttgtgactgtcattcctatacgaccaagtttcccaccaacccaacaatgtcattattcagccaataacaacccttctccttacccaccacccaattatccataa

SEQ ID NO: 88936 - DNA, 528 bp, Glycine max
  Peptide Sequence Number=SeqID_205714
atgggggagacacatgaaatgccccaccataatctagccgacttcgagccttgcctcggatatgccactaaagggcaagcagttggtggtataccattacaaaacactttggagggcactcagtatcacccacaaccacaccccttgcattccacagcgggtaaaaaccctcatgctatggcagaaatgggaaacctggatcatctagaagaaaggctcagggccattaaaggaggcaaagattatgcctttgctaacctagaagagttgttcctagtacccaatatcatcacccctcccaagttcaaggtgccggactttgacaagtacaaggggactacttgccccaagaaccatctaaagatgtattgtcggaagatgggggcatacacaaaagatgaggaactactgatacatttcttccaagaaagtcttattggggtagctgttacctggtacactaacttggaaccttcccgagtccattcttggaagaacctaatggttgcctttgttaggcagtattag

SEQ ID NO: 88937 - DNA, 482 bp, Glycine max
  Peptide Sequence Number=SeqID_205715
atggaggagaagaaaaagaaacaactagatgaagctgctaaatctagaagcacatacactgtcattgatcctccatcttccatcagacgacacgtgaagtggaagatggcccacactaagaaaattggacaaatgacttatgaggcagctaaagaaattgctaacaagattgtaagtcacattcaattgattccttggaggagcaagcctcatagggttcctttgtcgcccatggacgtcaggatccgatgtcatgatcaagcaatactttggactggctccaaggacctcccacacgtcttcgtccatggctcccaaagacttagagcaacaggcgcaaaaaatcaaggactagctggaggaggactaacactacctcctaagcatgaggttgatctttcagctgcttgtgtcagcacaaaggagagttgtgttgatccctcagggaacgatccaaaaatgggtgacttagacaaatgcgg

SEQ ID NO: 88938 - DNA, 228 bp, Glycine max
  Peptide Sequence Number=SeqID_205716
atggcggtgcagctaatccgtgatcgagtagagatggagtgcctagagggagtttgggagaccctcgaaggcaacacgaggtgccgatttcggggcaccattcgattcacggctacttctttggtgcatccagatgaacctgcacggacgcttcagcgcacggcatttgatgattgtatacatgtggctgaagccaccgctatggacacctttgctctggatgacact

SEQ ID NO: 88939 - DNA, 696 bp, Glycine max
  Peptide Sequence Number=SeqID_205717
atgtcctcgcctttagaggactataggtcttcgcctttagaggactacacgtcctcacctttagaatgctacaggccctcgccttcagaggactatacgtcctcgccttcatatggatgtacgcaaacgtttagaggactagacatcctcgccctcagagggcttcgtgtcctcctattcagaggaccccatgtcctcgccatcagagggctgcatactctcaccttcagaggactaaacgtcatcaccttcagaggactacatgtcctcaccttcagaggacgacacgtcctccccttaagaggaccacatgtcctcaccatcagagggttgcacgcccttgccttcagaggactacacgtcctcagcttcagagcactacacctcctcccctataaaggactatacgtcctcgccttcagagtaatggaagttctcaccatcagaggactatatgtcctcgccttcagaggactacacgtcctcaccattagaggacgacacgtgctcaccatcagagggttccacgccctcgccttcagaggactacccgtcctcaccttcagaggactacacgtcctcttattcagaggactacacgtcctattattcagaggactacacaccctcgccttcagaggaatggacattttcaccttcagagggctacacgccctcaccttcagaggactacat

SEQ ID NO: 88940 - DNA, 469 bp, Glycine max
  Peptide Sequence Number=SeqID_205718
gaagcggaagagcgcccaatacgcaaaccgcctctccccgcgcgttggccgattcattaatgcagctggcacgacagcggataacaatttcacacaggaaacagctatgaccatgattacgaattcgagctcggtacccgctgagctccctattgaagaggttccacttttgcaggaagagataatcaacttgtgtcgtagcatgggaaaggctgttattgtggcaacaaatatgctagaaagcatgattgttcacccaactccaaccagagcagaggtatcagatatagcaattgcagttcgtgaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 88941 - DNA, 456 bp, Glycine max
  Peptide Sequence Number=SeqID_205719
caatcactacgcatagctcaaaactcgaaggtggaggacacatgaacgaaaaggcaattcatggggctccgaaaaagggtgagattggagaattgcactatgcaatcactacgcatggctccaaactcgaaggtggaggacacatgaacgaaaacagaattcaaggttctccgaaaaagggtgagaatggagaattgcactatgcaatcactacgcatggctacgaactcgaaggtggaggactaatgatcgaaaacgcaattcatggggctccgaaaaagggtggaggacacatgaacgaaaacgcaattcaaggttctccgaaaagattgagaatggagaattgcactaagcaatcactacgcatggctccaaactcgaaggtggaatcaagcttatcgataccgtcgatctcgagggggcgcccggtaccagcttttgttccctgtactgagg

SEQ ID NO: 88942 - DNA, 582 bp, Glycine max
  Peptide Sequence Number=SeqID_205720
atggtccagtctaactcctcaagactcgggtttcctgctcttatcacagctttatgcaggaccagaggagttgactccgacagtcttgtctttgaacgtctgagcccggtcattaatttggcctacatatggaaaaattgttggaaccctgatgatccaacaattattattaggggggccagaagaccaagggcaaggccagctgagactccttctacatcagtaactcctcctccagctcgtattgcagtagctccttctaccccacctcctgggcagattattttgctgcaatgtctccaactggtagcacctccagacccaatccctacagtagagaaatttaatgaatgggtagcctggccaaggactcagcctcctcctcacagggacgatgaggatcccgccgctcaggtcccacatcagccatcagatgagtcatcagattcttccactcctgagcccttgatcaggaagaggagggtagttttaactcaggaggttacaaccactcctgaaaagtctcctgaggccactccagaacctccgacactagtggcagataccacttctccacaatag

SEQ ID NO: 88943 - DNA, 386 bp, Glycine max
  Peptide Sequence Number=SeqID_205721
gtccattcataccaactaaagacttaaatggtgaattggtacctaaagaatgggatgagatgaaagatgacgagaaaagaaaagtgcaagatgataaaaaagctaaagacattttaacttttggtgaaaaattgcgaaggagatatggaaaatgcttgaagtcactcatgaatgtagaagcaaggcttcatgatgaatgtgattcaaagatgatgacaaaggtgatgaacaaaaagctcaaagatcaaagaacaactaaagtgaatcaaagaacaattcaagagttcaagaatcaagaagaattcaagactcaaggagaaagcctagaatcaagaatcaagattcaagattcaagatctcaagaatcaagatcaagattcaagtga

SEQ ID NO: 88944 - DNA, 378 bp, Glycine max
  Peptide Sequence Number=SeqID_205722
atgcttcagagcattcatcagagacagatcattttattacagagtttatatgtggtggcacctccaggatctattcctttagttgagcagttcagggagatggatgagtcatctaaggccaccatcctagagccatttgttatagaagaagaggtagaggagacacaggtcacttcagagccaccggcaccattagtgaacctaccctcacctcagcgtacaacagacccctccactcctattctagagatgccagaggacccgaccacactagtcctggctatggacacttctcctccagctactccagtacttcatctaacagatgagcaggatgttcagacactggacacccaggaccagtcacaggaattctga

SEQ ID NO: 88945 - DNA, 311 bp, Glycine max
  Peptide Sequence Number=SeqID_205723
atgacaaaaaaatggattaagccatttcttgtgcaatatattcaccaacgacaatcaggatgtgcaaatctaaaggaagacgttatgaaaacttatctcatcaataacaactgcatctacaatgaacagaaatatgaactaagaacgagctcaaactcgcaagttattagaatgacagcaatgcgttctaaatgtcttagcttcattattgaaaacgctcatctggagattatcgaacgccagaaaatcactaatgagctatggggtagcagaagtcattttgtgaatgatgccaatctaacgcagatact

SEQ ID NO: 88946 - DNA, 278 bp, Glycine max
  Peptide Sequence Number=SeqID_205724
gtcattatgagtattcagacaaagttatcaaatttgaaattattgagctgaaaattgacgatgacatgctaaaggtcttagtacagtctaactactggaaacaatttgggccaatagaaattttagctgtttttagtaaacagacaaatttgtataacgctgcattctacctatgtacggagtgggccactgctttgcctgagaatgacaatgtgtattccacaacaacaccactggtggtaaaggataatagtctcgtaacaaaacctgttacataa

SEQ ID NO: 88947 - DNA, 276 bp, Glycine max
  Peptide Sequence Number=SeqID_205725
atggcaaacttcctagcaaattttgccgagaataaccaaaccaccctaaactggtggagcctctacattgacagtgcgtccaacgtgaaggggagcaaggcaggaatcatcctcaaaggccctaacaatgtcaccctagagcaaacccttaagctcaacttcaaagcctcaaacaatcaggtcgaatctactacatacctagggagagcaacacaagagcaaacctgctctccaaactgcccagcactaaaaagatcgggcacctcaagactataa

SEQ ID NO: 88948 - DNA, 744 bp, Glycine max
  Peptide Sequence Number=SeqID_205726
atgaggggcatcgtgcatgagcctcaagtggacccttgggtactagtacctatcttcttcagaggactatgcgtcctcaccttcagaggactatacgtcctcacctttagagggctacacgtcctcgccttcagagggttgtgtaccctcacctttagaggactacacgtcctcgcctctagaggactacacgtcttcaccttcagagggctacatgctctctcctttaaaggattacatgtcctcgccttcagagggctacacgtcctcgccttcagagggtcgtgtaccctcgcctccagaggactacacgtcctcaccttcaaagggctacacgctctctcctttagaggattacatgtcctcgactttagagggctacgcgccctcgccttcgtagggctacacgccctcacctttagaggactagacgtcctcacctttagaggactatacgtcctcacctttagaggactacacgtcctcacctttagagcgctacacgccctcatcttaagaggactacacgtcctcaccttcagaggactacacgtcctcgccttcagaggactacacgtcctcaccatcagaggacaacacgtcctcgtctttagagggctacacgccctcatcttaagaggactacatgtcctcaccttcagaggactacacatcctcgccttcagaggactacacatcctcaccttcagagagctgcactccctcgccttcaaaggactatac

SEQ ID NO: 88949 - DNA, 972 bp, Glycine max
  Peptide Sequence Number=SeqID_205727
atgaatggcaggaggtacaggtttgtcagattcaaaggtgtagaagacgagagcctgcttgagaggcaattggacaacgtcattgttgaagccgaagacagaagaaaaaagacaggtgctagggaaccgaaaaagacagaggaacaggaccatattcaaagaggcgtaagagcaaagcaaacctcttacgcggaggtggtaacggggaagaggagggaagcacacagtggcgagcgtgggttatcgtcggtatacttcgagcccacagaggagatgctgaaatggctgaacgatgcgtgggtcgctaggctgtcaaatctggcaaattttgataaggtggaagatcagctgcggtgggactatggaatggatatctcaaccacgtatttgggggatgatatgatcctaattcttggactcactgatgaaagagttgaacaactaatgaatgaagttggccacagtacgcttcccctgttttattcgttgcaaaagtggtcgccgagcctgcgtccgggatataggctggcttgggtacactattggggaatcccaatcctagcatgggaagtggcggtcatcaagaagattttgggggtaatgggggaagtactggagattgatgaggaggtcgaggaacgacggcggatggatagagccagggtgcttctcaaaacaccatggaagccatctattcagcacactgtcgttgtgcatatcggctcagaggtgcacgaagtccaaatattggaagaaagaggcccaaacgtcgacttacggcaaggaacaacatggacaggggcaatgtcatcggaagaaatagattccaacgggagctttatggaatctccgacatcggataagtcacaggcccggatcgaaatcgctacaagggacgaggaggagcagccaaatggtgtcgtccgggatataggctggcttgggtacactgttggggaatcccaatcctag

SEQ ID NO: 88950 - DNA, 195 bp, Glycine max
  Peptide Sequence Number=SeqID_205728
atgaactcgctaagcgagcatgctgcgctaagcgagttcatcagtactcattgtgtgtatatgcattctcggaagaactcgctaagcgcgcctaccgcgctaagcgatcgcgcgctaagccgagctttcttgggccaagcgcgatttgttgcggcatccgctgagctaagcgagcttcgctcgctaagctcctaa

SEQ ID NO: 88951 - DNA, 491 bp, Glycine max
  Peptide Sequence Number=SeqID_205729
atggaaaacaatagccagaaccatcaccatcaacaccatggtttctctgccaaatcgagtagtactaaggagagaaggggtctcgactttgatttaaacgaacccataattgatacaagctttgagacttctcctctggttcctgctgataacattaataattgcctggtggaaatggaagggtgccaacctcttgctcctcccacacaagacgttgctgaacaagtacactcctccaatgatgcggaaaaggtgaagtttcgatttgatcttaacgctaaacctgatgaggaggaggaagttagtgccaaagttggtggagggagtgaaacacatgctgctgtatctgaatcagctgacaacgttggacctgacaatggtttggagctcactcttaataatgatgttcatccaacacatgctgctgatgacagtgattatgaagaagacagagccagtattggggaaggaggatctgacactgagaacag

SEQ ID NO: 88952 - DNA, 1428 bp, Glycine max
  Peptide Sequence Number=SeqID_205730
atggacaataaccaacaacacccgaaactcgaaaattttcttttggaaaaaccggcaaccgggggtggcggttgtccaaaaaacaccaactctatagggttgtccatgataaagacatggctgaggaaacaaatgtcatcacagtcagatgctgcaaacacatcactttccatgagcactactagagtgtcagagtctggcacagtagcattgccccttctaacagcgggtgaagagagttcctcctcgaagagtaagcaaagcggaattcttaatgttgacactgtgtccagaaaatccgctgacacatttggaaagaggacttccatataccgtggtgtaagcaggcatagatggacgggtagatacgaggctcacctgtgggacaatagtagtagaagagaggggaaaactagcaaaggaaagcaaggaggttatgataaagaagaaaaagcagctagagcgtatgatttggcggcactgaaatactggggagcaacgacaacaacaacaaattttccaattatccactatgaaaaagaattagaagaaatgaagaacttgacaaggcaagagtacgtcgcatcactgagaaggaagagcagtggcttttctcgcggtgcatccatttatcgaggagtaacgaggcatcaccaacatggtagatggcaagctaggattggaagagtagcagtcaacaaagatctctacttgggaactttcaacactcaagaagaggcagcagaggcatatgacattgcagccatcaaattccgaggactgaaggcagttacaaacttcgatatgaacagatacgacgttaagagcatacttgagagcagcactttgcccattggtggtgctgccaaacgtttgaaagatgctgatgaacaggttgacctcaccatcatggatcctcaaacccctcacgtggattctaacatcaatatctttggagcttctcaccattctcttgcattacatcaacctcagccttatagccacttgaattacacttatggacaaaagttttggattgattctgcttccgttgataataacaataatagctctggatctaactatgtcatttatggtggtggagatggttacgcgattcccatggctactcctacgttcaatattgcagatgatgatgatgttgttcaaaatagtagaagcaacggtcttgagcataatgatgtgaagatgcttggttatgaaaatgtgctcagctccagtaccgatccttatcatgcaagggacttgtgttatctttcgcagccagcatctggtgatactgttaagggtagtgcatatgatgcatgcaatacttgggtgccatttgtgattccaagtactcttgcactaaggcataccaatgatctttgctccggagcttcaccgttcacattgttgcatgagtag

SEQ ID NO: 88953 - DNA, 523 bp, Glycine max
  Peptide Sequence Number=SeqID_205731
ggcctactacaaatgcataagtgctgggtgttatgtaagaaagcacgtggaacgtgattcatgcaacagaaaaattgtgattaatacttatgagggtaaacacaatcatgaacaaccaccccccagaaggaaacgtcaccagatacagcttgtggatgatgaagaagatgaagacgaagatgaagatgatggcctaatgacttttcaatttgctgcgactgggaattttctgaataacccaaaccctgcagaaactgatcaagttcacacacttcaacttcgtaatgacatgaatcctgatcaatttgccaatgggtttctgagtcccaataaccattttggaagtttcaacaataatataaacatgaatattgggtcttcttcctacaccccccaaatgcattattattcttccttgaataatactaaagccatgcctcaaagctcctatggactcaactttggcagtgatgctgcccctcaacctgggccttccggggtaccaggtgcaggagataattag

SEQ ID NO: 88954 - DNA, 537 bp, Glycine max
  Peptide Sequence Number=SeqID_205732
atggatttctcaaatgcttctccttctccaacacaagttgatcaacaaaatgatgagaaaaaagtgaaggtttcattgtcatttgatcttaattccaaaccagaggaggaggaggaggaaccaatttctttctcggaggaagcccgtgccaaagttggtggcggctgtgaaaccagaggcgctagtacttccgaaccagacgatcacattcaacaagttgctcttcctaccgatgctgctcacaatcacagagtcaacattgttgatccggaatctcactctcagaataggaagagaaaaagatctgataatagagggatgggaagcgttttccgtagggaaacctttgtgttgccatttgagacccaaagtgagacagtaatatttgtggatgatggctatcagtggcaccaatatggactcaagactatgaagggaaatttattccctaggtattgtgctctctctttactcggtgcacattgcatacataagatggagaatattgacgagtgctatgctctttgttcagtttga

SEQ ID NO: 88955 - DNA, 1278 bp, Glycine max
  Peptide Sequence Number=SeqID_205733
atggatcatcgtcattggcgcttcttcattatgcttttcattaccgcagcagcaataggacttgtttcgtcgttagggataaactacggccaaatagcgaacaatcttccttcacaagacgacgccgttgcgttggtgaaatccatcggagcgacgaaggtgaagctctacgacgcagatccacgcgttttgaaagcgttcgcgaacaccggagtggaattaatggtaggtctgggaaacgagtacttgtctagaatgaaagatccgaaacaagcacaggcatggatcaaagccaacctccaaccctacctcccagccaccaaaatcacctcaatcttcgtcgggaacgaggttctgaccttcaacgacacctccctaacctcgaacctcctcccagccatgcagagcgtgcacgccgcactcatcaacctcggtctcgacaaacaaataaccgtcaccactactcactcccttgccgttctccaaacctcctaccctccctcggcaggagccttccgtccggacctagctccgtgcctagctccaatcctgagcttccaagccaaaaccggatctccgttcttaatcaacgcgtacccctacttcgcatacaaggcgaatccgaagcaggttccgttggagtacgtgctcttccaacccaacgaggggatggtggacccctccagtaacctccactacgataacatgcttttcgcgcagatcgatgcggtgtattccgcgttggattccttgggctacgggaagttaccggttcacatctcagaaaccggttggccttctaaaggggatcaagacgaagccggtgcgaatctcgagaatgcgaagaagtataacgggaatctcattaagatggctatgagcagcagcagcagcgccaagaaggggacaccgtgcaggcccaatgaggatttgaacatttacgtttttgctctgtttaatgagaacatgaagcccggcccagcttccgaaaggaactatgggctttttaagcccgatgggacccctgcttacccccttggcttctctctggcttctgtgccagtcgtcgccggtaataacaataccggcgtcgcaagcacgccgccgcaaccaacgtcaccgacttcttccaccggctatttgtcaatttcctctgcttcctctctgaaaatcgattttgttgagaatgacacctttgacacggcaattccaaagacaaattttaagttcgcgtgtcataactcgtattttaattctcctatttatcgttccaactaa

SEQ ID NO: 88956 - DNA, 747 bp, Glycine max
  Peptide Sequence Number=SeqID_205734
atgcccttattgtttttttcaatgccatgttcaggaaatatctctagtgaggcatgtgtagcacctcctgatagaaccagttcaaaggataaagataaagagagaaatatctctaatgaggcatgcgtaacacctcctgttggaaccagttcacatgataaagataaagaattagaaaatggtcttgtcaaggagcaagctcggcctataacgacaaagcaaacatccaatgggagcaatgaagatcattctccacaaaaggcagacagtggtcacagagctggtgaggattccattgtatatgaacatgaagctgatgctgaggtactaatgccaaaacttcggcggtctgattactgcacactgcctcggatgcctgaaccggtggccaaggaaagagctgaaccaggattctgctgtcatgttgaggactttatgcttggaaggcaaggctatggcagcatcagattcttgggtgagaccgatgtacgagggcaagcccttgagtctcttgttcagtttaacactcggggggtgattgcatacatggacaactcaacaaaacctcctgtgggacaagggctgaataagcttgctgaggggtcaaagatcgagaaatacaaggagatgctcaagagaatggttgaggaccaaggtgctgattttgtatcatatgatcccattaaaggagagtggaagatcagggtcaaacacttcagtgtctacaagctggtgcctggtagatga

SEQ ID NO: 88957 - DNA, 3723 bp, Glycine max
  Peptide Sequence Number=SeqID_205735
atggggactgagcttatgagaatatgtgttaaagaagataatgatgattttccatcagttccaccgggttttgagtcatatacatctttctcactgaagagggtagaaagcaatgaaaaacaagatgataaaaatatgaccagttgttcagcctctactagtgcttctgaatcaccatcaactcaggtggaaaatgatgttcaaggtggtgatactagaaaggttcctagatcccttcgacgaagaccatggattaattatggacaatatgagaacatttcagatgaagaccctgactgtgagcagctcgatcaaaatttctcctcaagaccttgtcttcctcgaggagtcatccgtggatgtccagattgcagtcattgccaaaaggttgttgccagatggcgaccagaagatgctcgtaggccaaatattgaggatgctcctgttttctaccctactgaagaggagtttcaagatactttgaaatatatatcaagcattcgctccagggctgagtcatatggaatttgtcgcattgttccaccatcttcttggaaacccccttgtcctctcaaggaaaaaagtatatgggagggttctaaattttctacacgtgttcagaggattgacaaacttcagaatcgtaattcaatgagaaagatgccgaagattcaaactaatatgaagaggaaaaggaggagatgcacaagaatgggggtggataatagcattagaacaggacctaatgcaggattttgtgaagctgaaaggtttgggtttgaacctggtccagaatttaccttggaaacatttcagagatatgcagaagattttcagctcaaatacttcagaaaaaatgagaatgtatctcatttgggtgctaatacaacaattttaaatggtacctctgagccttctgtagagaacattgaaggtgaatattggcggatggttgagagtcctactgaagaaattgaggtgctttatggagctgatctggaaactgggatttttgggagtggtttccctagcaaatctagtcaagtaggttctgcttcacatgaacagtacataaaatctggctggaatttaaataactttgcaaggctacctggatctctgctctctcatgaaagctgtgatatatctggtgttctagtgccatggttgtacgtaggaatgtgcttttcctccttttgttgggaacccatgcatgtccatcatgtggaagatcaccatttatattcattgaattacatgcattggggagctccaaaaatgtggtatggtgtccctggaaaagatgcctgcaaattggaagaggccatgagaaagcatttaccagaactttttgaagaacagcctgacctgcttcataagctggtcactcagctttctccttctatcctgaagtctaaaggagtaccagtttataggtgtatccaaaaccctggggactttgttctgacatttcctagagcctaccactctgggttcaactgcggcttcaactgtgctgaggctgttaatgtagctcctgttgactggcttccccatgggcatattgctatagagctgtaccaggagcaggggcgcaagacttctatatcacatgataagctgttgcttggggctgcaagggaagcagtaagagcccaatgggagcttgatttgctgaagaagaatactttggataatctacgatggaaggatgtctgtggaaaggatggccttttggcaaaagcactcaagatgcgtgttgagatggagcaagcaagaagggaatttctctgctgtccttcacaggcattaaaaatggagagtacttttgatgctacagatgaaagggagtgcaatatttgcttttttgatttacacctatctgcagctggttgtcgctgttccccagatagatatgcttgcttggatcatgcaaagcagttttgttcatgctcttgggattccaaatttttcctctttcggtatgatatcagtgaactaaatattcttgtggaggcattggaaggaaaattaagtgcaatttacagatgggcaaaatcagatcttgggctggcattatcttcttttgtctcagcgggcaaggaaacaatacctgaggaattgaaatcgaattcatccaatttgtctcattcttccagggtcactgtgcataaagagatgtcaatgaatccatcaaataaatatattgatgattctcaattgattgatgtccctatagagaatcaagcaaatagcaaagatcagagctattttcaacagaggaaatcggttgaagctatttcatctttgagttccatgaaggaattgctaacatttaaaggctcaaaacctacatctgagatggctaatcataagatctgtgttaataaagaagaatcagttatttgcagatcaaatatgagagcccctggttgtcaattgtctaaagaggatacatcatatgctttatctgtgcctctagctcaagatggaggtgaaaaaagttcacttaacagacataataacagtattatacttcttagtgacgatgaagatgatgaaaagatgtccaattcaaatagaaggaaggaattttctttgatgcttgctggtcctagagataaggcaatcccatgtaatgatatagaaaacacaaagttgaccatttctgtgtcagattctgctgtgatgggtgaaaaggatgctattacattgccacgtgaaaatatgagttctgattcaacttggcttttgcatgtgaaagaagaatgtcatgaacagacaggaacagttctaacctctaccctagtagatctttcttgtcatatgggtcttacaagtacagaatctactagaaatattccagctccttcaaaagtagaggccagtgatcattgtttggagagtttggaggtttgtcctccaaacccacaactttctggcattaaggttaagactgaagataatcatgaaaagcttggaggatgtaccacttctaatgtagcagacaatgcaagagctgttaatgggaacttttcttgtggtccaaacaattaccgtcagaaaggtcctcggattgcaaaggttgtccggcgcatcaactgcaatgttgaaccattagaatttggagttgtgctctctggaaagtcttggtgcagtagtcaggctatctttccaaagggatttagaagccgtgttagatacataaatgtcttagatccatccactgcaagatgctgggaactggtcagagagaaagtgaatcaagaaattgcaaagcaacataagctgggaagaaagggtcttcctcctttacaacctcctggcagccttgatggctttgaaatgtttgggttttcttcaccagcaatagtgcagctatcagtgtataatgaacctgctttctttcaacaggctattgaggcgctggatcgaagtagattatgtaatgaatattgggactcacggccctactctcgtcctcagggacagatttcacaatcaatccaaaccaatgtcaatggtggaaatgctcaaggggttgtcttgaataagcacatgcctgttgaagttgtagcagtgctaaggagcctatttaaaaagtctaatgcagaagagttgaacttattgtacagcattcttagtgacaataggccagaggctgacaggaacctagttgcacaacttctcaatgaagaggttcacaaatcacaaccgccctag

SEQ ID NO: 88958 - DNA, 450 bp, Glycine max
  Peptide Sequence Number=SeqID_205736
atggcgttgcttgaaatttatagaggctttgagaaagaatcagaatatgaaactgttgagctgaaagtaaggatgtgctgcacgggctgcgagagagttgttaaaaacgccatttacaagctcaaaggcattgattcagtggaggttgacttggagatggaaagggtaacggttggagggtacgttgatcggaacaaggtgcttaaggctgtgaggagggcagggaagagggcagaattctggccttaccctaatccaccactttacttcacaactgctgaccattacttcaaagacaccgctcatgaattcaaagaaagctacaactactatagacatggctacaacctcccagagaggcatggcaccatgcatgtgtctcaccgtggagatgacaatgttagcaacatgttcaatgatgataatgtcaatgcttgttctatcatgtaa

SEQ ID NO: 88959 - DNA, 317 bp, Glycine max
  Peptide Sequence Number=SeqID_205737
atgaaggcctgggcagtgtacgactgggccaattctgtttactctttggttattacctctaccatctttcctatttattattctattcttactaccgcctatgaaaaaaaggatattacagcaagtgtaggattttggggaagtctggtattctataactcatttttacccgatatcgcaactccggataagcaggatgctctttcagcaaaaggttatgtctacggttatattggttctgtagttttagttgttatttgtttagttctgattcaggttttcgctaaaggtgctgcccaacaacttttacccctaaa

SEQ ID NO: 88960 - DNA, 366 bp, Glycine max
  Peptide Sequence Number=SeqID_205738
atgaccggtttccttcggttttttcgacgttttccacaaataaatgttggtggcgactccacgcattttccttctttggaagacgctcccatgagcctcgcctcggttgcccgcaaaaggagattcaataaatttctgagaaacaaaggaaatcaaaggagatcaaatatcaatccaaagaagaaaggagaagattcctccttagtcccaaaatgctatgaatgcaatcaacctaggcacttgagattcaattgttgtgtctttaaaggaagaatggaaaaatctgacaagagaaaaagaaagcatacatcacttgggaagataatgacatggattcttcaagtgattcagaaaatgaaatcataa

SEQ ID NO: 88961 - DNA, 513 bp, Glycine max
  Peptide Sequence Number=SeqID_205739
gatctgtacgcgtcgtggtgcggcgtcggaggagaagaagttgttgcgagaagcggggacgaggagagtgcgccgtttcgggagtcggtgtggacttcgccggcgttgtgtttggttgcggatgaggggaacaggttggtttggagtggacataaggatgggaagattaggtgctggaagatggatgatgatgatgataacaacgacaactgcgattggagcaatcggtttacggaaagcttgtcttggcatgctcaccgtggacctgttctttcccttaccttcacctcatatggggatctgtggtcgggttcagaaggaggaggtataaaaatatggccttgggaggctgttgaaaaatctattcatcttactaaggaggaaaggcacagtgctgtcatattcgtggagaggtcctatgttgacttaaggagccagctatctacaaatggcttcagtaacatgctaacttcagatgtaaagtacttagtatctgataatttgagagcaaag

SEQ ID NO: 88962 - DNA, 951 bp, Glycine max
  Peptide Sequence Number=SeqID_205740
atgggatgggagggaggggatcgggtgaaatttttttctgtcagagctatggcaggttattgtgtagcaagagtgacatgcaatggtttagaaggggagacacaaaggaacccacaggctatggtaggattggagggaagttctgttgggcagtggtggctggatatgataggcaaaacattagatgaaggttcaacatttgaacgtattggatccaggcaacttgctggcttggtcattgctgtgtgggttaaaaccaacattagatttcatgttggggatgttgaagtggcagcagttccatgtggcttcggacgtgctattggcaataaggctgttgctagattctctactagattttatggtgtgttgcaattccaaggagctgttggtttgagaattagagtgtatgatcggataatgtgcttcgttaattgtcactttgctgcacatttagatgcagttggtcgtcgcaatgcagattttgatcatgtataccgaacaatgtccttcagtcggccaacaaacctcttaaatactacagctgatctggcttgccattggtccttgcagctggcacttcatcttctgttccaacgtttcgtggtacaaatattgttggatgaagcattgattcttgagattggtttccagtccgcagaagggatgcccgagttatctgaggcagacatggttgtgtttcttggtgattttaattatcgccttgatgacatttcttatgacgaagcaagagattttgtttctcaaagatgctttgattggcttagagaaagggaccaacttcgagcagaaatggaagctgggaatgtcttccaaggaatgcgtgaagcagttataacatttcctcccacatacaagtttgaacggcaccaagctggtttggcaggttggccccctgcccaaaacaaaaacacacaaatggtctcatga

SEQ ID NO: 88963 - DNA, 565 bp, Glycine max
  Peptide Sequence Number=SeqID_205741
atggcagacatctacgaagaaaacagaaatgtttgtaaatatgttcatagtacttcaagaggtcatgaagcaatccagctggctaccgcatatcagttaaaaaaagaagactgggtttctccctattacagagatgaaagtattcttttggggataggatttgagccatatcaattgatgttgcagctattggcaaaagcagaagaccctttttcaggaggaagatcttactactcccatccgtccagcagggatgaaaaaatgccaaagatcattcaccagagctcagcaacaggaatgcaaaccatcccgactacaggtgtagcacagggaataaaatatattcaggattttaatttacagaattttgaaaacaacccggttgttgtgtgcagcctgggtgataattcggtcactgaaggtgaagtaagcgaagcattacagtttgcggccttacatcagcttccgatcatcttccttgttcaggataatgaatggggaatttctgtaaccaaggaagaagcacggacttgcgatgcttatgatttcgttgcaggatttacag

SEQ ID NO: 88964 - DNA, 672 bp, Glycine max
  Peptide Sequence Number=SeqID_205742
atgtatttagtttttgacacagaaacaacagggttaccaaagaatttcaatgctccactttcagattccgataactggccaagaatggtgcagattgcatggcagttacatgatgatgacggaacgctgattgaaaatcaggattatattataaagcctgagggatacgatattccctttaatgcagcccgtattcacggaattacgacgaagattgccaatgaagaaggtagagaccttgaagagattcttaaagagttttctacagtcttagaaaaagtaagggttgtttccggacacaatgtagagtttgattacaatattgtaggagctgagcttttcagaaaaaatataaaggacattcttcaggaaaaacctaaagcagacacgatgattctgggaacgaatttttgtgagcttgggggtggaagaggtggtagatttaagccgccgaaacttgaagaactctatgaaaaattatacgggaataagtttgatgaagcccacaatgcagctgccgacgtaaatgctactgctcaggttttctttgaaatgatgagaataggagtaattccttctgatgtgttgaagatttcagaagatcagcttgcttattttaaaaccttacatccggatcctatcaagccgtttgatatcgtaatcagaaggcag

SEQ ID NO: 88965 - DNA, 297 bp, Glycine max
  Peptide Sequence Number=SeqID_205743
atgtcggaagtcaaaaagaagcattgttgcacaatccgtgaaaagttccgtaacatttcggaagccacaaaagggatgattacggggaggaggacagaacaaaaaggttcaaccctcctgatatctgagaatcacttaaaattagtgagaaaaattgtttccgtgaagaaaatccaaggcaaggtgcttcctgtaacgcttccgagacgtttccgtgggcaatttcacgaagatttttcaccgttcttcatcgttcttcgttcattcttcatcgttcttcaaccactaagttcctga

SEQ ID NO: 88966 - DNA, 1604 bp, Glycine max
  Peptide Sequence Number=SeqID_205744
gcgccggccttggccacgacagccgcgttacgacggatgatcgcagcggcctggcgtccgcgctccacgaactctgcggccgccgcgccgcggctgagcgcctcgagaccgagggcccccgaaccggcgtagaggtcgagcactcgagctccggcgatggcgctcagcgactcgagcgcgccgaagagggattcgcggacccggtcgctcgtcgggcgtgtccccgcacccggcacgtcgagccgggcacctctggcgctgcctgcgatgatcctcgtcacccgatgccgctcacgctcgattcgtcgctcgaggatgccctcggcgcggcgtccgccaagacgctcggacgcgccttcggcatgcagaacgtcggcgaccttctcgcgcactacccgcgccgctacgcggatccgggtgagctgaccccgatccgcgatcttcccctcggcgagacggtcaccatcgtcgccgaggtgctttcctcgagcttccgtcgtatgcgcaatcgtcctggcgcgatggtcgacgtcgtgatcggagacggcatcggtcggatgtcgctcaccttcttcgccaagaatgtcggcgcggcggaatggcgttccaaggatctggccgtcggccgtcgaggtgtgttctccggcaaggtcggcgagttcaacggtgtgacccagttcgcgcatccggagtacgagctgttcgatgatgaagacgccgcgcggcgtagcgccgatgctcgggctgcggtgccgatcccgatctaccccgcgacctcggcgatccagacctggcagatcgcacgactcgtgggccgcgtcctggacgatctcgcgagcgtccccgacccgttgaccgaggagatcagggttcgggaggagctgctgagcgcgcgtgaggctctggaacggatccatcgcccgcgcacgcgcaacgacatcgatccggccgtccgcacgctccgtatgcacgaggcactcacccttcagacggcgctgctgcagcagcgcgacgccgtccgggcgttgtccgcgacctcgcgtcccgcccatcccggcggcctgctggagcgcttcgacgcgggcatgccgtacacgctcaccccggatcaggagaccgtgggtgcgcagatcgcggcggacctggtcggagcctggcctatgaaccgcctcgtccagggcgaggtcggatccggtaagacgctggtggcgttgcgtgccatgctccaggtcgctgagagcggtgggcaggcggcgctgatcgcccccaccgaggtgctcgccggtcagcacctgcgttccatcacgaagatgctcgggcccgacctggcgccgcttctcatgccgacgctgctcacggggcagctgccggcggcggagcgtcgcaaggcggcgcttcgggtcgcgtcgggacaggcgctcatcgtggtgggcacccatgctctgctgggggagaagacgaccttcgccgatcttggtctcgtcgtcgtcgacgagcagcatcggttcggtgtcgagcagcgggaggcgctgcgtgccaagggctcgagtccacatgctctcgtgctcacagcgacccccattccgcggaccgtggcgatgacc

SEQ ID NO: 88967 - DNA, 470 bp, Glycine max
  Peptide Sequence Number=SeqID_205745
atgcttgccgcccagctcgcccaggcgagctcagctcgcccaggcgagctcagctcgcccaggcgagcagggttgcttcctccagaagcaaccgccttctggaggaatcttctggagggcccaaatgggcctggcacctcacgaggaccaaagaatggtcgcacgttatcaagcaaaggtccccggacgaaattagggtatgacaccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacg

SEQ ID NO: 88968 - DNA, 1194 bp, Glycine max
  Peptide Sequence Number=SeqID_205746
atgttcgacccggacgccggcttcttccagagccgcaaggccgatgggcgctggcgcgtggacgccaaggcctacgacccgcgcgtgtggggccacgactacaccgaatccaacggctggacgttcgcgttcaccgccgcgcacgacggcgagggcctggcggcgctgtacggaggccgcgaaaagctggcggcgaagctggataccttcttcgccacaccggaaaccgcggacccggcactggccggttcctacggcggcaccatccacgagatgaccgaagcgcgcgacgtgcgcatgggcatgtatgcgcacagcaaccagccggcacaccacatcccgtggatgtacctgtacgccgggcagccgtggaagacccagcagcatgtgcgcgagatcctgtcgcggctgtacgtcggcagcgagatcggccagggctacccgggcgatgaggacaatggcgagacctcggcgtggtacgtgctggcctcgctgggcctgtacccgctgcgcatgggcgccccggagtacgtgatcggttcgccggcattccgtcacgcgcgggtggaactgcagggtggcgcggtgctgaccgtgaacgcgaccaacaactcgcgtgagaacgtctacgtgcagtcgctgaagatcaacggtacgccgtggacgaagacctgggtgccgcacgacctgatcgccaagggcgcgaccctcgacttcgtgatgggcccccgtccctcgcgctggggcagtggcgtggacgatgtgccgcgctcgttgaccccgcgcggccagcgcccccagctgctgcacgacctgctcggcagcggcaccaaggcgacgctggccgatggccgtgccctgcccgcgctgctcgatgacgatgccggcacgacggtgggcctgggtagcggcgcaaccatcgcgctgaccggcctggccgagggcaccccgacgatgtacacgctgaccagcggcgacggccgcatccagggcggtgagtggacgctggaagcgcgcaacggcagcggcagctgggccgtgctcgaccagcgcagcggcgaagacttcgaatccgcccgccagacccgtccattccggatcgccaaacccggtcgttacagcgagtaccgcctgcgcctggcggcaccggcacggctgccgctggcggagatcgaactgctgtcggccggcacc

SEQ ID NO: 88969 - DNA, 183 bp, Glycine max
  Peptide Sequence Number=SeqID_205747
atgcatcaccaaaaagggaaaactctaggtgaggcttcattgttatcaagtaatagatacaaagatacacaccaagaagtaacaacttatcaaaggttatatacaagcatgagcgaaacaacgaacaaaggaaacaacattgaagcaaaaccgcaaacgaacggtaacggaatggaactttaa

SEQ ID NO: 88970 - DNA, 334 bp, Glycine max
  Peptide Sequence Number=SeqID_205748
atggaaggaggcataggtcccatactagacctcactcccaaagaagagaaaaggatagaagataatgttgaggcctacctagattgggaaatgaaggttgaacaactctttgcttgccatcatattagtgaagaaagaaaagttccattagctacccttagcttccaagggtatgccctctattggtggacttcccttgttagggaaagaaggattcataggaatcctcttgtagactattggaatgatcttaagagtgcccttaggaagaagcacattccctcctactatgaaagggagcttatggataagctccaaaggcttagacaaggga

SEQ ID NO: 88971 - DNA, 135 bp, Glycine max
  Peptide Sequence Number=SeqID_205749
atggcgaaagacaacgattgtgcctcaaagccttacactggggcaatgaaaggcaccatgtacaaggtcatgacgaaagataacaattggtacctcaaagccttacactggggcaatgaggggcatcatgcatga

SEQ ID NO: 88972 - DNA, 438 bp, Glycine max
  Peptide Sequence Number=SeqID_205750
cgcgaccatagccgcgacgagctgaaacgcaaactgcagctgaacaatcagcgtgcggcctggctgcagcaacaggagagccagccgataccggaagcgctgctggagaaagtgctcgactggtgtcaggagaatggctggctcaacgaccagcgttttactgaacgctttattcagagtcgcgcgcgcaaaggctatggtccacagcgggtgcgcatggagctgcagcaaaaaggcatcgaccgtgatgagatcaaccaggcgctgttcgatagcgaggttgactggagccagtgcgcggccgaggccgctaaacgtaaattcggcgaaccgctgccgcaaagctgggcggaaaaaagcaaagtccagcgctttctgatgtcgaaaggctttatgatggaagacattcaggcgattttcagaaatattgacgactga

SEQ ID NO: 88973 - DNA, 132 bp, Glycine max
  Peptide Sequence Number=SeqID_205751
atgcctagggcacagaattccacagcacaccacagtgcctatttcgggaaaagagctctggaggcgacaagaggagtagcttttgcagagatacctaggtttttgcttaaattctgtatgctcttggtctga

SEQ ID NO: 88974 - DNA, 249 bp, Glycine max
  Peptide Sequence Number=SeqID_205752
atggccctgctgttcttatttgtgtcaaaagaacaagtggtgagcttgtgtggaaaaccactttggattaccatcctgaagcattcatcaccgtgtctgggacatattacaaagagtcagtactactgtaaatctcttggcccttctccattcaaattgccattcattattctaaccttgctaatgaacttagtggcaaacattctgtcacctcttgggtcacaattcgtggcctttttgaatgaataa

SEQ ID NO: 88975 - DNA, 164 bp, Glycine max
  Peptide Sequence Number=SeqID_205753
atgctggatcatcctgaacccctgaaactcccccattgtacagaagttcttcttagagcttgcgacaaccacatgacagtcttaaggcggcatggccccccactgcaatggaaagttgaaacgctgaatcctgctattggtggaaaaggtgttatccaaccatg

SEQ ID NO: 88976 - DNA, 462 bp, Glycine max
  Peptide Sequence Number=SeqID_205754
atgatcacgctaagtgcgttcatcgttgctgatgaaaaatatgatgaacccactaagtgcatctgtgcgctaagcgggcctagtgttttagacttgctgatgaaaaatatgatgaacccactaagtgcatctgtgcgttcatcgttgctgatgaaaaatatgatgaacccactaagtgcatctatggcttccaagaaaagaaaattatttgcttcttcatcttcccagattagatttgacagatcacgattccattcacaggaagcttgggaaagatataatgatattgtggtacctaggaagctgctgccagagagaaatgtggtagtataccacactgaatttgatgagttcaagaaggaactcgagagaaggaaattggatgaagaattgaccagttttgctgaaggcagcatcgatgttgccatagtaaaagaatgttggaccaagtggcctcaataa

SEQ ID NO: 88977 - DNA, 411 bp, Glycine max
  Peptide Sequence Number=SeqID_205755
atgcctaccaaaagttggagctttgttggagcttcaatggtggaggaagaagaagagaatggcaacctatgccacatgtctccatttgagtggagcagaaagggcccaccttcttctcttgatgtgactcatgcacagtcacaagaagaaaagaaaaatctgacctttgaaacgctaaaatcctaccttggtttgcgtgccatttctctggaaattcttcatacggtagaaggttcttccgtacaaacgattctcttcctatggaagaaggttcttccgtatgttcttacggaagaactttcttccgtaactgaaaatcattcgtacggaagaaggttcttccgtgagttcatatggaagaacgttcttccgttgtttacactggaatttggtaaacaaccgctagtctaa

SEQ ID NO: 88978 - DNA, 915 bp, Glycine max
  Peptide Sequence Number=SeqID_205756
atgccgcagcgcgacgtcgcttttgcccgtagcgcgcccgcgtatggacgctgggttagctggatcgtggtcctgacgctggcagcgaatggtctgtggctggtggcgaccaatcccaattttgagtggcacgtggtgctgcagtggtttaccgaaggctcggtgctgaaagggctgcaggtgacgctcgggctgacggtggtgtcgatggtgctgggcaccctgctggggctgctgctggcggtctggcggctgtcagagaataaactgctgagcggcgtgtcggcgctctacatctggttctttcgcggtacgccgctgctggtgcagctgatattctggtacaacctgtcgacactgtttcccacgctttcgatcaccgtgccgtggacggacatcacctttgccagctggaatactaacgatctgatcacgccgctgactgccgccatcgccggtctggcgctcaacgaggctgcctatatggcggagattatccgtgccggcctgctgtcggtcgatcacggtcaggttgaaaccactcaggcgtttggcatgagccgcagccgcgcgctgcggcgtatcatcattccacaggcgatgcgtgccattattcccccgaccggcaaccagctgattagcatgattaaagccacgtcgctggtgagcgtcatcgcgatgggcgatctgctctattcggtgcaggccgtttacaaccgtacctttgaaatcattccgatgctgatggtggcggtgatctggtatctgctgattacctcgatcctcaacgtcggccagtcaggcattgagcgctattacgcgcgcggcagcaaacgtaccgtggtggtgaacaaacgacgcgccagcagtgacacggcgctggctgcggccccgcgtttaaaggaggacgtatga

SEQ ID NO: 88979 - DNA, 186 bp, Glycine max
  Peptide Sequence Number=SeqID_205757
atggatacatgcatcactcagcttgaagaggatgaattaaattgtcatcataaaaaagggagagattgtagaagtaaagactttgactttgatgttttgatgatgccatgtgatcatgcgcttctcaagtttaattcaagacaaaaatccaagaaattcaagatacatcatcaagaagatctatag

SEQ ID NO: 88980 - DNA, 410 bp, Glycine max
  Peptide Sequence Number=SeqID_205758
tacccaatgtcgtcacccctcccaagttcaaggtgttggactttgacaagtacaagggaactacttgccccaagaatcatctaaagatgtattgtcggaagatgggggcatacgcaagagatgagaaattgcttatacatttcttccaagaaagtcttactggggcagctgccacctggtatactaacttggaaccttcccaagtccattctaggaaggacctaatggttgcctttgttagacagtatcagtacaattctgatgtggctccggataggatgcaactacataacatgggtaaaaaggggcatgaatccttcaaaggatatggcagcccaactggcgcccccaatgacggaaagggagatgataacagtgatagtggacacgttaccaatgttttactatga

SEQ ID NO: 88981 - DNA, 507 bp, Glycine max
  Peptide Sequence Number=SeqID_205759
atgtccaaatcttgtggatttgggatgaccggccctctcgatgagtcgatctcttgctttctcataagggtggacccttgggtacttgtacttatcgccttcagaggactgcacgtcctcaccttgagaggactacacgtcctcgccttgagaggactacaggtcctcgccttgagaggactacacgtcctcaccatcagagggcaacacgccctcacctccagaggactacacgtcctcgccttgagagggctacccgccctcgccttggggctacacgccctcgccatcagaggactgcatgtcctcacctttgtagggctacacgccctcacctttagaggactacacgtcctcgccaacagagggctgcacgccctcaccttgagaggactacacgtcctcaccatcagagggctgcacgccctcacctccagaggactacacgtcctcgccttgagagggctacccgccctcgccttgggtactagttaccctcacctttag

SEQ ID NO: 88982 - DNA, 177 bp, Glycine max
  Peptide Sequence Number=SeqID_205760
atgaaaggcctttttgttacaaaacttgaaagcaatgaagtgattcttagtccaatagctcttaaggtggttggcccctttcttcttgactcaaattcttcaagggatggcaccaatccttcttccaattccttatatgacaacccacaaacaaggaaacaaagagacaagcaataa

SEQ ID NO: 88983 - DNA, 462 bp, Glycine max
  Peptide Sequence Number=SeqID_205761
atgacatgcggggaaccatttggtcccgcactttttcaccttttgtcatccaaaggcggcgggcccgatgacatgcggggaaccatttggttccacactttttaccttttgtcatctagaggcggcgggcccgatgacatgccggaaccatttagtcccgcactttttcaccttttgtcatccagaggcggcgggcctgatgacatgcggagacaaattatggtcattctgcttaccttttgccatccagacatagtcgtgtccgatggcatgcagagacaaattatggtcattctgcgtcttttgtcatccagaggcggcggagccgatgacatgcgggaatcatttggtcccgcactttttaccttttgtcatccaaaggcggcgggcccaatgacatgcgggaaccatttggtccgcactttttcaccttttgtcatccaaaggcggcaggcccgatga

SEQ ID NO: 88984 - DNA, 272 bp, Glycine max
  Peptide Sequence Number=SeqID_205762
ggttcgtaaaggaggaaatatggttcttgctgcaaaatcttgtgatgatatctttaacaacctgttgcaagatggggtttctccagatgagctttataagacagtgttcaagcaggaggttgaaattgttctcactgctcatcccactcaaattaaccatcgtaccttgcaatataaacaccttaaaattgctgtgggagagaaaacttcgagatgggagacagatgaacttatgcgttcaaaacccactccagttgatgaagctagggcaa

SEQ ID NO: 88985 - DNA, 257 bp, Glycine max
  Peptide Sequence Number=SeqID_205763
gaacaacaagctgagtggataaatgcgcagagacagattctgtgccctttatcattcaggaatgacaagctgagtgggagcagcgaagcgggtgatgaacgcgcagagacaaattctgcaccctttgttattcaaaaaacgggcgatcgtgttcggtggcatgtagagacaaattatggtcattctgtatcttgccgcccaggctcgatcgtttccaacaaaacgttccgctggcaaggaggttcactggcggaatg

SEQ ID NO: 88986 - DNA, 147 bp, Glycine max
  Peptide Sequence Number=SeqID_205764
atgagaatcaatatacaaggtggtgatgcagagacaccaaagagcaagaagagtgaagggtcatctaatgctcagtcttcaagtgttgttgctcctaaacccaagaaacctgtctattcctattgggtggacaagagaagaggataa

SEQ ID NO: 88987 - DNA, 409 bp, Glycine max
  Peptide Sequence Number=SeqID_205765
atgtcgaagcgattaccacctctgaatgcattacgtgtttttgatgcagccgcacgtcatctgagcttcactcgcgcagccgatgagctttttgtgacgcaggccgcatggctggtgccgcgactctcaagctttaactcagcttatccggggatcgacgtgcggatccaggcggtggaccgtcaggaagacaaactggccgacgacgtcgacgtagcgattttctatggccgcggcaactggccggggctgcgtgttgaaaaactgtacgccgaatatttactaccggtttgttcgccgttgttgttaaccggtgacaaagcgttgaaaacgcctgccgatctggcgcaacatacgctgttacatgatgcctctcgccgcgactggcaaacttatacccggcaactgg

SEQ ID NO: 88988 - DNA, 957 bp, Glycine max
  Peptide Sequence Number=SeqID_205766
atgtcttgcaaaggaatatttgcgattattgtactattgtggttcaaagcttctttgtcaattgggggccaaaaccttttagaatattggattgttggtttttggattggggtcaagttcaatcaaatttcaatcattgataatgagctttttatggccaagtttggtgttgaggaggtaagggaggccgtgtggagttgtgggagctcaaagtgccagggtccagatagttttaattttaattttataaaatccttttgggagaccatacaaggggatgttttgagatttttggatgaattccatagatatggggtttttccaaaaggatgcaactcatccttcatcacacttatcccaaaagtggaggtggcaaacaaattgggagactataggtcaatttctcttgttgagtgtatgtataaaagtgtggccaaagtcctctcatttagattgatgaaagtctcaagtggtatggtggataaaatacaaagcgcgttcttgagtggaagatctctactacatagtgtacttgtggctaatgaagtggtggaggaagctgagaggtcgggaaagaattgcttgctattcaaagttgattttgaaaaggcatatgactcagtatgcctattggggctaatccgaggaaaaatgccaagtctttttgtgaggagagttgtgcctattcaaagaaattttttgtggggttgtgaggagggaaaaaagaaatacctaaaaggaggaaaggatttgtcttatgaggggtgggaaggtgagacggggagatggaatttttcttggaggagggaatggtttgtttgggaattggaggtagtggacaaatttcttaatattgtaaagagtgcgaggatggatattctttttgctcgaatcactagttgggaatcaggaggaggaaatttttattcaggattggaggttgggaatttcacctaa

SEQ ID NO: 88989 - DNA, 333 bp, Glycine max
  Peptide Sequence Number=SeqID_205767
atgaccgcttcgaggaactcaacacccatcgtcaggcaatccgtgaagttccgcgacatgccggaagtcgaaaggaagcattgttgcgcaatccgtaaagttccgcaacattccaaaaatcaaagaagggattgttgcgcaatccgaggaagcaactgggcggcaagctcctccacgtttttgaaaaatggtttccggggcttccgtggcatccgtaatgcttccgtaaaattttcgaaaatcttgggtaagcatattcatcttaacattggtgaaagggaagagaaaaaagatgaaaatcaaatccgaaacacttccgtaaggcttccgtaa

SEQ ID NO: 88990 - DNA, 225 bp, Glycine max
  Peptide Sequence Number=SeqID_205768
atgaatgatttgggtggtgcaacactcttttgtaaaatcactcgtgcacccaacatcttcatgatttatgtacatagggactcattaggtaggaataatcaacatgaaaatacagaaaaaggggttcccatgaaccctaagagaataaaggtcattcctgagtggcccgctccaccaagtgtgttgaggaaaaaagcccagagtttcaagaaccttgggatttga

SEQ ID NO: 88991 - DNA, 264 bp, Glycine max
  Peptide Sequence Number=SeqID_205769
atgaagtgtaccttgggctcgaacaacgaagggattccggtggctgcggaagggggttgtgacggagggaacggcgacggcgaaggtggaagcttgggtggtcattgccggagcgagaaaagggaatggtggttgttgacgttgaggtttcaggttccaggcaatgccatcattctttggctctcttcatcttcttatccacattatattccacctcctcatccatcaacttcagatttggattttggattaccccaaatttaa

SEQ ID NO: 88992 - DNA, 438 bp, Glycine max
  Peptide Sequence Number=SeqID_205770
atggccaacaacgctaacatggctgcaatgcaattccaggtgttttgtttggaacacagatcctacaagtcccattcatgcccaaaatccgaccacaacagcagaaaggtggttgtttgcgaagcatgttccatgtccattgagaccaccggcaacgtgggacaagacaaaaaggcaatcttgcagaagcatctcaagtctggtatctgtgaccccaccaagaagaagaaaccaacttgccccgtcaagcgttgcaaggaggttttgacgttttccaacaccagcacatgtaaaacatgccacattaaggtgtgcctcaagcaccgtttccctgctgatcatgcttgtagcagaggagcttcagcttctgttgctaatgaatgtgccaaaaatggtgctactcgtcctcctagcactccttctgttaaggcctattga

SEQ ID NO: 88993 - DNA, 912 bp, Glycine max
  Peptide Sequence Number=SeqID_205771
atgaaggagaaggaggtgtgtatctcttccagtttttccacagattggatttgcaaagaatatatgttggaggtccctgctgtgggaaagcatctaggaaatttcattggaagcttcatggagtatgatgataagaacaacactgaagatggaggaagatggaaaagtaattgttccaacacccacagaagctacaaacacccaaagattgataatccaagcaatatgagagacctcaggccaatcgctctatgcaatgtgatatataaaattcttgcaaaggtccttgccaatagacttggtggagtgattgataaaattatttctgaagaacaatcaggtgatgttgctctgaaaatcaacattagtaaagcttatgatcacatgaagtgggattggattatctttggggaattgtcttgcctcattaaagatgttgaagcaaaaggtgccctccatggtataagaatttgcaaaaatgctcctccggttactttcagcaagaatgtcaatgtggatttacgaaaggagatcacatatgagcttggagtaattgaaggctcagagacatgtgaaacggatgttgaatctagtttctcgcaaattgctcctcccatctttgatgaggagagttatgacctttggaaggtgaaaatgaagtcttacatgaagtttttttatttgtgggatgctgtggaaaaggattatgaagtgtctccgctgcctgaaaatcccaccacgacccaaataaagcatcacaaggaggaaaaaaccaagaaggaagagtatgaagggaatgagcacgtttgtggcatgcaagtactatacctgagaaaatttgaggtgcaaaagataaaggaatccgagacaattaaagggtacttggatagattgcttgacattgctaacaag

SEQ ID NO: 88994 - DNA, 381 bp, Glycine max
  Peptide Sequence Number=SeqID_205772
aggaatgggtcaaatgagcagactgggctgcatgtagaggagaagggaaataaggaaggaattgcaggaaaggtctacgcagcagagaaaaggcaaaagaagaggctgttgaggttgttaactgacaggcaagctggcatgtgttgtttggaggggttggctgaccataaagatacgttgggtgcaccactgtgcccttgccggcattatgatgataaagctgctgaggttgcacaaggattttggaattgcccttgtgttcccatgagagagaggaaggaatgccactgcatgctatttctcactcctgataatgattttgctggcaatgaacagactatcaccttggatgaaattaaagaatcaacagccaacatgtaa

SEQ ID NO: 88995 - DNA, 1707 bp, Glycine max
  Peptide Sequence Number=SeqID_205773
atggagattcaacaaagcttgaagctcacaatccacaagaaatggccatcatcacccaaaaaaccacctaaagaaacagaaccaataaccaccaccccaactactccaaagctgaaatggaagaaaatcttcttccaaaccaaaaccaaaacccaaactcaaacacccccagaagaattcctctgccctatttctcattccctcatgttcgacccagtcatcgtctcctccggccactccttcgaacgctcctccgtggaagcctgcataaatgtcaattttacccctcaactccccgacggcaccacccccgatttctccaccctcatccccaacctcgccctcaaatccgccatcctcaaatggtgccaatccacccacacaccaccccctccacaccccaacaacaacaacaaccacctcgtacaaaccttaatctcctcgaacccaagcctcgtacccaccttaaaccccccgaacccaagcctggtacacacgaaccccaccccagagaaaatctccgaccaagatttgattttgaattctctgaacgaaaacccaccactgacgaacctccgccaccacgcggaaaccgaggttccgataagacggacacatttgtacacaagttccgatgaatccatagcgacaacgtcagcctcaacgccgccacttcaactctccacgcgcccaagctgctgctactactcttcaccttcgtcttcagaactcgaacccgccacaaccccagaagaagaagaaatcatgacaaagctcaaaaaccctcaacacagtataatcgaagaagcgcttatctctctcagaaaactaacgagaataagagaagaaacaaggcttcaactttgcactcctcggttactctccgcgttacgttccctcgttttgtcgaagcacgtgaacgttcaggtgaacgctcttgcatcggtggtgaacctatcgttggagaaaagtaataaggtgaggatcgtgcggtcggggatggttccgccgttgatcgaggttttgaagtttggatcctctgaggcgcaggagcacggtgcgggcgcgctgtttagtttggcaatggatgatgataacaaaaccgcgattggggttttgggtggtttggctccgttgcttcacatgctccgatccgagagcgagcggactcggcatgactcggctttggcgctttatcatttgtctttggttcagagtaaccggtccaagatggttaaactcggttcggttccggttcttttgagcatggttaaatcgggtcatatgatgggtcgggttatgttgatattggggaatttgggttccgggtcggacggccgggccgcaatgttggatgcgggtgtggtggagtgtttagtggggttgctcagtgggcccgaaccggggaccgggtcaactcgggagagttgtgtggcagtgatgtatgcactgagtcacggcgggttgaggtttaaggcggtggcgaaggcggccggggtggtggaggtgttgcaaaaggtggagaagatggggagtgagagggccaggcggaaggtgaggaagatattggagataatgaggacaaaggaggtggaggaggaggatgtggattgggaggagttgctagactcggggttgggttgccggactcggagtagactcggtggtgggttggatgagtcaagtgcaaactcggccgagttttga

SEQ ID NO: 88996 - DNA, 405 bp, Glycine max
  Peptide Sequence Number=SeqID_205774
atggcaaggtgtgggacaacacatcctccacgagccaatctgtggtgcatcaatatgatattttctaccaagtatggatcagagcacaagaaaataataatcaccaacgctcctcgtcagttcatcaacaccaccaccaacaagtctcatcctggttcgtacaagtgcaacattcatgcagctttttgcgttgatcttaattgcacaagagaagcatgggccttacgtgcaacattaaatattgttgtcaacatgggtctcactaacgttctctttgagatggataacaagtcagtcgttgacaaagtgaaaaataccaagaaagatgaatctgaggctggaattatcatcagtgagtgtgaagagattttagcatctaataaaaccttccatttgggtttttag

SEQ ID NO: 88997 - DNA, 306 bp, Glycine max
  Peptide Sequence Number=SeqID_205775
atgacgccgaacaagttcgacaatgcttacttccagaaccttcccaagggtttgggtgtgttgaaatctgaccatggtttgtatggtgacccttctacgagaccctttgtggagaccttcgccaaggatcaaaatagattctttcaggtttttgctagggcgatgcacaagttgagtctcttgaatgtgcagactgggaggaaaggagagatcaggcgcagtgtttatgaggttgtaagagaatgggggcattggggtattgaggagttactattgttgttcttcgccctcttgttctttggatag

SEQ ID NO: 88998 - DNA, 246 bp, Glycine max
  Peptide Sequence Number=SeqID_205776
atgcagaggaacgtattatctaatccattcaaaaagttgaatcaaatgaaggaaggtcctgaatggtacaagattttgcagaggaatcgagcttgcatcttttctgacaagctctgcagttcttcttcgctaaccatgggatgttatcacgtcccgttatgcaggcatcattacaaccaagggagagggaatatcatggaaagttttcagagaaccgggtttggatttgacgattttagcgtttga

SEQ ID NO: 88999 - DNA, 672 bp, Glycine max
  Peptide Sequence Number=SeqID_205777
atgtcgttgaagactgataagcccctgagcgtagcgagggttgtaggaggaggaagtgttgttggagaggttcgtgacgaactcggagcagtgagagaatccgacggtgtgggccccactgagggcgacgaattcttcgacggtgaagccgcgtttggcgaagagttgggtgatttgagagatgggcatggagggggtggggaggtgggaggatacggcggaggcgagggaggttcggccgtcgcggcggccgaggaagacggggaagaaggggccgccgagcatggtgaggaggtcgcgggtggcggcggagaggatgtcggagcaggagacggtgttggggcaggagagctcgagggcggtcttggcacggacgacgaggtcgaaggcgtcgccggggagggagaggttgatgtcggcgtcgcgctcggccttggagaaggcggtggaggagaggaggatggaggcgtcgcagccgttggggaggaggcagtcgtggaggaagaggcggagggtggcggcggcggtggtggggctggcgatctgcttgctggttactgtaaatccaaggtgagtcgcgcgttagcagaagaaaaagatagtagcaatgtggtgaagaggaagaagaagaagagagaaaatgaagccattgttagagaagttgagaactga

SEQ ID NO: 89000 - DNA, 738 bp, Glycine max
  Peptide Sequence Number=SeqID_205778
atgtttgtagaggtagaatggaagaagcctccaacagaagttgaatctttacgtgttcgcttgctctatgctgggacaaattacatgagaatggtggaaccccttgctattgctcagtactacagagaggggggtaaagattatatgaaagaaaggtctaaacactttgtatggttggaggagttattgttgaaggaacagaaacaaaaagacacaggcaattcaaacgatacaaacaaaaagaatgtggaaatcattttaacttatgattcttgcttttgggcacatgttgaagaagctcttcttttgtgcaaacaattggtgaatgtacaatatagcgtgactgagaaggaagaggcaactaggaagttgctcgaattcgagaaatttagcagtggattcgagcttgcatcttctgtgacaagctctgtccttcttcacagatcatggaatgttatcacgtcccgttatgccggaatcgttacaaacgtgggagagggagtatcatggaaagtttatagagaaccaggttcggatttgacgattatagcctttgaggtcaagctagatttttctaatgttcaagcgggtttggtttcatctaatactctcagggagaataatttccatcactttgagtttctgtgtaccaagaaagatccatttttttctgttaacaagactgcaatttcactcttttctgaaaactatgagaagcttgatcaactgaaatccgag

SEQ ID NO: 89001 - DNA, 270 bp, Glycine max
  Peptide Sequence Number=SeqID_205779
atggaagcaacaatggaagcaataacaaacaataaaagggacatagaccttacctcgatgaaggacaaaagagcagcacctcgcgggagaagaagcgcactcgaaggaaggagaagcagcagcttgcatggaagaagaacaaccacctcgcactggagaagcaaaggggctcgcggaagaatgaggaaggaggaagaaagggtcgtcggcgaaagaaagaaacgaagagactcgaggaagaaaggagaagaagaaaagctcatagaataa

SEQ ID NO: 89002 - DNA, 327 bp, Glycine max
  Peptide Sequence Number=SeqID_205780
atggctgaggagaaagacgctttctacgttgtaaggaaaggggatgttgttggcatctacaagtccttcagtgacatccgaccttcccttgcatcttttgatccatattcatctggaggaagagctttcaatgtgagttcctcatcaaggaacttgcatggagccattcagtttgacactcgtctttcgtgtaaccttcattttgatggtgcgtccaaaggaaatcctggaccagctggtgcaggagctatactgcgtgatgggagcaaggaatacaactctgaagctgatgctcaagcaaacctggccataaatctcagaggttag

SEQ ID NO: 89003 - DNA, 174 bp, Glycine max
  Peptide Sequence Number=SeqID_205781
atgaaatgcgagagcgcaaagggaagctgcaaaaggcaaagaagggagaagatgaagaagaagaagaagaagaagaaaaggaagaagaagaggggcgagcagagtgcagagacaaagtttcaagtgaagagaagaagtttcagctctgctcttgatttcccacacgctatctaa

SEQ ID NO: 89004 - DNA, 411 bp, Glycine max
  Peptide Sequence Number=SeqID_205782
atgggttcgaatccggaaacagcctctttgcatatgcaagggtacggctgcgtacaacatccctcccccataccttcgcatagcgaagagcctctgggcaatggggcagagggaacagtgagtgaaacagctattccagctttaaccaaagctttagaggaggctaagagtaatgttagtgatgtttatttagacccagtattgtacatcttagattcaaatgagacagatggtgttactgatttgaagtttcagcttgccgagggacttgcaattttagagttgaagaagcagacaacagtccaagctacaggagtggcttctggtcttttagaaaccatacaaggttcaggctttaaactacagacattaaatctgagttttgaggatgaagaagttgcagttgcctag

SEQ ID NO: 89005 - DNA, 678 bp, Glycine max
  Peptide Sequence Number=SeqID_205783
atggcaccaaatactgagaagtctaacaacaacgacttcaccttgttacaagttcatgattcggattctcccatgtttccagagaagcagaaagccacaagccgcaagcagtttacttggtttcttctccttaaactccacagagttctgacatgtttgtcatggttgaccaattgtctcaaagccacttttgctttggtcaagaagcgcgtttcattggctgacatgagcgatgagggccctaagagtagaggaaagttgtacaggttcatcaaaatctttcttgctctctcaattggaggcttggccatagagatcattgctcatttcaacaaatggaacttgcacaacatgattcagccttgggaggttcagggtctgctgcaatggtgctatgtggcttggctctccttcagggaagactacgttgctccattagtcttgatggtttcaaagttctgcattgtcctcttcttgattcagtccttggatcgccttgttctctgccttggatgcttctggatcaagtacaagaagttgaagccaacctttgaggcagatgcatgtgatgttgaggacccttcaaacttcccaatggtccttgttcagattcccatgtgcaatgagagagagaaatgtcacttggaggagttggcttcaccattctccaaccactga

SEQ ID NO: 89006 - DNA, 3588 bp, Glycine max
  Peptide Sequence Number=SeqID_205784
atggctgaccacggaaccagaaagatgaccactgatcgcctcgaagatgccatcgtacgcctcactaatagtcaggctttcattaacgaacgttacgcagacctttctagcaaggtcgattcgattttggatcacctttgcctccacgattccggccagaacaccaccaccactgcgaatcaccagaaccatcaacgcaacgcggtcaagcttgacatactgagatttgatggacacgatccgttagggtggatcttcaagatcacacagctttttcaataccaaaacacaccggaggaagacaggatcaccgttgcgtccctgtaccttgacggcaccgcattgagatggtatcaatggatgttcagcaatggctttatcacgtcatggaacggtttcctccaagctctcgaatcatggtttgctctgacgttctacgacgatccaaaaggcgctctattcaactgtttcatctctggattaaacccaaacattcgacgagaggtactggcgcttcagccaatctcactcttgcaagccaccgcctttgccaagcttcaggaggagaaactacgtgacaagcaagctccaataccacgcaacttcgtcccacctccgccctccgctagccatatcactcacacaacgagcaaagctaaaccttcctacgttcaacgaacaccagaggaaatggctttccggcgagagaaaggcttatgctataactgcgatgaaaagtggaacgctaatcatcactgcaaagggcgagtaatgttgttcatcgccgacgagcaattgtcgttaccagagactatcgagccaggacctgaggaggagcaggttgcagttgttagtgaacacacagaatccccgtctgataccggctgctctcacataagcctccatgcgttatctgggttaccctcgtcggataccttcagaatatttggcacggctaaacacgcgcgacttaccatcctcattgatagtgggattggaaatggttctatgttggaatgcgatcaggtttgccccgatattcaggtcgccatgcaaggccactcctttgcagttacattccatcttctccagatcagcggtgccgatgccatactagggatcgattggttgaagaagcttggaccagtaacaacagattacactacgtttgttatgcactttaatcatctgggccaagatatttcgttaaaagcagatgtcacaattgggcctgaaccaacatcagtagcccaattgaaatgcctcattcatacgggttcgacgtcagtgttttatcacttgagcctcgtacccgaacgtcgacccgagcaacccacggcccaacaccccatctcctctatcgcaaaccttcttctacgatatgatcatctcttccagcctctatctcagttaccgccaccatgcaatgtggttcatcgaatcaccttgaacccatccaccgctccggtgaacgtccggccgtaccgctacccccatttccagaagaatgagatagagaagcagatttttgacctcttctctgcggggttgataaggccaagtacgagcccctactcttctccggtgcttctggtaaagaaaaaggacggaatgtggagaccatgcatggactatcgcgcacttaactcagtcacagttcgcgatcgcttccccataccaacaatcgatgagctattaaatgaattgggccacgcctcctggttctctaagttggatctccgctcctacaaccattcttgcgctgattcgccattgtgttctttgatgacatcctggtgtataacaactccttgtcatcccacgttcaacatttggagatcatctttcaaactctacaacaagggagttgcccctgaaccatccaaggttcaggccatcgtgaattggccaccaccaacgtcagtcaaagaactacgtgccttccttggcctcacgggattctacagaaagtttgttaagagctatgccgccattgcagccccacttacaggcttgttgtgcaaagatgcgttcacctggacaccggaatcccagacggccattggtgtcttgcttctgcagaatgggcaccctctggcttacttcagtaaaggcctcggccctcggctcctccatgcctccacctatatttgggaactgcatgctatcgtcgcggcggtcatccagaccccggagcaacattactacctctcaaaattattgggttatgagtattgcatccagtacaagggtataatatggctaaacaacgacaacccatgcattcccaaattgttaactgaatatcatgcaactccgttaggtggtcatctgggtgtagctaagaccacccatcgcatcgaatccaatttcttctggacaagcctgaaacaggatgttaaacgttttgttaaagagtgctcgacatgccagcaaactaagagtattaccaggcgtttagcaggcctgctgcagccattgccaccaccgactggggtgtgggaagacctctcaatggacttcatcacacacctacccctttccaatggcttcacggttatactcatcgtagttgatcgatattcaaaaggggtgcacctgggtgccttgcccactggtttcactgcattcaaggtcgccaccttgttcctggacattatctgcaaactgcatggatttcccaagagcatagtgtttgatcgggacccgatattcctgagcaagttttggagcgaattattctggttgagcgggacacggttgcgactgagcactgcctattatccccagtcggatggccaaaccgaggtgatgaactcgaacaatatccttcgttgctttgttcattcccaacctaccgcgtggttccgatacttggctcttgcagaatggagttacaatacttcgttgcattctagttcgggtctaacaccattcaaaatcatctatggcaagccacccccaaccgtacttgactatgtggctggcacgactaataatgaagctgcccagtccttacttgagtcccaccatgcactgcattctaagcttcaacaaaggttgaagaaggcccaagaaacgatgaatcactacgctgatgcaaaacgagatagcgtctccttcgaagtagggcaatgggtttacgtgaagctcagaccaggccgccagagctccgtcatcggacagccccacccgaaactatccgagcgtttcttcggtcccttccagatcatggagcgcgtcggagcgttcctggatcagcaacctctccgacaaccattatgtttcctcgacgttaaactcgatcagtcgacaacaccacccaccctgttgatccttacacaatgggtcggcgagccaccagaggatacttcttgggagtcgtggtctgaactacgcgacacctaccaccttgagggcaaggtggattttggagagggaggtattgttagcaccacccaccagatagaagaagagaagacacgttcaacctcatcgacgctggtggtacaacccacgagaccagcacgaactagggctaggccactgcgcttgcaagattaccacgtagatgggttaccatattag

SEQ ID NO: 89007 - DNA, 537 bp, Glycine max
  Peptide Sequence Number=SeqID_205785
atgggagctattgggcctaattgtgctgttaagaataatagttttgagtgcattgagatggaaaggaaagcccttcttaagtttaaacaaagtctaaatgatccttttcattgcctatcttcatgggttggcagtgattgctgcaaatgggtgggcataccaacaaatattggagcactacatcatttggaaagccttgacctttctagcaaccatatctcaggtccaattccttcaaatatggcttccttgactttcttgggacatttgaactacttgtcctataacaacttgtcaggtgaaatacccacagcaaatcagtttcatactttgacagatccctccatctatgagggtaatccacacctttgtgggacacccttgtccattaagtgttcagaatatgatgatgaaaacaccacagatgaagatctagacagttcccatgataagttatggttatatttgagcataggacttggcttcattgtgggattttgggctgtttgtggcagcttagtattgaaggaatgttga

SEQ ID NO: 89008 - DNA, 3606 bp, Glycine max
  Peptide Sequence Number=SeqID_205786
atgaaaatctcgttgcgtgcccagagaaagtggggtttcatcgatggaacctatgaacagcctgacgacggctcaccagaaatggaagattggtggactgttcaatccatgcttgtgtcgtggatattgaatgccattgaacctaccctgcgttcaacagtgacatatgcggaaaacgcaaaagatttgtgggaggacattcgagatcgtttttcagttgtaaatggtccgagaatccagcatctgaaagcggaattagttgattgcaagcaacaatggatgaccatggtttcctattatggcaaattaaagacactttgggacgagctcgcgaattatgagcagatccctcggtgttcatgtggaggatgcaaatgtgatattgcatccaaactcgaaaaacgaagagaggaagaccaggttcatcagttcttgatgggcttggatgatgcgagttatggtactatgcggtctaacatattagctgttgatcctctaccttcattaaatcgagtatacgcaattctagtgcaagaagaaagggtgagaacaatcagcagaacaaaggaagagagaggagcagtcatgggtcttgcagtacaagcaggacataaaagtaagtggagaggagaaatcaaagacaaatcgatggtgtgttctatttgtaggaaagcaggacatgatgataagaactgcttccaagtcgccgaatatcccgactggtggggtgatcgcccacgaagtgaaggcggatctagtggcaaaaatcagcaacgaaatgggacttcagctggacgtggcagaggaggcatggcccgagctaacgcaacacacgttgagaaatttgagctgcctggtttaagcaacgaacagtggcaaactcttgttgagatgttgaacaaccgtaagacagatgagattgagaaaatgattggtaagcatcctgataatttgtggataatagacactggtgcttctaaccatatgacagggtatttgaagaatttatgtcaacaaagaacaatacaaggatgtccggtgggattgcctgatggagaaaaagtaattgccaccaaagaagggacggcgattcttgatgggggtctcaaacttgaaaatgtcctttatgaccgcactttgaagacgctgattggagcgggtgagcggaaagatgggctttatctgtatcatggtgttcgaaattccaaggcttatcataccagtacaaaatatgaccttgatatcttgcataaacgcatggggcatccatcctttaaggttgttaaattgatccctaatgtaactagtagtcgtaagcattcgaataaagtctgtgaaatatgtgaaagagcaaagcagacaagagaaaaatttcccttgagtacttatcgtgcatcaggcatttttgatttaatacattgtgatctatggggtccttatagaactctttcatcatgtggtgcatcctattttttaacattagtagatgattattcccgttctgtttggatatatttgttgagtgaaaagagggaagtgtctcgaacaatgataaatttctttgctctaattgaacgacaatttgataaacacgttaaagtgattagaagtgataatggaactgaattcacttgtttgaaacaatactttcttgaacatggcattctccatcaaaaatcatgtactggcactccgcaacagaacggaagagtcgagcggaaacatagacatattttaaatgtagcaagggctctaagatttcaagggagacttccaattcgtttttggggtgagtgcattttaaccgcaggttacttgattaatttgacaccatcgcccatccttgatggaaaaactccatatgaactcgtcgatggaacctctccttcctatgaccacttgcgcgtgtttggttcgctttgctatgcacacaatcaagatagaaagagagacaaatttgatagtagaagccaattttcatttgaagaatcaatcaataatccttccccaacatcactggtgcccctcattaatccatgtatggataaggaatgtatggttgaaaatggccatgataatgacacaaatgctgacgtcagggggggtgctagtgaagcaagcaatgaaccccaaagctttgcaccaccactagaaaaacaaaattgcatagatgttgtacaatgtagtagtgaaggaccagaaacaagaagcaacattcctcccacctctccacttggaaaaggtcatcggatcaagcgaccgtctgtgaagttaattgattatgtgacctacaccatgatcaagttgagctcatctacctgttcctctgcttcatcacatgattcaggtgcgcgttatcctatagctcactatgtaaattgtgatagattttcatatcagcatcgtcagtttcttgcagcagtaagtgcaggtcgagaaccgatgcatttttcagaggccgtacaagatgaacgctggcgagaagccatggcaagtgaaattgaggcactacaaaataacggtacatgggccattactaccttgcctccaaagaagaaagctcttggttgcaagtggatttacaaaatcaagtatcactcagatggaaccattgagagattcaaagcaaggctagtcattttgggaaatcaccaagttgaagggctagactacactgaaacttttgctccagtggaaaaaatggttactgttcgtacagtgttggttgtggcggctgctaaagcatgggaacttcatcaaatggatgttcacaatgctttcttacatggtgaccttcaagaagatgtgtacatgaaactacctcccagtttcatgacagaacacaaaggaatggtatgcaaacttcgtaaatcactctatggtttgaggcaagctccaaggtgctggtttgctaagctttctactgcattgaagaattatggatttcgtcaatcttgctctgactattccctcttcactttatggactacaactgtacatcttgtggtgctcgtttacgtggatgatcttattgtttcaggtaatgattctgaagctattcttcggtttaagctttatcttcatagatgctttcatatgaaggatttgggaagattgaaatattttcttggagtggaagttgctcgctcacccaaaggaatttacttgtgtcaaagaaaatacgccacagatattattcttaagactgggttacttggagccaaaccaatgtctcttcctcttgaagaaaatcatcggttagcattggctgagggtccgttgttctctgatcctggtcgttatcgtcgacttgttgggcgactcatctacttgtgtttcactaggcctgaactctcttactgtgtccatactctatctcaatttatgcagcaacctcgcgaagaacattggcatgctgccttgcgtgtggttcgatacttgaaagggaaccccggccaaggtattctcttgcgcagcgacaatgatctgaaattgtatgggtggtgtgactcagattgggctggttgtccacttactcgtagatcatttacaggatggtacatctctcttggtcacttgcctatttcatggaagaccaaaaagtaa

SEQ ID NO: 89009 - DNA, 264 bp, Glycine max
  Peptide Sequence Number=SeqID_205787
atgaacgatttcaagagacattctgctgcaacaactcaatgtttagaggatgaaaaaatcctaacactagggcaagagactaagaaagaaaggaacaaagagagacttggcaaagagattgaagggggtgaaaggagtgcaagagaggagagctgtgaatatctgatgaaagaaaagggaatatgttgttgctctgaaaaaagggagtgtttatttgctctgaaaatgggagtatgcaaagaagaaaaagttgtgcagcaataa

SEQ ID NO: 89010 - DNA, 636 bp, Glycine max
  Peptide Sequence Number=SeqID_205788
atggttcttgccatcggcgcgcagtgcgctgccttccacgttccactggtcgttgaagctgtaaccgccgcgcaggctcttggacaggttgcggtagccgtcgcggtcgtgctcgtcggcaaagcagcccgcggtgaacaccgaggaagaaccgcggcaggcatcgatgccgtcggaatgctggtaggcgatgtcggcaccgaaccagccgcgctcggtgccgccaccaatgccgccgctggcttcgcgcagcccgttgctgccgccgccgagctggaagtgcggagcgaaatcgccctggttgcggcgggtgaagatctggatcacgccaccgatggcgtcggcaccgtacaggctggactgcgggccgcgaacgatttcgacgcgctcgatctgcgccaagggcaggtcctgatacatggccaggccgaggtcggcactgttgatgcgcacgccgtcgaccagcaccacggtgtggcccgagttggtgccgcgcaggaacagcgagctctgcttgccgaggccgccagcattggtcaggttgatgccggcgcggccgcgcagcagctcctgcagcgaggtggcctggctggattcgatctgcgcgcggtcgatcacctgcgccggcgcgatact

SEQ ID NO: 89011 - DNA, 1121 bp, Glycine max
  Peptide Sequence Number=SeqID_205789
atgcgtcagcgactgcacgtactgctcgacgtaggccttgccttccagcttgcggcgcatggtttccagcgcctggccgagatcgccgatctcgtcgcggcggcggcgcggcggcggcaccggttcgccggcgctgaccgcacgcgcatagcggctgagctggcccaggccggtggtcagccacatcgtcaccagcacaccgaccagcgccgacaagccgatcagccaggccccgcgctcgatgatggcgcgctggctggcggcgatgaacggatcgatgctgcggttgggctgcgccaggctgagcacgccgatgagggtgcgcccatcggccgggtcatatacgggcgccgccacatgcatcaccgtgtcgccctcttcgccggcaatctcgggactggaacgcgcgccgtactcacctcgcagggtgcgatagacatcattccagcgcgagttgtcgcgccccaggtcgcggcccagcgagtcgtagatgacgatgcccttggcatcggtgatggtcacccggtaatccagcgagcgcttcgggaagcgccagaccatcgccttcaggtcgcgctggcgtgccttggcgaggttgcgggtgaagctgccgctgcggatggtgccggccttgacgtcggcggcggccatttcggccagcacgttggccgcatcgaccagggtcgattccatcgcctggcgcacaccgggcttcacctcgttgacgaacacgcgcatcacgaagaacgccgcgatgccggtgatcaggaagaagcccaggaacagcttcagtaccaggcgcatcggctagacctccagcgcgtagccaagaccacggtgggtacggatcgggtcgtcgctggcaccggccgcgcgcagcttggcgcgcagcgtctttacatgcgtatcaacggtgcggtcggcgctgtcggcgctgctgtcccagccacggtccatcagctgggcacggctgacgatggcgcccgggcgcagcaccagcgcttccagcagcgcgtactcgtagcgggtcaggtccagtgcctggccacggaagcggatgcgccggccttcgcggtcgatggcaaaggcgccatgttcctgccagcccgcatcggcgccag

SEQ ID NO: 89012 - DNA, 636 bp, Glycine max
  Peptide Sequence Number=SeqID_205790
atgacgaaagacaacaattggtacctcaaagccttacactgggcaatgaggggcaccatgtatgagcctcaaggtggacccttcggtactagtaccctcaccttccgaggactacacgtcctcaccttcagagggctgcacgccctcagaggattgcacgtcctcgccatcagaggactgcacgccatcaccttcagaggactacacgttctcgccttcagaggactacgtgtcctcgccatcagaggactatatgtcctcgccatcagagggctacacgccctctccttcagagggctacgcgttctcaccttcaaagggctacatgccctcgccttcagagggctgcacgccctcaccttcagaggactacacgtcctcacctttagagggctgcacatcctcgccttcatggggctgcacaccctctcctttagagggctgcacgccctcgctttcagaggactacatgtccttgccttcagagggccacacgccctcaccttcagaggactacacgtcctcacctttagagggttgcacgtcctcgccttcagagggctgcacaccctctcctttagtgggctacacaccctcgcttttagagggctggacgccctcgtcttcaaagggtga

SEQ ID NO: 89013 - DNA, 654 bp, Glycine max
  Peptide Sequence Number=SeqID_205791
ccatcgaggccattgcccacggtgatgaaaccacttcgcgcgtggtcggccgcctgattgaagatattaaactgccgccgggcaccattatcggcgcggtggtgcgtggtgatgacgtgatcatcgccaatgataatgtgcgtattgagcaaggcgaccacgtgatcatgttcctcaccgacaaaaagtttgtgccggacgttgagcccactggccaaggcaaggagataacaatgagtttattcaaagagtttcgtgattttgcgatgcgcggcaacgtggtggacctggcggtcggtgtgatcatcggtgctgcgttcggtaagatcgtatcgtcactggttgcgaacatcattatgccaccgctcggtttactgattggcggcgtcgactttaagcagtttaaatgggtactcaagccagcagaaggcgatatccccgcggtggtgatggaatacggtaactttattcagacggtatttgatttcatcatcgtggcaaggccagaggtaaacactgttgcttaccgctggcctcctgattcgctcccttcgcgtgtttatctttacgccggtagctgcctttccccttctgattgcgctcaactcgctggcgatacagcggatcgtgtaacagggcttccagggcgttatc

SEQ ID NO: 89014 - DNA, 756 bp, Glycine max
  Peptide Sequence Number=SeqID_205792
ggcgctgatgacggccaaccacctgcccggcggggtcgacttgccgcgcatgtcgcgctcgatgttcagcgaggcgtcttacgagggcgtgggcttcggcctgggctttgccacgaccatcgcgccggccaacacgctgatcccgggcagcgccggcgacatgttctggggcggcgcggccagcacgttcttctgggtcgatcccaaggaagacctgatcggactgttcctgacacagctactgccatcgtcggcctatccggtgcggcggcagttgcggacgctggtgtacagcgcgatcacggatctggggtgaggcgggggggtatgcctgctgccggtctgctcccctctcccgcttgcgggagaggggctgggggtgagggcatagaggctctgcttgccgacctgtcgcaatttgaaccgccgggccctctcccccgcccctctcccgcgatgcgggagaggggagcaaacaagcgatacgttcctgcccctagtaaaatgccttccatcacccccatccccgaaaccgccatgcccatcaggacaacgcttcttgccttcgcaatcgccctcatgagcccgctggcgcacgccagtgtgtcgtcggatgcacacgcgttcaaggaaggggtcaaggaagcaggcaagaagaccggccacgcggtggccgacgtggcgcgcaccatcggccacggcgccaaagaggccgggactgccatcggccatggcgcgcgcgacgccgggcacgcg

SEQ ID NO: 89015 - DNA, 1962 bp, Glycine max
  Peptide Sequence Number=SeqID_205793
atgaatctgccggtggagaacagtaaagacgaaacgcgcattcactgtccggtgctgtttggccactatcagttcaccgatgccatgttccgctactacagcgattcgctgacggtggcgctgcgcatcaagacgctgaccatcaagccgggtgagcgcatcgccgtgctggggcgcaacggctctggcaaatccacgctgctgcaggcgatggccggcggcatggatctggtgggcggcgagctgcggctggacaatcttagcctgccgcatattgatgtcgcggacgtgcggcgcaacgtcgggctactgacgcagaacgcgcggctgttccacggtacgctgcgggaaaacctcaccatgggcgcggcgcacgccaccgacgaagcgatttttgccgcgctgacggtcagtggcggggccgattttattcgccgtctgccgctcgggcttgatcatccggtcatggagggcggcgtcgggctgtccggcggtcagcgccagtcgctgctgctggcgcgcatgctgctgcgcgatcctaatatcgtgttgctggatgagccgaccgcttcgctcgacgatcataccgagaaggattttattgagcggctgggcgcctggctgaatggccgcacgctgatcgtggcgacgcaccgcgcggcgattctgtcgctggtggatcgcatactggtgctgaaagaggggcagctgcggagcagcgggggagggacaggcatgatgaagcaattgccggcaaaactgcggctggtgaccgccgcggaagtggattcgtccgacgatctgctcggtgaactgaaatcggaaagccactacaccggcgcagtgcggctgatcgtcatcagcacggcgctgatcgtggtggcgctggtgtgggcgtggtttggcatgctggatgaggtctcaaccggcaccgggaaggtgatccccagttcgcgcgagcaggtattgcagtcgctggagggcggcattctcacggaactgtatgtgcatgagggcgatcgcgtgcaggccgggcagatcgtggcgaaactggatgccacgcgctcgcagtccagcgtcggcgagagcgcggcgcgctaccgggccgcgctggcagcggcctcgcgcctgcgtgcggaagtaaacgatgatccgctcacgtttcccgccgagctgaagggctacccggatcttatcgcggcggaaacccggctgtataacaccaaacgcgcccagcttaatgatgcaacccggcagtttaaggagtcgctggcgctggctaatcgcgaactggcgatcacccagcggctggcgaaaaccggtgccgccagcagcgtggaagtgctgcgcttacagcgcgataagtccgacctggagctgaaacttaccgatatgcgctcgcagtattatgtgcaggcgcgcgaagagctggcgaaggccagcgccgaagccgacagcctggcgcaggtgattaaaggacgcgaagataccgtaacgcgtctgaccatccgcgcgccgatgcgcggcatcgtgaaaaacatcaaagtctcgacggtgggcggggtgattccgcccaacggtgagttgatgaacatcgtaccgatgaacgatcggctgctgattgaagcgcgcctgtcgccgcgcgatattgcttttatccatcccggccagcgcgcggtggtaaaaatctccgcttacgattacgccatctacggcggcctgaacggcgtggtggaaagcatttcgccggataccatccaggacgaagtcaaaccggagatttactactaccgcgtgtttattcgtactgataacgactatgtgcagaacaaggctggccggcgctttgccatcagcccgggcatggtatccaccgtggatatcaaaaccggcgagaagagcatcatggattatctggtcaaaccgtttaacaaggccaaagaggcgatgcgcgagcgctaa

SEQ ID NO: 89016 - DNA, 420 bp, Glycine max
  Peptide Sequence Number=SeqID_205794
atgcaggtggctttcgcgaccacggcggcacgcaacgctgcggcgtcggtgggtggcgtgattggttcgctgtcgcagtcacagctgggcgagatgggcgagaagctggttaacgcgcagttctcacagacccaggagtcgcaggcggatgactattcgtacgatctgctgaagaagcgcggcattaatccgcttggtctggcgaccagcttcgagaagctggcgaagctggatcagggccgccagatcgccggtcttcccctcaccccagccctctcccgcacgcgggagagggagcactccgtgctgttctcacggcccgctcgatcggttccctctcctgggggagagggagcaggccgtgctgttctcaccgcccgctcgatcggttccctctcctgggggagagggtcagggtga

SEQ ID NO: 89017 - DNA, 1672 bp, Glycine max
  Peptide Sequence Number=SeqID_205795
atgccagcacacagggcgctgagcttacaggtacggcgagttgttgcgcctgattgcatcagatccatcgattgttcaccagtaaaagagagaaaggggcacctccctgtgcccgttatgcttccctgcgttacacccactaagccgtgtggttttgatgcgggtaatcagctgcgtactgctgtaccccgtgccgctgccgtcacggtcaatcgacaacaccgtattgccgtccgcggtatgatccactttcacaaagtcattgatattactggtggaatcattccagccgatcagcagactgctgacgtcgatcttgtcaccctgcgcgacgctgaagtcggtccaggtgtcgtgaccgttgccgccggtggcatctgcgctgctcagcaggtggtaaaccagcgtatctgcgccggcaccgctggtaatggtgtcgtcgtaggcgctgctggtgaggctgtcagccgcggcgctgcccgtgatggtcgggtgaagctcaatggtaaaggtgttgctggtgatggtgccgtcggacgacgccagggtgtaggtaaacacctccttatgcgtgatgttctggatattcacatccgcgttcagggtataggtatagctaccgttgacggcgatggtcagtacaccaaagtccccggccaccgccgtgctgcccacgctgctcacggtggtgagatcgccgtgctcattgaggatgctcagcgtgccgatgtggctgacgttgctgtctccccagatgctgccgctggcatcgtgctcgctggtggtggtggtttccgccgccagactggtggtggcgaacagcgcggtggccgcaccgttatgcagcgtcaccgtcagcgtcgccgaggtcactgcaccgctggcatcccgcaccgagtaggtgaaggtgtctgcggatggcagggtatcgatatccagcccggccttcagcgagtaggagtagttacccttcgcatcaatggtcagcgtaccgtaggtggtgttgatcaccgtattgccgctggacgccaccgcgctgctgcccaccgacgccaccgccgtgccggacggaatcgtcccggcgatggagctggtgtcgttggtcagcaggttaccggtgaccgtcgcggcggtggtgaccgccagcgtggtgaaatccgacaccgtgcttaccgtggtggttggcaacacgctaatgttggtggtggctgccaccaccaccgcatagttgccggtccccagtccggtgtaggtgacgtttgcccctttcagcgtaccgatcgtcaacagcgcgttaatgtagttggtcttgatactgatcaactgccacgagccgttcgcctgctgttcatacaggtaagcattaccgttgttcagtacgctggcattgagcaccgtacccagccccacggtcagcagcgcggtgtgcgacgagttgaccgtaccgttgttcaccgttgcctgcgtactggtgtaatccacctcgttgctgtcgttggtcgccacgatgcgaatcgcaccggtcagcgaggcccccggcgagacgttaccagcgcgatccgtctgaatcaccgagagcggcgcaccggtgatttgcgcggtggtgagcgacaccgaccagttgccgccgctgcagaccgtggtggttttattttcgtagccacatattttg

SEQ ID NO: 89018 - DNA, 517 bp, Glycine max
  Peptide Sequence Number=SeqID_205796
atggctgccagtgatgccgtgacgcaggcggggcgcataacctcagccggtctggcgcagcagcaggatcttccctccttaaccggtcaggtggccgaacccgcgctggctaacgtgccggataccttaacccttaaccaggccgtacagcgtgccatccagtggcatccggacatcgcacaggcgattggcaaaatgctggagcaggccagccaggtcgatgtggcgcaggccaaatactatccgcaaatcagtgccggcatgaacaacggctacagcaacgcctacagcgaaaaaggcttcagcccgtcatttgtgctgtcggtatcacagatgctgtatgacttcggcaaagtcagcagttcggtgcgctccgccgaagccggagtggcgcaggagcaggccagcgtgctggtgagtattgataccgtcgcgcacgacaccgccgccgcgctggtacaggtgcagggctatcagcagctggtgaagatcgcccaggatcagctgactgcgctga

SEQ ID NO: 89019 - DNA, 288 bp, Glycine max
  Peptide Sequence Number=SeqID_205797
ggaaggagcttgccacccagctcgcccaggcgagcaaggttgcttcctccagaagcaaccgcctttctggaggaagaatctggaaggcccaactttggaagaagttacagaaactcacagattgcgcaacgacacctccttttggtttccgccacattacggaatttcacggatcgcgtaaccctgcttccttttgatttccgatgcgtctcgggacttacatattgtgcaacaaagggtgccaagtatcttgaagcggccaatcaaaggttgcatgtcatcaggtaa

SEQ ID NO: 89020 - DNA, 586 bp, Glycine max
  Peptide Sequence Number=SeqID_205798
aggattacacgtcctcgcctttaaaggactacacgtcctcaccttcggagtactgcacgttctcacctttaatcggctacatgccctcgccttcagaggactacacgtcctcaccttcaaagggctacacgtcatcgccttaagagggctacacgtcctcgctttcagtgggctacaaggtctcgccttcgtaggactatacgtcgtcgccgtcaaagggctactcatcctccccttcaggggacaacacgacctcccctttagaggactgcacgccctcgccttaacaggactgcatgttctcaccttcagaggactacacaacctcgccttccgagggctagacgccctcgccttcagaggagtacacatcctccccttcagagggctacacgccctcgccttcgtagggttacacacccttaccttcaaaggagtgcacatactcaacttcagaggactatacatcgtcgccatcagagggctacacgtcctccccttcagagggctacacgtcctccccttcagaggacaacatgacctcccctttagaggactgcacgccctcgccttaacaggactgcat

SEQ ID NO: 89021 - DNA, 144 bp, Glycine max
  Peptide Sequence Number=SeqID_205799
atggggcaagccacattgcccttatccccttgttgttggtacccaaaagtgcgcccaccaagtgctcggttaaatgcctcaatggtgtttgcgcataagtttgtgaaggttgcttatagattggggacagcttgcggaagttag

SEQ ID NO: 89022 - DNA, 348 bp, Glycine max
  Peptide Sequence Number=SeqID_205800
atgtggcagcaggatacgccgctgcttttaggctgtcgagacttgcggtgcgatccaattcccttgatccagcagggcgaaaccattatttttgcccctgtttatcaggagaaaagcatgagccaaaaccttgccctgctgtcgcaggaagagaaagacaaagttaacgtcgatctcgccgccgctggcgtggcgtttaaagagcgctacaacatgccggtgatcgccgagatggtggagcgcgagcagccggaagcgctgcgcgactggttccgtcagcgcctgatggcctatcgccaggcatcgctcagcctctcccgcctgccctacgaatctaagcagaaataa

SEQ ID NO: 89023 - DNA, 636 bp, Glycine max
  Peptide Sequence Number=SeqID_205801
atgaaaactgcatccaggcgcgttatcgcgctactgctggcgggcgcgacgctgggcttcagccagctggctctggcacatgcccacctgaaagccccggtgccggcggataacgccgtggtggagcgcgcgccgcagcaactcaccctgacatttaccgaacatattgaaccggcattcagcggcgtggaaatgatcaacgcgcagcagcaaccggtggcgctggagaaagcccaactgaatccgcagcagcacgatcagctgattgtgccgatcgcccagccgctggcgtcgggccattatcagcgcgttctggatcggcctgcgggcgctgcattttctggcgctgttcctgctgaccggcagtgcattttataccgcgctgctggcgccggcgcgctaccgaccggtgctgacacagcgctggcggcggctgatgggatacagcgccgtgctgagtttactcagtgcgctgttgatgctggcggcgcagaccgggctgatgagcggcgactggcgcagtatcgccagcatcgacgtctggctggcggtgctgggtacgcgcttcggcgcggtgtggcgctgggttatcctgtttgccctgctcagcacgctggcgctgcgcctgcgtggtaa

SEQ ID NO: 89024 - DNA, 852 bp, Glycine max
  Peptide Sequence Number=SeqID_205802
atggagactccagttgaagtgaaacctactagtgttgcatccggattcttagatgatttgtctgagacttgcaagatgggtagtccgaatggaagagcaatgtataggacagacgatgaagttccttttgactccgaaataaattttcacccgtcagaatcgagtctgatggatgtacatggatcacattctggagaatctcggactgtccatcatgaaacgttggcgggtatgatttacaggagcatacaagttgtagtcttttctaacaaactcaacttgcttatgccttttgggcctcttgcaattcttgtacagaagttgactggtcatcttggttgggtctttggtctgagtttgttggggataatgcctctggcagagcggcagctggcgttttacactggagatactgttgggggtcttttaaatgctacatttggaaatgcaacagaactgatcatctcaatatatgcactgaaaagtggaatgacacgcgttgtccagctctctttgctgggttcaattttgtccaatatgttactggtgcttgggtgtgcattcttatgtggcgggattgttaatcacgagaaggagcaagtgtttaacaaggcagctgcttccgtgaactcaggattattgctaatggcagtcatgggcatactttttcctgctgttctacactacactcacactgaggtccatgttgggaagtcagagttgtcactttcaagattcagcagctgcattatgcttgtggcttatgttgcatacctattttttcagttaaaaagtcaaagaaatctctacgtctctgtgaacgaggttttggaccgaatggatgctctttaa

SEQ ID NO: 89025 - DNA, 186 bp, Glycine max
  Peptide Sequence Number=SeqID_205803
atggcgggtatgatttacaggagcataagggttgtgcttttgtctagcaaactcaacttgcttatgccttttgggcctcttgcaattcttgtgcagatattgactggtcatcatggttggatctttggtctaagtttgttgggaataatgcctatggcagagcggttagattatgtaaccaagtaa

SEQ ID NO: 89026 - DNA, 903 bp, Glycine max
  Peptide Sequence Number=SeqID_205804
atgtcattctctattgtgattcacaatatgggttcatgggtaaatgaaccacaattgtattataaggggggcgaggtgcatgtaattcatggattggatgttagtaaatggtcatattttgaagctatgagggtactaacagaactaggctataagggagatggtgatatgaaaatgtggtggaaagggaagggaactgattttgatagtttaagagattttgtgttggatcaagatgctatggacttggccaattatgctctaactcacaactgtgaagttgagatatatgttcaacatggggtgggtgttctagttgaaaatgacagtatatgtaagatgatagttaatggggagcaatgccataatggtagtttggagcaatgtggtaatgttcaagaatctggtaatttgaaccaacttggtaatgttaagcaatctggtaatgtggaccaatcttctggtggcgaagatttggagaagtcaaatttcaatgccagtgcagaagaaagggacttaggcatggaagatgggtttgatcttcctgaggttggacatgttaaggccacattgaataagaaggtggataaaatgaagaacaaagttgagggggtcacaaggggatatggtacacgacagagaaagaataaagatattgcaaggagggataatgatcataaagtaaatgtgcctgatgatgctgactcattgtataagatggaaagttcttactatagtgacgagttggatagtgatattggtcaggatgatgacattgaaagtcatgcaacgaaacatgtcacgtttaagaaggaggatatgcgtaacttcattaagcagagtttactactcagcgaatattcaatacagacacttgtgaaaggacaactcttttatatataa

SEQ ID NO: 89027 - DNA, 1077 bp, Glycine max
  Peptide Sequence Number=SeqID_205805
atgagcgattctgcatacagagtccaaaccacaccgcgccttgctcaatggagaatcgaaaacttggcttcttgcacttaccgcaaatcagatcctttcaagatcggaaactggaattggtatttttctctctccatacctatctatctgtctgttaacaagaaaaagaaagtgaccatgtttcctttggatttaagatacactctaaggcatttgtcggtggagaaaaacagggttttgtttgttaaattgttcccagaaatatccaatcttacgagagacaaccccccaattgcatctttcatcgttcgggtcgttagttctgttggaggtcgccaggccatcacacatccagaaataaaggacaaagtgttaaagaacaacgaggattttgtttgggcaattgaggttccactaactgggaaattcattattgacgtagagtttcttgatttgaagactgcatccccaaacggtggagaaccttgttccatttgggcagaaggatttactcagcaaagatcaaatgcaaaagccatagagtctcttggtagaatgctaacagaaggcattcacacagacatcaccatcaatgcttctgatggaagtataggagctcatagagctgttcttgctgccagatcacctgtcttccgcagcatgttctcacataatcttcaggagaaagagttatcaaccataaacatctcagacatgtcacttgaatcatgccaggcttttctctattatctttatgggataatcaaacatgaagagtttctgactcataggctggcccttctgcaggcggctgacaagtatgacatatctgacttgagagatgtatgccacgaaagtcttctagaagatattgacacaaagaatgtacttgagaggctccaaaatgcatctctatatcagttgatgaaactgaagatgagttgcatccgatatcttgtgaagtttggtaaaatatatgaaattcgcgatgatttcaataccttcctgcgaaatgcagatagggatctgatttctgaagtcttccatgaagttcttgatgcttggaaaggattctga

SEQ ID NO: 89028 - DNA, 2028 bp, Glycine max
  Peptide Sequence Number=SeqID_205806
atgctcggtggagaattggatctgagccagcagcggcgcatccagcatcagcggatgatcgctgagcagcacctctcccgcggcggtctcctgcccgtcatagcgctggatatcggcgccgtagccgcccaggatcgccatcaggtagctttccagccgctgattgcggatatccagccacagccgacgcccctgccaggtatcgctggcctgcgggatcgggaactgggcgttaaacaatggaatgcgaatgctgaacaagctgcccaggcccggctcggactcgacggagacgtcgccgtccatcaggttgaccaatttctcgcagatcgccaatcccaggccggtgccctggaaatgacgctgcacgccggtccccacctggaagaacggatcgaacaggcgcgaaatctccttctccgggatgccgacgccggtatcgcgcacgctgaactccaggtagctgccgcgggtgcagacctgcagcacgatacagccggtatcggtgaacttgatggcgttgttcaccaggttggagagcacctgctgcaaccgcaccggatcgccgaagatgcgctccggcacgttctgttcgataaagcagtacagccccagacgtttcttgaccaccagcggcaaatagttgccggcgatatgggtgatcacctccagacaggagaactcgcgcggttcaatcttcaactgctcggactcgattttggagaaatcgaggatgtcgctgatgattttcagcagcaggccggaagagttgttcatcgcattgaccagccgatcgaccccttgcggcaacgccttggtttgcagcagatcaaggttgccgataatgccgtacagcggcgtgcgcagctcatggctgacggtggccaggaacatcgatttcgactggctggcctgctccgccgccgccgccatctcctgcagcgactcttccatcttcacgcgcgcgctgacgtccaccaacacgcaaatcgccacctcttcgttacggtagcgcgaatggacaaagctgatctgcaggttgttgttgttgctggtcatcacatcgacgaaattcgcctgctgttcgcaaatgatgcgcgttatgcgatcgcgatcttcgtgggtcaacaggttgatgtagttgtgcgccagttcgttactcaggatattggtgccgtcgctgatgcgcaggatacagatgcccaccggcgccgaagcgacgatcttgcggttgaactgctcgtgctcttccaggcggaaggcgttgtcctccgccggcaggaacatcttgcgctcaaacagccacgccagcgtgaacagcacgatggccgacaacaggttcagcaacagcgcgttgaggatcagcattttgaagcgttccaccacgcttttcaccggcagcgcatagacgatgctcagcgaagaaggcggcagcgctttcttcaggatcaggtcgcggtaattgtcgacataaccgaagtaggcatgctcttcggggtagctgttgagcgcagcggcatagcgttcgccatccgccaggcgcagcaccggctcgttgttctcatccagcagcgtgacgccgatcggcaggttgccggcggtaacgaaatcttccagccgaacggtttgctcgatgcccagcaacgcctccagcttgttgccgatatagagaggcgtcagcacgtacagataaccgacgtccggccgctgcgcgctggggctgatccaatacaggttgttgtctttgtcgagattcttggcgttgcggtatttcagaatgcgctcgtgcagcaacttcagcatgttttcccgattggcgctcgcgttgccgccgccgaattccgccatacacaggctgtcgccgccaatgaagaacacccggttgagatcgtaggccgccacgaagttctctttccaatactggatcaggccgctcagcgaatcgagcgaactgcgataggtgcgctcccaacgaccacagcaaaatcgccagtacccggaacagatagcgggatatcttcagcgtag

SEQ ID NO: 89029 - DNA, 489 bp, Glycine max
  Peptide Sequence Number=SeqID_205807
atggcgacgccaatcgtaacgctgcgcgccgctggcacacagctctcctgccccaacagtgaaagctgcctgctcgacgtgctggaactgcacgacgtgcaggtggagtaccaatgccgctccggctattgcggcgcctgccgcatgaagctggtgaaaggcgaagtggcctaccgccaacagccgctggcgtttatcaacgccggcgagatcctgccctgctgcttattccgcttagcgcccctttcctgccgatgcggaaaaataacgcgccggagaatcgccaaaggctttgcgaaacatggcgataaaattactcggcgaggcatatcccagcgtttccgcgatctgcagcacggtttcgccgcgcaggcactcaggaactacggtacagaactgcaaacgcggggcgcggcggcgatacgcctttcacgcctggcgtccgaacggctgcagcaaaaccgtgacgccggcaactcggcgccatga

SEQ ID NO: 89030 - DNA, 487 bp, Glycine max
  Peptide Sequence Number=SeqID_205808
atgatgaaaaagacttgggtcgcgtgcgcggcaggattgctgttggtgaccggcgcggcgaacgccatcagcgtgtcgggcgaagccgggcagcactacaccaacctgggcgttggcatgagcaccggctcttctggtctgggcctgaccggcaactgggcgcgcagcgaccacgacggtaacgtcggcagcctggggctgaacttcggcgtgccgctggggccgttgacggcgaccgtgggtgccaaagcgctgtacctcagcccgaaagatgggaagagcggcggggcggtggcgctgggcggcggcctggagtgggagatcaaccgttacttcagcctgcacggcgaagggtactttgcccctgaatccttcaccagcggcgtgaaagcctataacgaagccagcggcggcctgcgctggaagttccgtccgctgagcgtggacgtgggctaccgttacatgcaaatggaaggcaaagacgggc

SEQ ID NO: 89031 - DNA, 249 bp, Glycine max
  Peptide Sequence Number=SeqID_205809
atgggttttcacccaacaaaactcaatttcgtgcctagcgatgcggatgaggcgccactcgatgttttccatttgcctgcatgcctttggtattgtggggtgtgggtgctgacgattggttcctgtgttgcctacctaccaaacggtattcgtgtggctagtcagacccattccatccaggcctctttgttggggacgctggaggatttcaaagtcccacacgtgaaccacgttagtcgtccatcataa

SEQ ID NO: 89032 - DNA, 1122 bp, Glycine max
  Peptide Sequence Number=SeqID_205810
atgtctgattattactttgatgaggaggagatacaagagttgctgaaggagaatgatgcgccagtctttgatgacttctttaacgattttgccgctcaagattcgtcccctccagcggatgagattcttcccgccgatgaggttcttgatcctcttcttgttcctacttctcatatggttcatacttctgctccggatcctgctcctcacatggttccatctgaggagacattgcggagcagccacccgcaccacttgctgccgcagaatatggagtccaatcatgtcatgttgtccggtgactcatcccatcacaagaaatacgaacattggacaatagaagaacataagtcatttctctttgggcttgagatcaagaaagagaaacgatggaaacagatttcagagaaatatgttccatcaaaaactgcatggcaagttgccagtcatgctcaaaaatacttcaaacgcaagaataccccaatgaaagagaggaagagaagaagcatccatgacacaattttagaagacattgatataatccgcattgatcaacaaaatttggttccaccaacttcaaattttatagtgcagccacatgctccctgcactaattgggttccatcaactccaaattttatggtgcagccacatgctccccgtactcaccaacataattgggttcctcctcctcttccaaatttttctgtgcaaccacgtactcctcgtgttgatcaagataattgggtttcacctccttcaaatcttgcagtgcaatcacgtactgcccatattgatcaatatacttgggttccacctccaaatttagcagtgcagccacctactcctcatgttgatcaacataactgggttccatcacctccaacttttgcaccacatacttcccttgttgatcaagataactgggttccaactcctccagattttgcagtgcagtcacatactcgccatattgatcaacataattgggttccacctcccccaaattttgcagtgcagccacatgaaatgcaacgagcacaacatatgcagcagttcaacttacatagttcatctcctcaaatggatgaatatagaaattttaatagtggccatccctag

SEQ ID NO: 89033 - DNA, 1433 bp, Glycine max
  Peptide Sequence Number=SeqID_205811
caggtaaacatctacaatctgttgccatggcaaaaacaactcacatagctattgtttcaagccctggttttggccacatagttccaataattgagttcagcaagcgacttgtgaagcttcacccaaattttcaagtgacctgcatcattccttcacttgagtcatccacagaatcctgcaaagcctaccttaaaacccttccttcattcatagacttcatctttcttcctccagttagcatagaacaattatcccaaggaggatacattggacagctaattcaactcaatatttctcattctctgccatcaatacatgaggtgctgaaatccttgttctctaaagtccctttaactgcgttggtggtagatgttcttgcacttcaagcattggaatttgctaaggaattcaatgccctgtcctatttttacttccctagttcagctatggtattgtcactgcttctacacatgtcaaaacttgatgaggaggtttcaagtgcgtacaaggatctaacagaacctataaggttaccaggttgtgtaccattcatggggagtgatcttccggatccatcccatgatcgatctagtgaattttacaagcattttgttgaagataccaaggcaatggtaactactgatgggatcttgatcaacaccttcttagaaatggaatcaggtgctgtaagagcattggaagagtttggaaatggaaagatcagattgtacccagttggacccattacacaaaaagggtcaagcagtgaagttgacgagtctgataagtgtttaaaatggttggacaagcagccacctagttcagtgttgtatgtttctttcggaagtggtggaacactctctcagaaccaaatcaatgagttagcttcgggtttggaattgagtggtcaaaggttcttgtgggttttgagagcaccaagtgaatcagttagtgctgcataccttgaggctgcaaatgaggaccctttgaaatttttaccaagtgggtttttagaaaggacaaaggagaaaggtttggttgtgccatcatgggcacctcaggttcaggttcttagtcacaattcagttggagggttcctaagccattgtggttggaactcaactctggagagtgtccaagaaggagtgcctattataacatggccactctttgctgagcagaggatgaatgcagtgatgttaaccgatggtcttaaagtggcattgaggccaaaatttaacgaagatggcataattgagaaggaggaaattgcaaaggttgtaaagtgtttgatggaaggagaggaaggtaaaggaatgcgtgaaagattgaggaatttaaaagattctgctgctaatgcactgaaacacggttcttcaacacaaactctgtctcagttggctaatcattgggagaatttgactaaagtttag

SEQ ID NO: 89034 - DNA, 1407 bp, Glycine max
  Peptide Sequence Number=SeqID_205812
atggcgaaaacaactcacatagcagtaatttcaatccctgcattcagccaccaagcctccattgtcgagttcagcaagagactcgttcatctccatcgccacttccacgtttactgcatcttcccgaccattgatgcacctccccctgccacactcgccatgcttgaatcacttccttccaatatcaactacaacttcctccctcccgtgcataaacaagacctgtcccacgacgacgctccctctatggtgcaaatcgacctcgccgtgtctcaatctatgccatccttccgccacatgctgggatctcttctctcaaccacgccactcgttgccttgattgctgatccttttgcgaacgaggcgctggaaatagcaaaggagttcaacctcttgtcttacatatacttccctccttccgccatgacactctcattattcctccaattaccggctttacacgagcaagtttcgtgtgaatacagagataacaaagaagccattcaacttccaggctgtgtaccaattcaaggccacgatctcccctcacattttcaagatcgatccaatcttgcttataagttaattctagagcgctgcaagagactctctcttgccaacggtttcttggttaatagtttctccaatattgaagaaggaactgagagagccttgcaagaacataacagttccagtgtttatttgattgggccaattatacaaactggtctaagtagtgaatcaaaggggtcagagtgtgtggggtggttggataagcaaagtccaaactcggttttgtatgtgtcgtttggaagtggaggcacactctctcaacaacagcttaatgagttagcttttggattggaattgagtgataaaaaattcttgtgggttttgagagcacctagtgattcagcagatggtgcttacgttgttgcttctaaggatgaccctttaaagtttttaccagatgggttcttagagagaaccaaaggacgtggctttgttgttacttcttgggcaccacagacccaaattcttagtcacgtttcaaccggtgggtttttaactcattgcggttggaattctgctcttgaaagcattgtgttgggagtgccaatggtaacttggccactgtttgctgaacagagaatgaatgctgttttgttaactgagggcctcaaagttgcgttaaggcctaaatttaatgagaatggtgtagcggagagggaggaaattgctaaggtgataaagggtctaatggttggtgaagaaggaaatgagattcgtgaaagaattgaaaagatcaaagatgctgccgctgatgccttgaaagaagatggatcctccacaaaggcactttaccaatttggcactcagatggagaaatttctggaacagccgtag

SEQ ID NO: 89035 - DNA, 1398 bp, Glycine max
  Peptide Sequence Number=SeqID_205813
atggcaaaaacaactcacatagctatcgtttcaagtcctggtttcggccacctagttccaataattgagttcagcaagcgacttataaagaatcacccaaattttcatgttacttgcatcattccctcactcgggtcacccacagaatcctccaaagcttacctcaaaacacttccttcatttattgacttcatttttcttcctccaattaacaaagaacaattaccacaaggagtatacgttggacgcaaaattcaactcactgtttcttattctctgccatcaatacatgaggttctgaaatccttgtcctctaaggtccctttaactgcgttggtggtagatattctagcactccaagccttggaatttgcaaaggaattcaatgccttgtcctatttttacttccctagttcagctatggtgttgtcactgcttctacacctgccaaaacttgatgaggaagtttcaggtgagtacaaggatctaatagaacctataaagttaccaggttgtgtaccactcttgggggttgatcttccagatgcaatccgaaatcgaccagttgaatattaccaacatcttcttaaaagtgccaaagaaatgcttaaaactgatgggattattatcaacaccttcttggaaatggaaccaggtgctataagagcattggaagagtttggaaatgggaagagcagattgtacccagttggacccattacacaaaaagggtcaatcaatgaggctgataagtgtttaagatggttggacaatcatcccccttgttcagtgttgtatgtttcttttggaagtggtggaacactctctcaacaccaaatcaatgagctagccgcgggtttggaatggagtggtcaaaggttcttgtgggttttgagagcaccaagtaattcagctagtgctgcttaccttgagactgaaaatgaggatcctttgaaattcttaccaagtgggtttttggaaaggacaaaggagaaaggtttggttgtggcttcatgggcacctcaggttcaggtccttagtcacaattcagttggagggttcctaagccattgtggttggaactcgattttggagagtgtgcaagagggagtgcctctaataacatggccactctttgcagagcagaagatgaatgcagtgatgttagccgatggactcaaagtagcattgaggccaaaagttaatgaggttggcatagtggaaaaggaggaaattgcaggagtgataaagtgtctgatggaagggggggaaggtaaagggatgcgtgaaagaatggggaatttaaaagattctgctactaatgcactgaaggatggttcttctacacagacactgactcagttggctagacagtgggaatgtttgagtgggatttag

SEQ ID NO: 89036 - DNA, 1407 bp, Glycine max
  Peptide Sequence Number=SeqID_205814
atggcaaacacaacacacatagctattattgcaagtcctggtttcggccacttggtccccataattgagttcagcaagcaacttgtgaagcatcaccaaaattttcatgtcacttgcatcattccctcacttgattcacccccagaatcatccaaagcttaccttaaagcccttcattcattcatagacttcatctttcttcctccaattaacaaagaacaattaccccaaggagtatacgttggacagcaaattcaactcactgtttctctttctctgccatcaatacatgaggccctgaaatccttgtcctccaaagtccctttaactgcgttggtcgcagatcttcttgcattccaagcattggaatttgcaaaggagttcggtgccctctcctatttttacttccctttatcagctatgatattgttactgttgctacacatgccaaaacttgatgaggaagtttcaggtgagtacaaggacctaacagaacctataaagttacaaggttgtgtaccaattttcggggttgatcttcctgatccaatccaaaatcgatcaagcgaatattatcagcaccttcttaaacgttccaaaggaatgcttattactgatggtattattatcaacaccttcttagaaatggaaccaggtgctataagagcattggaagagttgggaaatggaaaaaccagattctacccagttggacccattacgcaaaaaaggtcaatcgaagagactgatgagtctgataagtgtttgagatggttgggcaagcagccaccttgttcggtgttgtatgtttcttttggaagtggtggaacactctctcaacaccaaatcaatcacttagcttcgggtttggaattgagtggtgagaggttcttatgggttttgagagcaccaagtaattcagctagtgctgcttaccttgagactgaaaatgaggatcctttgaaatttttaccaagtgggtttttggaaaggacagaggagaaaggtttggttgtggcttcatgggcacctcaggtacaggtccttagtcacaattcagttggagggttcctaagtcattgtggttggaactcgattttggagagtgtgcaagagggagtgcctctaatagcatggccactctttgcagagcagaagacaaatgcagtgatgttagccgatggactcaaagttgcattgaggctaaaagttaatgaggatgacatagtggaaaaggaggaaattgcaaaggtgataaagtgtttgatggaaggggaagaaggtaaagggatagctgaaagaatgaggaatttaaaagattctgctgctaatgcattgaaagatggctcttcaacacagaccctatctcagttggccagtcattgggaatatttgagtgggaattag

SEQ ID NO: 89037 - DNA, 1398 bp, Glycine max
  Peptide Sequence Number=SeqID_205815
atggagaagccaacccacatagtgattgttccaagtcctggcttcagccatttactttcactcattgaattttccaaaaggctaatccaccactccaatggcttgcaagtcacatgcatgattcccacacttgactcaccctctgaaccctcccaagccatacttcaaactctcccttcaaccattcactccatttttcttccctcaatccacttcaacaaagagacacagactccaatagcagtccaagttcaactcgcagtgactcactctcttccctttatccgtgaggctttgaaaaccataagtttaagctcaaggctagttgccatgtttgctgatatgttcgcaagtgatgctcttatttgtgctaaggaactcaacttgttgtcatttgtttactttccatcatcggccatgacactctctttctgtttttatctaccgaagttggatcaaacatttccttctgaattcaaagaccttacagaacccatagaaattcctggctgtgttccaatatatgggaaggatttaccaaaaccggttcaggatcgaaccggccaaatgtacgagttctttcttaaacgatgcaaacaactccatgaaaccgatggggtcttggttaacagcttcaaaggcattgaagaagggcctataagagcattggtagaggaaggaaatggttacccaaatgtttatccgattggacccattatgcaaacaggattaggtaatttaagaaatgggtctgaaagtttaaggtggttggagaatcaggtaccaaattctgttctttatgttagctttggaagtggagggacactttcaaaagaccaactcaatgagctagcttttgggttggagctaagtggtgagaaattcttgtgggttgtgagagcaccgagtgagtcagccaattcttcttaccttaattctcaaagtgatgactctttacgattcttaccagaagggttcattgagaggaccaaagaagaacaaggtttggtggttccttcatgggcacctcaagttcaagttcttgctcataaagcaactggtgggtttttaactcactgtggatggaattccacacttgagagtataatgaatggtgtaccactcatagtgtggccactgtttgctgagcaaagaatgaatgcagttacgctaactgatgacctaaaagtggcactaaggccaaaagctaacgaaaatggtttggtgggaagagaggaagttgctaaggttgtaagaaaactaattaagggtgaagaaggcagagaaattggtggaagaatgcagaaattgaagaatgctgctgctgaagcacttgaagaagaaggttcatctacaaagactctaattcagtttgcagataatttgattggcaactag

SEQ ID NO: 89038 - DNA, 1347 bp, Glycine max
  Peptide Sequence Number=SeqID_205816
atggcaaaaacaactcacatagctattgtttcaggtcctggtttcagccacctagtccctatagttgagttcagcaagctacttatcaagcttcacccaaattttcatgtcaactgcatcattccctcatttgggtcacccccagaatcctccaaagcctaccttaagactcttccttcaaacatagacaccatcttacttcctcccattaacaaacaacaattaccccaaggagtaaaccctgcagtcactattactctttctctgccatcaatacatgaggccctgaaatccttgtcctctaaatttcctttaacagcgttggttgcagatacttttgcatttccaaccttggaattcgcaaaggagttcaacgcactatcctatttttacaccccttgttcagccatggtactgtcactggctctacacatgccaaaacttgatgaggaagtttcaggtgagtacaaggacctaacagaacctataaagttacaaggttgtgtaccaattttgggggttgatcttccagcttcaacccaaagtagatcaagcgaagcttacaagtcttttcttgaacgtaccaaagcaatagctaccgcagatgggataattatcaacaccttcttagaaatggaatcaggtgctataagagcattggaagagtatgaaaatgggaagatcagactgtacccagttggacccattacgcaaaaagggtcaagagatgaggttgatgagtctgtgttgtatgtttcttttggaagtggtggaacactctctcagaaccaaatcaatgagttagcctcgggtttggaattgagtggtcaaaggttcttgtgggttttgagagcaccaagtaattcagttaatgctgcttaccttgaggctgaaaaggaggaccctttgaaatttttaccaagtgggtttttagaaaggacaaaggagaaaggtttggttgtgccatcatgggcacctcaggttcaggttcttagtcacaattcagttggagggttcctaagccattgtggttggaactcaactctggagagtgtgcaagagggagtgcctataataacatggccactctttgttgagcagagaatgaatgcagttatgttaaccgatggactaaaagtgacgttgaggccaaaatttaacgaggatggcatagtagagaaggaggaaattgcgaaggtgataaagtgtctgatggaaggggaagaaggtaaaggaatacgtgaaagaatgatgagtttaaaagatttctctgctagtgcactgaaagatggctcttcaacacaaaccctgtctcaattggctcgtcactgggaaaattcgagtgag

SEQ ID NO: 89039 - DNA, 1428 bp, Glycine max
  Peptide Sequence Number=SeqID_205817
atggcaaaaacaactcacatagctattgtttcaagtcctggtttcagccacttggtccctataattgagttcactaagcgacttgttaagcttcacccaaattttcatgtcacatgcatcgttccctcacttgggtcaaccccagaatcctccaaggcctaccttaaaactcttccttcaaacatagactccatttttctccctccaattagcaaggaaaatgtaccccaaggagcatacgctggactcctaattcaactcactattaccctttctctgccatcaatatatgaggccctgaaatccttgtcctctaaatttcctttaacagcgttggttgcagatacttttgcatttccaaccttggaattcgcaaaggagttcaacgcactatcctatttttacaccccttgttcagccatggtactgtcactggctctacacatgtcaaaacttgatgaggaagtttcaggtgagtacaaggacctaacagaacctataaagttacaaggttgtgtaccactcttgggggttgatcttccagctccaactcaaaatcgatcaagtgaagcttataagtcttttcttgaacgtgcaaaagcaatagctaccgcagatgggataattatcaacaccttcttagaaatggaatcaggtgctataagagcattggaagagtatgaaaatgggaagatcagactgtacccagttggacccattacacaaaaagggtcaagagatgaggttgatgagtctggtaagtgtttgagttggttggacaagcagccaccttgttcagtgttgtatgtttcttttggaagtggtggaacactctctcagaaccaaatcaatgagttagcctcgggtttggaattgagtggtcaaaggttcttgtgggttttgagagcaccaagtaattcagttaatgctgcttaccttgaggctgaaaaggaggaccctttgaaatttttaccaagtgggtttttagaaaggacaaaggagaaaggtttggttgtgccatcatgggcacctcaggttcaggttcttagtcacaattcagttggagggttcctgagccattgtggttggaactcgacattggagagtgtgcaagagggagtgcctataataacatggccactctttgctgagcagagaatgaatgcagttatgttaaccgatggacttaaagtggcgttgaggacaaaatttaacgaggatggcatagtggagaaggaggaaattgcgagggtgataaagtgtctgatggaaggggaagaaggtaaaggaatgcgtgaaagaatgatgaatttaaaagatttctctgctaatgcactgaaagatggctcttcaacacaaaccctatctcaattggctcgtcactgggaaaattcgagtcaggtttcgggagatgtagggtatcgttga

SEQ ID NO: 89040 - DNA, 462 bp, Glycine max
  Peptide Sequence Number=SeqID_205818
atgggcagttttccgctgctgggttcggacatcgacggcgtgctgccggtggactacctggcgggggtcatcgcccgggtcatgacccgcgaccaggatcgcatcggccaggactacgacttcgccaacccgcaggcgcctggcttcaacagcctggtgcggcacatccgcggcgccggcgcgcaggtcggcagcctgccgttcgagcagtggcgggaggaagccctggcgtatgcgcaggccaaccccaggagcgccatcgcgcgcatcgcggcggtgctggacggcctgggcgtgcagagcgacctggagcagatgttcgactgcttcccggtgggccggcaggtgttcggcggcgaggtctatccctgcccgccggtcgatgcccggcacgtccggccgtatgtggaacgcatcttggccgccgcgccggctgccgcgcaagcgcaggagttgtcgccg

SEQ ID NO: 89041 - DNA, 728 bp, Glycine max
  Peptide Sequence Number=SeqID_205819
atgtattcgttctttcttcaacgaagcaaaacgcttcatgtagctgatggaatcttggttaatagcttcaaagagattgaagcagggccaataagagcattgagagaggaaggaagtgggtggttggagaaacaggtacctaattctgttctttatgttagctttggaagtggagggacactttcacaagaccaattcaatgaactagctttggggttggagctaagtggtaagaaattcttgtgggttgtgagagcaccaagtgaatcacaaaattctgttcaccttggttgtgaaagtgataaccctttacggttcttacccgaacggttcattgagaggaccaagggcaaggaacacggtttggtggctccttcatgggcacctcaagttcaagttctttctcataatgtaactggtgggtttttaactcactttggatggaactctacccttgagagtattgtgaatggtgtgcctctaatagcgtggcctttgtatgctgagcagggaatgaatgcggttatgttaactaatgacctaaaagtggcactaaggccgaaggataatgaaaagggtttggtggaaagagagcaagttgctaaggttataaggagactaatggaggatcaagaaggaagggaaatcggtgagagaatgcaaaattcgaaaaatgctgctgctgaaacccagcaagaagaaggatcatctacaaaaactttgattca

SEQ ID NO: 89042 - DNA, 276 bp, Glycine max
  Peptide Sequence Number=SeqID_205820
ctgggttgcttccacaacccagcttgcctgggcgagctgggcggcaacctcctccccctttttcctataaataggctgaagggggctgttctatggatcccggatgcccctgaaaatccaagtcgaggtgcttctgtaacgcttccgagaggtttccgtaagcaaattcgtgaaggttttcctccgttattcaccgttcttcatccgttcttcgttcttcaacggtattcgttaatttctgttaaactgaattccgaccgttcggtcgtgccgtaa

SEQ ID NO: 89043 - DNA, 426 bp, Glycine max
  Peptide Sequence Number=SeqID_205821
atgcagcccaatcgggcggtaaatcccgtcccaaggctaaatactggcgagagaccgatagcgaacaaggaagcggatgggggccggcgatgtgtcccggtcggatgtggaaacggtgaagagccggtccgccgatcgactcgggacattgaaccgacgcggattgcgatggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtgggttgcaccgccgaccgaccctga

SEQ ID NO: 89044 - DNA, 2226 bp, Glycine max
  Peptide Sequence Number=SeqID_205822
atgatcaagtctgcccgcgatacaggaggagacgtgacccctgcggttaatgagaacagcaccctgccgtcgctaagtggcggactttacgccttcttttttgatgttgacggcacgctggccgcgcttcagtcgcagcccgagtcggtttccatccccgcatcggtgcgccagcatctgcaacaaatttctaatttaagtcacggcgcgctggcgctggtttccggccgtccgatcagccagctggatgagctggtcgcgccgctgcaagccccggcagcgggcgtgcacggcgctgagcgccgcgatgccagcggacatctgcaccgtcagtcgctgcccgatgaggtggcgcaaacgctgcaggttgaactacagcagacccttgaccagtggcccggtacgctgctggaagtaaaaggcatggcctttgcgctgcactaccgcaacgcgccagagtatgaaaacgccatcatgcagctggccgaagaggcggtaacccgctttccggcactggcgctgcagccaggtaaatgtgtggtggaactgaaaccgcagggcatcgataaaggtgctgcggtacgcgaatttatgcaggaagcgccatttaccggtcgcattccggtatttgtgggcgacgatctgaccgatgagaaaggctttcttgcagtcaatgccatgcacggcatctcggtcaaggtcggtgaaggtccaagccaggcgcgctatcgtctgcccgatgtggcagcggtctggcactggctggaacaactattattacaactagaacatgacaacgtcgtcgtcgtatctaaccgtatcgctattcctgatggaagcaaaaccaacgcaggcggtctcgccgtcggcattctggatgcgctgcagaccaccggaggattgtggtttggctggaacggagagatcagtgagttttccggtgaagaagatgaggaacttacccagatcgaacaagacggcattacctatgcctcattccccctcaatcaaaacgattacgatcagtactactgccagttttctaacacggtgatctggcccgcgttccactatcgcctcgatctggtgcagtaccagcgtgaagcctgggaaggctactgccgcgtgaataccctgctggcgcagcggctgaaaccgctgatcaagccggacgatatcctgtggatccacgattaccacctgctgccgtttgccgctgaactgcgtaaacagggcatcaataaccgaatcggattctttctgcatatcccgttcccgacgccggaaattttcaatgcgctgccgccgcatcaggaactgctggaaatgctgtgtgaatacgatctgctgggtttccagacagaatccgatcgcgtggcgtttctcgacagcctgagccagctgacgcagctgcagaataaaggcgagaagaagcatcgcgcctttggcaacacctttatgaccgaggtttaccccatcggaatcgagccggacagcattaaagagatggcagaagggccgctgccaccgaagatggccgcgatgaagcgtgagctgggcgatttgcagaatattatcgcctgtgagcgtctcgactattccaaaggcttgccggagcgtttccttgcctatgaagcgctgctggaaaacttcccgcagcaccgcggcaaaatccgctactcacagattgcgccgacctcgcgcggcgacgtgcaggcctatcaggatattcgtcaccagctggagacggaagcggggcgcattaacggtaaatacggcacgctgggctggacgccgctctattatctcaaccagcattttgaccgccgtctgctgatgaagattttccgcctgaccgacgtggggctggttacgccgctgcgtgacggcatgaacctggtggcgaaagagtatgtcgcggcgcaggatccggacgatccgggcgtgctggtgctgtcgcgctttgccggagcggccaacgagctgacttctgcgctgatcgttaacccgtacgatcgtgatgatgtggcggcggcgctggaccgcgcgctgaccatgccgcgcaccgagcgtatctcgcgctataacgacatgatggccgtactgcgtaagcaggacatttcgcactggcgcgaaagcttcctgaacgatctgaacacgctgccggcacgcagcgccagccacggtagcgataacaaggtcgcgacgtttcagaagctggcgtaa

SEQ ID NO: 89045 - DNA, 1032 bp, Glycine max
  Peptide Sequence Number=SeqID_205823
atgaagcacggtaatcgcccgattgtgctggtcaaacggcgcaaacataaaaagcatgaaggcagccatggctcatggaagattgcctatgccgactttatgacggcgatgatggcgttcttcatggtgatgtggctgatctcgatcgccaatccgcaggagctggtgcagattgccgaatattttaaaacgccgctcaaggtcgccctgaccggcggtcagcgtagcagcgacagcgaaagtccgattcccggcggcggcgatgatccgacgcagaagaaaggcgaagtgcaaaaacaggtcgatatggatgcgcaaaagcgccagctggatgacattcgcctgaaccggctgcgtgaaaaactcgaccagctgattgaggccgatccgcgcctgaaagcgctgcgtccgcatctgatcatcaacatggtggaagaggggctgcgcattcagattatcgatagccagaaccgcccgatgtttaaaaccggcagcgcggaagtggagccgtacatgcgcgatatcctgcgcgccattgcgccgctgctgaatgatattcctaacaaaatcagtttgtccggccataccgatgacttccagtacgccagcggcgatcgcggctacagcaactgggaactgtcggcggatcgtgccaatgcctcacgccgtgagctggtggcgggcgggctggacggcggcaaaatgctgcgcgtggtcggcatggccgacaccatgaaactgaaaaaccgcggcgccaacgacgcggtgaaccgtcgtatcagcctgctggtgttgaaccatgacaccgaagcggcgattgaaaaagagaatgccgagagcgatgccgttcaggtgagtgacccggcgcagattttacctagcattaccgcaccggctggtccggcggcgccaactgcccccacgggttctaccgcagcaccggccacaccggcagccgcggcgaatccgccggcagcggcaccgcccgccgccagcgcggtgacaccagaccaaccctcacagccgaggtga

SEQ ID NO: 89046 - DNA, 189 bp, Glycine max
  Peptide Sequence Number=SeqID_205824
atgggtttctccgcttcccgcgcggcatgcgcactggtttttctcgcctctacagtgatttctccctcggtgcttgcgcatgcgcatcttcaacagactatcccgggggcagacagtcaggtgagcgcaccgcagagcctgacgctgaatttctcggagggtatcgaacccggttttagcggtgtagtg

SEQ ID NO: 89047 - DNA, 563 bp, Glycine max
  misc_feature (61)..(61): n is a, c, g, or t
  Peptide Sequence Number=SeqID_205825
gatataattattgggattacattgacgcctggaccaatgtgttctggcatcaaaatagtanattcaagcatccatggctaatttacttcaaaaataacaccgtgtataattttccaaattggttcctccaatggtggaactacttcggaccaattccacagatatttccagaagaagtccaacagggattccaacaattcagcaagctcttcaacaacaaggaatcaagaattccgacagacttaaaatacttttccagtttttccttgtcatggattttttcatggcaatacagatatggaaaaaccgaaaatagcaagcagtatccaccattgcagagacacacctttgtaaagtggtggtcacaattcgatacctcaaaggctgctccagaacaagtcaagaactggtttcagagcaaccctgagtttctcaaacctgctgatccagagacatctttgtttctgaatcagaagtctcaacttgtagcatttttggcaagctcaaaatctaaagaaagtcttactcagaatcttaaggaagttctccaactacttcaatag

SEQ ID NO: 89048 - DNA, 264 bp, Glycine max
  Peptide Sequence Number=SeqID_205826
atgacgatagatgaagctctagcaaatgatgactggatcattgcaatggaaaaagaactccaccagttcactagaaacaatgtttggacacttgttcccaaactcgagaatgaaagcattattggaacaaggtgggtttttagaaataaactggatgaacaagcagaatggagaagaagaagagttgagaggagatgccacttcaaggagaagatgagtcaagaagaagctcaccaccataggaagccatggataagagcttga

SEQ ID NO: 89049 - DNA, 165 bp, Glycine max
  Peptide Sequence Number=SeqID_205827
caagctcaaaatctaaagagagtcttgctcagaatctcaaagaagttctccaactacttcaacaggaagtggaagaagaaccttccaagaaggaagctgaatcatccgagactaatgatgaccaagaagatgattcattctaccagaatgaagatgactgttttg

SEQ ID NO: 89050 - DNA, 1203 bp, Glycine max
  Peptide Sequence Number=SeqID_205828
atgttggggatgaacattgatggttatgtggtgaatgacgtaggggatgattttgctgacacgtactttcggcttcaatggacacgctacgccctcataaatgcactgttccgccatgcaaaggggcaagccaaggccaaaccgcattcctatacggtgcacttacccacattgctttgggcaccggaggaatcaagccctgtgtgtcctccttcggtgctgaccaatttgacgagggagatgagaaagatagtgcagatgaagttctctttcttaaactggttcttcttcgccatcaacatgggtgccatccttggaatcacaccattggtttacatacaagacgccgctgggtttggttggggttttggaatacacgcagccgccgccatttgttccatcgttatcctacttgctggtctccgatattaccgtttcaaaatgccaatgggaagccctttcactaggtttcttcaggttatggtagcctccacgatgaatcatctaaatagggttcatttagaaaatgaccaaactcgtctctacgaggtcgaaaccactcgcaagcttcctcacaccccacaatacagaacgagaaagacgagcaatcgatggcgcatatgtacggtgacgcaagtagaagagttcaaatccttcattcgagtccttcctgtgtgggcttccaccattgctctctccgtgtcctacgctcagctctcaaccttcttcctaagccaagccaacatcatggacagaacactcggtacccacttcaaaatccccgcaggttctgtccccgtgttcagcgccatcacactcatcctcgtacccatctacgagaaattcattgtcccctccctccgcaacatcatcggccaccaccgaggcgtcacgtcgttgcagcgaatgggcgtaggtttattcgtcttgatcttcgccatggcctcggcagcgttggtggaaaggaaaagacgggaccacaagtcattaaagatgagtgtgttctggttgctccctcagtttttcctaatgggtgctgctgagattttgacggctatcaatgacgtcaatttcttggtttatttggtggtggcttattgccacagagggaaaggagcactggtgatggatgaggccatggttgaattcactgagtctaactcagccaaccacgaaggggaattaccaagtacctttttctga

SEQ ID NO: 89051 - DNA, 1788 bp, Glycine max
  Peptide Sequence Number=SeqID_205829
atgacgatgatttctctccgccgcgccggattactgctgctggcttgcctgctggccgcctgcagcagcaacagtccggcgccggttgcacgctacaatctcgactttcaggcgcatccgcagatcaacgcgggtgcgccgctcaaagtccgggtgatgttgctgacctccgatgcggaattcatgtccgctgatttctactccctgcagaaccagcccgccaccgcgttgggcagcacgctgctcaacaatcagcagttcttcctgatgtcaggtcagctgagtaaaaccctcagcgcgaaaagcctgccggaagcgcgcttcatcggcatcatggccgagtatcaggcgctggacggtaaagtctggcgcctcgcgctgcccttcccggatggcgacgacagcgcattctggcagttctggaaaaataacgatgtaaggatgcctatgaaccgagccgaaaaggttgtctggaccgaggggatgttcctgcgccctcaccatttccagcagtcggaaaattttctacacagcaccctgcgcgagtgggggcagtcgcagcgcgcctacacctggggtttttttgatctcgaatttgatgaagcgctgctgcgccagggaaaactggcgctgagtgccgccagcggatgtctgcctgacggcacctttttctctttcagccagccacagcacggtccggccccgctggatctgccggcgaatgtcgatcgcagcaaagtggtactggcgatcccggcccggcgcaacgggcgtgaagcggtggcgtttcaggagacacaggattcactggcgcgctatctggcgtgggaagccgaagtcgaagatgacaatgctcaggcggtcggcgctgccaccgttcagttcggcaaactgcgcctgcgcctgatgctggaacaggatctcaccgcggagtggacggcgatgggcgtggcgcaggtgattgaaaaacgcagcgataaccacgtgcgcctcgacaccgattacattccgccgatgctgacgctcaacgccagccggccgctgcaaagcatgctcaatgacctgcacggcctgattcagcagcgcagccagcagctgagccagcgcacgccgggtaccggccgttttaacagtgccgacatggtcgattttatgctgctgaccttgctcaaccgtcagcttggcctgcacgcgcacttacaggatctgccgctgctgcacccggaaacgctctacagtcactggctgcagctggccgctgaattgagcagctggatgccggcgcgcaccccggacgcgctgccgctgtatgaccatgacgatctgtacagctgctttgcccgcttaacgctgctgctgcgccagggactgtcgcaggtgatggaagagagcgccatccagctgccgctgacgcagcgctcgcacggcctcaacgtggccacggtgccggaaagcagtatggtacgcgagttcggctttgtgctggcggtcaaagccagcgtgccagccgaagcgctgaaaacccacttcccggcgcagatgaaagtcgcgcccgtcaccaaaatccgcgatctggtgcagctgcagctgccgggactggcgctgaaagccatgccgggcgcgccgccgcaaatcccgtggcatgccggctacagctatttcgagctcgataagaacagcgagctgtggcaggagatggagcgctcaggtgcctttgcgctgcatctggccggtgagtttccgggcctgaacatggagttctgggccattcgtagtcagtcagaataa

SEQ ID NO: 89052 - DNA, 360 bp, Glycine max
  Peptide Sequence Number=SeqID_205830
atgctcaagggcaaggtaaaaattgccatcatcaccaacggttttacagcgctgcagcaggcgcgccttgaacgcaccggtttccatgactactttgacgcgctggtgatctccgaacaggtgggcgtacccaagccggacgcggcgatttttgaccatacgctgcagctgctgggcaatcccgatcgccgccgggtattaatggtcggcgacacgccggaatcggatattcttggtggtatgaatgccggcgttaaaacctgctggatcgatcacggcacgcgtccgctgccagcgcacatcacgcccacctggcaggtgaaaaccttgcctgagctgcaatctattctgactgcttaa

SEQ ID NO: 89053 - DNA, 555 bp, Glycine max
  Peptide Sequence Number=SeqID_205831
atgcataatttcaaagttgttaagaatgatggccaatttagagtgtgcgaacatgagtacaagttattttttattggagtgacagttgttagagaagctgatttgcatgaactgccttttaaggaatttagatttgttgaatttgcaaatgttgttgctggcaattttgtgtctggcctattggttgatattattggggtcgttgatcaggtggtctttcggcatgtttcatcgaaaaataccagggttgtttttagaatgaaggatttgagtggtgaaattttgtcttgcacactttgggagaattactgtactcagttcctatcctatttgaatgaacctggggatgatgggtcgatggttattatattgacacatgccagaataaaagatgcacagggaagttatccagcttcagtgagcaattccttcaaggcgtcaaaactattgattaatgatcctatattggaaattcaggaatttaaagagaggcttttagatttaggtgttgaggtgagtcgagttttgctacctggcgatcaagcaagctcataa
